United States Patent 7,745,391 (HUMAN THROMBOSPONDIN POLYPEPTIDE) - sequence listing, part 17

SEQ ID NO: 41504 - DNA, 2858 bp, Homo sapiens
gcggccactcggggactgtcccttgctccaggcgctcactttgcgggcggcactttttccaggttgttaatccagctaatggagaaggatagatgcacgctacttggtttagaaaaaaaaacaaaaatgagcaaacgagacgccccttccgttttatgataactaagctgcagggaaataaatcggctggccctactgcaatctactgcactcgagtgacaagtgagcctgcttctgtcaattactgaagctataaggagattttttaaaaattaaacttcaacacaatgagaacctggaacagtggtggcacaaagtgttgccacatctgcaaacttcctgggagagtaatggggattcgagtgcttcgattatctttggtggtcatcctcgtattattactggtagctggtgctttgactgccttacttcccagtgttaaagaagacaagatgctcatgttgcgtagggaaataaaatcccagggcaagtccaccatggactcctttactctcataatgcagacgtacaacagaacagatctcttattgaaacttttaaatcattatcaggctgtaccaaatctgcacaaagtgattgtggtatggaacaatattggagagaaggcaccagatgaattatggaattctctagggccccaccctatccctgtgatcttcaaacaacagacagcaaacaggatgagaaatcgactccaggtctttcctgaactggaaaccaatgcagtgttgatggtagatgatgacacactcatcagcaccccagaccttgtttttgctttctcagtttggcagcaatttcctgatcaaattgtaggatttgttcctagaaagcacgtctctacttcatcaggtatctacagttatggaagttttgaaatgcaagcaccagggtctggaaatggtgaccagtactctatggtgctgattggagcctcattcttcaatagcaaatatcttgaattatttcagaggcaacctgcagctgtccatgctttgatagatgatactcaaaactgtgatgatattgccatgaattttatcattgccaagcatattggcaagacttcagggatatttgtgaagcctgtaaacatggacaatttggaaaaagaaaccaacagtggctattctggaatgtggcatcgagctgagcacgctctgcagaggtcttattgtataaataagcttgttaatatctatgatagcatgcccttaagatactccaacattatgatttcccagtttggttttccatatgccaactacaaaagaaaaatataaaagtaaaacaaacaaaaacaaacctgaaaactgcttggcatttgagtagcttctccatgctatgtatttttttaagcaacatcatgaattttatctactccagaagtctctacaatagaaaaaaaagtgcagtgcttctaggatataaaattcacattacttttgaaagccaagaagttggtcttatccagttaggtcttcttatgaagagttttcatccagggatataactccttggtcagtgattttattgtttacatcctgagactgttctacagtttctttgactcctggcatttgccttaaggacctatagcaagctgtttctaggatcagaaactcaagagaggcatttctctgctttttcactaaaggtcagttgttttaatttgaaacctgaaatgcctctttagcaaaagcctgtggtatggggtaaagccatgtaagaagagaatagtctcagtcacatatgaagaggaaaatttgcagctgccagtgctttccttgtggccctgccaaccagctcttccaggacgaactcagtccagcatggttttgatgtaaccatccatgcttttatttttgttaagtcttttgtgactgggacagttaattttagtagctgaagaacgtctagttgtttgcttgatatttgtgaacatttactgcatggatcacaaaacaatataccctgtatttcttacacgccacttatatgcagcaaggagtaaatgtgttactagattcgggtagtgcattttgtcactgaatctgaccttgagaatgtacattaattcttatattttacataatgtatgtgttgtttaagaaatgtataaaaaacctgaaaaaaatgagtaagaactggcagaagttaaaaccctttgtatcaaaagatctttattggtagagcactggttatcttctggatactaaaaagttgtattacaaagccaaacacttgcattcacaactttaaaaaaagatccaaggaactattcataatgatgaaattccaactacatacaaggaggagaaaataagaacccagtcataacagaggaattctataggagtctgcatcaattcattcttaaggttgcctactctctgttatgtgaattagcgtctgtgtttcacccattgtctgtgtttagtccttgttcaccactagggcaaggaattcttaactaggcctctgtttaccaacttctctttctcctcctttccctcttattcctccttctcctcttccttcttatataatgctagtatattctcaaaattgcaaagctgtgagaatattaaaataatcatggctaatgttccaataatgaggtctttgtgcatttagttccgcatatgatggttttttttttacattaaagagtatatgtgtcttaatgcagtcagattgtaaaaaacaaaaacaaagaaactaagaatcttactaaaaatcgataatgtcagttatctgttttgtccaatattggtagtacttttttgcctcttatgattcctctagcagataaataaaagaaacttttgccatcc

SEQ ID NO: 41505 - DNA, 2758 bp, Homo sapiens
gcggccactcggggactgtcccttgctccaggcgctcactttgcgggcggcactttttccaggttgttaatccagctaatggagaaggatagatgcacgctacttggtttagaaaaaaaaacaaaaatgagcaaacgagacgccccttccgttttatgataactaagctgcagggaaataaatcggctggccctactgcaatctactgcactcgaggtgttgccacatctgcaaacttcctgggagagtaatggggattcgagtgcttcgattatctttggtggtcatcctcgtattattactggtagctggtgctttgactgccttacttcccagtgttaaagaagacaagatgctcatgttgcgtagggaaataaaatcccagggcaagtccaccatggactcctttactctcataatgcagacgtacaacagaacagatctcttattgaaacttttaaatcattatcaggctgtaccaaatctgcacaaagtgattgtggtatggaacaatattggagagaaggcaccagatgaattatggaattctctagggccccaccctatccctgtgatcttcaaacaacagacagcaaacaggatgagaaatcgactccaggtctttcctgaactggaaaccaatgcagtgttgatggtagatgatgacacactcatcagcaccccagaccttgtttttgctttctcagtttggcagcaatttcctgatcaaattgtaggatttgttcctagaaagcacgtctctacttcatcaggtatctacagttatggaagttttgaaatgcaagcaccagggtctggaaatggtgaccagtactctatggtgctgattggagcctcattcttcaatagcaaatatcttgaattatttcagaggcaacctgcagctgtccatgctttgatagatgatactcaaaactgtgatgatattgccatgaattttatcattgccaagcatattggcaagacttcagggatatttgtgaagcctgtaaacatggacaatttggaaaaagaaaccaacagtggctattctggaatgtggcatcgagctgagcacgctctgcagaggtcttattgtataaataagcttgttaatatctatgatagcatgcccttaagatactccaacattatgatttcccagtttggttttccatatgccaactacaaaagaaaaatataaaagtaaaacaaacaaaaacaaacctgaaaactgcttggcatttgagtagcttctccatgctatgtatttttttaagcaacatcatgaattttatctactccagaagtctctacaatagaaaaaaaagtgcagtgcttctaggatataaaattcacattacttttgaaagccaagaagttggtcttatccagttaggtcttcttatgaagagttttcatccagggatataactccttggtcagtgattttattgtttacatcctgagactgttctacagtttctttgactcctggcatttgccttaaggacctatagcaagctgtttctaggatcagaaactcaagagaggcatttctctgctttttcactaaaggtcagttgttttaatttgaaacctgaaatgcctctttagcaaaagcctgtggtatggggtaaagccatgtaagaagagaatagtctcagtcacatatgaagaggaaaatttgcagctgccagtgctttccttgtggccctgccaaccagctcttccaggacgaactcagtccagcatggttttgatgtaaccatccatgcttttatttttgttaagtcttttgtgactgggacagttaattttagtagctgaagaacgtctagttgtttgcttgatatttgtgaacatttactgcatggatcacaaaacaatataccctgtatttcttacacgccacttatatgcagcaaggagtaaatgtgttactagattcgggtagtgcattttgtcactgaatctgaccttgagaatgtacattaattcttatattttacataatgtatgtgttgtttaagaaatgtataaaaaacctgaaaaaaatgagtaagaactggcagaagttaaaaccctttgtatcaaaagatctttattggtagagcactggttatcttctggatactaaaaagttgtattacaaagccaaacacttgcattcacaactttaaaaaaagatccaaggaactattcataatgatgaaattccaactacatacaaggaggagaaaataagaacccagtcataacagaggaattctataggagtctgcatcaattcattcttaaggttgcctactctctgttatgtgaattagcgtctgtgtttcacccattgtctgtgtttagtccttgttcaccactagggcaaggaattcttaactaggcctctgtttaccaacttctctttctcctcctttccctcttattcctccttctcctcttccttcttatataatgctagtatattctcaaaattgcaaagctgtgagaatattaaaataatcatggctaatgttccaataatgaggtctttgtgcatttagttccgcatatgatggttttttttttacattaaagagtatatgtgtcttaatgcagtcagattgtaaaaaacaaaaacaaagaaactaagaatcttactaaaaatcgataatgtcagttatctgttttgtccaatattggtagtacttttttgcctcttatgattcctctagcagataaataaaagaaacttttgccatcc

SEQ ID NO: 41506 - DNA, 2350 bp, Homo sapiens
gaaggattggactctttggtgactggaatttgttaatgtcagataatgtttgaattaggagaacatttgtaagggtagaatatttgttttcagagatgtttgggttgtgatgccatttgacctgtaaacatatcagaacacagatttatgaagttacctggagctagataaaactgaaatgtagaaaccaggaataaggaagagttgacaaatcagtttcattctctctgtaataaatcattgcctttttcactatgtcttctctaaaaatatgtgacattttattgttctttttccctcttttcagcaatttcctgatcaaattgtaggatttgttcctagaaagcacgtctctacttcatcaggtatctacagttatggaagttttgaaatgcaagcaccagggtctggaaatggtgaccagtactctatggtgctgattggagcctcattcttcaatagcaaatatcttgaattatttcagaggcaacctgcagctgtccatgctttgatagatgatactcaaaactgtgatgatattgccatgaattttatcattgccaagcatattggcaagacttcagggatatttgtgaagcctgtaaacatggacaatttggaaaaagaaaccaacagtggctattctggaatgtggcatcgagctgagcacgctctgcagaggtcttattgtataaataagcttgttaatatctatgatagcatgcccttaagatactccaacattatgatttcccagtttggttttccatatgccaactacaaaagaaaaatataaaagtaaaacaaacaaaaacaaacctgaaaactgcttggcatttgagtagcttctccatgctatgtatttttttaagcaacatcatgaattttatctactccagaagtctctacaatagaaaaaaaagtgcagtgcttctaggatataaaattcacattacttttgaaagccaagaagttggtcttatccagttaggtcttcttatgaagagttttcatccagggatataactccttggtcagtgattttattgtttacatcctgagactgttctacagtttctttgactcctggcatttgccttaaggacctatagcaagctgtttctaggatcagaaactcaagagaggcatttctctgctttttcactaaaggtcagttgttttaatttgaaacctgaaatgcctctttagcaaaagcctgtggtatggggtaaagccatgtaagaagagaatagtctcagtcacatatgaagaggaaaatttgcagctgccagtgctttccttgtggccctgccaaccagctcttccaggacgaactcagtccagcatggttttgatgtaaccatccatgcttttatttttgttaagtcttttgtgactgggacagttaattttagtagctgaagaacgtctagttgtttgcttgatatttgtgaacatttactgcatggatcacaaaacaatataccctgtatttcttacacgccacttatatgcagcaaggagtaaatgtgttactagattcgggtagtgcattttgtcactgaatctgaccttgagaatgtacattaattcttatattttacataatgtatgtgttgtttaagaaatgtataaaaaacctgaaaaaaatgagtaagaactggcagaagttaaaaccctttgtatcaaaagatctttattggtagagcactggttatcttctggatactaaaaagttgtattacaaagccaaacacttgcattcacaactttaaaaaaagatccaaggaactattcataatgatgaaattccaactacatacaaggaggagaaaataagaacccagtcataacagaggaattctataggagtctgcatcaattcattcttaaggttgcctactctctgttatgtgaattagcgtctgtgtttcacccattgtctgtgtttagtccttgttcaccactagggcaaggaattcttaactaggcctctgtttaccaacttctctttctcctcctttccctcttattcctccttctcctcttccttcttatataatgctagtatattctcaaaattgcaaagctgtgagaatattaaaataatcatggctaatgttccaataatgaggtctttgtgcatttagttccgcatatgatggttttttttttacattaaagagtatatgtgtcttaatgcagtcagattgtaaaaaacaaaaacaaagaaactaagaatcttactaaaaatcgataatgtcagttatctgttttgtccaatattggtagtacttttttgcctcttatgattcctctagcagataaataaaagaaacttttgccatcc

SEQ ID NO: 41507 - DNA, 450 bp, Homo sapiens
cgacaggaagtggagcgtcaccgaaagggaggggcggccactcggggactgtcccttgctccaggcgctcactttgcgggcggcactttttccaggttgttaatccagctaatggagaaggatagatgcacgctacttggtttagaaaaaaaaacaaaaatgagcaaacgagacgccccttccgttttatgataactaagctgcagggaaataaatcggctggccctactgcaatctactgcactcgaggtaaggagacacagcaaaatgctccagtattagtatttttctttttgtagtgaggatatatgcatgttttgctctcgttctgagaactttgtgtgtgtgtatggagtattcggtggttttatttttgaaaatatgtacttattctacaattttgaaaaatgttaattaaaactgctgtgtaaaaacagctaggtttcagaa

SEQ ID NO: 41508 - DNA, 374 bp, Homo sapiens
gcgtagggaaataaaatcccagggcaagtccaccatggactcctttactctcataatgcagacgtacaacagaacagatctcttattgaaacttttaaatcattatcaggctgtaccaaatctgcacaaagtgattgtggtatggaacaatattggagagaaggcaccagatgaattatggaattctctagggccccaccctatccctgtgatcttcaaacaacagacagcaaacaggatgagaaatcgactccaggtctttcctgaactggaaaccaatggtgagttgcagtgtagttctcagcctggaaaggctgccgctgtccagagctgggacagacatgtgaatttctggccttctgcttaaccgtctg

SEQ ID NO: 41509 - DNA, 2834 bp, Homo sapiens
gcggccactcggggactgtcccttgctccaggcgctcactttgcgggcggcactttttccaggttgttaatccagctaatggagaaggatagatgcacgctacttggtttagaaaaaaaaacaaaaatgagcaaacgagacgccccttccgttttatgataactaagctgcagggaaataaatcggctggccctactgcaatctactgcactcgagtgacaagtgagcctgcttctgtcaattactgaagctataaggagattttttaaaaattaaacttcaacacaatgaggtgttgccacatctgcaaacttcctgggagagtaatggggattcgagtgcttcgattatctttggtggtcatcctcgtattattactggtagctggtgctttgactgccttacttcccagtgttaaagaagacaagatgctcatgttgcgtagggaaataaaatcccagggcaagtccaccatggactcctttactctcataatgcagacgtacaacagaacagatctcttattgaaacttttaaatcattatcaggctgtaccaaatctgcacaaagtgattgtggtatggaacaatattggagagaaggcaccagatgaattatggaattctctagggccccaccctatccctgtgatcttcaaacaacagacagcaaacaggatgagaaatcgactccaggtctttcctgaactggaaaccaatgcagtgttgatggtagatgatgacacactcatcagcaccccagaccttgtttttgctttctcagtttggcagcaatttcctgatcaaattgtaggatttgttcctagaaagcacgtctctacttcatcaggtatctacagttatggaagttttgaaatgcaagcaccagggtctggaaatggtgaccagtactctatggtgctgattggagcctcattcttcaatagcaaatatcttgaattatttcagaggcaacctgcagctgtccatgctttgatagatgatactcaaaactgtgatgatattgccatgaattttatcattgccaagcatattggcaagacttcagggatatttgtgaagcctgtaaacatggacaatttggaaaaagaaaccaacagtggctattctggaatgtggcatcgagctgagcacgctctgcagaggtcttattgtataaataagcttgttaatatctatgatagcatgcccttaagatactccaacattatgatttcccagtttggttttccatatgccaactacaaaagaaaaatataaaagtaaaacaaacaaaaacaaacctgaaaactgcttggcatttgagtagcttctccatgctatgtatttttttaagcaacatcatgaattttatctactccagaagtctctacaatagaaaaaaaagtgcagtgcttctaggatataaaattcacattacttttgaaagccaagaagttggtcttatccagttaggtcttcttatgaagagttttcatccagggatataactccttggtcagtgattttattgtttacatcctgagactgttctacagtttctttgactcctggcatttgccttaaggacctatagcaagctgtttctaggatcagaaactcaagagaggcatttctctgctttttcactaaaggtcagttgttttaatttgaaacctgaaatgcctctttagcaaaagcctgtggtatggggtaaagccatgtaagaagagaatagtctcagtcacatatgaagaggaaaatttgcagctgccagtgctttccttgtggccctgccaaccagctcttccaggacgaactcagtccagcatggttttgatgtaaccatccatgcttttatttttgttaagtcttttgtgactgggacagttaattttagtagctgaagaacgtctagttgtttgcttgatatttgtgaacatttactgcatggatcacaaaacaatataccctgtatttcttacacgccacttatatgcagcaaggagtaaatgtgttactagattcgggtagtgcattttgtcactgaatctgaccttgagaatgtacattaattcttatattttacataatgtatgtgttgtttaagaaatgtataaaaaacctgaaaaaaatgagtaagaactggcagaagttaaaaccctttgtatcaaaagatctttattggtagagcactggttatcttctggatactaaaaagttgtattacaaagccaaacacttgcattcacaactttaaaaaaagatccaaggaactattcataatgatgaaattccaactacatacaaggaggagaaaataagaacccagtcataacagaggaattctataggagtctgcatcaattcattcttaaggttgcctactctctgttatgtgaattagcgtctgtgtttcacccattgtctgtgtttagtccttgttcaccactagggcaaggaattcttaactaggcctctgtttaccaacttctctttctcctcctttccctcttattcctccttctcctcttccttcttatataatgctagtatattctcaaaattgcaaagctgtgagaatattaaaataatcatggctaatgttccaataatgaggtctttgtgcatttagttccgcatatgatggttttttttttacattaaagagtatatgtgtcttaatgcagtcagattgtaaaaaacaaaaacaaagaaactaagaatcttactaaaaatcgataatgtcagttatctgttttgtccaatattggtagtacttttttgcctcttatgattcctctagcagataaataaaagaaacttttgccatcc

SEQ ID NO: 41510 - DNA, 1119 bp, Homo sapiens
  misc_feature (1082)..(1082): n is a, c, g, or t
  misc_feature (1086)..(1086): n is a, c, g, or t
  misc_feature (1116)..(1116): n is a, c, g, or t
  misc_feature (1119)..(1119): n is a, c, g, or t
gcggccactcggggactgtcccttgctccaggcgctcactttgcgggcggcactttttccaggttgttaatccagctaatggagaaggatagatgcacgctacttggtttagaaaaaaaaacaaaaatgagcaaacgagacgccccttccgttttatgataactaagctgcagggaaataaatcggctggccctactgcaatctactgcactcgagtgacaagtgagcctgcttctgtcaattactgaagctataaggagattttttaaaaattaaacttcaacacaatgaggtgttgccacatctgcaaacttcctgggagagtaatggggattcgagtgcttcgattatctttggtggtcatcctcgtattattactggtagctggtgctttgactgccttacttcccagtgttaaagaagacaagatgctcatgttgcgtagggaaataaaatcccagggcaagtccaccatggactcctttactctcataatgcagacgtacaacagaacagatctcttattgaaacttttaaatcattatcaggctgtaccaaatctgcacaaagtgattgtggtatggaacaatattggagagaaggcaccagatgaattatggaattctctagggccccaccctatccctgtgatcttcaaacaacagacagcaaacaggatgagaaatcgactccaggtctttcctgaactggaaaccaatgcagtgttgatggtagatgatgacacactcatcagcaccccagaccttgtttttgctttctcagtttggcagcaatttcctgatcaaattgtaggatttgttcctagaaagcacgtctctacttcatcaggtatctacagttatggaagttttgaaatgcaagcaccagggtctggaaatggtgaccagtactctatggtgctgattggagcctcattcttcaatagcaaatatcttgaattatttcagaggcaacctgcagctgtccatgctttgatagatgatactcaaaactgtgatgatattgccatgaattttatcattttgcccaagccattatttgggcaaagaacttccaggggnatanttttgttgaaagccctggttaaacattggnacn

SEQ ID NO: 41511 - DNA, 407 bp, Homo sapiens
ggaaaaaaacatgaaaacacagggactcgtaagaatgctaacatttgtatgttgtttccatttctactccaggtgttgccacatctgcaaacttcctgggagagtaatggggattcgagtgcttcgattatctttggtggtcatcctcgtattattactggtagctggtgctttgactgccttacttcccagtgttaaagaagacaagatgctcatgttgcgtagggaaataaaatcccagggcaagtccaccatggactcctttactctcataatgcagacgtacaacagaacagatctcttattgaaacttttaaatcattatcaggctgtaccaaatctgcacaaagtgattgtggtatggaacaatattggagagaaggcaccagatgaattatggaattctc

SEQ ID NO: 41512 - DNA, 2501 bp, Homo sapiens
agctctccccaccaataaaaggaccagggaggatcagagagagcagaaggatcctgagcctcgcactctgccgcccgcaccaccttccgctgcctctcagactctgctcagcctcacacgatgtcgtgccgctcctacaggatcagctcaggatgcggggtcaccaggaacttcagctcctgctcagctgtggcccccaaaactggcaaccgctgctgcatcagcgccgccccctaccgaggggtgtcctgctaccgagggctgacgggcttcggcagccgcagcctctgcaacctgggctcctgcgggccccggatagctgtaggtggcttccgagccggctcctgcggacgcagcttcggctaccgctccgggggcgtgtgcggacccagccccccatgcatcactaccgtgtcggtcaacgagagcctcctcacgcccctcaacctggagatcgaccccaacgcacagtgcgtgaagcaggaggagaaggagcagatcaagtccctcaacagcaggttcgcggccttcatcgacaaggtgcgcttcctggagcagcagaacaagctgctggagaccaagtggcagttctaccagaaccagcgctgctgcgagagcaacctggagccactgttcagtggctacatcgagactctgcggcgggaggccgagtgcgtggaggccgacagcgggaggctggcctcagagctcaaccatgtgcaggaggtgctggagggctacaagaagaagtatgaagaggaggtggccctgagagccacagcagagaatgagtttgtcgttctaaagaaggacgtggactgtgcctacctgcggaaatcagacctggaggccaatgtggaggccctggtggaggagtctagcttcctgaggcgcctctatgaagaggagatccgcgttctccaagcccacatctcagacacctcggtcatagtcaagatggacaacagccgagacctgaacatggactgcatcatcgctgagatcaaggctcagtatgacgatgttgccagccgcagccgggccgaggctgagtcctggtaccgtagcaagtgtgaggagatgaaggccacggtgatcaggcatggggagaccctgcgccgcaccaaggaggagatcaacgagctgaaccgcatgatccagaggctgacggccgagattgagaatgccaagtgccagcgtgccaagctggaggctgctgtggctgaggcagagcagcagggtgaggcggccctcagcgatgcccgctgcaagctggctgagctggagggcgccctgcagaaggccaagcaggacatggcctgcctgctcaaggagtaccaggaggtgatgaactccaagctgggcctggacatcgagatcgccacctacaggcgcctgctggagggcgaggaacacaggctgtgtgaaggtgtgggctctgtgaatgtctgtgtcagcagctcccgtggtggagtctcctgtgggggcctctcctacagcaccaccccagggcgccagatcacttctggcccctcagccataggcggcagcatcacggtggtggcccctgactcctgtgccccctgccagcctcgttcctccagcttcagctgcgggagtagccggtcggtccgctttgcctagtagagtcatggagccagggcttcctgccaagcacctgcctgcctgcatcactgcactgaatggcatgtgaatggaaaatgtgtgcttgcttccagaatcttctggatgttcctacagagggaaagacctacagagggaaagaccctcgggccgctcccctgcgccttttcatgctagggagatgcatcctagttgtcctcctggcagctgttttcagaggcattcccagcccttcacttaactcctacttagctccaaaatacctgtatccaatttgtattattcccccagctctcagggacaagaccagtcccccagcgtggtggtcagcacggaagctccaccttctgggtggaggcgccatcctaaccatccagccaggccacccacaacccgagaatcagggagaaagtccctccccagcagccccctcctcctggctgggaagaatggtcccccagcaagcacttgcctgttcattcccgttcatgttttgcttctctctcagactgccttcctgcttctgggctaacctgttccagccaggctcctcatgtgacctcgcagttgagaagcccattatcgtggggcatccttttgcctacagcccctggttagggcactttggacaggtcttgctattcagtgaacctttgtacatttcaaagaagactccatggctgctccagatgcccccttgctgggtgcaggtggggactgtccaatgcagagctggcgggacagagagttaagccacttcctgggtctccttcttatgactgtctatgggtgcattgccttctgggttgtctcgatctgtgtttcaataaatgccgctgcaatgcaaaaaaaaatgg

SEQ ID NO: 41513 - DNA, 372 bp, Homo sapiens
gatttcccagtcttcattttccaccggaaagcactttcttctcttgattgctgtgtctgattgcctttcccctctcttgcttagctgatagcctatgaagatggtctttcaggttgtttcattcatgcagtgtagacctgggttgactgctgatgttcacagtggctttcctgggtctgctcacttttctctgcctctgtgtgtgcttcacctccccaccgccgccaccccaccccctctgcactttctgaaccaggaatttcattcttatgaagcttggtttgctttacctttgtgttcttctccctttcctctaataaatactgaaaatagattgggaatatttagtaaatattccctctagtaaatact

SEQ ID NO: 41514 - DNA, 463 bp, Homo sapiens
cttgtaaataggttgcagtatgtctccaatgaactttgctgtatttcaagagaaagaatctgaattcatttcaccatttttgtctccattaatgtgcgtggcaggttatccttacctttctttgcgttttcaagtgtgtttttgcaatcagtccattgagtagcatgttcaacaattaacaaataattactaagcaggaactatgaagcaaagcaatgtgctggccttctttcctatacttcacgagactttattggatgctttaatgctcagtaaatatttactactttgcatttttcttttcaactagagaattgctaacaaccaggcaatagccccaatgcacaatgaagatatggagctgtgtttaagcagatgtatctaccagagacagtaggtagaataaaaaccatggcttttggaactgtattagtccattctcatgctgctgataaagacatac

SEQ ID NO: 41515 - DNA, 451 bp, Homo sapiens
gcttaacttcgctttaatgcttttatgtagaacccagtgcaccccatttttgagaagtgcctggaatgtggagttgcatgcttgcaactagagttaaacagagaaaaagtagttccggaaggagagcaactgacccttaactcgacctcaggggcctttaggcactcagaactgaaacttggatagtttgtaagggataagcttgtccattcatagttatatgtacaaataaaaagagcctcagtgaagttagttacctataatgtgggagttaaggatgggtttataacacaatatgtatttaatgtatttgttcaatgaaaagaaaaaaatgttacctagttgttggcctgatgaacattggcattttataatgcacaaattgtcccaaaccagttggtatttaattacatttgtttggtttctgcataataaacaagtcttccgatta

SEQ ID NO: 41516 - DNA, 548 bp, Homo sapiens
ggtgcagcccacggagggcaagctgaagcagcgcctcacctgggaagcgcaaggggtcaggggatttccctttcttagccaagggaatccatgacagtctgtacttggaggaacggtacattcctgcccaaatactgcgcttttcccatagtcttcgcaacccacagaccaggaaattccctcctgtgcctggctcagcaggtctcacgcccatggaggcttgctcacagctagtgcagcagtctgagatcaacctgcaatgctgcagcttggtgggggaggggcgtccgccattgctgaggcttgaatgggtggttttgtgctcacagtgtaaacaaagaggccaggaagctcgaactgggtggagcccaccatagctcagcaaggcctactgcctttctagattccacttctgggcagtgcctaccagaagaaaaggcagcagacagcttcagcagacctaattttccctgtctgacagctctgaagagagcagtggctctcccagcatggcgtttgagctctgagaacggacagactgcctcctc

SEQ ID NO: 41517 - DNA, 446 bp, Homo sapiens
agaggctactgatagtggcaggaggcagacaaaggcctaggcagacagtggcaggtctacagtgaaaccccacctccaagctgaagacagtttaaagcctgaaagccaagctagaagtcaaatccacagatcggattgaaaacctgtgttcctgtctggcatgctttctctgactgatccccacccttcacctattttacttatatctaccctttcctaattgcttttctacactgctatgcccaactttgagtggtgcctttgctttagcctttctttgcatactcagcaatcagcacacactcccctattctgagcccataaaaaaccccggacacagccatactgacagagagagagaaaccacctggagtcccctttcctcttccatcgctcaataaaattcttctctgcccatccagacccttctaattgtcagtgtatcc

SEQ ID NO: 41518 - DNA, 844 bp, Homo sapiens
ttatttttgagacagagtcttgctctatcgcccaggctagagtgcaatggcacgatctcggctcactgcaacctctgcctcccaggttcatgcaattctcctgcctcagcctcccaagtagttcggattacaggtgcctgccaccaaacccagctaatttttgtattttttttagagatggggtttcgtcatgttggtcaggctgatcttgaactactgacgtcaggtgatctgcccgccttggcctccccaagtgctgggattacaggcataagccactgcgcccagcctcccattttttcaatctcctcagttcttctattctcaacgttttttgacttcacctttcgtttccctgatttgattttaattctccttcatgagtttcaaagttgaactcaattggcctgttgctatttcattgtttatctccgattctggttgggctactgtatatgtgatggccttctttatctctgaaaacaagactctaggccattgtttgaaatcctcgagtttccctgttgggagatcccatttcaggtattagattttatccgtgtccttgctgttctgatccattcttcctcaaaataagccaataactaattccataaaattttctttttgtctgtacttctgctttaattatctgattccttgctgttaataccaaacagcacacaacatttggttttgggttttatgagacaaagtctcactctgttgcctggacgagtacagtggcaccatcactgctaactgaagcctccacctcctgtgttcaagcgatcttcccgcctcagcatccctactagctgggactacagacttgcagcaccac

SEQ ID NO: 41519 - DNA, 388 bp, Homo sapiens
gttatctgtcctggtcatcacactctgctcccagaacctggcacggtgcctggaacaccaaagacaccacacgtgatgtcagaatgaacaaagacagaaaggagtgatgggatctgcctaacagggagagaacaggcccttaaaaaaaagagaatctggtcgggcgcggtggctcacgcctgtaatcccagcactttgggaagccaaggcgggcagatcacgaggtcaggagatcaagaccatcctggctaacacggtgaaatgccatctctactaaaaaatacaaaaaattagccgggtgtggtggcgggtgcctgcggtcccagctactcgggaggctgaggcaggagaatggcgtgaacccaggaggtggagcttgcagtgagcc

SEQ ID NO: 41520 - DNA, 883 bp, Homo sapiens
gcccttagaaaaagtagatcttttacatggcttggctcacaatttaagtggttataaatatatatacatatgatatagtggtataaatagatttataaatatacatcattttttgctacactttgaacaccaacatgtaatctttgggcttagcagaataaaagatagaataacacaaagtctatcttgctggagcacatttactcggtttctcctctagagaagcaaatcattagataagacatcatttcctgcactactggacacactcaatgaggtaactgttgttgaacaactttgcaatgccctttcatcttccattaaattaaccataaaatgtaaaaacacaaatactgaggaaaatctgagttttacagaaaaaatacaattgatgtgttggggataggaatgttcattacccgcttttaccccaagatgactagaatacccgttttttgttgtttgtgtgtttgtttttaaagtgtggcctgagcctatctacctcgaatccttcctggtagagcaccatgtttgtgcaattttgacattaaaaaaaaaaaaaaaaaaaaagcaacaaaaaccaacaacaaaacaccacccagactcaagcccccaaatcgcacacacacaaagccacctatgctttggggaaattttcgcagtggttttaaaacatggcatttttttcttcttcacattttctgataatacaatggatgcaaaagtcatgtggccgctctgaatggccacaggactcggtggggagggcagggcggtgggaggattctgctcttttggagggagagacaggttggtaaagccttcctgtcacccttccggtaaaattgtggctgggggaaaaacatgaactatcaacaaaaat

SEQ ID NO: 41521 - DNA, 791 bp, Homo sapiens
  misc_feature (16)..(16): n is a, c, g, or t
ggtcggtccggacatnggattcgctacactttgaacaccaacatgtaatctttgggcttagcagaataaaagatagaataacacaaagtctatcttgctggagcacatttactcggtttctcctctagagaagcaaatcattagataagacatcatttcctgcactactggacacactcaatgaggtaactgttgttgaacaactttgcaatgccctttcatcttccattaaattaaccataaaatgtaaaaacacaaatactgaggaaaatctgagttttacagaaaaaatacaattgatgtgttggggataggaatgttcattacccgcttttaccccaagatgactagaatacccgttttttgttgtttgtgtgtttgtttttaaagtgtggcctgagcctatctacctcgaatccttcctggtagagcaccatgtttgtgcaattttgacattaaaaaaaaaaaaaaaaaaaaagcaacaaaaaccaacaacaaaacaccacccagactcaagcccccaaatcgcacacacacaaagccacctatgctttggggaaattttcgcagtggttttaaaacatggcatttttttcttcttcacattttctgataatacaatggatgcaaaagtcatgtggccgctctgaatggccacaggactcggtggggagggcagggcggtgggaggattctgctcttttggagggagagacaggttggtaaagccttcctgtcacccttccggtaaaattgtggctgggggaaaaacatgaactatcaacaaaaat

SEQ ID NO: 41522 - DNA, 443 bp, Homo sapiens
gcctcagacttggcttggactatgggttccatccatagggttggcctcattgatcagcgttacaggaaggcttcgaggtggctccctgtgaccgtgttgtgagcaaaccattcctggcatcccaccttgcaggtgaggagactgcctcctagccgtggtaagtcccagcaccccacgctgcctctgtgggtttggaggtctggctcattctgttcacgtgggatggtgggattcagcaaaaatgggagagttgggctgtgaactcttgaaggtcagctcgtccaggaactcatttcgtgcatgtatactggcacctgctatgcagtggacaccgttctaggcacttgggatacatcaggggacaaaacagatgaatagccctgccttcctagagctgacattgtaggaaagaaggaagatggataataaacaatagatcaaca

SEQ ID NO: 41523 - DNA, 407 bp, Homo sapiens
ctgcaagagcaaaggatgcccagaggtcagggctggctgcccacccagctcgcccaccatccccaagagaagtaggcacagacccctagaggcgactctgcctcccagagccccggtggggagcatctgcagaacttccctcaggggctggggcaggcctctcctgtttgtctttgcctccaagttgaggaagagcagggactggcctctgcaggctctgcagtttgtgcaggtcctggcttgtggccctctcctaggacagcccctgacctttgtctctctggttttccagaggaggaagccaagggtggcctgcctcggtgcaagcagctgcttctctatggtggcaaaatttggaattaactgccttgtgacaggatggtttaatgatatttatttgtgttttc

SEQ ID NO: 41524 - DNA, 383 bp, Homo sapiens
gcttagtttgtaataacttgttatgcagctccagaaaacttgcgcgttagtgggggttctccagagaaacagatctgataggctgagaagtcccacaatctgccgtctacaaactagagaaccaggaaatctggtggtggaattcaatccaagtttgaaggcctgagaaccaggagcactgatgtccatggacagaagatgaatgtctcagctaaaacagcaagtccaccagctgcctgtttaaattctgtttaggcaacagattgtacaatgcccatccacattggtgaggatgatctttacttagtctacctattcaaatactaatctcttccaggaataccctcaaagacacacccagaaataatgctttaccagctatc

SEQ ID NO: 41525 - DNA, 391 bp, Homo sapiens
cagttgatgctactgaaaactgctatgtcacttgaggaacctgcttcctgttctgtttcagatgtttcttcttcattaactttttaattaaaaagctttacagatcaccctaaacttagaaaataagaataatgctctcagtttttttctctcttttgtgtgtgtttatataatctgtaattctccagctctattaaaataagtgccttcctgcaagctgaaataagcctaaagtataatgtgtcttggttctctaattatctcatggatttctaccattgtattaattcatctctaaacttcatggatctgttgactttactggctctcaatatcatctgctttcagtgttgttcatagttaaaaaaaattaaatcaaccttttcctata

SEQ ID NO: 41526 - DNA, 448 bp, Homo sapiens
ggctttctctacatggttgttcatgtagaactttgggcaactcactgtgccctcaagttatgagtccaataacctgttgctccagatgcttgatttcctcaactccagtgcccttcaggtgaggtccacctcactttgctgatagtggcagaggcagtcaaatgcctaggccgatggggcgggtccccaatgaaaccccccttcaaaccaaagacagttcaaagcctgaaatccaagctacaagtcttgggataaatccatgggaccaaattgaggaacctctcttttcgtttggcatgctttcctctgattaatccccaccttccacctattttacatatacctactcttccctaagtggtttcttgcactgtgtttcttacctacctttgagtgggtgcctttgttttagcctttcttgcatactcataaaccaatcagcatgcac

SEQ ID NO: 41527 - DNA, 367 bp, Homo sapiens
tgtccccactgcttggcaccgatgatgagctcaacacaagaggcttcatgcacggcccttgccaggcagcgaaggggagcgtgaggagcaggtgaggtcactggactggcacacgggctcattttaggagactcttgaagctcttcaaatcggtactttaaatctaggccaaattgtacatcaataccttctgttaagaagggaaggatagaccgggtgcggtggctcacacctgtaatcccagcctcccaagtagctgggattacaggcgtccaccaccatgctcagctaattttttgttttgttttgttttgttttgtttgtctgtttgttttttgagatggagtatccctctgttgccaggctg

SEQ ID NO: 41528 - DNA, 359 bp, Homo sapiens
gaccagtggaggtgcctcagtttacttgggagcttggcctctccagcttgccctcctactgcctggaagaagattagtgtcctcttgccttctctagcccctttcccaagaaccctcccagaatttcgtcctatgaagggccagggggtgcaagcacaatgacaggacccaccagcaataccagaagttggccagccctactcatccaaattcccttctgccagctggacatcacaaggatttcagactgccatcctgtgacaactccattttggggtctggggatgtaagggttactgtattagtccattctcactctgctaataaagacatacctgagactgggtaatttataaaga

SEQ ID NO: 41529 - DNA, 628 bp, Homo sapiens
  misc_feature (550)..(550): n is a, c, g, or t
  misc_feature (563)..(563): n is a, c, g, or t
  misc_feature (624)..(624): n is a, c, g, or t
atactttataaagtatattacagtgcagccatatcataagtgcatttcacttaatccaactccaggcccctgaagaaaaaaaaaacaaaatttaggccaagtgtggtggctcatgcctgtactcccaaagtgctagggttacaggggtgagccactgcacccagcctcaatactactttttaaaaatgagtttatctattttttttcctgttgtcttaattattttcaatttctccttaaattttgctagatcttctaatacttagaggatagatacctacagactactgtagggtaacactgttcatttatatttgtgaatattccagagacctaaagcttttctctgcatactttataaagtatattacaatgcagccatatcataagtgcatttcacttaatccaactccaggcccctgaagaaaaaaaaaacaaaatttaggccaagtgtggtggctcatgcctgtaatcccaaagtgctagggttacaggggtgagccactgcaccccagcctcaatacctactttttaaaaatggagtttatcntattttttttccnggtggccttaattaatttccaatttcccccctaaaatttggccaagatcctcctaataccnaaga

SEQ ID NO: 41530 - DNA, 650 bp, Homo sapiens
  misc_feature (572)..(572): n is a, c, g, or t
  misc_feature (585)..(585): n is a, c, g, or t
  misc_feature (646)..(646): n is a, c, g, or t
ttctattaaaagtacagaagttagccagacgtggtggtgggtgcctgtaattcctgctactcgggaggctgaggcgggaaaaccgcttgaacccaggaggctagtcttgaactcctggcctcaagtgatcctcctgccttggcctcccaaagtgctagggttacaggggtgagccactgcacccagcctcaatactactttttaaaaatgagtttatctattttttttcctgttgtcttaattattttcaatttctccttaaattttgctagatcttctaatacttagaggatagatacctacagactactgtagggtaacactgttcatttatatttgtgaatattccagagacctaaagcttttctctgcatactttataaagtatattacaatgcagccatatcataagtgcatttcacttaatccaactccaggcccctgaagaaaaaaaaaacaaaatttaggccaagtgtggtggctcatgcctgtaatcccaaagtgctagggttacaggggtgagccactgcaccccagcctcaatacctactttttaaaaatggagtttatcntattttttttccnggtggccttaattaatttccaatttcccccctaaaatttggccaagatcctcctaataccnaaga

SEQ ID NO: 41531 - DNA, 878 bp, Homo sapiens
  misc_feature (658)..(658): n is a, c, g, or t
  misc_feature (664)..(665): n is a, c, g, or t
  misc_feature (668)..(668): n is a, c, g, or t
  misc_feature (671)..(671): n is a, c, g, or t
  misc_feature (679)..(679): n is a, c, g, or t
  misc_feature (681)..(681): n is a, c, g, or t
  misc_feature (683)..(683): n is a, c, g, or t
  misc_feature (685)..(685): n is a, c, g, or t
  misc_feature (690)..(691): n is a, c, g, or t
  misc_feature (698)..(699): n is a, c, g, or t
  misc_feature (705)..(707): n is a, c, g, or t
  misc_feature (729)..(729): n is a, c, g, or t
  misc_feature (731)..(731): n is a, c, g, or t
  misc_feature (739)..(739): n is a, c, g, or t
aaatgtagactcagacttatttataatgcaacagaatagatgatggtgcctgcaattgtggaccatcccaaatgttctcctacttctccccctttctggttcatttaggaaattattcaattcctggtcatcattgtgggctgctaaacttggtttactctctcccctcaccaaagggaagacagttagttgaccctggctgctgcagttcacattctgctagagcctgggggaaagctgttgtcatttgtctttaggtttattcataatgttgggtttacacatacgttttacatttttatgtagttaaatgtcttgtcctttatgggttctggcttgattgtgcttagaaaggtctttcctcctccaagattgtgaaaataatgtcatgtgttctttgctggcacttgtacgatttcatttttgcatttaaatcagaacttgtaagctggtggactgtgggacagatctggtcaacatatgggttttggttagcctgtcacggaattctgaaagaaattatctgccagtgttttttacataacaatcttctatcttctcatgaaaaatgtaagatttagcaaccctgggcttgcattgtcatatagcaatgctcagaaagaattgaatagcttcggctctttacggacacagctcnatcagnntcnatngtggcacnangntncagtnncagagtnntcggcnnncctaggtacaggctactactcngngatatgtncgtgcaaactggcaaaaaaaagttatgagcactatcttgtgggtttcggcgtacagggaaggcaattgcctccggctgcggcctactacgacgcgacgtggggaacccaccctcggagggtcaaaggccgttcccgcta

SEQ ID NO: 41532 - DNA, 819 bp, Homo sapiens
aaatgtagactcagacttatttataatgcaacagaatagatgatggtgcctgcaattgtggaccatcccaaatgttctcctacttctccccctttctggttcatttaggaaattattcaattcctggtcatcattgtgggctgctaaacttggtttactctctcccctcaccaaagggaagacagttagttgaccctggctgctgcagttcacattctgctagagcctgggggaaagctgttgtcatttgtctttaggtttattcataatgttgggtttacacatacgttttacatttttatgtagttaaatgtcttgtcctttatgggttctggcttgattgtgcttagaaaggtctttcctcctccaagattgtgaaaataatgtcatgtgttctttgctggcacttgtacgatttcatttttgcatttaaatcagaacttgtaagctggtggactgtgggacagatctggtcaacatatgggttttggttagcctgtcacggaattctgaaagaaattatctgccagtgttttttacataacaatcttctatcttctcatgaaaaatgtaagatttagcaaccctgggcttgcattgtcatatagcaatgctcagaaagaattgaatagcttcggctcttttaagcggaacacaggctttctaattcagaacttcccaattggtgtgccatcaaatgcttttcaggtgtgccacgatgttgattccccgccccccagcctaaaggtcagccagagctcctatctaatttcctcctgcagacatcatctgctttgtccgtttgccccagagacttga

SEQ ID NO: 41533 - DNA, 243 bp, Homo sapiens
tgccattatgctcaaacctgggcaacagagcaagacttcatctcaaaaaaaaaaaaaaaaaaaagattcctaccccagaaacacccatcacagcaggttcctgtgcataatttctgcagaggtggagcagagccctgccaagcagaggctgggccacagcggacttcctcttccttatctttgtagctgggactgattttgaattgttttccatttttgcattctcaaggacacattgagtac

SEQ ID NO: 41534 - DNA, 960 bp, Homo sapiens
  misc_feature (951)..(951): n is a, c, g, or t
gcgccgggcgctccatggccgcgccgtaacggggacccagccgcctccccgcccagcccagcccagcccttccgcccgcccaggatggaggcgcccgccagcgcgcagaccccgcacccgcacgagcccatcagcttcggcatcgaccagatccttaacagcccggaccaggacagcgcacccgccccgcggggccccgacggcgccagctacctgggagggccccccgggggccgtccgggcgccacatacccgtctctgcccgcctcctttgcgggcctcggcgcgcccttcgaggacgcgggatcttacagtgtgaacctgagcctagcgcccgcaggcgtgatccgggtgccggcgcacaggccgctgcccggggccgtgccaccgcctctgccaagcgcgctacccgccatgccctccgtgcccacggtctccagccttggcggtctcaatttcccctggatggagagcagccgccgcttcgtgaaagaccgcttcacagcggcggccgcactcacgcccttcaccgtgacccggcgcatcggccacccctaccagaaccggacgccgcccaagcgtaagaagccgcgcacgtccttttcccgggtgcagatctgcgagctggaaaagcgcttccatcgccagaagtacctggcctctgccgagagggcggcgctcgccaagtccctcaaaatgacggacgcgcaggtcaagacctggttccaaaaccggaggaccaagtggcggcggcagacggcggaggagcgggaggcggaccggcagcaggcgagccggctcatgctgcagctgcaacacgacgccttccaaaagagcctcaacgactccatccagcctgacccgctctgtctgcacaactcgtcactctttgctctgcagaatctgcagccctgggaggaggatagttccaaggttcccgctgtcacctcnctggtgtga

SEQ ID NO: 41535 - DNA, 800 bp, Homo sapiens
gcgccgggcgctccatggccgcgccgtaacggggacccagccgcctccccgcccagcccagcccagcccttccgcccgcccaggatggaggcgcccgccagcgcgcagaccccgcacccgcacgagcccatcagcttcggcatcgaccagatccttaacagcccggaccaggacagcgcacccgccccgcggggccccgacggcgccagctacctgggagggccccccgggggccgtccgggcgccacatacccgtctctgcccgcctcctttgcgggcctcggcgcgcccttcgaggacgcgggatcttacagtgtgaacctgagcctagcgcccgcaggcgtgatccgggtgccggcgcacaggccgctgcccggggccgtgccaccgcctctgccaagcgcgctacccgccatgccctccgtgcccacggtctccagccttggcggtctcaatttcccctggatggagagcagccgccgcttcgtgaaagaccgcttcacagcggcggccgcactcacgcccttcaccgtgacccggcgcatcggccacccctaccagaaccggacgccgcccaagcgtaagaagccgcgcacgtccttttcccgggtgcagatctgcgagctggaaaagcgcttccatcgccagaagtacctggcctctgccgagagggcggcgctcgccaagtccctcaaaatgacggacgcgcaggtcaagacctggttccaaaaccggaggaccaagtggcggtgagagaggcctgacccggcccaccttacacctgcccttcacctgtcccg

SEQ ID NO: 41536 - DNA, 412 bp, Homo sapiens
gacaaagctgggatttgaactcatgaatgtcctatcgtcaatttgggaggcttaaacatgctgacatgttgccttcaggtggccatcacataggtggatagtatttctgccccgggtttccagaatggtctttgaagagctcactgatcatggtgtattccatggtgcataacagacagattctgtggtagtacctaatgcaggcagaggtgccttcctgcaggtgtgccagagtctttggtaatgagccattatgctccgtcagtcattctgctgtaaccatgcatagtcatcctgtttccttcctcacagtatatggagttgggatgcattgtttcttggtagaatttactttgtctgccatattgataatatccacttcagcagctacactatgacattcccttaaaaa

SEQ ID NO: 41537 - DNA, 388 bp, Homo sapiens
gagcaagaacgttgagaccttcaagaaccttttctcatgtctcattggccagaattgggtcatctgcccgtccccaaatcagtcactgttacccttagaatttataggctcactcctggagtgaggtcagttttccagattatattgctgctgctcaaaaagggtgagatggaggttggagacccaacagcaatgttcactgtaaatagtttcatcactttgtttctaagttccagttaaactttgcacctttagaaacggaataaattggctggtatggtggctcactcctgtaattctagcactctgggaggccgaggtgggcagattgtttgaactcaggagtttaagactagtctgggtcggccgggcgtggtggctcacacct

SEQ ID NO: 41538 - DNA, 314 bp, Homo sapiens
gccacgacgcatgagcttggcctccagagggcctccgtgaggcaggagctgggcctgcggaggccgtcccgaggtgggagcctggcccgaggaggccacggcgaggcaagaggtgggcctggagggcacactgttgaggtagaggctgggcctctagtggctgtcaacaggcaggaggccaggcctggagaggccgactggtggtcaagttcggggcctgcagaggccgcggaaagtcaaaagcagggcctgggaaggccaccgggaggcatgagctgggctgggctgaaagaggccactgggagacaggagga

SEQ ID NO: 41539 - DNA, 361 bp, Homo sapiens
gagagatcttaagccccatcagtcaccaaagtggttcccttcatcacaatctgccctagaggaaataggcaagtaaaatgatatataaagccatactatgtgctttctgagtatatactgcacttacctttgtgagcggctgtaggagggtctatcctcgaagctagcattttctggcatttaagtttgtagataatcactgttgtttgagttatttattagatattatttatttaatttatttctctcttcctttcacgaaaattcctttagccccatagatgtgcttgcaaacccttcctaaaattttatttggaaagtagctcataattttgctaagaactgctgagttttggagtga

SEQ ID NO: 41540 - DNA, 334 bp, Homo sapiens
tatttagagacaaggtcttgctctcttgcccaggctggagtgcagtggcatgatcttggctcactgcagcttcagcctcccaggctcaagcaattctccttcctcagcttcctgagtagctgggactacaagtgcgtaccaccatgcccggctaattaatttttttatattttgtagagatggagtttcaccatgttgcccaggttggttgaactcctgagctcaagtgatcctcccgccttggcctccccaaatgctcagattatagtcatgagccgctgacttggccccatctacattttagaataatcttgactatatttggaaaaaaaac

SEQ ID NO: 41541 - DNA, 837 bp, Homo sapiens
aggagaacatggatgggtcttatactcccaagtattgcccacatgacagtcctatgttctaccaggtaggcagaggagtccctggacggaataaatgaaaaaacattcagctcaacttacacgcctctctcttgctatggcatatctctgatatatagtgagaagtgaagtaatagctcagatcctttttatgcattatttaagccacaaggcgaagacaaatcatgtttctcagctatcagccactgcacattctttgcctctatgcagtttccctacagtacatttaacccttgcaaacacctccaatacagtccttttcacttctaccttggggatgctgattccttcagctcagatttcctgaggccttgtgttcttcctttctccagaaatgcagacgctgcgtgaggttttggcaacactgggcttaggagcgtctgctcttgccaatacccttgcttttgcccatggaaatgaagtaattcccaccataatcaggtacagaaccttaagtatgccctgtcaggttcaaaatggacctttctcagataattgacactttttgcgggaagaaatctaagactggttcattaagaaaataaatcataacagtcataaacacaaataattatagaccaactttatctcaagctgactttttgccactgtattaagtcctttgatgtattatagtatcccacataaccttctgagccacctgagaggttggtgctaaggatagcagtatttcctaaatgatgaaaatgcatctaatgcacttgtgaactgaaaaattaattgctagcaaataaaagtgaaaatttcaaacacagg

SEQ ID NO: 41542 - DNA, 342 bp, Homo sapiens
taaacctcacttctctaaactaaaccaaggttgattttgttttcgttaggcttaaaagtaataaacttaaaggctggcacacagtaggtaccaataaatgtttgctggattttatctaaatctttctttatcaaatttacaactttgaaaagtatagagaagaactggggtatgtgcttccttatcttttcaaatgctgtcaattactgcggccctactttttttttttttaaataaaatgaacggtaaatatttattttatttttttcctacgagtccagaaatccagaaggattgtaagtgtatgaatatgattattgacttttaaaagaacatatgaca

SEQ ID NO: 41543 - DNA, 446 bp, Homo sapiens
cagtctggctttagaccccttgctctgaactatcactttattgcttatcactgttactgttgttccagtattaagagcatggctgttttaggctgattgccttctctcctgggacctggcatcaccaaagcactatgtctcggaaatccattatctttccccagtctttcctccgttattgtgaggccttttgaaaatgtaccttccggcctccctgatgtcagagggaggcactaggtgctgcccattgtgattagatgggttctggtcttctgcctgcagtgcccctgctcccctttgtccctgtgctcacctctaacatgctctttgaggctgaagggaggaataaaagagcaaaaacaaccgggcacagtggcttacgcctgtaatcccagcactttgggaggccgaggcgggtggatcacaaggtcaggggttcaagacca

SEQ ID NO: 41544 - DNA, 417 bp, Homo sapiens
ctgcatctctaacattacaaaaaagaacaaaaaacagctgatacaaaagggacactctgacctcctttttaaaaataaaaataaattggtcctattttacagatgggaaactgatacaaaagagatctaacggcaggtagtaagattaaattttaggctattttcgaacttgggtcactattaaaaacagaatattaattcaggttgcttcgtaagtctcctgtctgctctttcctgcactgtgaagcatacctgcagtggcagaatttttcttaccaagttccttcctcctgcaatgtggtactggaaattctacagtaaagtaatccagtcacactgagctctcccttctcattgacctgagtctatttcaaaacatggcttaggttttacctcttcctgaaatgttcttgagta

SEQ ID NO: 41545 - DNA, 561 bp, Homo sapiens
aaaaaaatctctaagcacttttttttaatctagaaagtatccttaaatttttctgtcaccggtgtcaccctaggctgcttttgacctgactttagacagctcactggttttaagtcacatttcatcaacccttagccataataatcaggatcctctggttaagtggaatgtctaaccaaaacaaaacaaaaactgatttctttcatactcttttaaatgttcattctgcagacatactgtagattatatttgtaaaaaaaaatcaatttttggtggttacccccacttcccccaaaagaatcacagagaaaggaaagaggaataggtaaagttttaaacttcgtctcaggtaaatgggaaacgagcttgatttttcagggtcttagataagacacttgtatatactgaacaggtgctgcttttggcttgtatcaccaatgaggcagcaaagttagaactcgaaactagggtggggggtggtggctgtataattaggtcacaaagaaatgtggtaaggactttgcatgaataaagtaggtgctttataaggattcaataaga

SEQ ID NO: 41546 - DNA, 405 bp, Homo sapiens
ctaaaaagatttgaaatcattctaatccggctgggctcatgtcacacgacactggcttccggggtttccatgagctagaagtgcattaacattccccaaaggtcacaatgggactaagaaagggcctccaggcctgtgatatgggagagaaagaactttgagagagtgatctttaaaaaatcgtaacgaaatctttggaaccccgactctttctgcaaagaagcaggttttgtccagctcttctaggctccctgaaagtcaataagacccagggagagtggaatgagccaaacggtgccaacacccaaagccctactaggaggaaatcttgtagacaactgcaactgtctggaagtctattaagttggggtaagattaatcctaaacttggattataaggccaga

SEQ ID NO: 41547 - DNA, 923 bp, Homo sapiens
aggtctggggattacagcatggaaatatttggggtagggtggtcattcactctgcttaccacttttggtactatgtatgtgtacagtgtgtgaagtcaagcacagtcacttgcatacgtagagctactcaacagtcagtggtaaatcatgtggtcttgatatggttaggctttgtgtcctcacccatatctcatttgaattgtaatccccataatccccacaatccccacgtgtcaagggagaggccaggtggaggtaattgaatcacggaggcagtttcccccatgctgtgctcttgatagtgagttctcacaagatctgatggttttataaggggctcttccttccctgccttgcttcaccttccaccatgattgtaagtttcctgtggcctccccagccatgctgaactgtgagtccatgagccctctttcctttgtaaattacctagtctccagaagttgtttataacagtgtgaaaacagactaatagaggtataatgtacatggatgcactttggtcaagagtaggccaaggcaggcatccgagcctgcatgactcagtgagtttagggcacaggtgcatactccatttgttataaccggtttgtgtaagtttgtacttggttctggaccactattgtctgtaaaaggtataactgtcctgctgacgctatacaggtgctcgtgcccagagaaagagagagctagagctgtccgtcttttccgtctttgcagacggacagtgaggagccaggacacagctcggcctgcttatgtccagagagagaaagagttaagctgctgaccctgaaggcagggagagccacccacacaggtatacgtgggagcagccggctcaagcagccgagacagagcagaaagtgtaagagagatgctgaataaagctgtatttcacctat

SEQ ID NO: 41548 - DNA, 649 bp, Homo sapiens
gccggactatgggctgtgcctcaagaaaagaagcgcctgccggcgcaccagcgcgtcccactggctctccacgcctcccgcctctcgcactcggagccgccctcggccacaccatcgccagcgctcagcgtggagagcctgtcgtctgagagcgccagccagactgcaggtgcagagcttctggagccgccagctgtgcccaagagctcctcagagcctgctgtccgtgcacctgtgtattcctttcatctttctcattataggatttctgacaggactctgggcccctccccagctccactccctacctcaagaatgtgaccatttggaaaaggcaaagagaaaaggagcaaaatgaagcattcccccaggcttcagccctgggctctgaggggaaagagtggggcattgtttttctaacctaacctttccctctggtgatgttggggtagagaagccgagagaccctgtcctccctaatgcactgtggcccagtccccttgcctttttcctgttctgtttggagtggagaagggcagcacctctgtgtttaatggaagtagcccatagtctcctggatttttggaacatctttttcagcctattttgtgtcctaatgattcactcaataaacatgtttgaatccaca

SEQ ID NO: 41549 - DNA, 429 bp, Homo sapiens
cgctgcacacaaatcagggattaggaggatgttattctgttagtccctgggggcggagtctggagccggagggaggggatcccaccaccatctggtgctgtcccaaccacctggagtcccatgcagccctgaactcctgacgaccccctcaacctaggcccagcagcgccgtctgactccttctcaggttgcaaagagaaagtaggggatcagaggcctgaccccagcccctggataagcctaggaaatcgccgatccccctgcagccccctttggattgcagcgtctcacccagggcccagccccgacacagcggctaccgggtcacgggaggacaagcgacccgagcctgtgggggcggtaccggccttggtgacgtctcaatgtcatatgcaaatagaacgacgtcatggtctaccgggcgtgcgg

SEQ ID NO: 41550 - DNA, 2673 bp, Homo sapiens
tggccgtgcgccggaggcagcggcggcgtggcgcagcggcgacagtaagtgcgggccggctcgggctcttccggctacggtcccggccgcccccagactcgcgctcagcgacctccctcccggaccctgggggcggctgcgggctgccaggggagccgcaggaccctaccccatccgtggtcccttccccaccgtccctcctctccctccttgctctctgccacccctctttctgggtctctatcttctcttccccaaatcctctcccctcctcctccgtgagactggacctcaccgcctgtatggtgggggcctggtatggacccgtcggcccgaagtatccagacggtggctgattctctcggtcccagctgcggggcctgaggctggggctgtttacaccgcaaagccggttctgctgcggccagtaggcggtgccctgcgcttcccagtgccttcccacagtggccgttgtctcagaggacgactttcagcacagttcaaactccacctacagaaccacaagcagcagtctccgagctgaccaggaggcactgcttgagaagctgctggaccgcccgccccctggcctgcagaggcccgaggaccgcttctgtggcacatacatcatcttcttcagcctgggcattggcagtctactgccatggaacttctttatcactgccaaggagtactggatgttcaaactccgcaactcctccagcccagccaccggggaggaccctgagggctcagacatcctgaactactttgagagctaccttgccgttgcctccaccgtgccctccatgctgtgcctggtggccaacttcctgcttgtcaacagggttgcagtccacatccgtgtcctggcctcactgacggtcatcctggccatcttcatggtgataactgcactggtgaaggtggacactttctcctggacccgtggcttttttgcggtcaccattgtctgcatggtgatcctcagcggtgcctccactgtcttcagcagcagcatctacggcatgaccggctcctttcctatgaggaactcccaggcactgatatcaggaggagccatgggcgggacggtcagcgccgtggcctcattggtggacttggctgcatccagtgatgtgaggaacagcgccctggccttcttcctgacggccaccatcttcctcgtgctctgcatgggactctacctgctgctgtccaggctggagtatgccaggtactacatgaggcctgttcttgcggcccatgtgttttctggtgaagaggagcttccccaggactccctcagtgccccttcggtggcctccagattcattgattcccacacaccccctctccgccccatcctgaagaagacggccagcctgggcttctgtgtcacctacgtcttcttcatcaccagcctcatctaccccgccgtctgcaccaacatcgagtccctcaacaagggctcgggctcactgtggaccaccaagtttttcatccccctcactaccttcctcctgtacaactttgctgacctatgtggccggcagctcaccgcctggatccaggtgccagggcccaatagcaaggcgctcccagggttcgtgctcctccggacctgcctcatccccctcttcgtgctctgtaactaccagccccgcgtccacctgaagactgtggtcttccagtccgatgtgtaccccgcactcctcagctccctgctggggctcagcaacggctacctcagcaccctggccctcctctacgggcctaagattgtgcccagggagctggctgaggccacgggagtggtgatgtccttttatgtgtgcttgggcttaacactgggctcagcctgctctaccctcctggtgcacctcatctagaagggaggacacaaggacattggtgcttcagagcctttgaagatgagaagagagtgcaggagggctgggggccatggaggaaaggcctaaagtttcacttggggacagagagcagagcacactcgggcctcatccctcccaagatgccagtgagccacgtccatgcccattccgtgcaaggcagatattccagtcatattaacagaacactcctgagacagttgaagaagaaatagcacaaatcaggggtactcccttcacagctgatggttaacattccaccttctttctagcccttcaaagatgctgccagtgttcgccctagagttattacaaagccagtgccaaaacccagccatgggctctttgcaacctcccagctgcgctcattccagctgacagcgagatgcaagcaaatgctcagctctccttaccctgaaggggtctccctggaatggaagtcccctggcatggtcagtcctcaggcccaagactcaagtgtgcacagacccctgtgttctgtgggtgaacaactgcccactaaccagactggaaaacccagaaagatgggccttccatgaatgcttcattccagagggaccagagggcctccctgtgcaagggatcaagcatgtctggcctgggttttcaaaaaaagagggatcctcatgacctggtggtctatggcctgggtcaagatgagggtctttcagtgttcctgtttacaacatgtcaaagccattggttcaagggcgtaataaatacttgcgtattcaatgta

SEQ ID NO: 41551 - DNA, 2040 bp, Homo sapiens
tggccgtgcgccggaggcagcggcggcgtggcgcagcggcgacatggccgttgtctcagaggacgactttcagcacagttcaaactccacctacagaaccacaagcagcagtctccgagctgaccaggaggcactgcttgagaagctgctggaccgcccgccccctggcctgcagaggcccgaggaccgcttctgtggcacatacatcatcttcttcagcctgggcattggcagtctactgccatggaacttctttatcactgccaaggagtactggatgttcaaactccgcaactcctccagcccagccaccggggaggaccctgagggctcagacatcctgaactactttgagagctaccttgccgttgcctccaccgtgccctccatgctgtgcctggtggccaacttcctgcttgtcaacagggttgcagtccacatccgtgtcctggcctcactgacggtcatcctggccatcttcatggtgataactgcactggtgaaggtggacactttctcctggacccgtggcttttttgcggtcaccattgtctgcatggtgatcctcagcggtgcctccactgtcttcagcagcagcatctacggcatgaccggctcctttcctatgaggaactcccaggcactgatatcaggaggagccatgggcgggacggtcagcgccgtggcctcattggtggacttggctgcatccagtgatgtgaggaacagcgccctggccttcttcctgacggccaccatcttcctcgtgctctgcatgggactctacctgctgctgtccaggctggagtatgccaggtactacatgaggcctgttcttgcggcccatgtgttttctggtgaagaggagcttccccaggactccctcagtgccccttcggtggcctccagattcattgattcccacacaccccctctccgccccatcctgaagaagacggccagcctgggcttctgtgtcacctacgtcttcttcatcaccagcctcatctaccccgccgtctgcaccaacatcgagtccctcaacaagggctcgggctcactgtggaccaccaagtttttcatccccctcactaccttcctcctgtacaactttgctgacctatgtggccggcagctcaccgcctggatccaggtgccagggcccaatagcaaggcgctcccagggttcgtgctcctccggacctgcctcatccccctcttcgtgctctgtaactaccagccccgcgtccacctgaagactgtggtcttccagtccgatgtgtaccccgcactcctcagctccctgctggggctcagcaacggctacctcagcaccctggccctcctctacgggcctaagattgtgcccagggagctggctgaggccacgggagtggtgatgtccttttatgtgtgcttgggcttaacactgggctcagcctgctctaccctcctggtgcacctcatctagaagggaggacacaaggacattggtgcttcagagcctttgaagatgagaagagagtgcaggagggctgggggccatggaggaaaggcctaaagtttcacttggggacagagagcagagcacactcgggcctcatccctcccaagatgccagtgagccacgtccatgcccattccgtgcaaggcagatattccagtcatattaacagaacactcctgagacagttgaagaagaaatagcacaaatcaggggtactcccttcacagctgatggttaacattccaccttctttctagcccttcaaagatgctgccagtgttcgccctagagttattacaaagccagtgccaaaacccagccatgggctctttgcaacctcccagctgcgctcattccagctgacagcgagatgcaagcaaatgctcagctctccttaccctgaaggggtctccctggaatggaagtcccctggcatggtcagtcctcaggcccaagactcaagtgtgcacagacccctgtgttctgtgggtgaacaactgcccactcccgtaccagggggatccctctagagt

SEQ ID NO: 41552 - DNA, 2198 bp, Homo sapiens
tggccgtgcgccggaggcagcggcggcgtggcgcagcggcgacatggccgttgtctcagaggacgactttcagcacagttcaaactccacctacagaaccacaagcagcagtctccgagctgaccaggaggcactgcttgagaagctgctggaccgcccgccccctggcctgcagaggcccgaggaccgcttctgtggcacatacatcatcttcttcagcctgggcattggcagtctactgccatggaacttctttatcactgccaaggagtactggatgttcaaactccgcaactcctccagcccagccaccggggaggaccctgagggctcagacatcctgaactactttgagagctaccttgccgttgcctccaccgtgccctccatgctgtgcctggtggccaacttcctgcttgtcaacagggttgcagtccacatccgtgtcctggcctcactgacggtcatcctggccatcttcatggtgataactgcactggtgaaggtggacactttctcctggacccgtggcttttttgcggtcaccattgtctgcatggtgatcctcagcggtgcctccactgtcttcagcagcagcatctacggcatgaccggctcctttcctatgaggaactcccaggcactgatatcaggaggagccatgggcgggacggtcagcgccgtggcctcattggtggacttggctgcatccagtgatgtgaggaacagcgccctggccttcttcctgacggccaccatcttcctcgtgctctgcatgggactctacctgctgctgtccaggctggagtatgccaggtactacatgaggcctgttcttgcggcccatgtgttttctggtgaagaggagcttccccaggactccctcagtgccccttcggtggcctccagattcattgattcccacacaccccctctccgccccatcctgaagaagacggccagcctgggcttctgtgtcacctacgtcttcttcatcaccagcctcatctaccccgccgtctgcaccaacatcgagtccctcaacaagggctcgggctcactgtggaccaccaagtttttcatccccctcactaccttcctcctgtacaactttgctgacctatgtggccggcagctcaccgcctggatccaggtgccagggcccaatagcaaggcgctcccagggttcgtgctcctccggacctgcctcatccccctcttcgtgctctgtaactaccagccccgcgtccacctgaagactgtggtcttccagtccgatgtgtaccccgcactcctcagctccctgctggggctcagcaacggctacctcagcaccctggccctcctctacgggcctaagattgtgcccagggagctggctgaggccacgggagtggtgatgtccttttatgtgtgcttgggcttaacactgggctcagcctgctctaccctcctggtgcacctcatctagaagggaggacacaaggacattggtgcttcagagcctttgaagatgagaagagagtgcaggagggctgggggccatggaggaaaggcctaaagtttcacttggggacagagagcagagcacactcgggcctcatccctcccaagatgccagtgagccacgtccatgcccattccgtgcaaggcagatattccagtcatattaacagaacactcctgagacagttgaagaagaaatagcacaaatcaggggtactcccttcacagctgatggttaacattccaccttctttctagcccttcaaagatgctgccagtgttcgccctagagttattacaaagccagtgccaaaacccagccatgggctctttgcaacctcccagctgcgctcattccagctgacagcgagatgcaagcaaatgctcagctctccttaccctgaaggggtctccctggaatggaagtcccctggcatggtcagtcctcaggcccaagactcaagtgtgcacagacccctgtgttctgtgggtgaacaactgcccactaaccagactggaaaacccagaaagatgggccttccatgtctggcctgggttttcaaaaaaagagggatcctcatgacctggtggtctatggcctgggtcaagatgagggtctttcagtgttcctgtttacaacatgtcaaagccattggttcaagggcgtaataaatacttgcgtattcaatgta

SEQ ID NO: 41553 - DNA, 1404 bp, Homo sapiens
  misc_feature (1001)..(1001): n is a, c, g, or t
tggccgtgcgccggaggcagcggcggcgtggcgcagcggcgacagtaagtgcgggccggctcgggctcttccggctacggtcccggccgcccccagactcgcgctcagcgacctccctcccggaccctgggggcggctgcgggctgccaggggagccgcaggaccctaccccatccgtggtcccttccccaccgtccctcctctccctccttgctctctgccacccctctttctgggtctctatcttctcttccccaaatcctctcccctcctcctccgtgagactggacctcaccgcctgtatggtgggggcctggtatggacccgtcggcccgaagtatccagacggtggctgattctctcggtcccagctgcggggcctgaggctggggctgtttacaccgcaaagccggttctgctgcggccagtaggcggtgccctgcgcttcccagtgccttcccacagtggccgttgtctcagaggacgactttcagcacagttcaaactccacctacagaaccacaagcagcagtctccgagctgaccaggaggcactgcttgagaagctgctggaccgcccgccccctggcctgcagaggcccgaggaccgcttctgtggcacatacatcatcttcttcagcctgggcattggcagtctactgccatggaacttctttatcactgccaaggagtactggatgttcaaactccgcaactcctccagcccagccaccggggaggaccctgagggctcagacatcctgaactactttgagagctaccttgccgttgcctccaccgtgccctccatgctgtgcctggtggccaacttcctgcttgtcaacaggttgcagtccacattcctgtgtccttggccttgactcaacagtgtctgaaactcccggtcgtctagctgaagaatactaatagagagttatgcctgggcatcggtggctgggcatcgccatgtaaatcccaagcatactcagaggaggcttgangtcatggcagaatcacgttgacacctgggacggtggatgttcgcagtgagcgtgagacgcatgccattggacgtatgccaaggtgtctagaaggcttcccataagagcctatttcgcttgtgaagaactagcattggtgacgtggatagtcaagagaggacgaaaggagaccagatcatgacgatggagcgtctctctcaatgagtcctgcagaaagaccatgaattcacccccaagacttgtggcaagcccctctggagccagtgaattcaggccccttttgcttgctcttggcagaaaatgcaactgggcttcattggtgccccttgaagagggctgacttgaaaccagaaagcagtcaagtaatccagaccgggtggcaggcatgttcattgctccccag

SEQ ID NO: 41554 - DNA, 2252 bp, Homo sapiens
tggccgtgcgccggaggcagcggcggcgtggcgcagcggcgacatggccgttgtctcagaggacgactttcagcacagttcaaactccacctacagaaccacaagcagcagtctccgagctgaccaggaggcactgcttgagaagctgctggaccgcccgccccctggcctgcagaggcccgaggaccgcttctgtggcacatacatcatcttcttcagcctgggcattggcagtctactgccatggaacttctttatcactgccaaggagtactggatgttcaaactccgcaactcctccagcccagccaccggggaggaccctgagggctcagacatcctgaactactttgagagctaccttgccgttgcctccaccgtgccctccatgctgtgcctggtggccaacttcctgcttgtcaacagggttgcagtccacatccgtgtcctggcctcactgacggtcatcctggccatcttcatggtgataactgcactggtgaaggtggacactttctcctggacccgtggcttttttgcggtcaccattgtctgcatggtgatcctcagcggtgcctccactgtcttcagcagcagcatctacggcatgaccggctcctttcctatgaggaactcccaggcactgatatcaggaggagccatgggcgggacggtcagcgccgtggcctcattggtggacttggctgcatccagtgatgtgaggaacagcgccctggccttcttcctgacggccaccatcttcctcgtgctctgcatgggactctacctgctgctgtccaggctggagtatgccaggtactacatgaggcctgttcttgcggcccatgtgttttctggtgaagaggagcttccccaggactccctcagtgccccttcggtggcctccagattcattgattcccacacaccccctctccgccccatcctgaagaagacggccagcctgggcttctgtgtcacctacgtcttcttcatcaccagcctcatctaccccgccgtctgcaccaacatcgagtccctcaacaagggctcgggctcactgtggaccaccaagtttttcatccccctcactaccttcctcctgtacaactttgctgacctatgtggccggcagctcaccgcctggatccaggtgccagggcccaatagcaaggcgctcccagggttcgtgctcctccggacctgcctcatccccctcttcgtgctctgtaactaccagccccgcgtccacctgaagactgtggtcttccagtccgatgtgtaccccgcactcctcagctccctgctggggctcagcaacggctacctcagcaccctggccctcctctacgggcctaagattgtgcccagggagctggctgaggccacgggagtggtgatgtccttttatgtgtgcttgggcttaacactgggctcagcctgctctaccctcctggtgcacctcatctagaagggaggacacaaggacattggtgcttcagagcctttgaagatgagaagagagtgcaggagggctgggggccatggaggaaaggcctaaagtttcacttggggacagagagcagagcacactcgggcctcatccctcccaagatgccagtgagccacgtccatgcccattccgtgcaaggcagatattccagtcatattaacagaacactcctgagacagttgaagaagaaatagcacaaatcaggggtactcccttcacagctgatggttaacattccaccttctttctagcccttcaaagatgctgccagtgttcgccctagagttattacaaagccagtgccaaaacccagccatgggctctttgcaacctcccagctgcgctcattccagctgacagcgagatgcaagcaaatgctcagctctccttaccctgaaggggtctccctggaatggaagtcccctggcatggtcagtcctcaggcccaagactcaagtgtgcacagacccctgtgttctgtgggtgaacaactgcccactaaccagactggaaaacccagaaagatgggccttccatgaatgcttcattccagagggaccagagggcctccctgtgcaagggatcaagcatgtctggcctgggttttcaaaaaaagagggatcctcatgacctggtggtctatggcctgggtcaagatgagggtctttcagtgttcctgtttacaacatgtcaaagccattggttcaagggcgtaataaatacttgcgtattcaatgta

SEQ ID NO: 41555 - DNA, 2150 bp, Homo sapiens
  misc_feature (4)..(4): n is a, c, g, or t
ccgngcggcgtggcgcacggcgacatggccgttgtctcagaggacgactttcagcacagttcaaactccacctacagaaccacaagcagcagtctccgagctgaccaggaggcactgcttgagaagctgctggaccgcccgccccctggcctgcagaggcccgaggaccgcttctgtggcacatacatcatcttcttcagcctgggcattggcagtctactgccatggaacttctttatcactgccaaggagtactggatgttcaaactccgcaactcctccagcccagccaccggggaggaccctgagggctcagacatcctgggttgcagtccacatccgtgtcctggcctcactgacggtcatcctggccatcttcatggtgataactgcactggtgaaggtggacactttctcctggacccgtggcttttttgcggtcaccattgtctgcatggtgatcctcagcggtgcctccactgtcttcagcagcagcatctacggcatgaccggctcctttcctatgaggaactcccaggcactgatatcaggaggagccatgggcgggacggtcagcgccgtggcctcattggtggacttggctgcatccagtgatgtgaggaacagcgccctggccttcttcctgacggccaccatcttcctcgtgctctgcatgggactctacctgctgctgtccaggctggagtatgccaggtactacatgaggcctgttcttgcggcccatgtgttttctggtgaagaggagcttccccaggactccctcagtgccccttcggtggcctccagattcattgattcccacacaccccctctccgccccatcctgaagaagacggccagcctgggcttctgtgtcacctacgtcttcttcatcaccagcctcatctaccccgccgtctgcaccaacatcgagtccctcaacaagggctcgggctcactgtggaccaccaagtttttcatccccctcactaccttcctcctgtacaactttgctgacctatgtggccggcagctcaccgcctggatccaggtgccagggcccaatagcaaggcgctcccagggttcgtgctcctccggacctgcctcatccccctcttcgtgctctgtaactaccagccccgcgtccacctgaagactgtggtcttccagtccgatgtgtaccccgcactcctcagctccctgctggggctcagcaacggctacctcagcaccctggccctcctctacgggcctaagattgtgcccagggagctggctgaggccacgggagtggtgatgtccttttatgtgtgcttgggcttaacactgggctcagcctgctctaccctcctggtgcacctcatctagaagggaggacacaaggacattggtgcttcagagcctttgaagatgagaagagagtgcaggagggctgggggccatggaggaaaggcctaaagtttcacttggggacagagagcagagcacactcgggcctcatccctcccaagatgccagtgagccacgtccatgcccattccgtgcaaggcagatattccagtcatattaacagaacactcctgagacagttgaagaagaaatagcacaaatcaggggtactcccttcacagctgatggttaacattccaccttctttctagcccttcaaagatgctgccagtgttcgccctagagttattacaaagccagtgccaaaacccagccatgggctctttgcaacctcccagctgcgctcattccagctgacagcgagatgcaagcaaatgctcagctctccttaccctgaaggggtctccctggaatggaagtcccctggcatggtcagtcctcaggcccaagactcaagtgtgcacagacccctgtgttctgtgggtgaacaactgcccactaaccagactggaaaacccagaaagatgggccttccatgaatgcttcattccagagggaccagagggcctccctgtgcaagggatcaagcatgtctggcctgggttttcaaaaaaagagggatcctcatgacctggtggtctatggcctgggtcaagatgagggtctttcagtgttcctgtttacaacatgtcaaagccattggttcaagggcgtaataaatacttgcgtattcaatgta

SEQ ID NO: 41556 - DNA, 2203 bp, Homo sapiens
tggccgtgcgccggaggcagcggcggcgtggcgcagcggcgacatggccgttgtctcagaggacgactttcagcacagttcaaactccacctacagaaccacaagcagcagtctccgagctgaccaggaggcactgcttgagaagctgctggaccgcccgccccctggcctgcagaggcccgaggaccgcttctgtggcacatacatcatcttcttcagcctgggcattggcagtctactgccatggaacttctttatcactgccaaggagtactggatgttcaaactccgcaactcctccagcccagccaccggggaggaccctgagggctcagacatcctgaactactttgagagctaccttgccgttgcctccaccgtgccctccatgctgtgcctggtggccaacttcctgcttgtcaacagggttgcagtccacatccgtgtcctggcctcactgacggtcatcctggccatcttcatggtgataactgcactggtgaaggtggacactttctcctggacccgtggcttttttgcggtcaccattgtctgcatggtgatcctcagcggtgcctccactgtcttcagcagcagcatctacggcatgaccggctcctttcctatgaggaactcccaggcactgatatcaggaggagccatgggcgggacggtcagcgccgtggcctcattggtggacttggctgcatccagtgatgtgaggaacagcgccctggccttcttcctgacggccaccatcttcctcgtgctctgcatgggactctacctgctgctgtccaggctggagtatgccaggtactacatgaggcctgttcttgcggcccatgtgttttctggtgaagaggagcttccccaggactccctcagtgccccttcggtggcctccagattcattgattcccacacaccccctctccgccccatcctgaagaagacggccagcctgggcttctgtgtcacctacgtcttcttcatcaccagcctcatctaccccgccgtctgcaccaacatcgagtccctcaacaagggctcgggctcactgtggaccaccaagtttttcatccccctcactaccttcctcctgtacaactttgctgacctatgtggccggcagctcaccgcctggatccaggtgccagggcccaatagcaaggcgctcccagggttcgtgctcctccggacctgcctcatccccctcttcgtgctctgtaactaccagccccgcgtccacctgaagactgtggtcttccagtccgatgtgtaccccgcactcctcagctccctgctggggctcagcaacggctacctcagcaccctggccctcctctacgggcctaagattgtgcccagggagctggctgaggccacgggagtggtgatgtccttttatgtgtgcttgggcttaacactgggctcagcctgctctaccctcctggtgcacctcatctagaagggaggacacaaggacattggtgcttcagagcctttgaagatgagaagagagtgcaggagggctgggggccatggaggaaaggcctaaagtttcacttggggacagagagcagagcacactcgggcctcatccctcccaagatgccagtgagccacgtccatgcccattccgtgcaaggcagatattccagtcatattaacagaacactcctgagacagttgaagaagaaatagcacaaatcaggggtactcccttcacagctgatggttaacattccaccttctttctagcccttcaaagatgctgccagtgttcgccctagagttattacaaagccagtgccaaaacccagccatgggctctttgcaacctcccagctgcgctcattccagctgacagcgagatgcaagcaaatgctcagctctccttaccctgaaggggtctccctggaatggaagtcccctggcatggtcagtcctcagtgcccactaaccagactggaaaacccagaaagatgggccttccatgaatgcttcattccagagggaccagagggcctccctgtgcaagggatcaagcatgtctggcctgggttttcaaaaaaagagggatcctcatgacctggtggtctatggcctgggtcaagatgagggtctttcagtgttcctgtttacaacatgtcaaagccattggttcaagggcgtaataaatacttgcgtattcaatgta

SEQ ID NO: 41557 - DNA, 255 bp, Homo sapiens
taattttctgttaactcgagaatacccagatatgatagttttgtggctaggggttagacatagaaagtgtaactatgaatgcatgtatctgtttgacttcttgtacccccaaaataaaggctaaaataaatataatcagctaaccaaagctatagccacagtcatatatactgtgtaagaaaaaagcctctgatggaggttgcagtgagccgagatcatgccactgcactccagcctgggcgacggggccagact

SEQ ID NO: 41558 - DNA, 488 bp, Homo sapiens
atgctgcaaaccaaatccagcaacatataaaaataattatgcaccatcaccaagtaggatttatcccagggatataagattggcttaacatgtgaaaatcaatgtaatacattatatcaatataataaaaaagtcatctctactgatgcaaaaatagctgcatttgaataaatccaacaccctttcatcataaaaatgtttgaaaaacgaggaacggaaggaaactaccttaacctgataaagaacatctatgaaaaatctacagctttctttatacttaatggtgaaaaactgaatgctttcccactgagattagaaataagacaaggatgcccattatcacacttctatttaacattgtactggagggtctaagccattgcaattatgcaagaagaaaataaaggttggaaaggaagaagaaagactgttcacaaatgacatgatcttgtatgtagaagattctagggaatccaccaaaaaaaaaa

SEQ ID NO: 41559 - DNA, 501 bp, Homo sapiens
tctccatcttggtcacgcttgactcgaactcccgacctcaggtgatctgcctgccttggcctcccaaagtgctgggattacaggcatgagccacctcaccaggctaacaagattgtttttaaaagaatgtactaataaagtatctagtttttttgtttctttgtattactttatcagtggcattctgggttaccaaactgtagtaggattgcacaagttttttagttggttttgttttaactttaaggacttgcacatttcattttacatttaattctgttttttgagaaatgattaaagtgatctacctccaaaatgtttaacaatccgatatgcttctaagtatcctgccaatgtacttaatcaaatgtacttaaaaatcagttttcttaaagaagcatacactgtaattcacctggaaaaatagcatttttaagtaaaattaggcaattagcctaaaaatatgatttgcctctattctggaaaataattcatttaatt

SEQ ID NO: 41560 - DNA, 339 bp, Homo sapiens
aatggagtgagtgctgtttatctaacttccattcgatttgattcctacaaaagctcctgaagaggcgattccatccaggtcacatcagaatcagtttctgggtacccacgcatgagatttcattgcttcttttatcacaggagttggtatcctgtgatgattactccagatttctctttctccttctcttcatttatatctttaaattttttttagattgtttaaatttatttatttatttttattttttatttccgtaggttttgggggaccaggtggtatttggttacatgaataagttctttggtggtgatttctgagattttggtgcacccatta

SEQ ID NO: 41561 - DNA, 465 bp, Homo sapiens
agggaactttccagattcaacatgcccagccccactctcacagattctgtttcaaccagtctggggttgggcccagaaacttgaaaagtggttgtgatttgcacttttaataatctctaatccactataacaagttgtctctaatacctcaccagctcttcaactgcaggggccattttattaataattgtaaacatctatgtaaacatataggttcacttctttaggaaaattgaataaaatcacttatttcaccttatgctgtcttccacctgtgaatgtgttgtataacttcttaagacaaatctggcaccctgtgaatcaaatgagacaagttgatggtcacctgtgagattattcaaataagtgaagatgtttatgcaatttttgattgtcatactctgatgcctgttgagaaattttcttcttccttatatgaaataaatgccactttcacaattctgt

SEQ ID NO: 41562 - DNA, 995 bp, Homo sapiens
tgctttaacattgtaattaccaaacgacctctgtttgagagaggaacatacagaggaccaagggtaagctgtaacttgaaacttacataaaactttttagttacctgtggtggttaaatacttcatggttttggacttactccacattttgaatgtgttaattcagcaaacatttattttaagagtacttaacctactctgtgctaagcagtgtgcaagatattggggaaatagtaggtaacaagacatgaaatgactcacttcattttatttaccatttagcaggaaagataggtgttgaagtctgggaacatcaggaaacacttccctggtgtaatgtttatctcagcttggaaggatgaagaatactttgctggggcaaaaggatgggattggagacctgtgaaagcgttataggtttggtgaacagattgtatggaggtcctaaaaatggacaaaaaagatatgttggaggaattgaaagaaatagaaaaaagcaaaggagaagaatggcagtggaaagctccagagataggagccagatcacacaggactttgttgagtcatgtttaagactttggatgttattgaaggatagtgggaagccagtgaagggttttagggcaagagggttttcagatggatgtttaaaaaaaaaaaaaaaagcctggctgtgttttcagcgtgaaatagaagtctgcatatctgtatttactgtttcataacttctgtacatgtatcagggttctgagtttcataaattattgaaaataattttcaatgtctttttcataaattgagaattttgaactttattaaaattgtcatcttgaaatgcttaagattgatgttttgttatctcaaagatttgcttagtcatacttgccaataatatgaaactaaatgttagtcttttttctaacatttcgttttgatgatgagaagtcctgaaaaaaaaattaagctcctttgttgtagtaaacttttaaacaaac

SEQ ID NO: 41563 - DNA, 351 bp, Homo sapiens
ccagctaatttttgtattttttagtagagacgaagtttcaccacgatggccaggctggtctcgaactcctgacgtcaggagtttgtcctgacgttacccgcctcagcctcccaatctgggtttcgtatcaagtgtagaaatatttactcaagctattttatttagtaaacactatgatcacagatcttaggtctgtgagcatctcaaaaaaaacctataaaaatatttgaaacacaaaataaaatattttttgccctagaaaacaaaaagaaaattgctaagtctaagtaattaaatgcttattttaactaaatgtctaaaaatatagcattatatcactttcagtaacta

SEQ ID NO: 41564 - DNA, 426 bp, Homo sapiens
gacttccataccacctgctcccattgtttaattcacatgaagcgatggatcaaaatgaagtgaaaactaaagagagaaaacatacagtgtcattgagacatgtttccagtgtcaaggactatgtaaaccatccgcctcctcttaaggcgttagacttaatccatactttcaagttatctttccgcaatggttttggatacactgatgtcattcggtgattctttatccatatgacatatgccatttttcactcatgaaaagcgttgtttaagaagtaaatttaaatgataattcatgtttagggaagaaatgatactggtgctacagtgagtcctgcatcctaacagccttatataatttctgaaggaagtttcactggataaatccacgtagttcataagaaatagagactattccagtcataac

SEQ ID NO: 41565 - DNA, 278 bp, Homo sapiens
gaattaaaaagaagaaatgggctgggcatggtacctgtaatcccagcactttgggaggccaagctgagaggattgcttgagacctggctgggtaacacagtgagacctcatctccaaaaaaatcagaaaattagcctgatgtggtggcatacatctatagtcccagctactcgggaggctgaggtgggagaatcgcttgagctggggaagtcgaggctaaagtgaaccacagtcgcgccactgcactccagcctggatgaaagtgagactctgtctca

SEQ ID NO: 41566 - DNA, 1275 bp, Homo sapiens
  misc_feature (1)..(1): n is a, c, g, or t
  misc_feature (5)..(6): n is a, c, g, or t
ngccnnggcaggctattccggacgccagccctggaagctgagcctgacccagcaggtcccagcagcctggcagcccggccagcatgcagcagcagcctctgcccgggcctggcgcccccacaactgagccaaccaagcctccctacagctacatcgcccttattgctatggccatccagagctcaccggggcagcgggccaccctcagtggcatctaccgctacatcatgggccgattcgccttctaccgccacaaccggcccggctggcagaacagcatccgccacaacctgtcactcaacgagtgctttgtcaaggtgccccgcgatgaccgcaagccaggcaagggcagctactggacgctggaccctgactgccacgacatgtttgagcacggcagcttcctacgccgccgccgccgcttcacccggcagacaggtgctgagggcacccggggccccgccaaggcacgccgtggacccctcagggcgaccagccaggacccaggagtccccaacgccacgaccggcaggcagtgctcattcccaccagagctgccagatcccaagggcctaagctttgggggtctggtgggggccatgccagccagtatgtgcccagcaaccactgatggcaggcctcggccacccatggagcccaaagagatttccacgcccaagcctgcatgcccaggggagctccccgtggcacctcatcttcctcatgcccagcgtttggctttcctgccggcttctcagaggctgagagttttaataaggcccctacgcccgtcttgtccccggaatcaggcatcgggagcagctaccagtgtcggctgcaggcactgaatttttgcatgggggctgacccaggccttgagcacctcttggcctcagcagccccctcccctgcaccacccacccctccaggctcactccgggccccactgcccctgccaactgaccacaaggaaccctgggttgcaggtggcttccctgtccagggaggctccggctacccattggggctgaccccctgcctataccggacgccaggaatgttcttctttgagtaaaggcagcctcacctcgggcagtccctgcaggtcccctggtgagccaaggacaaccacacagaaagccaggattgaagcggtgctcagccaggcccctggggcctccggacaaacttgggggtgaggggaagcagggcctcttgggatttactctgtggctctcagggccaataaagccatgtgatgatgaaaaaaaaaaa

SEQ ID NO: 41567 - DNA, 1332 bp, Homo sapiens
  misc_feature (1)..(1): n is a, c, g, or t
  misc_feature (5)..(6): n is a, c, g, or t
ngccnnggcaggctattccggacgccagccctggaagctgagcctgacccagcaggtcccagcagcctggcagcccggccagcatgcagcagcagcctctgcccgggcctggcgcccccacaactgagccaaccaagcctccctacagctacatcgcccttattgctatggccatccagagctcaccggggcagcgggccaccctcagtggcatctaccgctacatcatgggccgattcgccttctaccgccacaaccggcccggctggcagaacagcatccgccacaacctgtcactcaacgagtgctttgtcaaggtgccccgcgatgaccgcaagccaggcaagggcagctactggacgctggaccctgactgccacgacatgtttgagcacggcagcttcctacgccgccgccgccgcttcacccggcagacaggtgctgagggcacccggggccccgccaaggcacgccgtggacccctcagggcgaccagccaggacccaggagtccccaacgccacgaccggcaggcagtgctcattcccaccagagctgccagatcccaagggcctaagctttgggggtctggtgggggccatgccagccagtatgtgcccagcaaccactgatggcaggcctcggccacccatggagcccaaagagatttccacgcccaagcctgcatgcccaggggagctccccgtggcacctcatcttcctcatgcccagcgtttggctttcctgccggcttctcagaggctgagagttttaataaggcccctacgcccgtcttgtccccggaatcaggcatcgggagcagctaccagtgtcggctgcaggcactgaatttttgcatgggggctgacccaggccttgagcacctcttggcctcagcagccccctcccctgcaccacccacccctccaggctcactccgggccccactgcccctgccaactgaccacaaggaaccctgggttgcaggtggcttccctgtccagggaggctccggctacccattggggctgaccccctgcctataccggacgccaggaatgttcttctttgagtaaaggcagcctcacctcgggcagtccctgcaggtccctcaccctccgggctgagcctggctctaggacctgaagaactctcgaaggacccagccctggtgagccaaggacaaccacacagaaagccaggattgaagcggtgctcagccaggcccctggggcctccggacaaacttgggggtgaggggaagcagggcctcttgggatttactctgtggctctcagggccaataaagccatgtgatgatgaaaaaaaaaaa

SEQ ID NO: 41568 - DNA, 488 bp, Homo sapiens
tttttttttttaaatccccagacagagtctcactctgccacccaggttggagtgcggtggccaatctcggctcactgcaacctctgcttcctgggttcaagcgattctcctgccttagcctcccgagtagctgggattataggcatgcaccaccacgcccagctaatttttttgtatttttagtagagatggggtttcaccatgttggccaggatggtctcgatctcctgaccttgggatccacccaccttagcctcccaaagtgctgggattacaggtgtgagccaccgtgcccagcccacaacttttttttaaagctgtgtttcttctaggagcctcttctccacgccaggcataaggaggaggtttattttaatgactttcaccttccaggtctttccagacataaagcaactaatgtgtaagtgcattaattgccaaatctcacaaaccacactactatgattcttgtcttgcagccgtctaac

SEQ ID NO: 41569 - DNA, 420 bp, Homo sapiens
agagatgaggtctcactctattgcccaggatggtcttgaactcctagactcaaacaatcctcccaagatgttggaattcaggtgtgagccactgtgtccagctgagattgagtaccctttcatgctatgggccatttgtattttgtgggagataaactgcctgttgggtctttttctcttttttttaattaaaaaagttctgaaaaattttaagtataaaaaaatacacagggtgttataatagccatgcatgtacctgtcacataaaatgaacaaatgttagtattttctaaagtgcatccaaatattttccttcccttccctcttaaaggaagaacatcactgataaaattaaattcctaaaaaaaaaaaagttaaaattcctgtaagtacccattcacccacctttccaggagcaat

SEQ ID NO: 41570 - DNA, 603 bp, Homo sapiens
tctttccccaaccccgttacccctgagcgagtttgggggcaagcataggtttgtaggcactgcaaagaagaactctcacgctgtggtgcaggaccgtggccttggcctctggatatctgggccaggtgggtgcatttgggcctcttccctacagtgcctggtcagactgcaagagacataggaagcagccagggcaggctatcttaagaggagggagcatatttgataaagttagaaaatgattctcagctgtccataggaaaagggaaggaaggaaggaaagaaggaaggaaggaagaaagaaggaaagaaagaagattcattattctgtcctctgaacctgagtgaagaaatatactctgtcctttgtacctgcgtgaagaaagaagagaaaagaaagaaaagaaagaaagaaagaaagaaacgaaggaaggaagaaagaaagagtgtaaagaaataaaaggctgtaaagaaataaaataatgtaaagaaagaaaataatgtaaagaaagaaaagaaaggaaagaaagaaggaaggaaagaaagaaagaagagagggagaggaaggaaggaagaaaggaaagaaagaaagaaagacagaca

SEQ ID NO: 41571 - DNA, 1226 bp, Homo sapiens
tctttccccaaccccgttacccctgagcgagtttgggggcaagcataggtttgtaggcactgcaaagaagaactctcacgctgtggtgcaggaccgtggccttggcctctggatatctgggccaggtgggtgcatttgggcctcttccctacagtgcctggtcagactgcaagagacataggaagcagccagggcaggctatcttaagaggagggagcatatttgataaagttagaaaatgattctcagctgtccataggaagagcagagtaaggggctatgtgagaagtttggaagatggcccagttccaaaaatgaagaaagaaagtaagaaagaaagagagaaagagagaaagaaaggaaggaaggaaggaaggaaggaaagaaagaggaaagaaagaaagaggaaagaaagaaggaaagaaagaaggaaggaaagaaagaaagaagagagggagaggaaggaaggaagaaaggaaagaaagaaagaaaaaggaaggaaggaaagaaggaaggaggggaagaaggaagaaagaaggaaagaaagattcattattctgtcctctgaacctgagtgaagaaaaataccctgtcctttgtacctgcgtgaagagagaaaagaaaagaaaagaaaagaaagaaagaaagaaagaaaagaaagacaggaaggaagaaaggaaagaaagaaagaaagaaagaaagaaaaaaagacagacaggaaggaagaaaggaaagaaagaaagaaaagggaaggaaggaaggaaagaaggaaggaaggaagaaagaaggaaagaaagaagattcattattctgtcctctgaacctgagtgaagaaatatactctgtcctttgtacctgcgtgaagaaagaaaagaaaagaaagaaaagggaaggaaggaaggaaagaaggaaggaaggaagaaagaaggaaagaaagaagattcattattctgtcctctgaacctgagtgaagaaatatactctgtcctttgtacctgcgtgaagaaagaagagaaaagaaagaaaagaaagaaagaaagaaagaaacgaaggaaggaagaaagaaagagtgtaaagaaataaaaggctgtaaagaaataaaataatgtaaagaaagaaaataatgtaaagaaagaaaagaaaggaaagaaagaaggaaggaaagaaagaaagaagagagggagaggaaggaaggaagaaaggaaagaaagaaagaaagacagaca

SEQ ID NO: 41572 - DNA, 1281 bp, Homo sapiens
tctttccccaaccccgttacccctgagcgagtttgggggcaagcataggtttgtaggcactgcaaagaagaactctcacgctgtggtgcaggaccgtggccttggcctctggatatctgggccaggtgggtgcatttgggcctcttccctacagtgcctggtcagactgcaagagacataggaagcagccagggcaggctatcttaagaggagggagcatatttgataaagttagaaaatgattctcagctgtccataggaagagcagagtaaggggctatgtgagaagtttggaagatggcccagttccaaaaatgaagaaagaaagtaagaaagaaagagagaaagagagaaagaaaggaaggaaggaaggaaggaaggaaagaaagaggaaagaaagaaagaggaaagaaagaaggaaagaaagaaggaaggaaagaaagaaagaagagagggagaggaaggaaggaagaaaggaaagaaagaaagaaagacagacaaagaaagaaagacaggaaggaaggaagaaaggaaagaaagaaagaaaaaggaaggaaggaaagaaggaaggaggggaagaaggaagaaagaaggaaagaaagattcattattctgtcctctgaacctgagtgaagaaaaataccctgtcctttgtacctgcgtgaagagagaaaagaaaagaaaagaaaagaaagaaagaaagaaagaaaagaaagacaggaaggaagaaaggaaagaaagaaagaaagaaagaaagaaaaaaagacagacaggaaggaagaaaggaaagaaagaaagaaaagggaaggaaggaaggaaagaaggaaggaaggaagaaagaaggaaagaaagaagattcattattctgtcctctgaacctgagtgaagaaatatactctgtcctttgtacctgcgtgaagaaagaaaagaaaagaaagaaaagggaaggaaggaaggaaagaaggaaggaaggaagaaagaaggaaagaaagaagattcattattctgtcctctgaacctgagtgaagaaatatactctgtcctttgtacctgcgtgaagaaagaagagaaaagaaagaaaagaaagaaagaaagaaagaaacgaaggaaggaagaaagaaagagtgtaaagaaataaaaggctgtaaagaaataaaataatgtaaagaaagaaaataatgtaaagaaagaaaagaaaggaaagaaagaaggaaggaaagaaagaaagaagagagggagaggaaggaaggaagaaaggaaagaaagaaagaaagacagaca

SEQ ID NO: 41573 - DNA, 880 bp, Homo sapiens
actcggtacctcataggttcgcagtgaaggaaggaaagaaagaaagaagagagggagaggaaggaaggaagaaaggaaagaaagaaagaaagacagacaaagaaagaaagacaggaaggaaggaagaaaggaaagaaagaaagaaaaaggaaggaaggaaagaaggaaggaggggaagaaggaagaaagaaggaaagaaagattcattattctgtcctctgaacctgagtgaagaaaaataccctgtcctttgtacctgcgtgaagagagaaaagaaaagaaaagaaaagaaagaaagaaagaaagaaaagaaagacaggaaggaagaaaggaaagaaagaaagaaagaaagaaagaaaaaaagacagacaggaaggaagaaaggaaagaaagaaagaaaagggaaggaaggaaggaaagaaggaaggaaggaagaaagaaggaaagaaagaagattcattattctgtcctctgaacctgagtgaagaaatatactctgtcctttgtacctgcgtgaagaaagaaaagaaaagaaagaaaagggaaggaaggaaggaaagaaggaaggaaggaagaaagaaggaaagaaagaagattcattattctgtcctctgaacctgagtgaagaaatatactctgtcctttgtacctgcgtgaagaaagaagagaaaagaaagaaaagaaagaaagaaagaaagaaacgaaggaaggaagaaagaaagagtgtaaagaaataaaaggctgtaaagaaataaaataatgtaaagaaagaaaataatgtaaagaaagaaaagaaaggaaagaaagaaggaaggaaagaaagaaagaagagagggagaggaaggaaggaagaaaggaaagaaagaaagaaagacagaca

SEQ ID NO: 41574 - DNA, 270 bp, Homo sapiens
cgtcaggccactgctcttctctgaccctcggtttcctttttgatgaaactggaacatgataccccctgcaaggctgttgtaggttgaatgcggtgatgtaaattgagggccaagcttggagctggcacagagtggacactaacatatgccaggctgcttcctttggtgagaggagctccattctctcttcgagctgagagacttttctggcttgaatgtgtagcggaaccggaagggcagtgaggccggaagtgggaggagcctgagatg

SEQ ID NO: 41575 - DNA, 426 bp, Homo sapiens
cccatctttgtcctttgaggagttttcagtggtgataatgggaatgattgtgctgtagtaaacctctttcctggctattttagctgtaattgaggtgagtctgagacaacaacagtattctgtgggtaattcccattggccttgggaccccaatctcaaaccttttcaatccaaacaaactttatcatgtgtaggaaaagaggaagggtgaagagtcctaaacttaagccatcccccattcacagatacacatggtggttaaatctgttttgccataggtatggtccacctgctaacagtcaaattcacgaaagtctcagtggcctaataaatagatctcttttttgttgcacagcctcactgcactcctggtccccagatttagggccttcctagtagcatttatagaggaataggagaggtgtt

SEQ ID NO: 41576 - DNA, 411 bp, Homo sapiens
tgcttaaactcaggaggcggaggtttctgtgagccgagattgtgccactgtactccaggcctgggtgacggagagagactccgtctcaaaaaaaaaaaaaaaaaaaaaaaaaaaaaacgaaaccaaaacaaaaaccaaatgtcttaaaaggtaggtactataagcagacccattcaacaaatggggaaatgggcttagttccaggtcacacccttaactgtgacactatctgtgtgacctcttttcttaacagtgacctgcccattttgactgacctgcccagacaggatttgtctcacttagtgacctccctggaactcccttcgattggtccccagagatcgcttacctccagcactgggttggagaacagcagtctgtcacgggctatttgtagtgactgggtcattg

SEQ ID NO: 41577 - DNA, 477 bp, Homo sapiens
aacatttgcattagcttatccgtggaaaagagatgaagtgggacctcatggctcctatgtgaacctcatcccagcatcactacatttacacctagaccattaaagacagaaggaaagcctgacaggagccatgagccaatagcaaagtggttcccaatggcaggtctgtggacccagagctatatggaaacatttttattcacctgtattcaaaaaagaaattagaatgatgttataagttttttaacatttcttatgaaatactgaaatatacaaaatgtgaccgggcttggtggctcatgcctgtaatcccagcactttgggaggctgaggcaggcggatcacctgaggtcaggagttcgagaccagcctgaccaacatggagaaaccccgtctctactaaaaatacaaaactagccgggcatggtggcacgtgcctgtaatcccagctaatagggaggctgaggcaggagaatc

SEQ ID NO: 41578 - DNA, 401 bp, Homo sapiens
cagaatcttgctctgtcaccaggctggagtgcaatggcacaatctcagctccctgcaacctttacttcccaggttcaagcgattctcctgcctcagcctcccgagagctgggactacaggcatgcgccaccacaccaggttaattgtttgtatttttagtagagacagggtttcatcatgttggccaggctggtttcgaactcctgacctcaagtgatccccctgcctcgccctcccaaagtgctaggattactggcttgatcccatggtgcccagcctcattactgtattttatatgtgattcaagaaaattctttgtctttcaatgtggccaggaggcggaggttgcagtgacccaagattgcgccacagcactccagcctgagcgacagagccagacc

SEQ ID NO: 41579 - DNA, 203 bp, Homo sapiens
gtcaaggaagggaagtgggagagagagctttgactagcagaggcttggaagccagccagccagcagccaacagtgcatgtgtgcattgggaagctagtggtccagggaccaggcactgctcctgtgggatccatcccagccctctaaggagcggtgcaaaggttcttatcctatttatcggagccagtgtccagaaaaggaag

SEQ ID NO: 41580 - DNA, 345 bp, Homo sapiens
ggcaggcttataaaacacacacacacacacacacacacacacacagagagagagagagagagagagagagagagagagagagagagagagagactcagagaagttaaaaaaggcagccctggtcataaagtgcatggtatgcagatgagacacatgaccttcccctgagcacttttgaacacttcccatatgtctggttaaattactcaccggtcttatctcacttcatctcacaaaatcttctggggtagtaacggtaacgatccccattttacagatgagaaaaccaagggtttgagaggttacatgcttgccccaaggctgcacagctacagagtgaggact

SEQ ID NO: 41581 - DNA, 376 bp, Homo sapiens
ctcagacataggacctaaatttagcaatcccagctagcagctgtcagtgtaagctacctcaggagaggtcccaagcagcttggaatagagatgagatgctccattttacccttcctgaattcctaacacacaaaattgtgagaaaataagctggtaagttttggcgtggtttcttacacagcaataaaacacttgaatgaaaatgtttttcagctttctcaaagtctcgtggctcttgatagctgactcaattttacctcacattttgttcatattacatatgtgtctgagaatcctccataatttccacttggtaaatgtcttaggcagttatgccatttctcttcatctagatcaccagcactcaattctttgg

SEQ ID NO: 41582 - DNA, 436 bp, Homo sapiens
  misc_feature (402)..(402): n is a, c, g, or t
  misc_feature (425)..(425): n is a, c, g, or t
gtgtagaactcagcagtttaatgagaaatcagacttttataaagaaaaaataggaagcaacctaaaaattcagcaattaagggaatagttaaaaatacccatggtacatagaatatcatgcaccctttaaaattatatttatggaacttttgtaatgagctgaagaaatgcttacgctatgaattcacaggaagcagtacatactagatgatgttggctatgttgaagaaaaatagatgtctagaaagattaagtacctttcacactcacaagatttgcagtaatttaaaagctgcccaagaagtagggcaataagaatttgcgttcactgctagtgggaagtataaattggggaccaaccccttttaaaaatttcccggcggcccgcaagcttatttcccnttagtgaggggtttattttaggnttggcactggc

SEQ ID NO: 41583 - DNA, 475 bp, Homo sapiens
tatgatttactcagaaatcacaaagagaggtaatgagggtttttaaatgaagccatttagatttcctattgttcaggatagatggtaacataagaaaaatccctatttcacttaattttgagaatgtgccaatgtcatgatgttaagcgtaggctttgcttgatagattgaaagaccggctgaaagaaccaagactgcttcaagtggcccacagtagtacctatcagactttgcaatgacttccaattgcttttctaattatttatgtttgtccttgttcccaaaccttaaagaaattctacaggatcattttacttttcctttagattattaccttgtaaaagccaagttccagcaaattacatagaaatgtgatagagttaggttaaaatggttccttgatacaaacacataattctaccaagaaagccaaagttaaacatgtctttccttttttggacatgcctatcctcag

SEQ ID NO: 41584 - DNA, 424 bp, Homo sapiens
gacattttaaacaaacccgtaaagctgtagggagataaggctactcaaatctaaaagatccagtaaatttcaattgaaagaactaccaagctggtgtttctcaagctggaaatcaaaaacaggcatgattctgaggatatcacagaaaacacagctgaaacactaattagctgtgtagtagtggcagttgttacttaaaaagcacacagggaattacagtggtaatctgatataataaggaattgatttaggggaagttttcagggtgttagaaatattaacaaatggttttagaaaatagataaccctctcttatccccaaattgatttttaatctgcttatcagataaaaaggcagcccagaagcatgaagttagtttggtgaaaaacaccaaatctagaagttattcggttaaaaaaagaa

SEQ ID NO: 41585 - DNA, 331 bp, Homo sapiens
gaacagcacagcctgtggctccgccccaaggaaccacttacacaaaatagctccgcccctcggaactttgcccagtgggacttcccctcgggactccaccccttgtggccccgcctccttcaccagagatctcgcccctcgtgatgtcaggggcgcagtagctccgcccacgtggagctcgggcggtgtagagctcagccccttgtggccccgtcctgggcgtgtgctgggtttgaatcctggcggagacctggggggaaattgagggagggtctggatacctttagagccaatgcaacggatgatttttcagtaaacgcgggaaacctca

SEQ ID NO: 41586 - DNA, 844 bp, Homo sapiens
ccctctacattaattcataacagtttcttttaagagctttggggccttcgttacatgcttaaagttccctgtgtgtgtgcagatgcaggtacacacatagcgcacacactcagaacaaaaccaccctcattctttattctatccctttcatctacaggcatttaatacagaaaattcagcttaccttagtggaagagtgttgatactgattgtgatccctggcatttccagagtagtttcagtgaacacatagtgaaatattggcagatactatttgttttctgaaaggtattaattttgtgatttctgtatgccccaagtggtggataggcctgcccgctccccaccttgacaaaaatcagaagggcaaaagaagccatccgttcagtgtaagagcaaaacaaaatgaacaattgtgaacatttaggcatttgtaatacagcatatagaagcaaagaaaaggggccagtcagtgtgtactggagtcattggggaagttttcatcttgggaatggtccttgaagagtggactggggtttagatagacacagggaaaggagaaaggcatcacaacagaggaaatagcatgagcaaaggcagagaggtattaatgcccagacggcctggtgtgcaagctgagtttttctggaatgctgtattgaagaaggaagacagaaagttgcaggaaagatggaagtgccaggtgtacacagagtttggcattctcaaaatttttccattgtctttacatccttgctattcgcctgatcagttgtttgcataacttgaatttagatctttatatctgtgaaattcaacgttaggctaattatagaaaaaaaaa

SEQ ID NO: 41587 - DNA, 845 bp, Homo sapiens
ggctcacttcctggcttgcagatgtcctcacatggccttgagtgtgtggtgggtggagggagcagaagctctctgatgtcttttcttaaaagggcacaaaccatgtcatcttatagaacatcaatgacctcattaacctttgttacttccttagaggccccatctacaatacacattgggagttagggcttcagcatacgaattttgtgccacaaacattcagtccataacagggccctagactcagttaggatcataggttcttttagacctaatgctgtccttaatagccagatgattttgggcaagtcacttaactactcacagtttcttcatctggtcgtatgttgggattgggtatagtacccctatcaccttcatggggttgttgtagttactgggtgaaataatatgtgttactgtaaataatagaattatatatatatgtgagagatgtcagccattaattctctgaatttaaagccatcctgacaataagatgtttattaaaatcagagaaattaaccaacatgataggattttttttcccagagcactaggtcttttcttttacagaggtattgcttcacatagccacctaattattctgtaatatatgtgcttatcaattggtcttatggactaaaaataaacacactttgatttctgatcaaagaaaaatgtaatttagatgaaaggatagattgctaatctgttgaattgtcacagctctaagatataaaaagattgcttacttaccagagcatagaaagatttgttattctttttttttgagatggcgtctccctctgttgcccaggctggagtgcaatggcacgatccca

SEQ ID NO: 41588 - DNA, 969 bp, Homo sapiens
gcatgcaacagctgggtcagtgggttatgcctgtaataccagcactttgggaggccaaggcaataggatcacttgaggccaggagtttgagatcagcctgagcaacatagtggggccatgtccctacaaaaaataaaaaaattaccagatatcatggcatgtttctgtaatcccagctattcagggggctgaggtgggaggatcactggagcctggaagttcgaggctgtagtgagccatgaccactgcactccaacgtggatgacagagtgagatcctgtctcttaaaaaaagaaaaataaaagggcattcaacatgtataggctagagagtaatcctcttactatattttcatgtcttttgcctctgttcttaactactgttttcaattttatggactaaaagtgacaaagtctcatgctcatgacagacagctcaaggaagaaaaagtagaatatggattaaaagaagagaatggatttgtgaaaaatcttaatgtaagaatcattaaatgctgaggcagatcatataatgtttatccatggagattttcaagaagagaaataagtcttgcagcagattctgtgtttcttacagttagagggcttgactaggtatcagtgagcgttccatgatttaatagtaccttacagcaaaatatgcctcatcctcttttggaaccacagttgcatatactgcgtattttaatcagaagtaggttatgaaggccacagcagtcactttttttttaggaagaaatgtgatgctgagagaagaggtacagctcagtgatatagaaatgtatatatctgtgtgtgtacacacatacatgtgtattctatgtattcagcacactcaaaacctatgaaaaaactatatagttagcaaacactgtgaatgtttcttctggctgcttgttgtttctctttatatgtgccttcatttgcaaaaggtgtattttcacttgtt

SEQ ID NO: 41589 - DNA, 283 bp, Homo sapiens
gcctcacttagttcccacgcagccagcaaggccagtctcactctcactgtgccccactaacagcaccaagtttatatccaggcagcctgtgagcagggctgatattttgcccaaggctacaagcctcccttctgagaaagcaagcagggctctcagtcctctcctttccccacctgccctcaccatcaactgtcacttctgtgcttgtatctgcacttcctgtctgcccccctcaaacccagattctactcaggaaaattcatgctcagtcaaagttattaca

SEQ ID NO: 41590 - DNA, 364 bp, Homo sapiens
cagaaaaaaatactgcagctaattaacaaattcagcaaagttatagggaacaagatcaacacccaaaaatcagttgtttccatataccagcaaagaaatttttaaaaaaagaaaaaaaaaatagttcagtttgcaacatttagaagagtaaaacacctaggaatatatttaaccaaaaaattgaaagatttatccactgaaaactaaaaaacattgctgagagaaattaaagaaaatctaataaatgggaaaggacatcccatattcatgggattgggaaaacttttaaggataggcaatattccccaaaacaatcttacaggttccagtgggtctgttttgcagaaataaaaagccaaccttc

SEQ ID NO: 41591 - DNA, 235 bp, Homo sapiens
tagtgtgcctgcaagcatgtgagagtatctgtgtgagtttcatggcctgcctgtgtgtaggtctctgttgaggaagtcaggagatccagattgggtgactcctctctgtatctcttgccagattccagagactggtgttagaaaatgtcaaaggtcttagccttggtggtgggcattcagggtggggttggagactggtattagggttggacggtgctgccttgccttgggccta

SEQ ID NO: 41592 - DNA, 325 bp, Homo sapiens
ctccactgattcaatagtatttagttttacgttgtttaaaaggaacattcaatctcctttgcagtcatagttcttgatttcatattactgaatggttgcattaaaatcccttttgactaattatgaggttgggaattctaaagtctgttgagcagacagcttgtgtcaagtgaggcagctggtgatttctggacactcttgattccatctgagcttccttttccagcacagccttatcctgaacacctgattttggggtaacttcttataaagcccactgtgtgttattgtggacacggtctcctggtgtccccccttgtgatga

SEQ ID NO: 41593 - DNA, 425 bp, Homo sapiens
ctgcaaggctatgagctaaggacaagcagccctacagcaccatttccattaggagatgttaacacagctctgatgaaactaaaactcagttaacataattagagacctccacatcctgctactgcttccttctctcccctcatcattcctatttcttacccccagaagcacttaaaagctgtttaaggtgaactgtgtttagacatgtggctgtcactattgttaaggatgtttgcaagggggtctcagtacaccctgcacaatcactgtctgccaggatctctgtgtctacctatgtttacatcacgcctatcactggcacatcagcagcctttgacaaacaagctgggaagtgcgggaagaaaagaaaaaagttgtttgtgactgatgctattaattatcgcttcgttacaccaggcactcct

SEQ ID NO: 41594 - DNA, 428 bp, Homo sapiens
ttattcacccattcattcattcatttgataaatgatcatgagacctcattgggtgccagttagccagttaggatattgacttccatataataagaaatagaacaggataatgttatagttatatctaggaagagctacagtacatcttgaactgataagcagaaaaatctagccattatacggtcagtaaacaccatttgggtcttacaaataatttcttatgtttgttatcaattcaaatgtttactttcccagaacatacatgtcatgtcatgagttttccatccccatcaagaacatcaaatttaaaggtacgttattgccaaggcatattaatattgattacatgatggggattctgtaccaataaggattatccctgtctcttttcgggactctggtactgctttcataatacagacgcatgc

SEQ ID NO: 41595 - DNA, 1244 bp, Homo sapiens
ctttttaaacaagcgtctccaagataaatagcaaaagaaaaaaagagggtgtgaggctccagacccacactcactcacttaatcatcttcttctgccttgtatagaatgatgtacatatataccttagacaacccagagtttttccctggtggagaggggagactttcagccctacctgtttccaggactgtgcacttagttaagggtgtgtggagagtgaggggaggcctatagatagtggtttgtatactgggtcctgaaaaccctcttggtgctctgtttttcaggagctgaagccaaagaatgccaataataatactttttgagtggttcttttcattattgttaattagacttatggtaccttgaattcttaagtttggcatagcatttctaaagaaagattgaattatttgttgataatgtttttaacccaataccgtgtggtttataattgccaatgccatagatttaaaaacctggcagattatacccctcatcttctctgcttgtcctcagcactactaccacaattaaaaagtactattttcttaaaaaagaaaataaatagaccttaaaattgatattttcattttctacgtattaatctttttaaactatgctagcatttttagtattacattaagtagaattagtcttgggagacaactttgtcttttgtttataaatagaataattctaatacatttcttttaaatgggcaatatggtatatagtatttggtgatgactgtcttcattgcaaacatctagtgaacactctggctacttccacagtaattttgcttttcatgataactacctgtattttcattccagtatctactgtccttccccacatgcacatagcctgtgttctttgaaggagagtgcctcacctacagcagctttggtgggggcctattagacttattaaaggcattccgttttcctggccacagaaactgattctgcatggtcatgtgatttagactaatctaaacagggtaaatttcagaactcttgcttagaattctgagacagaagtattaaactttcccatgtaactctgattgtggctgcagtcttcttttagcactagagcatctggccttgggaggtagcttgtattataaatagcagagtgaagagacaaaaacaaagtccttgatggaaacatctgttggacgctggatcagccagccttcaagcaggtcttccctgcattttagttacactagcca

SEQ ID NO: 41596 - DNA, 589 bp, Homo sapiens
acagataaggaaactgaggcatgattaacttgctcaaggtcacacaaccggaaaatggcagagcttggatttgaactgcagaccacctgtcaatcccaatttctctctctcaagcccacattcttacctaccacctgctatcccacacttaccagagggtgagatttctagttctagttccctccacagcctggcccagcctgtatcctctgtagtgctcaacacgaggctggactggcagaattgttctgcaaaatgggaaggatcactgatgctgagtcaagaggcagcagcctcccgcaatttgaaggggcgggggacctagttcaaggcctggcatgcaggaggtgctcaataaacatgtgtggcctgaatgaactaatgaataagcatgattcagtggagacagcccactagaaatgtgggtgaatgttctttctgccacttcctttgtccatgaaagaggaaataaatgcattacctccatgaaggttgagattaaatattgtatgaccgcttaagttcctttctaggctaaggatctagaatttattcactgatttttttttcattcattcatccagccatc

SEQ ID NO: 41597 - DNA, 2752 bp, Homo sapiens
tctgaggatcctcccgcgtacaagttgcgggaagcgattgaggaaacttgaatatttttgtatcctgaagggagaatggatgaagaagaaatggatgaagaagaccgaagataatgatgaagggataattgggaataggattcacagcaagagagacagaagggaaagacattgaagaaacagactagttaacacatgaaaaaaatagagcagaggaaaacacgtccatgtttttccacgtctaatgagaacagggtcctagcacagtgtctgatggagctttcctaccagaccctgaaattcacgcatcaggcgcgggaagcggatgatgaacgacagttgtcaaaatcttcccaagatcaatcagcagaggccccggtccaaaaccacagcggggaagacaggggacaccaaatcgctcaataaggagcatcctaatcaggaggtagttgataacactcgcctggaaagtgccaacttcggcctacatatatcaagaatccgtaaagacagtggagaggaaaatgcccacccacgaagaggccaaatcattgacttccaagggctgctcacagatgccatcaagggagcaaccagtgaacttgccttgaacaccttcgaccataatccagacccctcagaacgactgctgaaacctctgagtgcatttattggcatgaacagtgagatgcgagaattggcagccgtggtgagccggtatccacagctatttacaggaattctttctccctggaaaggactactgctgtacggccctccaggtacaggaaagactttactggccaaagctgtggccactgaatgtaaaacaaccttctttaacatttctgcatccaccattgtcagcaaatggagaggggattcagaaaaactcgttcgggtgttatttgagcttgcccgctaccacgccccatccacgatcttcctggacgagctggagtcggtgatgagtcagagaggcacagcttctgggggagaacatgaaggaagcctgcggatgaagacagagttactggtgcagatggatgggctggcacgctcagaagatctcgtatttgtcttagcagcttctaacctgccgtgggagctggactgtgccatgttacgccgcctggagaagaggattctggtcgatctccccagccgggaggccaggcaggccatgatctaccactggctgcctcctgtgagcaagagcagggccttggagctgcacacagagctggagtacagtgtgctgagccaggagactgagggctactcaggctcagatattaagctcgtctgcagggaagcagccatgcggcccgtgaggaagatctttgatgcacttgaaaatcaccagtcagaaagcagcgacttacccaggatccagttggatatagtaaccactgccgactttctggatgtgctaactcacaccaagccctccgcaaagaatctggctcagagatactcagactggcaaagagagttcgagtctgtctgaaaccacatttaccctgacctggccacaaaggcaaccacaaagacctcctagtttattaatgtccgtgggagaacaaaatgattggaatggaaaagagaaaattatttttgaagactggattaacttgagccactgtattgttttggatagctgagatatatttattaacttaccattatcgatgtcagcaaaatattgagagtttcagttacatacatatatgtgctattgggtcatacaatggagatttttctgacaattagactccataaaattttaatgaacaattttctgtaatgttactcatttgtaaactttttaagaaaaagatgtacttagaaaagttgtgttggccacacacaggatgaccctgagttggggcagccaagtagaagctaagcttgacaggcactgcccagctgacagtcccagggtgaaggaggacggaagcagggaaggcaatgcagtctgtttctcattccggacaatattctgaatctcatcagctccccctaattctgactccatccagctttgtcagcagcaaacccctcccaaacttaagccccactcagaaatgtcactgagcattctgatgctagagctaatagccagggtgactagcacaccatcaccatcagctgccagtctgattgttttgggttctggcccccaataacatcttttcactcttcacacctcacatccggtgtgctctgcccttctctttccattgccgcagcttctcatcagatccaaagcttaggatggggcacctaagcttcgagaacattcatcccaagtcttccctgctcttaggctcttccccctctccttaaggggttataaacaactagacgcatctctctcagaaacccacaatccgaggcatctactttcaacccttgataaattttgaaggcttctactaagtaatgccacttcttttcccccactagaacttacctatgggaaatcaccttcttttctcttccttgccttgtcttcatcatccctgcagacagactcttcaagaggaaaaacctccagaaagagacactttggatagctaagtatcccaaaggattttacccttttaaacaaaaccaaagcatttttttcggtatcgattattttgagattattctcaaatgcctctttaaacatcatttcatggaaaatgtcaaattgaaaatataccttatttaacaaattgaaaataaaaaagatttcatctcagta

SEQ ID NO: 41598 - DNA, 2908 bp, Homo sapiens
agcgtcaggttccttggatcgaccggtcagcccagtaactgactacttttctcccttctctagggtcctagcacagtgtctgatggagctttcctaccagaccctgaaattcacgcatcaggcgcgggaagcgggtttattgccgtaggagcagtgttattttttgttgtcatcctacctaaattttcctctgttccagtgcgagatgaggacagaagcacgacgaaaaaatcttctcattttgatttcgcattatttaacacaagaagggtatatcgatacagcaaatgctttggagcaagaaactaaactggggttacgacggtttgaagtttgtgacaacattgatcttgaaactattttgatggaatatgagagttattattttgtaaaatttcagaaataccccaaaattgtcaaaaagtcatcagacacagcagaaaataatttaccgcaaagaagtagagggaagaccagaaggatgatgaacgacagttgtcaaaatcttcccaagatcaatcagcagaggccccggtccaaaaccacagcggggaagacaggggacaccaaatcgctcaataaggagcatcctaatcaggaggtagttgataacactcgcctggaaagtgccaacttcggcctacatatatcaagaatccgtaaagacagtggagaggaaaatgcccacccacgaagaggccaaatcattgacttccaagggctgctcacagatgccatcaagggagcaaccagtgaacttgccttgaacaccttcgaccataatccagacccctcagaacgactgctgaaacctctgagtgcatttattggcatgaacagtgagatgcgagaattggcagccgtggtgagccggtatccacagctatttacaggaattctttctccctggaaaggactactgctgtacggccctccaggtacaggaaagactttactggccaaagctgtggccactgaatgtaaaacaaccttctttaacatttctgcatccaccattgtcagcaaatggagaggggattcagaaaaactcgttcgggtgttatttgagcttgcccgctaccacgccccatccacgatcttcctggacgagctggagtcggtgatgagtcagagaggcacagcttctgggggagaacatgaaggaagcctgcggatgaagacagagttactggtgcagatggatgggctggcacgctcagaagatctcgtatttgtcttagcagcttctaacctgccgtgggagctggactgtgccatgttacgccgcctggagaagaggattctggtcgatctccccagccgggaggccaggcaggccatgatctaccactggctgcctcctgtgagcaagagcagggccttggagctgcacacagagctggagtacagtgtgctgagccaggagactgagggctactcaggctcagatattaagctcgtctgcagggaagcagccatgcggcccgtgaggaagatctttgatgcacttgaaaatcaccagtcagaaagcagcgacttacccaggatccagttggatatagtaaccactgccgactttctggatgtgctaactcacaccaagccctccgcaaagaatctggctcagagatactcagactggcaaagagagttcgagtctgtctgaaaccacatttaccctgacctggccacaaaggcaaccacaaagacctcctagtttattaatgtccgtgggagaacaaaatgattggaatggaaaagagaaaattatttttgaagactggattaacttgagccactgtattgttttggatagctgagatatatttattaacttaccattatcgatgtcagcaaaatattgagagtttcagttacatacatatatgtgctattgggtcatacaatggagatttttctgacaattagactccataaaattttaatgaacaattttctgtaatgttactcatttgtaaactttttaagaaaaagatgtacttagaaaagttgtgttggccacacacaggatgaccctgagttggggcagccaagtagaagctaagcttgacaggcactgcccagctgacagtcccagggtgaaggaggacggaagcagggaaggcaatgcagtctgtttctcattccggacaatattctgaatctcatcagctccccctaattctgactccatccagctttgtcagcagcaaacccctcccaaacttaagccccactcagaaatgtcactgagcattctgatgctagagctaatagccagggtgactagcacaccatcaccatcagctgccagtctgattgttttgggttctggcccccaataacatcttttcactcttcacacctcacatccggtgtgctctgcccttctctttccattgccgcagcttctcatcagatccaaagcttaggatggggcacctaagcttcgagaacattcatcccaagtcttccctgctcttaggctcttccccctctccttaaggggttataaacaactagacgcatctctctcagaaacccacaatccgaggcatctactttcaacccttgataaattttgaaggcttctactaagtaatgccacttcttttcccccactagaacttacctatgggaaatcaccttcttttctcttccttgccttgtcttcatcatccctgcagacagactcttcaagaggaaaaacctccagaaagagacactttggatagctaagtatcccaaaggattttacccttttaaacaaaaccaaagcatttttttcggtatcgattattttgagattattctcaaatgcctctttaaacatcatttcatggaaaatgtcaaattgaaaatataccttatttaacaaattgaaaataaaaaagatttcatctcagta

SEQ ID NO: 41599 - DNA, 2842 bp, Homo sapiens
agcgtcaggttccttggatcgaccggtcagcccagtaactgactacttttctcccttctctagggtcctagcacagtgtctgatggagctttcctaccagaccctgaaattcacgcatcaggcgcgggaagcgtgcgagatgaggacagaagcacgacgaaaaaatcttctcattttgatttcgcattatttaacacaagaagggtatatcgatacagcaaatgctttggagcaagaaactaaactggggttacgacggtttgaagtttgtgacaacattgatcttgaaactattttgatggaatatgagagttattattttgtaaaatttcagaaataccccaaaattgtcaaaaagtcatcagacacagcagaaaataatttaccgcaaagaagtagagggaagaccagaaggatgatgaacgacagttgtcaaaatcttcccaagatcaatcagcagaggccccggtccaaaaccacagcggggaagacaggggacaccaaatcgctcaataaggagcatcctaatcaggaggtagttgataacactcgcctggaaagtgccaacttcggcctacatatatcaagaatccgtaaagacagtggagaggaaaatgcccacccacgaagaggccaaatcattgacttccaagggctgctcacagatgccatcaagggagcaaccagtgaacttgccttgaacaccttcgaccataatccagacccctcagaacgactgctgaaacctctgagtgcatttattggcatgaacagtgagatgcgagaattggcagccgtggtgagccggtatccacagctatttacaggaattctttctccctggaaaggactactgctgtacggccctccaggtacaggaaagactttactggccaaagctgtggccactgaatgtaaaacaaccttctttaacatttctgcatccaccattgtcagcaaatggagaggggattcagaaaaactcgttcgggtgttatttgagcttgcccgctaccacgccccatccacgatcttcctggacgagctggagtcggtgatgagtcagagaggcacagcttctgggggagaacatgaaggaagcctgcggatgaagacagagttactggtgcagatggatgggctggcacgctcagaagatctcgtatttgtcttagcagcttctaacctgccgtgggagctggactgtgccatgttacgccgcctggagaagaggattctggtcgatctccccagccgggaggccaggcaggccatgatctaccactggctgcctcctgtgagcaagagcagggccttggagctgcacacagagctggagtacagtgtgctgagccaggagactgagggctactcaggctcagatattaagctcgtctgcagggaagcagccatgcggcccgtgaggaagatctttgatgcacttgaaaatcaccagtcagaaagcagcgacttacccaggatccagttggatatagtaaccactgccgactttctggatgtgctaactcacaccaagccctccgcaaagaatctggctcagagatactcagactggcaaagagagttcgagtctgtctgaaaccacatttaccctgacctggccacaaaggcaaccacaaagacctcctagtttattaatgtccgtgggagaacaaaatgattggaatggaaaagagaaaattatttttgaagactggattaacttgagccactgtattgttttggatagctgagatatatttattaacttaccattatcgatgtcagcaaaatattgagagtttcagttacatacatatatgtgctattgggtcatacaatggagatttttctgacaattagactccataaaattttaatgaacaattttctgtaatgttactcatttgtaaactttttaagaaaaagatgtacttagaaaagttgtgttggccacacacaggatgaccctgagttggggcagccaagtagaagctaagcttgacaggcactgcccagctgacagtcccagggtgaaggaggacggaagcagggaaggcaatgcagtctgtttctcattccggacaatattctgaatctcatcagctccccctaattctgactccatccagctttgtcagcagcaaacccctcccaaacttaagccccactcagaaatgtcactgagcattctgatgctagagctaatagccagggtgactagcacaccatcaccatcagctgccagtctgattgttttgggttctggcccccaataacatcttttcactcttcacacctcacatccggtgtgctctgcccttctctttccattgccgcagcttctcatcagatccaaagcttaggatggggcacctaagcttcgagaacattcatcccaagtcttccctgctcttaggctcttccccctctccttaaggggttataaacaactagacgcatctctctcagaaacccacaatccgaggcatctactttcaacccttgataaattttgaaggcttctactaagtaatgccacttcttttcccccactagaacttacctatgggaaatcaccttcttttctcttccttgccttgtcttcatcatccctgcagacagactcttcaagaggaaaaacctccagaaagagacactttggatagctaagtatcccaaaggattttacccttttaaacaaaaccaaagcatttttttcggtatcgattattttgagattattctcaaatgcctctttaaacatcatttcatggaaaatgtcaaattgaaaatataccttatttaacaaattgaaaataaaaaagatttcatctcagta

SEQ ID NO: 41600 - DNA, 1347 bp, Homo sapiens
agcgtcaggttccttggatcgaccggtcagcccagtaactgactacttttctcccttctctagggtcctagcacagtgtctgatggagctttcctaccagaccctgaaattcacgcatcaggcgcgggaagcgggtttattgccgtaggagcagtgttattttttgttgtcatcctacctaaattttcctctgttccagtgcgagatgaggacagaagcacgacgaaaaaatcttctcattttgatttcgcattatttaacacaagaagggtatatcgatacagcaaatgctttggagcaagaaactaaactggggttacgacggtttgaagtttgtgacaacattgatcttgaaactattttgatggaatatgagagttattattttgtaaaatttcagaaataccccaaaattgtcaaaaagtcatcagacacagcagaaaataatttaccgcaaagaagtagagggaagaccagaaggatgatgaacgacagttgtcaaaatcttcccaagatcaatcagcagaggccccggtccaaaaccacagcggggaagacaggggacaccaaatcgctcaataaggagcatcctaatcaggaggtagttgataacactcgcctggaaagtgccaacttcggcctacatatatcaagaatccgtaaagacagtggagaggaaaatgcccacccacgaagaggccaaatcattgacttccaagggctgctcacagatgccatcaagggagcaaccagtgaacttgccttgaacaccttcgaccataatccagacccctcagaacgactgctgaaacctctgagtgcatttattggcatgaacagtgagatgcgagaattggcagccgtggtgagccggtatccacagctatttacaggaattctttctccctggaaaggactactgctgtacggccctccaggtacaggaaagactttactggccaaagctgtggccactgaatgtaaaacaaccttctttaacatttctgcatccaccattgtcagcaaatggagaggggattcagaaaaactcgttcgggtgttatttgagcttgcccgctaccacgccccatccacgatcttcctggacgagctggagtcggtgatgagtcagagaggcacagcttctgggggagaacatgaaggaagcctgcggatgaagacagagttactggtgcagatggatgggctggcacgctcagaagatctcgtatttgtcttagcagcttctaacctgccgtggtaagagaccaagagagtaaattttgaatacattttcaggagtcactaagtgcaaataaaaattttatattgaccacttcaggcaaa

SEQ ID NO: 41601 - DNA, 697 bp, Homo sapiens
tctgaggatcctcccgcgtacaagttgcgggaagcgattgaggaaacttgaatatttttgtatcctgaagggagaatggatgaagaagaaatggatgaagaagaccgaagataatgatgaagggataattgggaataggattcacagcaagagagacagaagggaaagacattgaagaaacagactagttaacacatgaaaaaaatagagcagaggaaaacacgtccatgtttttccacgtctaatgagaacagggtcctagcacagtgtctgatggagctttcctaccagaccctgaaattcacgcatcaggcgcgggaagcggtatatcgatacagcaaatgctttggagcaagaaactaaactggggttacgacggtttgaagtttgtgacaacattgatcttgaaactattttgatggaatatgagagttattattttgtaaaatttcagaaataccccaaaattgtcaaaaagtcatcagacacagcagaaaataatttaccgcaaagaagtagagggaagaccagaaggtaaagtgaatggtaattcttcttaatcgactcggctcgaggagcttgtggaatccctttccagaagctttaccatcacagctctgtgactgtctcccagcaatactgactgcagtcatgtgacctggcccagcccaggacttctctcattacagctgcccca

SEQ ID NO: 41602 - DNA, 380 bp, Homo sapiens
tagacacagttgggctgcatttaatctaccagtgggactgtggaccctttagttattttctccagctcactgcctgcctttggttttctttcaaataccatcattatattcatttacttgctttctatcatactgtatgtgaaaataacagcaaattgctcattttctctaactctagtatgaacggctccattggccatcagaacagaaactgttctacagtcacagggacattgctgtgaatgctgctcttgtcatgagggcgaaggctctgacacttaggagaatcacgtcttgtctctctgtaggggagaacatgaaggaagcctgcggatgaagacagagttactggtgcagatggatgggctggcacgctcaga

SEQ ID NO: 41603 - DNA, 548 bp, Homo sapiens
agggtggaaaccacattttgggactttattcaccccacccggttgttcaaaaaaactgtgtgggttccttataagtatccacagctatttacaggaattctttctccctggaaaggactactgctgtacggccctccaggtacaggaaagactttactggccaaagctgtggccactgaatgtaaaacaaccttctttaacatttctgcatccaccattgtcagcaaatggagaggggattcagaaaaactcgttcgggtgttatttgagcttgcccgctaccacgccccatccacgatcttcctggacgagctggagtcggtgatgagtcagagaggcacagcttctgggggagaacatgaaggaagcctgcggatgaagacagagttactggtgcagatggatgggctggcacgctcagaagatctcgtatttgtcttagcagcttctaacctgccgtggtaagagaccaagagagtaaattttgaatacattttcaggagtcactaagtgcaaataaaaattttatattgaccacttcaggcaaa

SEQ ID NO: 41604 - DNA, 2771 bp, Homo sapiens
agcgtcaggttccttggatcgaccggtcagcccagtaactgactacttttctcccttctctagggtcctagcacagtgtctgatggagctttcctaccagaccctgaaattcacgcatcaggcgcgggaagcggtatatcgatacagcaaatgctttggagcaagaaactaaactggggttacgacggtttgaagtttgtgacaacattgatcttgaaactattttgatggaatatgagagttattattttgtaaaatttcagaaataccccaaaattgtcaaaaagtcatcagacacagcagaaaataatttaccgcaaagaagtagagggaagaccagaaggatgatgaacgacagttgtcaaaatcttcccaagatcaatcagcagaggccccggtccaaaaccacagcggggaagacaggggacaccaaatcgctcaataaggagcatcctaatcaggaggtagttgataacactcgcctggaaagtgccaacttcggcctacatatatcaagaatccgtaaagacagtggagaggaaaatgcccacccacgaagaggccaaatcattgacttccaagggctgctcacagatgccatcaagggagcaaccagtgaacttgccttgaacaccttcgaccataatccagacccctcagaacgactgctgaaacctctgagtgcatttattggcatgaacagtgagatgcgagaattggcagccgtggtgagccggtatccacagctatttacaggaattctttctccctggaaaggactactgctgtacggccctccaggtacaggaaagactttactggccaaagctgtggccactgaatgtaaaacaaccttctttaacatttctgcatccaccattgtcagcaaatggagaggggattcagaaaaactcgttcgggtgttatttgagcttgcccgctaccacgccccatccacgatcttcctggacgagctggagtcggtgatgagtcagagaggcacagcttctgggggagaacatgaaggaagcctgcggatgaagacagagttactggtgcagatggatgggctggcacgctcagaagatctcgtatttgtcttagcagcttctaacctgccgtgggagctggactgtgccatgttacgccgcctggagaagaggattctggtcgatctccccagccgggaggccaggcaggccatgatctaccactggctgcctcctgtgagcaagagcagggccttggagctgcacacagagctggagtacagtgtgctgagccaggagactgagggctactcaggctcagatattaagctcgtctgcagggaagcagccatgcggcccgtgaggaagatctttgatgcacttgaaaatcaccagtcagaaagcagcgacttacccaggatccagttggatatagtaaccactgccgactttctggatgtgctaactcacaccaagccctccgcaaagaatctggctcagagatactcagactggcaaagagagttcgagtctgtctgaaaccacatttaccctgacctggccacaaaggcaaccacaaagacctcctagtttattaatgtccgtgggagaacaaaatgattggaatggaaaagagaaaattatttttgaagactggattaacttgagccactgtattgttttggatagctgagatatatttattaacttaccattatcgatgtcagcaaaatattgagagtttcagttacatacatatatgtgctattgggtcatacaatggagatttttctgacaattagactccataaaattttaatgaacaattttctgtaatgttactcatttgtaaactttttaagaaaaagatgtacttagaaaagttgtgttggccacacacaggatgaccctgagttggggcagccaagtagaagctaagcttgacaggcactgcccagctgacagtcccagggtgaaggaggacggaagcagggaaggcaatgcagtctgtttctcattccggacaatattctgaatctcatcagctccccctaattctgactccatccagctttgtcagcagcaaacccctcccaaacttaagccccactcagaaatgtcactgagcattctgatgctagagctaatagccagggtgactagcacaccatcaccatcagctgccagtctgattgttttgggttctggcccccaataacatcttttcactcttcacacctcacatccggtgtgctctgcccttctctttccattgccgcagcttctcatcagatccaaagcttaggatggggcacctaagcttcgagaacattcatcccaagtcttccctgctcttaggctcttccccctctccttaaggggttataaacaactagacgcatctctctcagaaacccacaatccgaggcatctactttcaacccttgataaattttgaaggcttctactaagtaatgccacttcttttcccccactagaacttacctatgggaaatcaccttcttttctcttccttgccttgtcttcatcatccctgcagacagactcttcaagaggaaaaacctccagaaagagacactttggatagctaagtatcccaaaggattttacccttttaaacaaaaccaaagcatttttttcggtatcgattattttgagattattctcaaatgcctctttaaacatcatttcatggaaaatgtcaaattgaaaatataccttatttaacaaattgaaaataaaaaagatttcatctcagta

SEQ ID NO: 41605 - DNA, 2040 bp, Homo sapiens
  misc_feature (1962)..(1962): n is a, c, g, or t
  misc_feature (2038)..(2038): n is a, c, g, or t
agcgtcaggttccttggatcgaccggtcagcccagtaactgactacttttctcccttctctagggtcctagcacagtgtctgatggagctttcctaccagaccctgaaattcacgcatcaggcgcgggaagcgggtttattgccgtaggagcagtgttattttttgttgtcatcctacctaaattttcctctgttccagtgcgagatgaggacagaagcacgacgaaaaaatcttctcattttgatttcgcattatttaacacaagaagggtatatcgatacagcaaatgctttggagcaagaaactaaactggggttacgacggtttgaagtttgtgacaacattgatcttgaaactattttgatggaatatgagagttattattttgtaaaatttcagaaataccccaaaattgtcaaaaagtcatcagacacagcagaaaataatttaccgcaaagaagtagagggaagaccagaaggatgatgaacgacagttgtcaaaatcttcccaagatcaatcagcagaggccccggtccaaaaccacagcggggaagacaggggacaccaaatcgctcaataaggagcatcctaatcaggaggtagttgataacactcgcctggaaagtgccaacttcggcctacatatatcaagaatccgtaaagacagtggagaggaaaatgcccacccacgaagaggccaaatcattgacttccaagggctgctcacagatgccatcaagggagcaaccagtgaacttgccttgaacaccttcgaccataatccagacccctcagaacgactgctgaaacctctgagtgcatttattggcatgaacagtgagatgcgagaattggcagccgtggtgagccggtatccacagctatttacaggaattctttctccctggaaaggactactgctgtacggccctccaggtacaggaaagactttactggccaaagctgtggccactgaatgtaaaacaaccttctttaacatttctgcatccaccattgtcagcaaatggagaggggattcagaaaaactcgttcgggtgttatttgagcttgcccgctaccacgccccatccacgatcttcctggacgagctggagtcggtgatgagtcagagaggcacagcttctgggggagaacatgaaggaagcctgcggatgaagacagagttactggtgcagatggatgggctggcacgctcagaagatctcgtatttgtcttagcagcttctaacctgccgtgcttgaaagccattgcactccagcctggcgacagagcaagactccgtctcaaaaaaaaaaaaagtgtactagtccattttcatgctgctggtgaagacatatccaagactgggaagaaaaaaaaattaactggacttacagtttcacatggatggggagcctcagaatcatggcggggggcaaaagacacttcttatatggtggcagcaagagaaaatgaggaagacgcaagaagcggaaacccctgataaaaccatcagaccttgtgagacttattcactaccatgagaacagcatgcgtggtggaaactgctcacgattcaaattatctcctactgggtccctcccacaacacgtgggaattatgcgattacaattcaagatgagatttgggtggggacacagagccaaaccatatcaagaagtttaaggaaatggcctatggatgcaaaatcacataaacttggcctgacagttttgggaggagtaaaagtgagtgtctgaaagggcggttatttgcactgggcacccaggaagggccactggtgctaagttcaccaatgtaatgaagtgaggggtcattcactccagaaggactgagaattttggaagaattaatgtacttagagtgcccaacttattgtcagcaataatttactcactggcaagatcggactgaataattcatgttacaactgcaatnagaatactcatgattgctggttgttagttggtttttgtaccccaaattaagtcgcataaaattacttccttttcanag

SEQ ID NO: 41606 - DNA, 518 bp, Homo sapiens
ttaattaaaaagaaatggtcaaaaaagctagtttaaccaaaaaaagttgagatcaggtgcggtcatggtggtatggctgtcgacattaaccaaaacagaaacagcaattaatatacttcaaaatttagtaggttgacaaagaaatcaaaatcaagggcatgagactcattcgtctctgggtatgaaaaaggattagattcaacttatcacactaaaaaaaggtgatgcataaatgtaacaataagtacattctgtattcaattgtaaaagaaattgtgtgtccattgaaatagtgccctttcatctccccatacaccttataccaccccctcccaaaaaatatcctctcgtgtcacagcttatgagggcatgacattaatgaggtaaaaagcaagcttgaaattttcccaggaaagcaccctaccggagactcatttattgtcattgaagcattcctttggctgacgaccagaagttggtggtttcgacttaagaggccatgttacatgaaaaaaaaa

SEQ ID NO: 41607 - DNA, 710 bp, Homo sapiens
ggagatgtaagaaacatggtggctgagctggtgaagtttctcagcatctctgtttcttgcatgtgtctcacacccttgtctaaaatgccttgctctcatctaacccagagttctctctcaactaaggcagcagggttggcgtgaggggggcaaaggagggaggaggaaggcaaccagcctcacaagtgggggccactcctcacagccacgagcagctgggccacatgcagcactggcagcccaggtggcctgttacggcgggcagtacttccctttgcctcccttcggaatctgtcagcacttttatgtggagtcttcatcccatgttcaaccctgggggttttaaggtgtttctcctttgctttgggatttcaaacatgggcagctcatagcactgtactgtcatttctccctggatgctagggatgccctgcctacttgccctacctcgagcagatgttctgaatgtcaagtcagcattgcttgaaacacacacacacacacacacacacacacgtacacaccactgttactagttctgctatgtctggctcatagacaaggatgtaaagaagcagtctaacattctgccattgacaaactactcctttttaaaatgccaaattcttgtaattctgcttattttcaataggctatgtctggccaaaatgtctgcttgaattggctaattaaaccaaaatatctatgtt

SEQ ID NO: 41608 - DNA, 680 bp, Homo sapiens
tcattacatatatgttctaggccaaaactttattcagtgatggaaatattcttcttccccatccagtacggtagccatcagccacatggcgcttctgagtccttgacatgtggcaggtgtaactgaggaactgaagcttgaatttcattggatttaaggttaaatagtcacgtgtggctggtggctactctattagatagtgcatttctaagccaagtgtgaaatctgaatctgcctctttattcacgcattcattcatgcaccagatatttattgaccaccaactctcccaggtattgttttgggtgctaggggtgcagacttggctacaacaggccaaaataacagaataatccctgccctggtggcaaggctcatgaagagctcactctagtgaggcccccattccagaggaggttctgttcagatgcatccaatcattgtggctttgcccacttgaatcagacaatttgtcaagttcaggggtagcacaaacttcatgacttgtgatgttgttttagtttttaaatagtcattgcaaagaactgcctgtggataagaaaagcaggaaaagcagcctatgtaatcttttacctcgtgaaattactcctattttatttttatttttatttttgagacagagtctctctctgttgcccaggctggagtgcagtggtgca

SEQ ID NO: 41609 - DNA, 551 bp, Homo sapiens
aatgaatgaattaatgattaaatgtatgtatgcatgaatcaatgaatgaagatgagtatctatgctcctagaagttataacctaaatacagggaattttaagtaacagagtacaagtctgggcgtaaatcaaaactaaagattttcaaatatcaaaaagaattttgtttgacttccttcttagagacggttttggtttgcttgttttaaacatctttcatctccatcccttgttttctggaatttctataagctatcaccatcctccccaccaccaccctgctaaaaaaggcccttttctgagaaacagaagaagaaataaatgaaattggtttgcatgccttagtgaattcttatgatgaaagggtaacctggaaacaattcccattacacttagcaaaaccatttttcagtctatacagcccactatctaattacagtattggaatactgttaagaatggagcaaagttcaaagaatcagttatatccccaatcaaagcgaccggccacactttcagtagctggtgagagtgaagaggaagtcactaaa

SEQ ID NO: 41610 - DNA, 373 bp, Homo sapiens
aaactgaggttacttgccctttgaatcaaagctaagaattggtgaggccgggattcagaccctgtggtctaacaccagagcccatgctcttcagcaccacctattatgctcaaggtagtgcctggcaggattaatcctctttcctggagtccttattttctgctagagcctgggaaggattcaggctccgatcttgtatttacacttgtgtattctgctttggattgtattttggagataaggtctcactctgtcacccaggctggagtgcagtggtgcagtcatggctctctgcagccttgacctcctgggctcaagccatcctcccacctcagcctcttgagtagctgtgattgcaggtgcataccaccat

SEQ ID NO: 41611 - DNA, 260 bp, Homo sapiens
gacctcgactctcccctttgatgtgcaggaagtggggtcattcagaattgaggattgcttttaagtcatttagtgctgtcattcggagaggggagaagtaaggtctcactgcttttagaaaacattagaaatgcctacttatggctgggcgcggtggctcacgcctgtaatctcagcactttgggaggccgaagtgggtggatcacttgaggacaggagttggagaccagcttggccaacatggtgaaaccgtcgatctg

SEQ ID NO: 41612 - DNA, 216 bp, Homo sapiens
aactaattcattttggttaactgaaattttgtacctgctgaatagtaattcccagttaccccctctttttagtccctagtaactaccattctactctctgcatttaagagttttactgttttacattcatcatataaaagaatcatacagtattggtgtaaggttcttgtatcagttcgaacaccaagagtgcgccagcagacaacacaaggcagt

SEQ ID NO: 41613 - DNA, 401 bp, Homo sapiens
cacctcggcctcccaaagtcctgggattacaggtgtgagccaggcctgtaccaggcctgttatttgttatttactccatcatttattaggataatgaacctttttccagtgaaacacttccagataattctatgcagaagtaccgctttcttgtaactctgattaactcaagaaacggtagtaaatgaatatttttaggaaagcttttttcccaacagatttaccaatgcttttctcaaattgggtgtgtatgtgtgtgtgttttaatgaatttgatccaaaatcaaaatcaaaacaaaacaaaacaaaaaaactaccctttgccaagtgacctcagggtccactgacttaattaaacatttaatcattgaaatattttaaaatgtcaaaacttcggcaac

SEQ ID NO: 41614 - DNA, 484 bp, Homo sapiens
tgtatatgtgtgtgtgtttttgtttgtttcaggtaacaactgatgttggaactatgaaaagctcttctctacttttaacaaagcttagtcacaaacagttccccagttgacgagaacaactaaaacaacagaacaattgaaagtccaaatttgaaagctccatctccgagaagcaaattttacagccactccagatttgtattccaaatggatagtttgattataaaaatcacatcccttcagcctgcaaatgtgataactgcccaagagacagtgatgcctacatccatagataatcccctttcccccaacctatatataactggagtcaacagcagctggaggaaaatggcaaggacttgtaatcaagattaagttagaaaaacactgctgtagactgtttatcagctcttcagcatatgtccgttttccttgaaggatgagcgtttagaaacctctgacaataaagtttattttacacaca

SEQ ID NO: 41615 - DNA, 419 bp, Homo sapiens
aactttattgttgatcaacacaataaagtctatgtatggcaatcccacagctaacatcatacttgatggtgaaaatgatgaaaagttgaaaactttttctctaagatcaggaacatgacaagggggctcattttgccacttctcaacatcataaaggaagttctagccagagcaatgaagcaagaaaaagaaacaaaagtcacctaaatcagaatgaaagaagttaaattgtttttgtttgcagacaacatggttttatacatagaaaaccctaaatattccaccaaaaaactgttaaactaataaattgggtaacgttgcagaatacaaaattgatatataaaagcccatagcatttctgtatgttaacaatctgcaaaagatatcaggcaatcccattatttatttatttatttctc

SEQ ID NO: 41616 - DNA, 747 bp, Homo sapiens
atggaaggggccacctcagacttcagttttataacattggcccctgcaaatgctcactcagttgataagcttcccataacttagcatccacatagttgagcttcacatggggtcaaactggaaagtatctctttgctatgctcccatttaattaaattaggaaatctgcctaaaacttgaatcactcctcttttcagctggtggccaggcaggaatgctccctgaagagtactctttcaatagacttcagaatgtgttacctgaaaagtgctccatggatgaatcaagacatcactgtgttttccatacttctgaagtagagattgtccactaacagcttagggaaagcagagtacccgctcagctgctctttttctggtgtggtcagaccagctgggtcctctgaaacatgaatccatagtgcttcctttgttatactatttctgactcagttttctctaaacggctgtaaaatttaactgcctagctgtattttctttctgtggactttatgctctcatatttaggagaaagaataagagaacaccaacttacatctctgtagctctggatgattattaaggccctggtctaatgcttaaaggtaagcatctgttatctatattcaataaaagaggaaaatgaaccccagagagaaatcaagttactttagaatcgcaggctgtcccatgaccctggtgaccatcactgaattattaaacctgaccattcattgtgtgaaattat

SEQ ID NO: 41617 - DNA, 514 bp, Homo sapiens
cttcattttgtaaacatagtcatttcttcattaaattctccaaatcactcactcatttgagcgttccatttgtttcttgctgggaacctgatacaggctgtttggctctgaagtcttcctctttccactcttctacaccccctcatttcaccttcctcacataataattgtgatgatggtgatgatgacgatggcaatgataccaagacacttactgtatgagcacttattataggcaaggtgttgtgctgagaactttacataaatgatcttatttaatttccacaactaccctatgcattaggcactgcttcactcccattttgcagggaggaaaatgaatttcagaaattaagtaattgaccccagcagaaccggtaaatgttggtgctgagatatgagcaatactcactccttctaccaggcatcagggccatcatcacacaatattttcccagctaaatgtgtgagtaaaattcttgaaaataaagatgtcgaaaagtcatgttactta

SEQ ID NO: 41618 - DNA, 585 bp, Homo sapiens
tgatgcgaagaatttttttaaatgccattaagtttgaggttttaaagtgtgttctgatgttttaagctgaaaagctgattggtactaaaagcattctctagtatccataaaagcatatgttttttccatcctatctttataagacttacatggttaatatatgactctcatacatattgctcaaatgaaacagaatagaattactatttttgggtgatgggtctataactaaagccttggaaaatctaccctgataccctgttaagagataacagttgtttctacaatgaagtacccaatatctgcctcgtatagcataatccccattatccctgcacctgagaggcttgaagcttggaaaatgttcatgaactgatttcaatatcactagatatcattggctggctagcaacacagtaggaatcgtgcaggatcctttctgaagaaattataaaagaaaatgggccaggcgcagtggcttatgcctgtaatcccagcactttgggaggccgaggaggccggatcatgaggtcaggagatcgagaccatcctggctaacacggtgaaaccctgtctctactaaaa

SEQ ID NO: 41619 - DNA, 581 bp, Homo sapiens
ctgattctaagaactgcattacgggaggtccacctggcacctcagggagatgggaggctctgaggcctgggccttctgaagcacctccctgtggggcagttgggactgaaggattgaagaatacatcttccttcctgtcactcctcttagctgttaactgtcattgccctggaaacgtccccatttccatcgttgggcctaagagagtcggccgaggcagccaagcccggggaacacatagttgaggctggaggaggcctggcagcagcccttccgagccctggcttggccttccttctgtgcctctgcatgggcttgggaggagggtgtgtttagggcaggctgcgaggaggggaaggggaaatctgcaggcagataattgagttctttgagttggagggaccatggaaagtggagaaggggccaggagggcatagagcgaaaaaagaaaaagaaaaaaaaaaaagaccatctggcatagtctgcagagatttgtctttaaagcctatgggaaaacttgcattagtgtgtgccttctcctggggaggcaggggctggggaggctaggcatttgtttcatc

SEQ ID NO: 41620 - DNA, 451 bp, Homo sapiens
ctgattctaagaactgcattacgggaggtccacctggcacctcagggagatgggaggctctgaggcctgggccttctgaagcacctccctgtggggcagttgggactgaaggattgaagaatacatcttccttcctgtcactcctcttagctgttaactgtcattgccctggaaacgtccccatttccatcgttgggcctaagagagtcggccgaggcagccaagcccggggaacacatagttgaggctggaggaggcctggcagcagcccttccgagccctggccagcccctacgtccagcactgaccgtattcgcatgggagacgtgtgctcccaccccaatcatctatcagggtacagagagatgggcatgaagagtatccatttctgtcagaagtacatggcacggtaagtggaaaattgttccttccggaatagaattagaacatg

SEQ ID NO: 41621 - DNA, 1174 bp, Homo sapiens
gatggcaacaggatagaatcacactcaaacacaggaaagctgtaagaaaaagaaaaactcctaatctgctctttcaccttacttattttacagaaggagaaagccaaaaaggggagagcatgtggctaaaccacagaaagactagatgcctaaaggaaaaattttaaagtgttcctaaataggtattagaaggggaagggggatgtaaagcttatgtgatttacatcattttgttaatctgctaatctacttccctggaaggtgagaaagagtgttgtctgccttctgcaattgaagagactagggcagaaacttaattatgttcttaccctgtgtatacctggctgtcatctggctggcaactagtccacaaactattggttcaggcatttgcctggcaataatgttagccatcatttaaattgttaaatatggatcagaagatctctaagaattactgatatgcagctattaatactggatgtaaataatattatttggggtgtgggtaaatcatttgactggaaccacatttaaaaaaaggacttggaaattttatttttgaaatgctgttggggagatggcattgatgaaaaaaaaaattgaaaatggaaaaaaacatcatctacaaagagatgggtaaaaatgactaagcaaagaagccttgtcaccttcgacctgatgcttcattgtatcagaagaaagtaaacagattgctaacaaagagaccaccccttctaatttccaaaaccggcccagcaacaagagggagaaaatagagaagagtgcactgcgtggtggctcagggtgatcctttaatttgagtgttaaaaatgagggcacagacctagaggtttttaatggtccgcgggtggacttcagattctgaacactcctccaccttctgtggagaattcgggacacggtggagtttaaccagtatcttaaatcccagggacagggtggagattgctttgtgatcctgattaattaaaaggaaagaaatcaaagcagacatctctcctttttccatttgagccgcagagccatggaggggaacttgtgctctctggtgcttgcagctatgttccctggctttcatcgtcttggcttttccccttgtatttctaatgctgtgataccaggccaataaaatggaatctacaaaactgca

SEQ ID NO: 41622 - DNA, 859 bp, Homo sapiens
  misc_feature (838)..(838): n is a, c, g, or t
gactctgtgcgactatgggtgtgtgtgagtgctgggatatgactgggtgttgaactgggaacatgcatgtggccttctgtgcatgtcaagtttcctcctcacacagcagggcctctgatgaagcagctgtgcatcttcccatgtgtgtcaatgtggatgccaggtggcagaactggtgtgaatcttggggactgtgagttatcaatgactcatttgtgagcattaatgagagcagaaagcatgctctctagatgcctcttcccaagcagagtgggaaagaggaatgcagatcataggagtgatgtttcctcaggtaggttctgcacacagtgaccaccatctcctgtctttcagcctcatgtctcttcctggctcccaccaaagcctgcccttcttattgtgggtctggagagtttgcagatcctggctctctaaggaagagcattagagtctgtggtttcggatactaaatcaccctaaaccaggaaggaacaagtgtagcctcagttcagacagagtttacagtggatattaatcatcagagtagctgggttcactggctcatgcccataatcccagcactttgtcaagcaaagatgggaaaataacttgaggccagaggtttgagaccagcctgggcaatatagtgagatgctgtgtttacaaaaacttttaagtatcagacaggcattgtggcaggcctctttcatcacagctactcaggaggccaaggcatgaggatcccttcagcacaggagtttgtggctttgtgagctattggtgcaccactgcatgtcagcctgggtgacagagtgagatcatgtttcaaaaaggaggnaaaattatacacttgtaggtc

SEQ ID NO: 41623 - DNA, 852 bp, Homo sapiens
actggactgaaataagcatttgaactatgttgggccaatccaattcttccctcttggaatctgaaattgggattggagacaggtagtaaatcaggaaggtgtggggcagtcatgaatggagaagcagagacagcaatctgtaaagggaaaactgtgaagcagatgtgcaggattcaggattgcaattgtccacaaagcccgagtgcacttccgaactgcgggttctatggtagacccaattatcccggtagcagccacacccccttctacttagactagcgtaagtgggtttctgttaatcggggaaaagaaaggatcttgactaagacaaccacatactgccttctaatatcctgcgatagtggaggctaaatttaaattgtctgaatacagtgtgaagtttggatgtgataatcacccagtttgtgtaatcatggcggacacccaaaatggtggctcaaacaatatgcgcacttcaaaccgtgtggatcctaaagacatctacgtttatctattagtagaatcacctgatctccactcactgctcacagggcggacccacctcaggcaggtagagcaaggtaatccatattactttccattacctagctggcagtggactcaagagtttgtggaaaaagatcccttgtggtttttgaattatttaccattcaaagtcatgaaaattcaaatgcaggcagctttattttcagaaagttgcttaaaaatcaatctctaaacattattttgattttacttttgagctttctttatccagaatactttttttaaagatacatactttctgttatttttgaatccatgtattctcagtaaaaccaaaatcaaaca

SEQ ID NO: 41624 - DNA, 408 bp, Homo sapiens
actaaggacttaccttgcaagaagggcaaaatttgaaacagacctaccacagtgtgtaaacaatgcctttgtaagtttaaagtaattcatcggtaattcagtggaatgctagaacaaaaagtaatactcttgagagtaaaataatagaatccagagattctataatacatctatagcatccagtataaaaaaaatactagacatgtgaatgaacccatagtcaagagaaaaagccgtcaccaaaacaggttccaagatggaattcacagacaagggctttaaagacactattagaaatatgtgtatgaacttaaaggaaaagatggtttaatgaatgaacagatagtggttctcagctgagacatgagaagtagaaaaaagaaacaatggaaatcctggaactacaaa

SEQ ID NO: 41625 - DNA, 1059 bp, Homo sapiens
tgggaggccgaggctggcggatcatgaggtcaggagttcgataccagcctggccaatatggggaaaccccctctctactaaaaaatacaaaaattatccgggtgtggtggcacgcacctgtagttccagctactcaggaggctgaggcaggagaattgcttgaacctgggaggcggagggtgcagttagccgagatcgtgccactgcactctagcctgggcaacagagtgagactgcatctcaaaaaaataaaataaaatttaaactaaaacagattaaatacaacaaagccagtctaaatttttgattgtgtgcttggtattttgctgaaactaaatttccaatgtatttggaatatggcagcaattgttaaaagttgagggagtttttgagtttgtcaagtaaacactcccctaggccatgtggtggctcagttccccttttaagagtaaactatgaggtcactaagtttccagagtcatagatacaatcacattttaagttcagctccattcttttctcattttcttggacagttggagtaacctgctgagtctttgtcaaagaaagctcagatgcagaacccacatagcactacttagatgcaacgtggtgattcagattccccagaatatgcttatatttgcctttgagataaccactgaagtgaaaacaaaacatttaaaagttttgagtacagatctcatgaatctatcagcagtaagctaaggcatgtgtactagtcctggaggggagaagaggcaagtggaaacttaaaacagataattctggccctacagggtggctcttgcctgtaatcccagcactttgggaagccaaggtgggaagatcgcttgaggccaggagtttgagaccggcctgggcaacatagcaaaaccccgtctctaaaataataaatctacacctgtagtcccacctactccagaggctgaggggaggatcacttgacctccaggaggtcaaaaccacagggacctttgatggcaccacagtgagctttgatggcgccactgggtgactgagggagaccctgtctca

SEQ ID NO: 41626 - DNA, 719 bp, Homo sapiens
aagcagtggtatcaacgcagagtgcccattatggccgggagggagtttttgagtttgtcaagtaaacactcccctaggccatgtggtggctcagttccccttttaagagtaaactatgaggtcactaagtttccagagtcatagatacaatcacattttaagttcagctccattcttttctcattttcttggacagttggagtaacctgctgagtctttgtcaaagaaagctcagatgcagaacccacatagcactacttagatgcaacgtggtgattcagattccccagaatatgcttatatttgcctttgagataaccactgaagtgaaaacaaaacatttaaaagttttgagtacagatctcatgaatctatcagcagtaagctaaggcatgtgtactagtcctggaggggagaagaggcaagtggaaacttaaaacagataattctggccctacagggtggctcttgcctgtaatcccagcactttgggaagccaaggtgggaagatcgcttgaggccaggagtttgagaccggcctgggcaacatagcaaaaccccgtctctaaaataataaatctacacctgtagtcccacctactccagaggctgaggggaggatcacttgacctccaggaggtcaaaaccacagggacctttgatggcaccacagtgagctttgatggcgccactgggtgactgagggagaccctgtctca

SEQ ID NO: 41627 - DNA, 303 bp, Homo sapiens
gacagagcaagactccatctcaaaaaaaaaaaaaaaaagtaaaaataaaaaataaaaaaatagaaacacattgtaaaaggagaggattgtaaaagcaatcaaatgataactgaaggaaagaatgctcgtatcctagtgcattataatacttgaggttcataatgatgacccttaattagtaaggaaagattggatttgctgcatcctagagtagagaacatttttagttatttggaattatatagacttggtgctcccccccaagacccccaccgcaagacggagtcttgctctgtcacccag

SEQ ID NO: 41628 - DNA, 404 bp, Homo sapiens
acatactaagttccaattattcctaattaaaataaattaaaaatcagtaccttaataatgtattcaggaaaatatcctttaatttactgaagttcaagaagagtgtaagaaagatataagtatgaacttttcccctcaacatttctctaattctgatttggtacaataacatagacaatcctagcttaatacagaaatgtgccaggcgcagtggctcatgcctgtaatcccagcctacaaaagctgttttgaaaaattagcccggtgtggtggtgtgtgcctgcagccctacctactcaagaggctgaggtgggagaatcgcttgagccgggagttccaggctgcagtgagctatgatgctgccactgcactccagcttgggccacagaatgagactctcttta

SEQ ID NO: 41629 - DNA, 519 bp, Homo sapiens
ttgactaagttctgtcagttttgcgctcctaaatatctctcacatccattcatttctcttcatttcctcttttaccttttcagattaagatactgcctagactaatagcctcctaactgatcttcatatatccattctttcctcttctgaatcagttctcccattttagtgtgagtttttataaaatgtaaatcctggctgggcacagttgctcatgcctgtaatccctgcactttgggagcctgaggtgcacagatcacttgatcccaggagttccggaccagcctggacagcataatgagactccatccccattaaaaaaaaaaaaaaattaacccaatcatgttgtcactcttcttaaagccattcagtggcctccctttgctcttaggataaaagccaaaatcctttatgtcgcctacaatgcctagtagaatgtggctgtgtctccttctctagtctgttatactgtgggactccactttgttctctcctatcaccacccttcttctgtgtctt

SEQ ID NO: 41630 - DNA, 352 bp, Homo sapiens
gaaggacagaatgtgtcagaaatgatgctgtgtgatttccaaggtgaggttagaaaacatggcaaggtttccacctgcttctctctctctctctcacttgggacgtgcacctttggagccctgagctgccgtacaagaagtctagctccctggacaccccataatacagaggccatgtagaggggtttagaccacatagcaatagaggtgacagtggaaccccagctgagtaaatgaaccttcacgtgctttgactcccccacctccatgaccccaccccacactcccacttttttgagccatcccagtgaaagccaaatggagcagatatgagcagttcctgcggcgctct

SEQ ID NO: 41631 - DNA, 430 bp, Homo sapiens
gcatcagtgaattccacaaagcttcaggatacaagatcaacaaacaattggttttatttctatacactaacaacgaacaatctgtaacgaaattaagaaaaaaatttcatttacaatatcaatagtaaaaatactggggaatctggacatggtggatcatgcctgtaatcccagcactctgggaggcccaggtgggaggattacttgaactcagagttcgagaacagcctgggccacatagcgaaacccctgtctctacaaaaaatacaaaaatttagccaggtgtggtggtgtgtgcctgtagtcccagctacaaaggaggctgaggtgggaggatgccttgagcctgggagacagaggttacagtgagccaagatggcaccactgcactccaccctgggcaacaaagccaggtcctgtctcaaaaaca

SEQ ID NO: 41632 - DNA, 508 bp, Homo sapiens
accacatactactccacttcctctgccatctttcatctcctcctgccttgtacaaaaaaggcagcatttcttcttggcttcaactttattttagccaggatacttcacaaccagaagtgaattactgtttcaaatataaataatcctcatgaatttcagcatgcatgatgggtatttatgcagtcttagcaggccgagtcactgttgccaaattatcaggcacctacttgagtccttgttcacttgtttgtagacgcaaaatgatagataacttgtcccctgccttttaagagcttaaaagcttaatagaggagtcagtagagttacagaaatagaaactagctatgaattggattgtatcactggaagtatgtccaaccttccttttgctacaaacaaagaatgcctagggattcaactttttcatgtgttagagaatcagaatgtttaaaatactgagatgcttttcttctttaataaaaatctaattcttaagaaatcctgatta

SEQ ID NO: 41633 - DNA, 656 bp, Homo sapiens
gaccaaacttcactagtgcattaatcagcattactgaccaaaatgaatgcaccaagagtggattcaatttttgttcaaaataatccaaccagcttcctgccaccactttctgagaagccactagaaaaaaatcaatgtgtctggggttgggcaggcttctactgcacataaactaaatggggtttaaaacaacaatgaaaaataggtgcccatttgtacttaagtatacttctctctttttcttgctatcttttacaatttctggataatctcagaaatactcaggttttaaactaaaacaatacagagaaataatgctttagatagtagctaatatgctctcttcttcaaaagtgaatgctcatccactagacacaatgctaacatgaaagcgcatagattatttttttaattctcagatactttggttctctgaggcggagaaccagcatcaaggcctctgaatacaacaagcacaggcttgatgaggggcttgggaggtaagaaggtgcttttgccattcatagttacatgtaaatatggacaggttaggcatttgcttttaaggtattatggaaaagcacacttaacctttacagtatttctcctactgatctcccagtctttacacatcttcttgggtaaaggcaaatgtt

SEQ ID NO: 41634 - DNA, 691 bp, Homo sapiens
gcatgtttcagtgcagccacaaaataaggccacaggtgaaggcctgatgggaagcacagaagatactgtggcccacacttggctggactacctgttaaaagtggcctccgtcactttccacagtgaccatgccttgcctgctgccccgtccctgcaaccaacctggctttgtggccttctgctcatctatgcattgcaggactgaagaagctttatagatgtgtccgttacacttcatcacattaaggaaggaaattgtgtgatacagggattttgcaagaattaccaaagttctctggatggatccctgatgagggcttgacagtgcctgtcctcgaaatgcaggttaaccgctgtgtcctttgttagaggacttggccccgcactaagcatgctgagtttcatccactgatgttctcactcatgtggagagtatttgtggtgcatcctgggaaacgcaattgcaggtagctttctgagccgactagcaatctaaactgagcccacggtgatgagattttcttcaacgccactctttgggatgctgctgacttgtgatgaaatgggcagggaacccttatggatttaaagctgcaactctgaatgcctcagtcccgaggagtcctcagcctgggcattgcaggaaccaagcccctttcacctccacggggtcagagatcagattgtatca

SEQ ID NO: 41635 - DNA, 488 bp, Homo sapiens
aactcttgatcaaaaatggaaagaaaaaaaccagtgaaacaggctaggtagtttgtggaattctcctttgcaggtgaggggagaaagcagctatctcaagggcacagctacagattgggagctggggcttccatccagggtctgggacacccaaaccttaggcttgcccctcccgggaggcctccccctcagagctatgtgggatgcagttgcctttttacctgtgatgagaaactggtgaattgccaggattctggctctggcttcagtctgcccctttccggggattagagggcattaaccctacttcctacagccaagcagctcttcctcatgactctactttctaactccgggggttgactgattgatttgaagaccgccttgttgatgaatgtgttgaaacttgctatcataatgtaaatgctccttaataaaataacaggacctggtgggttcagttgccttgcccacgtgtgaaaaaaaaa

SEQ ID NO: 41636 - DNA, 321 bp, Homo sapiens
taatatttaatgtctgcatttgattcagagagatatttttcagccctatcaaatttgaaagtagcttagaattagaaaattcttcctagcaggagtttgcctcaccagctgctgtctcctaaacctgttcagtagagtcatatttcatagagctgcctcttagatttttactttgcatggcttaattccacttctcattatctcccatctatagttctttcgatctgtaactacactccaatccactagaattctacaagctaaaataacattttatacccccctgccccaatttataaaatacattttataggcagttgc

SEQ ID NO: 41637 - DNA, 1878 bp, Homo sapiens
ggcgtgagccactgcgcccggcccaaacttgtctgtctttatctctacttacagtgagtgtcaggtcaccctcttggagaccggtgatcagaggctgatgacctctcacagctgctggccctggggacctaggggatccctttgggaatcccaggtcaaccgggtgccagctccattgctctggctgtgtgggtggtggtgggtggtgaggcacatagaaagtcaccagcgccagggaagggcagctcagaaatcctggtcatgccaagtgccactcagggctattctcactctagtgagtgctcattggttcttcccgaagtccagagggaaggacaccatcgggggcgctgtatcccacccggcaccattagcccctgccacccaccacccagcagctggattcccacgggagttgcgggtgggggcggaaccggctgaggtctgggggcggggcgtccgggcgcggggcggggctggcgggaatgtgcgcacccccgcgcggggccccgcccgagcatcccgcgccgacggggctgtgccggagcagctgtgcagagctgcaggcgcgcgtcatggctgctttgagacagccccaggtcgcggagctgctggccgaggcccggcgagccttccgggaggagttcggggccgagcccgagctggccgtgtcagcgccgggccgcgtcaacctcatcggggaacacacggactacaaccagggcctggtgctgcctatggctctggagctcatgacggtgctggtgggcagcccccgcaaggatgggctggtgtctctcctcaccacctctgagggtgccgatgagccccagcggctgcagtttccactgcccacagcccagcgctcgctggagcctgggactcctcggtgggccaactatgtcaagggagtgattcagtactacccagctgcccccctccctggcttcagtgcagtggtggtcagctcagtgcccctggggggtggcctgtccagctcagcatccttggaagtggccacgtacaccttcctccagcagctctgtccagactcgggcacaatagctgcccgcgcccaggtgtgtcagcaggccgagcacagcttcgcagggatgccctgtggcatcatggaccagttcatctcacttatgggacagaaaggccacgcgctgctcattgactgcaggtccttggagaccagcctggtgccactctcggaccccaagctggccgtgctcatcaccaactctaatgtccgccactccctggcctccagcgagtaccctgtgcggcggcgccaatgtgaagaagtggcccgggcgctgggcaaggaaagcctccgggaggtacaactggaagagctagaggctgccagggacctggtgagcaaagagggcttccggcgggcccggcacgtggtgggggagattcggcgcacggcccaggcagcggccgccctgagacgtggcgactacagagcctttggccgcctcatggtggagagccaccgctcactcagagacgactatgaggtgagctgcccagagctggaccagctggtggaggctgcgcttgctgtgcctggggtttatggcagccgcatgacgggcggtggcttcggtggctgcacggtgacactgctggaggcctccgctgctccccacgccatgcggcacatccaggagcactacggcgggactgccaccttctacctctctcaagcagccgatggagccaaggtgctgtgcttgtgaggcacccccaggacagcacacggtgagggtgcggggcctgcaggccagtcccacggctctgtgcccggtgccatcttccatatccgggtgctcaataaacttgtgcctccaatgtggtaaaaaa

SEQ ID NO: 41638 - DNA, 1958 bp, Homo sapiens
ggcgtgagccactgcgcccggcccaaacttgtctgtctttatctctacttacagtgagtgtcaggtcaccctcttggagaccggtgatcagaggctgatgacctctcacagctgctggccctggggacctaggggatccctttgggaatcccaggtcaaccgggtgccagctccattgctctggctgtgtgggtggtggtgggtggtgaggcacatagaaagtcaccagcgccagggaagggcagctcagaaatcctggtcatgccaagtgccactcagggctattctcactctagtgagtgctcattggttcttcccgaagtccagagggaaggacaccatcgggggcgctgtatcccacccggcaccattagcccctgccacccaccacccagcagctggattcccacgggagttgcgggtgggggcggaaccggctgaggtctgggggcggggcgtccgggcgcggggcggggctggcgggaatgtgcgcacccccgcgcggggccccgcccgagcatcccgcgccgacggggctgtgccggagcagctgtgcagagctgcaggcgcgcgtcatggctgctttgagacagccccaggtcgcggagctgctggccgaggcccggcgagccttccgggaggagttcggggccgagcccgagctggccgtgtcagcgccgggccgcgtcaacctcatcggggaacacacggactacaaccagggcctggtgctgcctatggctctggagctcatgacggtgctggtgggcagcccccgcaaggatgggctggtgtctctcctcaccacctctgagggtgccgatgagccccagcggctgcagtttccactgcccacagcccagcgctcgctggagcctgggactcctcggtgggccaactatgtcaagggagtgattcagtactacccagctgcccccctccctggcttcagtgcagtggtggtcagctcagtgcccctggggggtggcctgtccagctcagcatccttggaagtggccacgtacaccttcctccagcagctctgtccagactcgggcacaatagctgcccgcgcccaggtgtgtcagcaggccgagcacagcttcgcagggatgccctgtggcatcatggaccagttcatctcacttatgggacagaaaggccacgcgctgctcattgactgcaggtccttggagaccagcctggtgccactctcggaccccaagctggccgtgctcatcaccaactctaatgtccgccactccctggcctccagcgagtaccctgtgcggcggcgccaatgtgaagaagtggcccgggcgctgggcaaggaaagcctccgggaggtacaactggaagagctagaggctgccagggacctggtgagcaaagagggcttccggcgggcccggcacgtggtgggggagattcggcgcacggcccaggcagcggccgccctgagacgtggcgactacagagcctttggccgcctcatggtggagagccaccgctcactcaggtgaggccctctgggcgccccgctcctgccgggcacaggccggcccaggcccaccccttcaatatcctctctgcagagacagacgactatgaggtgagctgcccagagctggaccagctggtggaggctgcgcttgctgtgcctggggtttatggcagccgcatgacgggcggtggcttcggtggctgcacggtgacactgctggaggcctccgctgctccccacgccatgcggcacatccaggagcactacggcgggactgccaccttctacctctctcaagcagccgatggagccaaggtgctgtgcttgtgaggcacccccaggacagcacacggtgagggtgcggggcctgcaggccagtcccacggctctgtgcccggtgccatcttccatatccgggtgctcaataaacttgtgcctccaatgtggtaaaaaa

SEQ ID NO: 41639 - DNA, 1362 bp, Homo sapiens
  misc_feature (40)..(40): n is a, c, g, or t
ggcctgcgtaagccaaagcgttggttgccaaagcaagccnttgccggggggcgcgcgtcatggctgctttgagacagccccaggtcgcggagctgctggccgaggcccggcgagccttccgggaggagttcggggccgagcccgagctggccgtgtcagcgccgggccgcgtcaacctcatcggggaacacacggactacaaccagggcctggtgctgcctatggctctggagctcatgacggtgctggtgggcagcccccgcaaggatgggctggtgtctctcctcaccacctctgagggtgccgatgagccccagcggctgcagtttccactgcccacagcccagcgctcgctggagcctgggactcctcggtgggccaactatgtcaagggagtgattcagtactacccagctgcccccctccctggcttcagtgcagtggtggtcagctcagtgcccctggggggtggcctgtccagctcagcatccttggaagtggccacgtacaccttcctccagcagctctgtccagactcgggcacaatagctgcccgcgcccaggtgtgtcagcaggccgagcacagcttcgcagggatgccctgtggcatcatggaccagttcatctcacttatgggacagaaaggccacgcgctgctcattgactgcaggtccttggagaccagcctggtgccactctcggaccccaagctggccgtgctcatcaccaactctaatgtccgccactccctggcctccagcgagtaccctgtgcggcggcgccaatgtgaagaagtggcccgggcgctgggcaaggaaagcctccgggaggtacaactggaagagctagaggctgccagggacctggtgagcaaagagggcttccggcgggcccggcacgtggtgggggagattcggcgcacggcccaggcagcggccgccctgagacgtggcgactacagagcctttggccgcctcatggtggagagccaccgctcactcagagacgactatgaggtgagctgcccagagctggaccagctggtggaggctgcgcttgctgtgcctggggtttatggcagccgcatgacgggcggtggcttcggtggctgcacggtgacactgctggaggcctccgctgctccccacgccatgcggcacatccaggagcactacggcgggactgccaccttctacctctctcaagcagccgatggagccaaggtgctgtgcttgtgaggcacccccaggacagcacacggtgagggtgcggggcctgcaggccagtcccacggctctgtgcccggtgccatcttccatatccgggtgctcaataaacttgtgcctccaatgtggtaaaaaa

SEQ ID NO: 41640 - DNA, 2335 bp, Homo sapiens
ggcgtgagccactgcgcccggcccaaacttgtctgtctttatctctacttacagtgagtgtcaggtcaccctcttggagaccggtgatcagaggctgatgacctctcacagctgctggccctggggacctaggggatccctttgggaatcccaggtcaaccgggtgccagctccattgctctggctgtgtgggtggtggtgggtggtgaggcacatagaaagtcaccagcgccagggaagggcagctcagaaatcctggtcatgccaagtgccactcagggctattctcactctagtgagtgctcattggttcttcccgaagtccagagggaaggacaccatcgggggcgctgtatcccacccggcaccattagcccctgccacccaccacccagcagctggattcccacgggagttgcgggtgggggcggaaccggctgaggtctgggggcggggcgtccgggcgcggggcggggctggcgggaatgtgcgcacccccgcgcggggccccgcccgagcatcccgcgccgacggggctgtgccggagcagctgtgcagagctgcaggcgcgcgtcatggctgctttgagacagccccaggtcgcggagctgctggccgaggcccggcgagccttccgggaggagttcggggccgagcccgagctggccgtgtcagcgccgggccgcgtcaacctcatcggggaacacacggactacaaccagggcctggtgctgcctatggctctggagctcatgacggtgctggtgggcagcccccgcaaggatgggctggtgtctctcctcaccacctctgagggtgccgatgagccccagcggctgcagtttccactgcccacagcccagcgctcgctggagcctgggactcctcggtgggccaactatgtcaagggagtgattcagtactacccaggtatggggcccaggcctgagccaagtcctcactgatactaggagtgccacctcacagccacagagcccattcatttgtctgatacactgtggggaaggcttgtagagtggagcatcccattgtacagatgaggaaactgatgcccccagaaggtcgggaacttgccctgggtttcccgtgacctgattggaggagccaggatttgaaccccagccttttttccctccagagccctaaaccaggaggacaattagaagtgtcccagcaacctcagagggtgggaaaatggagggcagtgggtcccttggcccagcaggttggtggcttctgacaattgagacacacaccctagaaacagctgctaggccgttgctgcccttcccgccaggacacctgcccttcctgtgccatcctcccaggcagcccctcttaccatcacctgttctttcccctgcagctgcccccctccctggcttcagtgcagtggtggtcagctcagtgcccctggggggtggcctgtccagctcagcatccttggaagtggccacgtacaccttcctccagcagctctgtccagactcgggcacaatagctgcccgcgcccaggtgtgtcagcaggccgagcacagcttcgcagggatgccctgtggcatcatggaccagttcatctcacttatgggacagaaaggccacgcgctgctcattgactgcaggtccttggagaccagcctggtgccactctcggaccccaagctggccgtgctcatcaccaactctaatgtccgccactccctggcctccagcgagtaccctgtgcggcggcgccaatgtgaagaagtggcccgggcgctgggcaaggaaagcctccgggaggtacaactggaagagctagaggctgccagggacctggtgagcaaagagggcttccggcgggcccggcacgtggtgggggagattcggcgcacggcccaggcagcggccgccctgagacgtggcgactacagagcctttggccgcctcatggtggagagccaccgctcactcagagacgactatgaggtgagctgcccagagctggaccagctggtggaggctgcgcttgctgtgcctggggtttatggcagccgcatgacgggcggtggcttcggtggctgcacggtgacactgctggaggcctccgctgctccccacgccatgcggcacatccaggagcactacggcgggactgccaccttctacctctctcaagcagccgatggagccaaggtgctgtgcttgtgaggcacccccaggacagcacacggtgagggtgcggggcctgcaggccagtcccacggctctgtgcccggtgccatcttccatatccgggtgctcaataaacttgtgcctccaatgtggtaaaaaa

SEQ ID NO: 41641 - DNA, 1910 bp, Homo sapiens
ggcgtgagccactgcgcccggcccaaacttgtctgtctttatctctacttacagtgagtgtcaggtcaccctcttggagaccggtgatcagaggctgatgacctctcacagctgctggccctggggacctaggggatccctttgggaatcccaggtcaaccgggtgccagctccattgctctggctgtgtgggtggtggtgggtggtgaggcacatagaaagtcaccagcgccagggaagggcagctcagaaatcctggtcatgccaagtgccactcagggctattctcactctagtgagtgctcattggttcttcccgaagtccagagggaaggacaccatcgggggcgctgtatcccacccggcaccattagcccctgccacccaccacccagcagctggattcccacgggagttgcgggtgggggcggaaccggctgaggtctgggggcggggcgtccgggcgcggggcggggctggcgggaatgtgcgcacccccgcgcggggccccgcccgagcatcccgcgccgacggggctgtgccggagcagctgtgcagagctgcaggcgcgcgtcatggctgctttgagacagccccaggtcgcggagctgctggccgaggcccggcgagccttccgggaggagttcggggccgagcccgagctggccgtgtcagcgccgggccgcgtcaacctcatcggggaacacacggactacaaccagggcctggtgctgcctatggctctggagctcatgacggtgctggtgggcagcccccgcaaggatgggctggtgtctctcctcaccacctctgagggtgccgatgagccccagcggctgcagtttccactgcccacagcccagcgctcgctggagcctgggactcctcggtgggccaactatgtcaagggagtgattcagtactacccagctgcccccctccctggcttcagtgcagtggtggtcagctcagtgcccctggggggtggcctgtccagctcagcatccttggaagtggccacgtacaccttcctccagcagctctgtccagccctagcctccccacctcaccctgtactgcagactcgggcacaatagctgcccgcgcccaggtgtgtcagcaggccgagcacagcttcgcagggatgccctgtggcatcatggaccagttcatctcacttatgggacagaaaggccacgcgctgctcattgactgcaggtccttggagaccagcctggtgccactctcggaccccaagctggccgtgctcatcaccaactctaatgtccgccactccctggcctccagcgagtaccctgtgcggcggcgccaatgtgaagaagtggcccgggcgctgggcaaggaaagcctccgggaggtacaactggaagagctagaggctgccagggacctggtgagcaaagagggcttccggcgggcccggcacgtggtgggggagattcggcgcacggcccaggcagcggccgccctgagacgtggcgactacagagcctttggccgcctcatggtggagagccaccgctcactcagagacgactatgaggtgagctgcccagagctggaccagctggtggaggctgcgcttgctgtgcctggggtttatggcagccgcatgacgggcggtggcttcggtggctgcacggtgacactgctggaggcctccgctgctccccacgccatgcggcacatccaggagcactacggcgggactgccaccttctacctctctcaagcagccgatggagccaaggtgctgtgcttgtgaggcacccccaggacagcacacggtgagggtgcggggcctgcaggccagtcccacggctctgtgcccggtgccatcttccatatccgggtgctcaataaacttgtgcctccaatgtggtaaaaaa

SEQ ID NO: 41642 - DNA, 1821 bp, Homo sapiens
ggcgtgagccactgcgcccggcccaaacttgtctgtctttatctctacttacagtgagtgtcaggtcaccctcttggagaccggtgatcagaggctgatgacctctcacagctgctggccctggggacctaggggatccctttgggaatcccaggtcaaccgggtgccagctccattgctctggctgtgtgggtggtggtgggtggtgaggcacatagaaagtcaccagcgccagggaagggcagctcagaaatcctggtcatgccaagtgccactcagggctattctcactctagtgagtgctcattggttcttcccgaagtccagagggaaggacaccatcgggggcgctgtatcccacccggcaccattagcccctgccacccaccacccagcagctggattcccacgggagttgcgggtgggggcggaaccggctgaggtctgggggcggggcgtccgggcgcggggcggggctggcgggaatgtgcgcacccccgcgcggggccccgcccgagcatcccgcgccgacggggctgtgccggagcagctgtgcagagctgcaggcgcgcgtcatggctgctttgagacagccccaggtcgcggagctgctggccgaggcccggcgagccttccgggaggagttcggggccgagcccgagctggccgtgtcagcgccgggccgcgtcaacctcatcggggaacacacggactacaaccagggcctggtgctgcctatggctctggagctcatgacggtgctggtgggcagcccccgcaaggatgggctggtgtctctcctcaccacctctgagggtgccgatgagccccagcggctgcagtttccactgcccacagcccagcgctcgctggagcctgggactcctcggtgggccaactatgtcaagggagtgattcagtactacccagctgcccccctccctggcttcagtgcagtggtggtcagctcacatccttggaagtggccacgtacaccttcctccagcagctctgtccagactcgggcacaatagctgcccgcgcccaggtgtgtcagcaggccgagcacagcttcgcagggatgccctgtggcatcatggaccagttcatctcacttatgggacagaaaggccacgcgctgctcattgactgcagtctcggaccccaagctggccgtgctcatcaccaactctaatgtccgccactccctggcctccagcgagtaccctgtgcggcggcgccaatgtgaagaagtggcccgggcgctgggcaaggaaagcctccgggaggtacaactggaagagctagaggctgccagggacctggtgagcaaagagggcttccggcgggcccggcacgtggtgggggagattcggcgcacggcccaggcagcggccgccctgagacgtggcgactacagagcctttggccgcctcatggtggagagccaccgctcactcagagacgactatgaggtgagctgcccagagctggaccagctggtggaggctgcgcttgctgtgcctggggtttatggcagccgcatgacgggcggtggcttcggtggctgcacggtgacactgctggaggcctccgctgctccccacgccatgcggcacatccaggagcactacggcgggactgccaccttctacctctctcaagcagccgatggagccaaggtgctgtgcttgtgaggcacccccaggacagcacacggtgagggtgcggggcctgcaggccagtcccacggctctgtgcccggtgccatcttccatatccgggtgctcaataaacttgtgcctccaatgtggtaaaaaa

SEQ ID NO: 41643 - DNA, 1384 bp, Homo sapiens
ggcgtgagccactgcgcccggcccaaacttgtctgtctttatctctacttacagtgagtgtcaggtcaccctcttggagaccggtgatcagaggctgatgacctctcacagctgctggccctggggacctaggggatccctttgggaatcccaggtcaaccgggtgccagctccattgctctggctgtgtgggtggtggtgggtggtgaggcacatagaaagtcaccagcgccagggaagggcagctcagaaatcctggtcatgccaagtgccactcagggctattctcactctagtgagtgctcattggttcttcccgaagtccagagggaaggacaccatcgggggcgctgtatcccacccggcaccattagcccctgccacccaccacccagcagctggattcccacgggagttgcgggtgggggcggaaccggctgaggtctgggggcggggcgtccgggcgcggggcggggctggcgggaatgtgcgcacccccgcgcggggccccgcccgagcatcccgcgccgacggggctgtgccggagcagctgtgcagagctgcaggcgcgcgtcatggctgctttgagacagccccaggtcgcggagctgctggccgaggcccggcgagccttccgggaggagttcggggccgagcccgagctggccgtgtcagcgccgggccgcgtcaacctcatcggggaacacacggactacaaccagggcctggtgctgcctatggtgaggggctgcacggggagcccctagcccgccgccgcctgtcccggccgccgaggagggcgggcctcggggacgctgggggcgagttcttcccgcgggagatgtggggcgggcagctgcgcctggagcaccggtgcacggaagagtccccgggacaggctgttccccacgttggaagggaggaagcgaggaagtggccgggagagggtgcgcggccgcctcttggctcaagcccgccctctgggggctggggctcctcgccttcaacctgggagcatgttccccttaaactgtgaggccctgtgtgccacgcagaaggggacactccgcgcctccggccaccgtggggccccaaccgcagacctgggcgaacgtagccttctggcccagcccgttcaatttacagaggaggaaactgaggcctagagaggcccagtgaactgctggaggtcacacagcaggttcttggcggggctgcgacttgggagtgaggactcccagctttcagcggggggcgctttccgccccatctgcagcttggggagtgcacaggtacaggatgtccagagccaccccaaaatgtaaaggctttggagctccagtgatctgttttccctttgggctagctctcccccttgccccac

SEQ ID NO: 41644 - DNA, 1752 bp, Homo sapiens
ggcgtgagccactgcgcccggcccaaacttgtctgtctttatctctacttacagtgagtgtcaggtcaccctcttggagaccggtgatcagaggctgatgacctctcacagctgctggccctggggacctaggggatccctttgggaatcccaggtcaaccgggtgccagctccattgctctggctgtgtgggtggtggtgggtggtgaggcacatagaaagtcaccagcgccagggaagggcagctcagaaatcctggtcatgccaagtgccactcagggctattctcactctagtgagtgctcattggttcttcccgaagtccagagggaaggacaccatcgggggcgctgtatcccacccggcaccattagcccctgccacccaccacccagcagctggattcccacgggagttgcgggtgggggcggaaccggctgaggtctgggggcggggcgtccgggcgcggggcggggctggcgggaatgtgcgcacccccgcgcggggccccgcccgagcatcccgcgccgacggggctgtgccggagcagctgtgcagagctgcaggcgcgcgtcatggctgctttgagacagccccaggtcgcggagctgctggccgaggcccggcgagccttccgggaggagttcggggccgagcccgagctggccgtgtcagcgccgggccgcgtcaacctcatcggggaacacacggactacaaccagggcctggtgctgcctatggctctggagctcatgacggtgctggtgggcagcccccgcaaggatgggctggtgtctctcctcaccacctctgagggtgccgatgagccccagcggctgcagtttccactgcccacagcccagcgctcgctggagcctgggactcctcggtgggccaactatgtcaagggagtgattcagtactacccagctgcccccctccctggcttcagtgcagtggtggtcagctcagtgcccctggggggtggcctgtccagctcagcatccttggaagtggccacgtacaccttcctccagcagctctgtccagactcgggcacaatagctgcccgcgcccaggtgtgtcagcaggccgagcacagcttcgcagggatgccctgtggcatcatggaccagttcatctcacttatgggacagaaaggccacgcgctgctcattgactgcaggtccttggagaccagcctggtgccactctcggaccccaagctggccgtgctcatcaccaactctaatgtccgccactccctggcctccagcgagtaccctgtgcggcggcgccaatgtgaagaagtggcccgggcgctgggcaaggaaagcctccgggaggtacaactggaagagctagaggctgccagggacctggtgagcaaagagggcttccggcgggcccggcacgtggtgggggagattcggcgcacggcccaggcagcggccgccctgagacgtggcgactacagagcctttggccgcctcatggtggagagccaccgctcactcaggtgaggccctctgggcgccccgctcctgccgggcacaggccggcccaggcccaccccttcaatatcctctctgcagagacgagcactacggcgggactgccaccttctacctctctcaagcagccgatggagccaaggtgctgtgcttgtgaggcacccccaggacagcacacgacggagtctggctctgtcaccctgtctggagtgcggtaacacgatctcggttcactgca

SEQ ID NO: 41645 - DNA, 1199 bp, Homo sapiens
aactcaggggcgagctgctaactcaggggcgagctgctaactcaggggcgagctgcctatggctctggagctcatgacggtgctggtgggcagcccccgcaaggatgggctggtgtctctcctcaccacctctgagggtgccgatgagccccagcggctgcagtttccactgcccacagcccagcgctcgctggagcctgggactcctcggtgggccaactatgtcaagggagtgattcagtactacccagctgcccccctccctggcttcagtgcagtggtggtcagctcagtgcccctggggggtggcctgtccagctcagcatccttggaagtggccacgtacaccttcctccagcagctctgtccagactcgggcacaatagctgcccgcgcccaggtgtgtcagcaggccgagcacagcttcgcagggatgccctgtggcatcatggaccagttcatctcacttatgggacagaaaggccacgcgctgctcattgactgcaggtccttggagaccagcctggtgccactctcggaccccaagctggccgtgctcatcaccaactctaatgtccgccactccctggcctccagcgagtaccctgtgcggcggcgccaatgtgaagaagtggcccgggcgctgggcaaggaaagcctccgggaggtacaactggaagagctagaggctgccagggacctggtgagcaaagagggcttccggcgggcccggcacgtggtgggggagattcggcgcacggcccaggcagcggccgccctgagacgtggcgactacagagcctttggccgcctcatggtggagagccaccgctcactcagagacgactatgaggtgagctgcccagagctggaccagctggtggaggctgcgcttgctgtgcctggggtttatggcagccgcatgacgggcggtggcttcggtggctgcacggtgacactgctggaggcctccgctgctccccacgccatgcggcacatccaggagcactacggcgggactgccaccttctacctctctcaagcagccgatggagccaaggtgctgtgcttgtgaggcacccccaggacagcacacggtgagggtgcggggcctgcaggccagtcccacggctctgtgcccggtgccatcttccatatccgggtgctcaataaacttgtgcctccaatgtggtaaaaaa

SEQ ID NO: 41646 - DNA, 1788 bp, Homo sapiens
ggcgtgagccactgcgcccggcccaaacttgtctgtctttatctctacttacagtgagtgtcaggtcaccctcttggagaccggtgatcagaggctgatgacctctcacagctgctggccctggggacctaggggatccctttgggaatcccaggtcaaccgggtgccagctccattgctctggctgtgtgggtggtggtgggtggtgaggcacatagaaagtcaccagcgccagggaagggcagctcagaaatcctggtcatgccaagtgccactcagggctattctcactctagtgagtgctcattggttcttcccgaagtccagagggaaggacaccatcgggggcgctgtatcccacccggcaccattagcccctgccacccaccacccagcagctggattcccacgggagttgcgggtgggggcggaaccggctgaggtctgggggcggggcgtccgggcgcggggcggggctggcgggaatgtgcgcacccccgcgcggggccccgcccgagcatcccgcgccgacggggctgtgccggagcagctgtgcagagctgcaggcgcgcgtcatggctgctttgagacagccccaggtcgcggagctgctggccgaggcccggcgagccttccgggaggagttcggggccgagcccgagctggccgtgtcagcgccgggccgcgtcaacctcatcggggaacacacggactacaaccagggcctggtgctgcctatggctctggagctcatgacggtgctggtgggcagcccccgcaaggatgggctggtgtctctcctcaccacctctgagggtgccgatgagccccagcggctgcagtttccactgcccacagcccagcgctcgctggagcctgggactcctcggtgggccaactatgtcaagggagtgattcagtactacccagctgcccccctccctggcttcagtgcagtggtggtcagctcagtgcccctggggggtggcctgtccagctcagcatccttggaagtggccacgtacaccttcctccagcagctctgtccagactcgggcacaatagctgcccgcgcccaggtgtgtcagcaggccgagcacagcttcgcagggatgccctgtggcatcatggaccagttcatctcacttatgggacagaaaggccacgcgctgctcattgactgcagcgagtaccctgtgcggcggcgccaatgtgaagaagtggcccgggcgctgggcaaggaaagcctccgggaggtacaactggaagagctagaggctgccagggacctggtgagcaaagagggcttccggcgggcccggcacgtggtgggggagattcggcgcacggcccaggcagcggccgccctgagacgtggcgactacagagcctttggccgcctcatggtggagagccaccgctcactcagagacgactatgaggtgagctgcccagagctggaccagctggtggaggctgcgcttgctgtgcctggggtttatggcagccgcatgacgggcggtggcttcggtggctgcacggtgacactgctggaggcctccgctgctccccacgccatgcggcacatccaggagcactacggcgggactgccaccttctacctctctcaagcagccgatggagccaaggtgctgtgcttgtgaggcacccccaggacagcacacggtgagggtgcggggcctgcaggccagtcccacggctctgtgcccggtgccatcttccatatccgggtgctcaataaacttgtgcctccaatgtggtaaaaaa

SEQ ID NO: 41647 - DNA, 1124 bp, Homo sapiens
  misc_feature (40)..(40): n is a, c, g, or t
ggcctgcgtaagccaaagcgttggttgccaaagcaagccnttgccggggggcgcgcgtcatggctgctttgagacagccccaggtcgcggagctgctggccgaggcccggcgagccttccgggaggagttcggggccgagcccgagctggccgtgtcagcgccgggccgcgtcaactcctcggtgggccaactatgtcaagggagtgattcagtactacccagctgcccccctccctggcttcagtgcagtggtggtcagctcagtgcccctggggggtggcctgtccagctcagcatccttggaagtggccacgtacaccttcctccagcagctctgtccagcacagcttcgcagggatgccctgtggcatcatggaccagttcatctcacttatgggacagaaaggccacgcgctgctcattgactgcaggtccttggagaccagcctggtgccactctcggaccccaagctggccgtgctcatcaccaactctaatgtccgccactccctggcctccagcgagtaccctgtgcggcggcgccaatgtgaagaagtggcccgggcgctgggcaaggaaagcctccgggaggtacaactggaagagctagaggctgccagggacctggtgagcaaagagggcttccggcgggcccggcacgtggtgggggagattcggcgcacggcccaggcagcggccgccctgagacgtggcgactacagagcctttggccgcctcatggtggagagccaccgctcactcagagacgactatgaggtgagctgcccagagctggaccagctggtggaggctgcgcttgctgtgcctggggtttatggcagccgcatgacgggcggtggcttcggtggctgcacggtgacactgctggaggcctccgctgctccccacgccatgcggcacatccaggagcactacggcgggactgccaccttctacctctctcaagcagccgatggagccaaggtgctgtgcttgtgaggcacccccaggacagcacacggtgagggtgcggggcctgcaggccagtcccacggctctgtgcccggtgccatcttccatatccgggtgctcaataaacttgtgcctccaatgtggtaaaaaa

SEQ ID NO: 41648 - DNA, 430 bp, Homo sapiens
tttgacacttctgagtagtgaaatgaagtgtttttattcttttgaagtagtgaggacacagcttctgattattccttctataaatatgcctgctacaaaagcgtgagacccacaaaataacagagataaaaacataaaatgagcaaaactttcaaaagagaaatcagaactttattttactgatgagtgtgtagaacttagaactgtacaacctctgcaaagaggaatttggcatcatctaacagaagtacacatgcaatcccacttccatctttctatctttacaagtgtgaaatagcatatgtattaggttattgcctgtgccattattgtaatcccaaaaggttgtaaacaccaaatgtccagcaatagggaactagtagaatatagactgtggtgtagcacatagtggagtactatgtagcttaaa

SEQ ID NO: 41649 - DNA, 1002 bp, Homo sapiens
catatctaggtgccttctcccaactcagatcctttgactatagaaagacacagatttcaaggctgagatccacaaaactctagcaaatactgcacagacactgaccaatgacagcaggtgctgcctgtcaccctggagcaccaggcagggttccaaagcacccttgctgtgccagcctctgattgctggttatagggaggtctggggtagtcccaaaagctgggatgtctaaggcagctggggtcagtcaggaggctcagggcagtggcaggaaaatattttcctccctggtagagccacagcggggtatccaggctgaatattattggcgagaaggaccatggcacagcaccaagacctgcaggacaaactttgttggagctgaatccagaaaaacaatcttcttctaaaccactctcctgcccctcatttaattattgtgcttttgggtgcacttggactactctgaaacattcagaactctgtcaaaaaaaaaaaaaagacctctctcctcagcacctctcccacttgggcatcagtcttggcttcctctctacttgctttcacttgctccttgtggcagagattgccctcagcagatcccttcccttaggttccttgctgtcaagtggaggctagggagcgagattatggccaatagaatgtgggcggaaccacagatctgagcctgaggaacatcccacaggaccctgagctcttcctccagctgctgcagtggccttggaagccatgtctgttctagaagtgtagctacagatggagaaggcccatgtgctagctagtctccaaagatggcgtatcaggccattcttgcgttgctataaagaaatatctgagataagttaatttataaagaaaagagtttgtattggctcattgttctgcgggcttcacaagaagcatggtgctggcatctgcttggcttctaaggaggcctaggaagtttacaatcatgagcaggcacatcatgtggccaaagca

SEQ ID NO: 41650 - DNA, 586 bp, Homo sapiens
ggtcgactggaaaaacagtttttgctctcacatcatgacaatcaacacaaaagacttctgtgaccaaatgtgtggagttttcttccaccaacaagcaagcaatcaattctgcagcggacaccagctgggtatcatctaattcaattctgacactgtctacttggagatagggtcagatcccttaggtttagggcttagtcctgcaagagggacccccatttctgatgccaatccaagccctaagttgttttacctgtgcttctgactgaccagctacacatgaggaatcctattaatacacaccttggggtgtattaatttgctagaggagctaacaaaactgagggagacatgttttccagtttattataaagatattacagagaccctgggcaacatggagaaaccctgtctctactaaaaatacaaaaaattagccgagcgtcatggcttgcaagtgtagtcccagctacttgggaggctgagacaggatctcactcctgttgcccaggctggaggacaatggtacaattatggctcactgcagcctagacttctcaggttcaggtgattctcccgtcgacgc

SEQ ID NO: 41651 - DNA, 455 bp, Homo sapiens
ctaattcaattctgacactgtctacttggagatagggtcagatcccttaggtttagggcttagtcctgcaagagggacccccatttctgatgccaatccaagccctaagttgttttacctgtgcttctgactgaccagctacacatgaggaatcctattaatacacaccttggggtgtattaatttgctagaggagctaacaaaactgagggagacatgttttccagtttattataaagatattacagagaccctgggcaacatggagaaaccctgtctctactaaaaatacaaaaaattagccgagcgtcatggcttgcaagtgtagtcccagctacttgggaggctgaggtgggagaatcacctgaacctgagaagtctaggctgcagtgagccataattgtaccattgtcctccagcctgggcaacaggagtgagatcctgtctccaaaaaa

SEQ ID NO: 41652 - DNA, 376 bp, Homo sapiens
cttctccctccactttcagccccttccttcaatcttgctgttgaagaagaggaagaaaaaaagatgatctgtagtgtacagggagatagctttgatctccactgctttgctttttcctctctcttttttaaccatccaaaaggctatttctaacaccgaaaggtgtcatgttgcttgcttcatgggagagctcagcctcatttcccttcagccaaaacaggctgctacaaatcctcttacttctgtgattttacttggcttccaaatgtcttatgacagtgttattccacacataaaataatattttgaacagcatgactgtgcatatctttctgactttattcaaagagagaagtacctctgtggcgttcacagc

SEQ ID NO: 41653 - DNA, 311 bp, Homo sapiens
ctcaaggaagattttaaaaataaaagttatgttcctggatgtttgaatgcacaagtcaacagataggagaagaggaatctcaaagccccatgactgagaatagtggtacccttgacggaaatagataaaaataataaatgggctgggcggctgacctccattgtttgggacattttgagtttgagacaagggaaggggccctaagcagaaatgccttgcaaatgggtggagatccaggacgggaactgagttcactacgggagctgtagacttccaaggcttcaacatgcagtaggtgaagtatgaaggct

SEQ ID NO: 41654 - DNA, 290 bp, Homo sapiens
aatgttacaattcagataacctaacactggggcatctataagactcttaaatttcttccagtgttagccaggggtggtggctcacccctgtaatcccagcacccgaggtcaggagtttgagaccagcctggccaacatggtgaaaccccatctgtactaaaaatacaaaaattagccaggtgtggtggcatgcacttgtaatcccaactacctgggaggctgaagcaggagaatcacttgaatccaggaggtggaggctgcagtgagctgagatcacatcactgccctcc

SEQ ID NO: 41655 - DNA, 290 bp, Homo sapiens
gcccagtaggaggaccggctgtatgtgctgtgtggccgggccagcattggactcacccgtgttgttgccatgactatttacatgtcagccactgatgtcagggtacgcaatggtggcgacatggttgctgttctttccggtcaagaagctgtgcagtgttacctctgtagagaaaatgtccagcagactttgctcaattaagcatgtacgtgtagaaatacaacagtcaaatgagcaggaataaaaatagattacttttgaaggagttaactaattccatcgggaaaact

SEQ ID NO: 41656 - DNA, 537 bp, Homo sapiens
cccaatccacaggagtaggtctttagtagtgacatttcttctttgtgcctgttttctggccatggccaactggatctggttcagatattggatccaagctgggccagtcagattctcaatcccaggaatttagaattagaatggacaacgagttattctcagtagaagactggaactgcaaaatataaacctcgcaaacaagagaagcagagaaatctggctttcagaaagaagttattgaagtaaatgttcaaagagaaacagagacaatggtcctaatggcatttatcttgtggtctagttcctacctgaagcccagcgttgagtttcatgagataccttatagtcttaaactgcattcccttttctcacttttaactagttcaaattggttatatgtaacaaaagagccaaagagtcctattaataattcgttctctcttggcttacattttaactatttattttaacaacattttttggatccttgccatgaacactggtgtgaggatatgaagaggaatttttcagactaag

SEQ ID NO: 41657 - DNA, 578 bp, Homo sapiens
caactggctatttcctgcacatagccagaaagaggattcacttactgataggagtaaaaactctgaagaagctgaatcttaagatataaattgtaccatctagtgactttttaaagcacctttacttaagtggctcatgcattttctcccagcagatcagtgcacttcaggtggctagtccgagtggtgtttacagctaattgatcacaaccagttacagatttctttgttccttccccactcccactgcttcaaattgactactgttaaaaaacaatacaaaacaatacactggaggtgttttcagtgagttttccccttccttttttttcaccttaagtgtcataattctattttgagtatgtttttacttttgccatttctgtaaagagtgcttacctttttgtgaacctggagatttgtgtaaactctgatcttgataccggtgattgatgacagagattgtaaataatcatagagatcagatcttaacctagccttgtccaacccacagcccgcgggctgcatgtggctcaggacaactttgaatgtggcctaacataaattcataaactttc

SEQ ID NO: 41658 - DNA, 493 bp, Homo sapiens
tgtgcacatgtggggcctctctccccaggggctgctgtgagcctgggaagtcccaggtggtgtctcatgccccagagagtagccccctgtgcacctcgcacacgccctcctgcgggtctgctgactttctcctctgcctcagccaagtctcccacgcggagcaggtgggaacttgaatgaaggcctcacaggattctgagtccccggtctgacacccacctggctcagcacctgcctcctcagcttccagttgcacgggtggccgcaggtcagggtgtgacggcgagcgtggccagtccggtcagaggtctctgcatcctccacacctctggccaggtgagacccagcctgtgtctctcccagctctactgacggacggcaggaagctgagaccccgagcccgtgtgtcctcggttcttggtgctttgcaatgcccctggccctggctgcagccgccccctggctgggccccgagcctgtctgccctgcaaca

SEQ ID NO: 41659 - DNA, 368 bp, Homo sapiens
ctggaccaaacacatcttcccacttgttttaagagacattgtttccaagatgaggtcaaggttaccttcagggctgacatcacttggtgtccctcaagacagaccctcggctctcctctggtgccagcctcaggtgccatgggcagttcagtgtaagctcagactctcattgcaatacagcattgccccaagcatacgctatgtgtctctctgcttcctggctcagggccttcctgagaggtgggagccagcttgactcactcaaaagtgcagtctgcccagcactttgggaggccgaggcgggtggattgcctgagctcaggagttcgcgaccagcctgggcaacacggtgaaaacctgtctctact

SEQ ID NO: 41660 - DNA, 1434 bp, Homo sapiens
aattgaactattcatatcaagtatttccaaataacaatgacattccaatttatagaatgtcatgtgttgtgagggtagtcaccctgcaactggcttggacatctctaagcaaatagaagtttctgtaagatagagatttggggcatctacttggaactacctatgaggagctggcattcctcaaatcccaactgactgcacttttccatgaaattacccagcagttatgatggtcagtggctcactcagcagcaagccacttaggtagctggcgagggacgtggcacagccttgtcttcacacagcacatcacagccaggcagcaaaggacagatctctctcatactcttcattcacagggcctgagaggtggaccatcagactccaccctgttttgcgctgacttgtagggagacctaggtgtggagcttcctggccaggagggcagtggctgcccagaaggcaggagatggctatctctttttttttcctgagacggagtcgtggtctgtcgcccaggctggagtgctgtggcgtgatctcagctcactgcaagctccgcctcctgggttcaagccattctcctgcctcagcctcccgagtagctgggactacaggtgcccacctccatgcccggctaatttttgtatttttagcagaaacagggtttcacacatgttagccaggatggtctcgatctcctgaccttgcgatctgcccgcctttggccttccaaagtgctgggattataggcgtgacccccacccccggtccaagatggctatctcttaacacacttgtaacccatttgtgcacacaggtgtgccgtgactcactggtggatccaaaaaaagctgaagcctacatttcccagagcccctttcagcttgaattccaaatgtgacttagcttcctctatgcagatgtacctacttgaaactgggaaggccaaatgagatagaggtaatgtttctgccaacaaacagccacagagcattttatttttctagaagagcaataacagagaccccagggtgtggtgtggcaggacgaggagcatccattttgctggtggggattgtggctaaaataatgtggctctggagccagcaatgggcagcatcttcatgactttccagcttccaggctgtaagcagagatagcatctcttctggacagccagttatgtgatagtgttctgagagtcattcctggaagtcagactaaaggctgctccttcagcctttccattcatcttgtaagcaggaggcttctgtgcatggccagaaactaacaaaagcacattgtgtctaaactaggttgcagtggtttctgttatcagcaagtaaatcctgattgataaagatactacaatatatgcacatatatatgttatagaatcaataaaaattggatactttgctttaaaaattt

SEQ ID NO: 41661 - DNA, 2579 bp, Homo sapiens
gcatcgcccttataagctctgtggtatccccgagccccactcctgtatgcagggaaattagtcattctccttggtaaactttcttcaagtaagtccttcagctacagccgcgaacatatgctttttgacctttgagggaatccgtaagatctcgtgagaagcgcagcttctcggggaagctgtcatggctgctcctgtacgtagtcacggtcttgtgctctaaggtgagtggaggacgagcttgggcttagcggcagcccgtatcacatcctagactttttacttcgaggagaagagtctcacgagttgtcctggaagaaaacgacagcacgtgttctttttcactagtagaagtgacgttggtttcatgttgacaactttgaagccatttggaagtgtttcagtggagagcaaaatgaataacaaagcgggctcctttttctggaaccttagacaattcagtacattagtttcaacaagcagaactatgaggctatgttgtttgggactttgcaaaccaaaaatagttcattcaaactggaacattttaaataactttcataacagaatgcaatcaactgatatcattagatatctctttcaggatgcattcatttttaaatcagatgttggctttcaaacaaagggcataagcactctaacagcccttagaattgaaagactactttatgctaaaagactgttttttgactcaaagcagtctcttgtccctgttgataaatctgatgatgaattgaagaaagtaaaccttaatcatgaagtctccaatgaagatgttcttaccaaggaaacaaaaccaaaccgtatcagcagtagaaaactgtctgaggaatgtaattccctgagtgatgtgttagatgcattttcaaaagcgcccacatttcctagtagcaactatttcacagcaatgtggacaattgccaaaagactgtctgatgaccagaagcgctttgaaaaacgactgatgtttagccaccctgcatttaatcagctctgtgaacatatgatgagagaagccaagatcatgcagtataagtacctactgttcagtcttcacgccatagtgaagcttggaatccctcagaacactattttggtgcagactttgctgagggtgacccaggaacgtatcaatgagtgtgatgagatatgcctttcagttttgtcaactgttttagaggcaatggaaccatgcaagaatgttcatgttctacgaacgggattcagaatactagttgatcagcaagtttggaaaatagaagatgtcttcacattacaagttgtgatgaagtgtattggaaaagatgcaccgattgctcttaagaggaaactggagatgaaagccttgagggaattagacagattttctgttttgaatagccaacacatgtttgaagtactagctgccatgaatcaccgatctcttatactcctggatgaatgcagtaaggtggtcctagataatatccatgggtgtcctttaagaataatgatcaacatattgcagtcctgcaaagacctccagtaccataatttggatctcttcaagggacttgcagattatgtggctgcaactttcgacatctggaagttcagaaaagttctttttatcctcattttatttgaaaaccttggctttcgacctgttggtttaatggacctgtttatgaagagaatagtagaggatcctgaatccctaaacatgaaaaacattctatctattcttcatacttactcttctctcaatcatgtctacaaatgccagaacaaagaacagttcgtggaagttatggctagtgctctgactggttatcttcacactatttcttctgaaaacttattggatgcagtatattcattttgcttgatgaattactttcccctggctccttttaatcagcttctgcaaaaagacatcatcagtgagctgctgacatcagatgacatgaagaatgcttacaagctgcatactttggatacttgtctaaaacttgatgatactgtctatctgagggacatagccttgtcactcccacagctgccgcgggagctgccatcgtcacatacaaatgcaaaggtggcagaggtgctgagcagccttctgggaggtgaaggacacttctcaaaggatgtgcacttgccacacaattatcatattgattttgaaatcagaatggacactaacaggaatcaagtgctaccactttctgatgtggatacaacttctgctacagatattcaaagagtagctgtgctatgtgtttccagatctgcttattgtttgggttcaagccaccccagaggattccttgctatgaaaatgcggcatttgaatgcaatgggttttcatgtgatcttggtcaataactgggagatggacaaactagagatggaagatgcagtcacatttttgaagactaaaatctattcagtagaagctcttcctgttgctgctgtaaatgtgcaaagcacacaataaagtgaaaatcaaccttttcatattaggagacatgcatttgtaaaaattaataaagatgacaagtcagttgtcaatggaa

SEQ ID NO: 41662 - DNA, 6902 bp, Homo sapiens
gcatcgcccttataagctctgtggtatccccgagccccactcctgtatgcagggaaattagtcattctccttggtaaactttcttcaagtaagtccttcagctacagccgcgaacatatgctttttgacctttgagggaatccgtaagatctcgtgagaagcgcagcttctcggggaagctgtcatggctgctcctgtacgtagtcacggtcttgtgctctaaggaaaacgacagcacgtgttctttttcactagtagaagtgacgttggtttcatgttgacaactttgaagccatttggaagtgtttcagtggagagcaaaatgaataacaaagcgggctcctttttctggaaccttagacaattcagtacattagtttcaacaagcagaactatgaggctatgttgtttgggactttgcaaaccaaaaatagttcattcaaactggaacattttaaataactttcataacagaatgcaatcaactgatatcattagatatctctttcaggatgcattcatttttaaatcagatgttggctttcaaacaaagggcataagcactctaacagcccttagaattgaaagactactttatgctaaaagactgttttttgactcaaagcagtctcttgtccctgttgataaatctgatgatgaattgaagaaagtaaaccttaatcatgaagtctccaatgaagatgttcttaccaaggaaacaaaaccaaaccgtatcagcagtagaaaactgtctgaggaatgtaattccctgagtgatgtgttagatgcattttcaaaagcgcccacatttcctagtagcaactatttcacagcaatgtggacaattgccaaaagactgtctgatgaccagaagcgctttgaaaaacgactgatgtttagccaccctgcatttaatcagctctgtgaacatatgatgagagaagccaagatcatgcagtataagtacctactgttcagtcttcacgccatagtgaagcttggaatccctcagaacactattttggtgcagactttgctgagggtgacccaggaacgtatcaatgagtgtgatgagatatgcctttcagttttgtcaactgttttagaggcaatggaaccatgcaagaatgttcatgttctacgaacgggattcagaatactagttgatcagcaagtttggaaaatagaagatgtcttcacattacaagttgtgatgaagtgtattggaaaagatgcaccgattgctcttaagaggaaactggagatgaaagccttgagggaattagacagattttctgttttgaatagccaacacatgtttgaagtactagctgccatgaatcaccgatctcttatactcctggatgaatgcagtaaggtggtcctagataatatccatgggtgtcctttaagaataatgatcaacatattgcagtcctgcaaagacctccagtaccataatttggatctcttcaagggacttgcagattatgtggctgcaactttcgacatctggaagttcagaaaagttctttttatcctcattttatttgaaaaccttggctttcgacctgttggtttaatggacctgtttatgaagagaatagtagaggatcctgaatccctaaacatgaaaaacattctatctattcttcatacttactcttctctcaatcatgtctacaaatgccagaacaaagaacagttcgtggaagttatggctagtgctctgactggttatcttcacactatttcttctgaaaacttattggatgcagtatattcattttgcttgatgaattactttcccctggctccttttaatcagcttctgcaaaaagacatcatcagtgagctgctgacatcagatgacatgaagaatgcttacaagctgcatactttggatacttgtctaaaacttgatgatactgtctatctgagggacatagccttgtcactcccacagctgccgcgggagctgccatcgtcacatacaaatgcaaaggtggcagaggtgctgagcagccttctgggaggtgaaggacacttctcaaaggatgtgcacttgccacacaattatcatattgattttgaaatcagaatggacactaacaggaatcaagtgctaccactttctgatgtggatacaacttctgctacagatattcaaaggttgcttacatatatttcatttgctgggctttctgaattaaaatcctaattctaaaagacttcatattaaatagcagtagtaaatctaagacttgatgtttgtatggagcctgcagcacaccaagagacttgtcatccatcaatgtactccttagaaagtgtaaatgtggacgttatggttgaatacaatggactacagtattggtcatttaatgagacagacatttttttaaaattaggttttgaagctatagttcaataaaacaatattaatataattgaaactatcaatgcagtgtagactttggacaagataatataatagtgatcataaagaataaagactcgaggcttctacaaaaatcaaatacccaataaatattttgctctaccaccaagacttttccagaggtagagaaaccgtagttttttaattaaactgtatttgtatgggttagagcacattgaagctaatcctaagttgtttctttggctcacacattacaaatagagtgtctctggggagaaatatgatgctataccatgagagaacatcctgcctcttcagtagatgcataagatcatgccatcattgcacacacccgtgggtcagttaccctttatgtaaaagctctgctacatggatcctgaccccaaggaacttgtatcttctgttaactccactggacacacacacacacataaatatgatagaaacatacaaaaaaatctgtagggatccaagctcttatctgcccatccctcttcattcacacacagttctgtgactttcacctctttctgaatgcatctagcttatttcttggccatcttttcaaccgctgtctttcctattagtgctacccatctcccctcagaagaggctttctctctgacctcattccaagatcagttttctttttcgggtactccgctattctggcataataaaataacagttgttctcagcataaagtcatgagaagtgaagaatgtgagcattcctttaaaaacataaaatttgtcttataacagccagagtataggtgaaggcagtaaggatataaatgtcttttttttttctttctttctcccagtaaacttagtatttccaaagtgccaggaacaatgaaaaaacaaattacaccttccacattttcgttatatttacagattttattttaacagtcttgcctttctcttggtgttttctttcttgtatttaaactcctatttctgttttttaaatgctgctttctctgggagatgatatgtgtaagaagagcatttactatttggtattatttacaccgttactactactggtagaataaataattatactcagatcagaaatcagcactacacagaaaacccttaaaattggtgctttcatgtctgaaaattttcctcttcaaaaatgtagccatccttaaagggaactgagaggtaactgtgtataatgttgtatatttttgatttataaagtagccttgtatagtggaatatctgcagaggccaagtaaaagaagtgaaggactaagacaggaatatcaaggattgtggtcggtggagagctcaacttggaaatctccagagaacaagaatgcagcaagactaaatagtaatatcaataactgttcttgttttgtttatttttgttttcagagtagctgtgctatgtgtttccagatctgcttattgtttgggttcaagccaccccagaggattccttgctatgaaaatgcggcatttgaatgcaatgggttttcatgtgatcttggtgagaaaaaaatgcaaatgaaatattctttaattactgatgtacattctaacagctgccaggaatcttgtggttgagactggttactaggactagaggaattgtcagcattattggaatgagtgctttagttactgttttctttgaaaaagaacattgctagtacacgatttgggttctgctcagctgattactgtcattactagagcttttacaaatgttgttctggtcagctttaatccttttttgctaagaagaagaatgcaaataatatattttcatatttaagatacacaaaaccatatttaatttccaggttatcttgaacaagggaaggaaagatgttaaagctttgttttcatggcctgtgtgaagctgttacaggatgtttgttgccagaaaaggctggatggttttaagaagatgggtctttctcttccctcttatgcttcaattttattttgtaccccacagcttctcttgaacagcctcttctgatgtttctaggtagtaggaaccttacaaatacatttatatatatgttgctgttggaatctatctaaatgccactcatttggtcctgcgcataatgtaagatgtaaacattccaagtcttctattattatactttagtattggaaatggattacgtgtggactattgagattaagatgactcctttctcttagtgggctactatttaagactttgttttttatattgctgattatatatattctaaggaagattttctcaagaaagcagtttttgcaccatttagaggacctttaaaatttgtataattttcacagttaaagctttcttaaaccctagcatgtagtcttattatgcctttaaaatatgagtagttataaggtcacatttgctttcaaaaagctattgtcctcatgttactttactatgtttggatctctaaactagctcttttgttagtatcgtctcacaaactgattattttcctctttctttggtaaggtcaataactgggagatggacaaactagagatggaagatgcagtcacatttttgaagactaaaatctattcagtagaagctcttcctgttgctgctgtaaatgtgcaaagcacacaataaagtgaaaatcaaccttttcatattaggagacatgcatttgtaaaaattaataaagatgacaagtcagttgtcaatggaattgagctatctgctaagacaaaaaatgttacctcagttcactattaaaattaattttaggagtggaagaaatgttgttactgccatttaaaaatatgctgagaaaattccagaagggttatttttccaaccacacctattccctctagtgcccagatatttgatttgtgagctgtacgtttcaccttttcatctttgatctactaaaaactggtttcttagttgtgaggtgtcacaggcaggttgatgtgggtagtagtccttgtctttggaatctgaatatttatactcctgctctaagctgttctaagacttggggttatgcctttaaatcattttcaagcattggccaaataataattggacaaagttctaaagttgtcaagtgtgtaagaattagtgaggtagctgttgaaaatgagtgaggatggtatttgtatttgtaataagcactgcaggtagagatatttcatgggttataataagagaaacacagatgagatgtagatggtaaggagtcttactgttgttggggtccttcctttctctttcttttttcccccttacccctcccacaatttcatgaagtcttttaaattaaatatatagctgaattgtgttgtgaatcagacctgaggactattttttcgattatgtgtgttcattctttgttcaaatatttgtccaaattcaactattttgttcaatatgcctgtctacctagtatttggctcgctggggatatagtgatgaataggcatggtctcttgtggaacttacagcatgggttccatgcaagttggtgttattctgcccccaagcacacagacatgcaattactagacatcttagtatgtgccgggcactgctaagtattcatttgtgtgctgccttttcatgatctgaaccctttgaggtgtagctgctattatgattctctctgtgtcttcacttcctcatctctaaaatcaggataggtatttgcccaaggctacacagaagtaggggagggctggagtttgaatgtgagctaacataggcttataagaaaatacaaaaatgggattataggcgtgacccccacccccggtccaagatggctatctcttaacacacttgtaacccatttgtgcacacaggtgtgccgtgactcactggtggatccaaaaaaagctgaagcctacatttcccagagcccctttcagcttgaattccaaatgtgacttagcttcctctatgcagatgtacctacttgaaactgggaaggccaaatgagatagaggtaatgtttctgccaacaaacagccacagagcattttatttttctagaagagcaataacagagaccccagggtgtggtgtggcaggacgaggagcatccattttgctggtggggattgtggctaaaataatgtggctctggagccagcaatgggcagcatcttcatgactttccagcttccaggctgtaagcagagatagcatctcttctggacagccagttatgtgatagtgttctgagagtcattcctggaagtcagactaaaggctgctccttcagcctttccattcatcttgtaagcaggaggcttctgtgcatggccagaaactaacaaaagcacattgtgtctaaactaggttgcagtggtttctgttatcagcaagtaaatcctgattgataaagatactacaatatatgcacatatatatgttatagaatcaataaaaattggatactttgctttaaaaattt

SEQ ID NO: 41663 - DNA, 6254 bp, Homo sapiens
gcatcgcccttataagctctgtggtatccccgagccccactcctgtatgcagggaaattagtcattctccttggtaaactttcttcaagtaagtccttcagctacagccgcgaacatatgctttttgacctttgagggaatccgtaagatctcgtgagaagcgcagcttctcggggaagctgtcatggctgctcctgtacgtagtcacggtcttgtgctctaaggaaaacgacagcacgtgttctttttcactagtagaagtgacgttggtttcatgttgacaactttgaagccatttggaagtgtttcagtggagagcaaaatgaataacaaagcgggctcctttttctggaaccttagacaattcagtacattagtttcaacaagcagaactatgaggctatgttgtttgggactttgcaaaccaaaaatagttcattcaaactggaacattttaaataactttcataacagaatgcaatcaactgatatcattagatatctctttcaggatgcattcatttttaaatcagatgttggctttcaaacaaagggcataagcactctaacagcccttagaattgaaagactactttatgctaaaagactgttttttgactcaaagcagtctcttgtccctgttgataaatctgatgatgaattgaagaaagtaaaccttaatcatgaagtctccaatgaagatgttcttaccaaggaaacaaaaccaaaccgtatcagcagtagaaaactgtctgaggaatgtaattccctgagtgatgtgttagatgcattttcaaaagcgcccacatttcctagtagcaactatttcacagcaatgtggacaattgccaaaagactgtctgatgaccagaagcgctttgaaaaacgactgatgtttagccaccctgcatttaatcagctctgtgaacatatgatgagagaagccaagatcatgcagtataagtacctactgttcagtcttcacgccatagtgaagcttggaatccctcagaacactattttggtgcagactttgctgagggtgacccaggaacgtatcaatgagtgtgatgagatatgcctttcagttttgtcaactgttttagaggcaatggaaccatgcaagaatgttcatgttctacgaacgggattcagaatactagttgatcagcaagtttggaaaatagaagatgtcttcacattacaagttgtgatgaagtgtattggaaaagatgcaccgattgctcttaagaggaaactggagatgaaagccttgagggaattagacagattttctgttttgaatagccaacacatgtttgaagtactagctgccatgaatcaccgatctcttatactcctggatgaatgcagtaaggtggtcctagataatatccatgggtgtcctttaagaataatgatcaacatattgcagtcctgcaaagacctccagtaccataatttggatctcttcaagggacttgcagattatgtggctgcaactttcgacatctggaagttcagaaaagttctttttatcctcattttatttgaaaaccttggctttcgacctgttggtttaatggacctgtttatgaagagaatagtagaggatcctgaatccctaaacatgaaaaacattctatctattcttcatacttactcttctctcaatcatgtctacaaatgccagaacaaagaacagttcgtggaagttatggctagtgctctgactggttatcttcacactatttcttctgaaaacttattggatgcagtatattcattttgcttgatgaattactttcccctggctccttttaatcagcttctgcaaaaagacatcatcagtgagctgctgacatcagatgacatgaagaatgcttacaagctgcatactttggatacttgtctaaaacttgatgatactgtctatctgagggacatagccttgtcactcccacagctgccgcgggagctgccatcgtcacatacaaatgcaaaggtggcagaggtgctgagcagccttctgggaggtgaaggacacttctcaaaggatgtgcacttgccacacaattatcatattgattttgaaatcagaatggacactaacaggaatcaagtgctaccactttctgatgtggatacaacttctgctacagatattcaaaggttgcttacatatatttcatttgctgggctttctgaattaaaatcctaattctaaaagacttcatattaaatagcagtagtaaatctaagacttgatgtttgtatggagcctgcagcacaccaagagacttgtcatccatcaatgtactccttagaaagtgtaaatgtggacgttatggttgaatacaatggactacagtattggtcatttaatgagacagacatttttttaaaattaggttttgaagctatagttcaataaaacaatattaatataattgaaactatcaatgcagtgtagactttggacaagataatataatagtgatcataaagaataaagactcgaggcttctacaaaaatcaaatacccaataaatattttgctctaccaccaagacttttccagaggtagagaaaccgtagttttttaattaaactgtatttgtatgggttagagcacattgaagctaatcctaagttgtttctttggctcacacattacaaatagagtgtctctggggagaaatatgatgctataccatgagagaacatcctgcctcttcagtagatgcataagatcatgccatcattgcacacacccgtgggtcagttaccctttatgtaaaagctctgctacatggatcctgaccccaaggaacttgtatcttctgttaactccactggacacacacacacacataaatatgatagaaacatacaaaaaaatctgtagggatccaagctcttatctgcccatccctcttcattcacacacagttctgtgactttcacctctttctgaatgcatctagcttatttcttggccatcttttcaaccgctgtctttcctattagtgctacccatctcccctcagaagaggctttctctctgacctcattccaagatcagttttctttttcgggtactccgctattctggcataataaaataacagttgttctcagcataaagtcatgagaagtgaagaatgtgagcattcctttaaaaacataaaatttgtcttataacagccagagtataggtgaaggcagtaaggatataaatgtcttttttttttctttctttctcccagtaaacttagtatttccaaagtgccaggaacaatgaaaaaacaaattacaccttccacattttcgttatatttacagattttattttaacagtcttgcctttctcttggtgttttctttcttgtatttaaactcctatttctgttttttaaatgctgctttctctgggagatgatatgtgtaagaagagcatttactatttggtattatttacaccgttactactactggtagaataaataattatactcagatcagaaatcagcactacacagaaaacccttaaaattggtgctttcatgtctgaaaattttcctcttcaaaaatgtagccatccttaaagggaactgagaggtaactgtgtataatgttgtatatttttgatttataaagtagccttgtatagtggaatatctgcagaggccaagtaaaagaagtgaaggactaagacaggaatatcaaggattgtggtcggtggagagctcaacttggaaatctccagagaacaagaatgcagcaagactaaatagtaatatcaataactgttcttgttttgtttatttttgttttcagagtagctgtgctatgtgtttccagatctgcttattgtttgggttcaagccaccccagaggattccttgctatgaaaatgcggcatttgaatgcaatgggttttcatgtgatcttggtgagaaaaaaatgcaaatgaaatattctttaattactgatgtacattctaacagctgccaggaatcttgtggttgagactggttactaggactagaggaattgtcagcattattggaatgagtgctttagttactgttttctttgaaaaagaacattgctagtacacgatttgggttctgctcagctgattactgtcattactagagcttttacaaatgttgttctggtcagctttaatccttttttgctaagaagaagaatgcaaataatatattttcatatttaagatacacaaaaccatatttaatttccaggttatcttgaacaagggaaggaaagatgttaaagctttgttttcatggcctgtgtgaagctgttacaggatgtttgttgccagaaaaggctggatggttttaagaagatgggtctttctcttccctcttatgcttcaattttattttgtaccccacagcttctcttgaacagcctcttctgatgtttctaggtagtaggaaccttacaaatacatttatatatatgttgctgttggaatctatctaaatgccactcatttggtcctgcgcataatgtaagatgtaaacattccaagtcttctattattatactttagtattggaaatggattacgtgtggactattgagattaagatgactcctttctcttagtgggctactatttaagactttgttttttatattgctgattatatatattctaaggaagattttctcaagaaagcagtttttgcaccatttagaggacctttaaaatttgtataattttcacagttaaagctttcttaaaccctagcatgtagtcttattatgcctttaaaatatgagtagttataaggtcacatttgctttcaaaaagctattgtcctcatgttactttactatgtttggatctctaaactagctcttttgttagtatcgtctcacaaactgattattttcctctttctttggtaaggtcaataactgggagatggacaaactagagatggaagatgcagtcacatttttgaagactaaaatctattcagtagaagctcttcctgttgctgctgtaaatgtgcaaagcacacaataaagtgaaaatcaaccttttcatattaggagacatgcatttgtaaaaattaataaagatgacaagtcagttgtcaatggaattgagctatctgctaagacaaaaaatgttacctcagttcactattaaaattaattttaggagtggaagaaatgttgttactgccatttaaaaatatgctgagaaaattccagaagggttatttttccaaccacacctattccctctagtgcccagatatttgatttgtgagctgtacgtttcaccttttcatctttgatctactaaaaactggtttcttagttgtgaggtgtcacaggcaggttgatgtgggtagtagtccttgtctttggaatctgaatatttatactcctgctctaagctgttctaagacttggggttatgcctttaaatcattttcaagcattggccaaataataattggacaaagttctaaagttgtcaagtgtgtaagaattagtgaggtagctgttgaaaatgagtgaggatggtatttgtatttgtaataagcactgcaggtagagatatttcatgggttataataagagaaacacagatgagatgtagatggtaaggagtcttactgttgttggggtccttcctttctctttcttttttcccccttacccctcccacaatttcatgaagtcttttaaattaaatatatagctgaattgtgttgtgaatcagacctgaggactattttttcgattatgtgtgttcattctttgttcaaatatttgtccaaattcaactattttgttcaatatgcctgtctacctagtatttggctcgctggggatatagtgatgaataggcatggtctcttgtggaacttacagcatgggttccatgcaagttggtgttattctgcccccaagcacacagacatgcaattactagacatcttagtatgtgccgggcactgctaagtattcatttgtgtgctgccttttcatgatctgaaccctttgaggtgtagctgctattatgattctctctgtgtcttcacttcctcatctctaaaatcaggataggtatttgcccaaggctacacagaagtaggggagggctggagtttgaatgtgagctaacataggcttataagaaaatacaaaaactgggctgggcacggtggctcgtgcttgtcatcccagcacttggg

SEQ ID NO: 41664 - DNA, 4238 bp, Homo sapiens
gcatcgcccttataagctctgtggtatccccgagccccactcctgtatgcagggaaattagtcattctccttggtaaactttcttcaagtaagtccttcagctacagccgcgaacatatgctttttgacctttgagggaatccgtaagatctcgtgagaagcgcagcttctcggggaagctgtcatggctgctcctgtacgtagtcacggtcttgtgctctaaggaaaacgacagcacgtgttctttttcactagtagaagtgacgttggtttcatgttgacaactttgaagccatttggaagtgtttcagtggagagcaaaatgaataacaaagcgggctcctttttctggaaccttagacaattcagtacattagtttcaacaagcagaactatgaggctatgttgtttgggactttgcaaaccaaaaatagttcattcaaactggaacattttaaataactttcataacagaatgcaatcaactgatatcattagatatctctttcaggatgcattcatttttaaatcagatgttggctttcaaacaaagggcataagcactctaacagcccttagaattgaaagactactttatgctaaaagactgttttttgactcaaagcagtctcttgtccctgttgataaatctgatgatgaattgaagaaagtaaaccttaatcatgaagtctccaatgaagatgttcttaccaaggaaacaaaaccaaaccgtatcagcagtagaaaactgtctgaggaatgtaattccctgagtgatgtgttagatgcattttcaaaagcgcccacatttcctagtagcaactatttcacagcaatgtggacaattgccaaaagactgtctgatgaccagaagcgctttgaaaaacgactgatgtttagccaccctgcatttaatcagctctgtgaacatatgatgagagaagccaagatcatgcagtataagtacctactgttcagtcttcacgccatagtgaagcttggaatccctcagaacactattttggtgcagactttgctgagggtgacccaggaacgtatcaatgagtgtgatgagatatgcctttcagttttgtcaactgttttagaggcaatggaaccatgcaagaatgttcatgttctacgaacgggattcagaatactagttgatcagcaagtttggaaaatagaagatgtcttcacattacaagttgtgatgaagtgtattggaaaagatgcaccgattgctcttaagaggaaactggagatgaaagccttgagggaattagacagattttctgttttgaatagccaacacatgtttgaagtactagctgccatgaatcaccgatctcttatactcctggatgaatgcagtaaggtggtcctagataatatccatgggtgtcctttaagaataatgatcaacatattgcagtcctgcaaagacctccagtaccataatttggatctcttcaagggacttgcagattatgtggctgcaactttcgacatctggaagttcagaaaagttctttttatcctcattttatttgaaaaccttggctttcgacctgttggtttaatggacctgtttatgaagagaatagtagaggatcctgaatccctaaacatgaaaaacattctatctattcttcatacttactcttctctcaatcatgtctacaaatgccagaacaaagaacagttcgtggaagttatggctagtgctctgactggttatcttcacactatttcttctgaaaacttattggatgcagtatattcattttgcttgatgaattactttcccctggctccttttaatcagcttctgcaaaaagacatcatcagtgagctgctgacatcagatgacatgaagaatgcttacaagctgcatactttggatacttgtctaaaacttgatgatactgtctatctgagggacatagccttgtcactcccacagctgccgcgggagctgccatcgtcacatacaaatgcaaaggtggcagaggtgctgagcagccttctgggaggtgaaggacacttctcaaaggatgtgcacttgccacacaattatcatattgattttgaaatcagaatggacactaacaggaatcaagtgctaccactttctgatgtggatacaacttctgctacagatattcaaagagtagctgtgctatgtgtttccagatctgcttattgtttgggttcaagccaccccagaggattccttgctatgaaaatgcggcatttgaatgcaatgggttttcatgtgatcttggtcaataactgggagatggacaaactagagatggaagatgcagtcacatttttgaagactaaaatctattcagtagaagctcttcctgttgctgctgtaaatgtgcaaagcacacaataaagtgaaaatcaaccttttcatattaggagacatgcatttgtaaaaattaataaagatgacaagtcagttgtcaatggaattgagctatctgctaagacaaaaaatgttacctcagttcactattaaaattaattttaggagtggaagaaatgttgttactgccatttaaaaatatgctgagaaaattccagaagggttatttttccaaccacacctattccctctagtgcccagatatttgatttgtgagctgtacgtttcaccttttcatctttgatctactaaaaactggtttcttagttgtgaggtgtcacaggcaggttgatgtgggtagtagtccttgtctttggaatctgaatatttatactcctgctctaagctgttctaagacttggggttatgcctttaaatcattttcaagcattggccaaataataattggacaaagttctaaagttgtcaagtgtgtaagaattagtgaggtagctgttgaaaatgagtgaggatggtatttgtatttgtaataagcactgcaggtagagatatttcatgggttataataagagaaacacagatgagatgtagatggtaaggagtcttactgttgttggggtccttcctttctctttcttttttcccccttacccctcccacaatttcatgaagtcttttaaattaaatatatagctgaattgtgttgtgaatcagacctgaggactattttttcgattatgtgtgttcattctttgttcaaatatttgtccaaattcaactattttgttcaatatgcctgtctacctagtatttggctcgctggggatatagtgatgaataggcatggtctcttgtggaacttacagcatgggttccatgcaagttggtgttattctgcccccaagcacacagacatgcaattactagacatcttagtatgtgccgggcactgctaagtattcatttgtgtgctgccttttcatgatctgaaccctttgaggtgtagctgctattatgattctctctgtgtcttcacttcctcatctctaaaatcaggataggtatttgcccaaggctacacagaagtaggggagggctggagtttgaatgtgagctaacataggcttataagaaaatacaaaaatgggattataggcgtgacccccacccccggtccaagatggctatctcttaacacacttgtaacccatttgtgcacacaggtgtgccgtgactcactggtggatccaaaaaaagctgaagcctacatttcccagagcccctttcagcttgaattccaaatgtgacttagcttcctctatgcagatgtacctacttgaaactgggaaggccaaatgagatagaggtaatgtttctgccaacaaacagccacagagcattttatttttctagaagagcaataacagagaccccagggtgtggtgtggcaggacgaggagcatccattttgctggtggggattgtggctaaaataatgtggctctggagccagcaatgggcagcatcttcatgactttccagcttccaggctgtaagcagagatagcatctcttctggacagccagttatgtgatagtgttctgagagtcattcctggaagtcagactaaaggctgctccttcagcctttccattcatcttgtaagcaggaggcttctgtgcatggccagaaactaacaaaagcacattgtgtctaaactaggttgcagtggtttctgttatcagcaagtaaatcctgattgataaagatactacaatatatgcacatatatatgttatagaatcaataaaaattggatactttgctttaaaaattt

SEQ ID NO: 41665 - DNA, 4277 bp, Homo sapiens
gcatcgcccttataagctctgtggtatccccgagccccactcctgtatgcagggaaattagtcattctccttggtaaactttcttcaagtaagtccttcagctacagccgcgaacatatgctttttgacctttgagggaatccgtaagatctcgtgagaagcgcagcttctcggggaagctgtcatggctgctcctgtacgtagtcacggtcttgtgctctaaggtgagtggaggacgagcttgggcttagcggcagcccgtatcacatcctagactttttacttcgaggagaagagtctcacgagttgtcctggaagaaaacgacagcacgtgttctttttcactagtagaagtgacgttggtttcatgttgacaactttgaagccatttggaagtgtttcagtggagagcaaaatgaataacaaagcgggctcctttttctggaaccttagacaattcagtacattagtttcaacaagcagaactatgaggctatgttgtttgggactttgcaaaccaaaaatagttcattcaaactggaacattttaaataactttcataacagaatgcaatcaactgatatcattagatatctctttcaggatgcattcatttttaaatcagatgttggctttcaaacaaagggcataagcactctaacagcccttagaattgaaagactactttatgctaaaagactgttttttgactcaaagcagtctcttgtccctgttgataaatctgatgatgaattgaagaaagtaaaccttaatcatgaagtctccaatgaagatgttcttaccaaggaaacaaaaccaaaccgtatcagcagtagaaaactgtctgaggaatgtaattccctgagtgatgtgttagatgcattttcaaaagcgcccacatttcctagtagcaactatttcacagcaatgtggacaattgccaaaagactgtctgatgaccagaagcgctttgagagagaagccaagatcatgcagtataagtacctactgttcagtcttcacgccatagtgaagcttggaatccctcagaacactattttggtgcagactttgctgagggtgacccaggaacgtatcaatgagtgtgatgagatatgcctttcagttttgtcaactgttttagaggcaatggaaccatgcaagaatgttcatgttctacgaacgggattcagaatactagttgatcagcaagtttggaaaatagaagatgtcttcacattacaagttgtgatgaagtgtattggaaaagatgcaccgattgctcttaagaggaaactggagatgaaagccttgagggaattagacagattttctgttttgaatagccaacacatgtttgaagtactagctgccatgaatcaccgatctcttatactcctggatgaatgcagtaaggtggtcctagataatatccatgggtgtcctttaagaataatgatcaacatattgcagtcctgcaaagacctccagtaccataatttggatctcttcaagggacttgcagattatgtggctgcaactttcgacatctggaagttcagaaaagttctttttatcctcattttatttgaaaaccttggctttcgacctgttggtttaatggacctgtttatgaagagaatagtagaggatcctgaatccctaaacatgaaaaacattctatctattcttcatacttactcttctctcaatcatgtctacaaatgccagaacaaagaacagttcgtggaagttatggctagtgctctgactggttatcttcacactatttcttctgaaaacttattggatgcagtatattcattttgcttgatgaattactttcccctggctccttttaatcagcttctgcaaaaagacatcatcagtgagctgctgacatcagatgacatgaagaatgcttacaagctgcatactttggatacttgtctaaaacttgatgatactgtctatctgagggacatagccttgtcactcccacagctgccgcgggagctgccatcgtcacatacaaatgcaaaggtggcagaggtgctgagcagccttctgggaggtgaaggacacttctcaaaggatgtgcacttgccacacaattatcatattgattttgaaatcagaatggacactaacaggaatcaagtgctaccactttctgatgtggatacaacttctgctacagatattcaaagagtagctgtgctatgtgtttccagatctgcttattgtttgggttcaagccaccccagaggattccttgctatgaaaatgcggcatttgaatgcaatgggttttcatgtgatcttggtcaataactgggagatggacaaactagagatggaagatgcagtcacatttttgaagactaaaatctattcagtagaagctcttcctgttgctgctgtaaatgtgcaaagcacacaataaagtgaaaatcaaccttttcatattaggagacatgcatttgtaaaaattaataaagatgacaagtcagttgtcaatggaattgagctatctgctaagacaaaaaatgttacctcagttcactattaaaattaattttaggagtggaagaaatgttgttactgccatttaaaaatatgctgagaaaattccagaagggttatttttccaaccacacctattccctctagtgcccagatatttgatttgtgagctgtacgtttcaccttttcatctttgatctactaaaaactggtttcttagttgtgaggtgtcacaggcaggttgatgtgggtagtagtccttgtctttggaatctgaatatttatactcctgctctaagctgttctaagacttggggttatgcctttaaatcattttcaagcattggccaaataataattggacaaagttctaaagttgtcaagtgtgtaagaattagtgaggtagctgttgaaaatgagtgaggatggtatttgtatttgtaataagcactgcaggtagagatatttcatgggttataataagagaaacacagatgagatgtagatggtaaggagtcttactgttgttggggtccttcctttctctttcttttttcccccttacccctcccacaatttcatgaagtcttttaaattaaatatatagctgaattgtgttgtgaatcagacctgaggactattttttcgattatgtgtgttcattctttgttcaaatatttgtccaaattcaactattttgttcaatatgcctgtctacctagtatttggctcgctggggatatagtgatgaataggcatggtctcttgtggaacttacagcatgggttccatgcaagttggtgttattctgcccccaagcacacagacatgcaattactagacatcttagtatgtgccgggcactgctaagtattcatttgtgtgctgccttttcatgatctgaaccctttgaggtgtagctgctattatgattctctctgtgtcttcacttcctcatctctaaaatcaggataggtatttgcccaaggctacacagaagtaggggagggctggagtttgaatgtgagctaacataggcttataagaaaatacaaaaatgggattataggcgtgacccccacccccggtccaagatggctatctcttaacacacttgtaacccatttgtgcacacaggtgtgccgtgactcactggtggatccaaaaaaagctgaagcctacatttcccagagcccctttcagcttgaattccaaatgtgacttagcttcctctatgcagatgtacctacttgaaactgggaaggccaaatgagatagaggtaatgtttctgccaacaaacagccacagagcattttatttttctagaagagcaataacagagaccccagggtgtggtgtggcaggacgaggagcatccattttgctggtggggattgtggctaaaataatgtggctctggagccagcaatgggcagcatcttcatgactttccagcttccaggctgtaagcagagatagcatctcttctggacagccagttatgtgatagtgttctgagagtcattcctggaagtcagactaaaggctgctccttcagcctttccattcatcttgtaagcaggaggcttctgtgcatggccagaaactaacaaaagcacattgtgtctaaactaggttgcagtggtttctgttatcagcaagtaaatcctgattgataaagatactacaatatatgcacatatatatgttatagaatcaataaaaattggatactttgctttaaaaattt

SEQ ID NO: 41666 - DNA, 4243 bp, Homo sapiens
gcatcgcccttataagctctgtggtatccccgagccccactcctgtatgcagggaaattagtcattctccttggtaaactttcttcaagtaagtccttcagctacagccgcgaacatatgctttttgacctttgagggaatccgtaagatctcgtgagaagcgcagcttctcggggaagctgtcatggctgctcctgtacgtagtcacggtcttgtgctctaaggtgagtggaggacgagcttgggcttagcggcagcccgtatcacatcctagactttttacttcgaggagaagagtctcacgagttgtcctggaagaaaacgacagcacgtgttctttttcactagtagaagtgacgttggtttcatgttgacaactttgaagccatttggaagtgtttcagtggagagcaaaatgaataacaaagcgggctcctttttctggaaccttagacaattcagtacattagtttcaacaagcagaactatgaggctatgttgtttgggactttgcaaaccaaaaatagttcattcaaactggaacattttaaataactttcataacagaatgcaatcaactgatatcattagatatctctttcaggatgcattcatttttaaatcagatgttggctttcaaacaaagggcataagcactctaacagcccttagaattgaaagactactttatgctaaaagactgttttttgactcaaagcagtctcttgtccctgttgataaatctgatgatgaattgaagaaagtaaaccttaatcatgaagtctccaatgaagatgttcttaccaaggaaacaaaaccaaaccgtatcagcagtagaaaactgtctgaggaatgtaattccctgagtgatgtgttagatgcattttcaaaagcgcccacatttcctagtagcaactatttcacagcaatgtggacaattgccaaaagactgtctgatgaccagaagcgctttgaaaaacgactgatgtttagccaccctgcatttaatcagctctgtgaacatatgatgagagaagccaagatcatgcagtataagtacctactgttcagtcttcacgccatagtgaagcttggaatccctcagaacactattttggtgcagactttgctgagggtgacccaggaacgtatcaatgagtgtgatgagatatgcctttcagttttgtcaactgttttagaggcaatggaaccatgcaagaatgttcatgttctacgaacgggattcagaatactagttgatcagcaagtttggaaaatagaagatgtcttcacattacaagttgtgatgaagtgtattggaaaagatgcaccgattgctcttaagaggaaactggagatgaaagccttgagggaattagacagattttctgttttgaatagccaacacatgtttgaagtactagctgccatgaatcaccgatctcttatactcctggatgaatgcagtaaggtggtcctagataatatccatgggtgtcctttaagaataatgatcaacatattgcagtcctgcaaagacctccagtaccataatttggatctcttcaagggacttgcagattatgtggctgcaactttcgacatctggaagttcagaaaagttctttttatcctcattttatttgaaaaccttggctttcgacctgttggtttaatggacctgtttatgaagagaatagtagaggatcctgaatccctaaacatgaaaaacattctatctattcttcatacttactcttctctcaatcatgtctacaaatgccagaacaaagaacagttcgtggaagttatggctagtgctctgactggttatcttcacactatttcttctgaaaacttattggatgcagtatattcattttgcttgatgaattactttcccctggctccttttaatcagcttctgcaaaaagacatcatcagtgagctgctgacatcagatgacatgaagaatgcttacaactgccatcgtcacatacaaatgcaaaggtggcagaggtgctgagcagccttctgggaggtgaaggacacttctcaaaggatgtgcacttgccacacaattatcatattgattttgaaatcagaatggacactaacaggaatcaagtgctaccactttctgatgtggatacaacttctgctacagatattcaaagagtagctgtgctatgtgtttccagatctgcttattgtttgggttcaagccaccccagaggattccttgctatgaaaatgcggcatttgaatgcaatgggttttcatgtgatcttggtcaataactgggagatggacaaactagagatggaagatgcagtcacatttttgaagactaaaatctattcagtagaagctcttcctgttgctgctgtaaatgtgcaaagcacacaataaagtgaaaatcaaccttttcatattaggagacatgcatttgtaaaaattaataaagatgacaagtcagttgtcaatggaattgagctatctgctaagacaaaaaatgttacctcagttcactattaaaattaattttaggagtggaagaaatgttgttactgccatttaaaaatatgctgagaaaattccagaagggttatttttccaaccacacctattccctctagtgcccagatatttgatttgtgagctgtacgtttcaccttttcatctttgatctactaaaaactggtttcttagttgtgaggtgtcacaggcaggttgatgtgggtagtagtccttgtctttggaatctgaatatttatactcctgctctaagctgttctaagacttggggttatgcctttaaatcattttcaagcattggccaaataataattggacaaagttctaaagttgtcaagtgtgtaagaattagtgaggtagctgttgaaaatgagtgaggatggtatttgtatttgtaataagcactgcaggtagagatatttcatgggttataataagagaaacacagatgagatgtagatggtaaggagtcttactgttgttggggtccttcctttctctttcttttttcccccttacccctcccacaatttcatgaagtcttttaaattaaatatatagctgaattgtgttgtgaatcagacctgaggactattttttcgattatgtgtgttcattctttgttcaaatatttgtccaaattcaactattttgttcaatatgcctgtctacctagtatttggctcgctggggatatagtgatgaataggcatggtctcttgtggaacttacagcatgggttccatgcaagttggtgttattctgcccccaagcacacagacatgcaattactagacatcttagtatgtgccgggcactgctaagtattcatttgtgtgctgccttttcatgatctgaaccctttgaggtgtagctgctattatgattctctctgtgtcttcacttcctcatctctaaaatcaggataggtatttgcccaaggctacacagaagtaggggagggctggagtttgaatgtgagctaacataggcttataagaaaatacaaaaatgggattataggcgtgacccccacccccggtccaagatggctatctcttaacacacttgtaacccatttgtgcacacaggtgtgccgtgactcactggtggatccaaaaaaagctgaagcctacatttcccagagcccctttcagcttgaattccaaatgtgacttagcttcctctatgcagatgtacctacttgaaactgggaaggccaaatgagatagaggtaatgtttctgccaacaaacagccacagagcattttatttttctagaagagcaataacagagaccccagggtgtggtgtggcaggacgaggagcatccattttgctggtggggattgtggctaaaataatgtggctctggagccagcaatgggcagcatcttcatgactttccagcttccaggctgtaagcagagatagcatctcttctggacagccagttatgtgatagtgttctgagagtcattcctggaagtcagactaaaggctgctccttcagcctttccattcatcttgtaagcaggaggcttctgtgcatggccagaaactaacaaaagcacattgtgtctaaactaggttgcagtggtttctgttatcagcaagtaaatcctgattgataaagatactacaatatatgcacatatatatgttatagaatcaataaaaattggatactttgctttaaaaattt

SEQ ID NO: 41667 - DNA, 2601 bp, Homo sapiens
aactacgacgcggccagcggcctgaccgatacagcggtgagcgacaccccccccccccctatccacagttcgtggaagttatggctagtgctctgactggttatcttcacactatttcttctgaaaacttattggatgcagtatattcattttgcttgatgaattactttcccctggctccttttaatcagcttctgcaaaaagacatcatcagtgagctgctgacatcagatgacatgaagaatgcttacaagctgcatactttggatacttgtctaaaacttgatgatactgtctatctgagggacatagccttgtcactcccacagctgccgcgggagctgccatcgtcacatacaaatgcaaaggtggcagaggtgctgagcagccttctgggaggtgaaggacacttctcaaaggatgtgcacttgccacacaattatcatattgattttgaaatcagaatggacactaacaggaatcaagtgctaccactttctgatgtggatacaacttctgctacagatattcaaagagtagctgtgctatgtgtttccagatctgcttattgtttgggttcaagccaccccagaggattccttgctatgaaaatgcggcatttgaatgcaatgggttttcatgtgatcttggtcaataactgggagatggacaaactagagatggaagatgcagtcacatttttgaagactaaaatctattcagtagaagctcttcctgttgctgctgtaaatgtgcaaagcacacaataaagtgaaaatcaaccttttcatattaggagacatgcatttgtaaaaattaataaagatgacaagtcagttgtcaatggaattgagctatctgctaagacaaaaaatgttacctcagttcactattaaaattaattttaggagtggaagaaatgttgttactgccatttaaaaatatgctgagaaaattccagaagggttatttttccaaccacacctattccctctagtgcccagatatttgatttgtgagctgtacgtttcaccttttcatctttgatctactaaaaactggtttcttagttgtgaggtgtcacaggcaggttgatgtgggtagtagtccttgtctttggaatctgaatatttatactcctgctctaagctgttctaagacttggggttatgcctttaaatcattttcaagcattggccaaataataattggacaaagttctaaagttgtcaagtgtgtaagaattagtgaggtagctgttgaaaatgagtgaggatggtatttgtatttgtaataagcactgcaggtagagatatttcatgggttataataagagaaacacagatgagatgtagatggtaaggagtcttactgttgttggggtccttcctttctctttcttttttcccccttacccctcccacaatttcatgaagtcttttaaattaaatatatagctgaattgtgttgtgaatcagacctgaggactattttttcgattatgtgtgttcattctttgttcaaatatttgtccaaattcaactattttgttcaatatgcctgtctacctagtatttggctcgctggggatatagtgatgaataggcatggtctcttgtggaacttacagcatgggttccatgcaagttggtgttattctgcccccaagcacacagacatgcaattactagacatcttagtatgtgccgggcactgctaagtattcatttgtgtgctgccttttcatgatctgaaccctttgaggtgtagctgctattatgattctctctgtgtcttcacttcctcatctctaaaatcaggataggtatttgcccaaggctacacagaagtaggggagggctggagtttgaatgtgagctaacataggcttataagaaaatacaaaaatgggattataggcgtgacccccacccccggtccaagatggctatctcttaacacacttgtaacccatttgtgcacacaggtgtgccgtgactcactggtggatccaaaaaaagctgaagcctacatttcccagagcccctttcagcttgaattccaaatgtgacttagcttcctctatgcagatgtacctacttgaaactgggaaggccaaatgagatagaggtaatgtttctgccaacaaacagccacagagcattttatttttctagaagagcaataacagagaccccagggtgtggtgtggcaggacgaggagcatccattttgctggtggggattgtggctaaaataatgtggctctggagccagcaatgggcagcatcttcatgactttccagcttccaggctgtaagcagagatagcatctcttctggacagccagttatgtgatagtgttctgagagtcattcctggaagtcagactaaaggctgctccttcagcctttccattcatcttgtaagcaggaggcttctgtgcatggccagaaactaacaaaagcacattgtgtctaaactaggttgcagtggtttctgttatcagcaagtaaatcctgattgataaagatactacaatatatgcacatatatatgttatagaatcaataaaaattggatactttgctttaaaaattt

SEQ ID NO: 41668 - DNA, 2435 bp, Homo sapiens
  misc_feature (31)..(31): n is a, c, g, or t
aacctttaaggctaggtacgaggccgggtgntgaaaaagaatcatcagtgagctgctgacatcagatgacatgaagaatgcttacaagctgcatactttggatacttgtctaaaacttgatgatactgtctatctgagggacatagccttgtcactcccacagctgccgcgggagctgccatcgtcacatacaaatgcaaaggtggcagaggtgctgagcagccttctgggaggtgaaggacacttctcaaaggatgtgcacttgccacacaattatcatattgattttgaaatcagaatggacactaacaggaatcaagtgctaccactttctgatgtggatacaacttctgctacagatattcaaagagtagctgtgctatgtgtttccagatctgcttattgtttgggttcaagccaccccagaggattccttgctatgaaaatgcggcatttgaatgcaatgggttttcatgtgatcttggtcaataactgggagatggacaaactagagatggaagatgcagtcacatttttgaagactaaaatctattcagtagaagctcttcctgttgctgctgtaaatgtgcaaagcacacaataaagtgaaaatcaaccttttcatattaggagacatgcatttgtaaaaattaataaagatgacaagtcagttgtcaatggaattgagctatctgctaagacaaaaaatgttacctcagttcactattaaaattaattttaggagtggaagaaatgttgttactgccatttaaaaatatgctgagaaaattccagaagggttatttttccaaccacacctattccctctagtgcccagatatttgatttgtgagctgtacgtttcaccttttcatctttgatctactaaaaactggtttcttagttgtgaggtgtcacaggcaggttgatgtgggtagtagtccttgtctttggaatctgaatatttatactcctgctctaagctgttctaagacttggggttatgcctttaaatcattttcaagcattggccaaataataattggacaaagttctaaagttgtcaagtgtgtaagaattagtgaggtagctgttgaaaatgagtgaggatggtatttgtatttgtaataagcactgcaggtagagatatttcatgggttataataagagaaacacagatgagatgtagatggtaaggagtcttactgttgttggggtccttcctttctctttcttttttcccccttacccctcccacaatttcatgaagtcttttaaattaaatatatagctgaattgtgttgtgaatcagacctgaggactattttttcgattatgtgtgttcattctttgttcaaatatttgtccaaattcaactattttgttcaatatgcctgtctacctagtatttggctcgctggggatatagtgatgaataggcatggtctcttgtggaacttacagcatgggttccatgcaagttggtgttattctgcccccaagcacacagacatgcaattactagacatcttagtatgtgccgggcactgctaagtattcatttgtgtgctgccttttcatgatctgaaccctttgaggtgtagctgctattatgattctctctgtgtcttcacttcctcatctctaaaatcaggataggtatttgcccaaggctacacagaagtaggggagggctggagtttgaatgtgagctaacataggcttataagaaaatacaaaaatgggattataggcgtgacccccacccccggtccaagatggctatctcttaacacacttgtaacccatttgtgcacacaggtgtgccgtgactcactggtggatccaaaaaaagctgaagcctacatttcccagagcccctttcagcttgaattccaaatgtgacttagcttcctctatgcagatgtacctacttgaaactgggaaggccaaatgagatagaggtaatgtttctgccaacaaacagccacagagcattttatttttctagaagagcaataacagagaccccagggtgtggtgtggcaggacgaggagcatccattttgctggtggggattgtggctaaaataatgtggctctggagccagcaatgggcagcatcttcatgactttccagcttccaggctgtaagcagagatagcatctcttctggacagccagttatgtgatagtgttctgagagtcattcctggaagtcagactaaaggctgctccttcagcctttccattcatcttgtaagcaggaggcttctgtgcatggccagaaactaacaaaagcacattgtgtctaaactaggttgcagtggtttctgttatcagcaagtaaatcctgattgataaagatactacaatatatgcacatatatatgttatagaatcaataaaaattggatactttgctttaaaaattt

SEQ ID NO: 41669 - DNA, 2517 bp, Homo sapiens
gcatcgcccttataagctctgtggtatccccgagccccactcctgtatgcagggaaattagtcattctccttggtaaactttcttcaagtaagtccttcagctacagccgcgaacatatgctttttgacctttgagggaatccgtaagatctcgtgagaagcgcagcttctcggggaagctgtcatggctgctcctgtacgtagtcacggtcttgtgctctaaggtgagtggaggacgagcttgggcttagcggcagcccgtatcacatcctagactttttacttcgaggagaagagtctcacgagttgtcctggaagaaaacgacagcacgtgttctttttcactagtagaagtgacgttggtttcatgttgacaactttgaagccatttggaagtgtttcagtggagagcaaaatgaataacaaagcgggctcctttttctggaaccttagacaattcagtacattagtttcaacaagcagaactatgaggctatgttgtttgggactttgcaaaccaaaaatagttcattcaaactggaacattttaaataactttcataacagaatgcaatcaactgatatcattagatatctctttcaggatgcattcatttttaaatcagatgttggctttcaaacaaagggcataagcactctaacagcccttagaattgaaagactactttatgctaaaagactgttttttgactcaaagcagtctcttgtccctgttgataaatctgatgatgaattgaagaaagtaaaccttaatcatgaagtctccaatgaagatgttcttaccaaggaaacaaaaccaaaccgtatcagcagtagaaaactgtctgaggaatgtaattccctgagtgatgtgttagatgcattttcaaaagcgcccacatttcctagtagcaactatttcacagcaatgtggacaattgccaaaagactgtctgatgaccagaagcgctttgaaaaacgactgatgtttagccaccctgcatttaatcagctctgtgaacatatgatgagagaagccaagatcatgcagtataagtacctactgttcagtcttcacgccatagtgaagcttggaatccctcagaacactattttggtgcagactttgctgagggtgacccaggaacgtatcaatgagtgtgatgagatatgcctttcagttttgtcaactgttttagaggcaatggaaccatgcaagaatgttcatgttctacgaacgggattcagaatactagttgatcagcaagtttggaaaatagaagatgtcttcacattacaagttgtgatgaagtgtattggaaaagatgcaccgattgctcttaagaggaaactggagatgaaagccttgagggaattagacagattttctgttttgaatagccaacacatgtttgaagtactagctgccatgaatcaccgatctcttatactcctggatgaatgcagtaaggtggtcctagataatatccatgggtgtcctttaagaataatgatcaacatattgcagtcctgcaaagacctccagtaccataatttggatctcttcaagggacttgcagattatgtggctgcaactttcgacatctggaagttcagaaaagttctttttatcctcattttatttgaaaaccttggctttcgacctgttggtttaatggacctgtttatgaagagaatagtagaggatcctgaatccctaaacatgaaaaacattctatctattcttcatacttactcttctctcaatcatgtctacaaatgccagaacaaagaacagttcgtggaagttatggctagtgctctgactggttatcttcacactatttcttctgaaaacttattggatgcagtatattcattttgcttgatgaattactttcccctggctccttttaatcagcttctgcaaaaagacatcatcagtgagctgctgacatcagatgacatgaagaatgcttacaagctgcatactttggatacttgtctaaaacttgatgatactgtctatctgagggacatagccttgtcactcccacagctgccgcgggagctgccatcgtcacatacaaatgcaaaggtggcagaggtgctgagcagccttctgggaggtgaaggacacttctcaaaggatgtgcacttgccacacaattatcatattgattttgaaatcagaatggacactaacaggaatcaagtgctaccactttctgatgtggatacaacttctgctacagatattcaaagagtagctgtgctatgtgtttccagatctgcttattgtttgggttcaagccaccccagaggattccttgctatgaaaatgcggcatttgaatgcaatgggttttcatgtgatcttggtcaataactgggagatggacaaactagagatggaagatgcagtcacatttttgaagactaaaatctattcagtagaagctcttcctgttgctgctgtaaatgtgcaaagcacacaataaagtgaaaatcaaccttt

SEQ ID NO: 41670 - DNA, 3575 bp, Homo sapiens
gcatcgcccttataagctctgtggtatccccgagccccactcctgtatgcagggaaattagtcattctccttggtaaactttcttcaagtaagtccttcagctacagccgcgaacatatgctttttgacctttgagggaatccgtaagatctcgtgagaagcgcagcttctcggggaagctgtcatggctgctcctgtacgtagtcacggtcttgtgctctaaggtgagtggaggacgagcttgggcttagcggcagcccgtatcacatcctagactttttacttcgaggagaagagtctcacgagttgtcctggaagaaaacgacagcacgtgttctttttcactagtagaagtgacgttggtttcatgttgacaactttgaagccatttggaagtgtttcagtggagagcaaaatgaataacaaagcgggctcctttttctggaaccttagacaattcagtacattagtttcaacaagcagaactatgaggctatgttgtttgggactttgcaaaccaaaaatagttcattcaaactggaacattttaaataactttcataacagaatgcaatcaactgatatcattagatatctctttcaggatgcattcatttttaaatcagatgttggctttcaaacaaagggcataagcactctaacagcccttagaattgaaagactactttatgctaaaagactgttttttgactcaaagcagtctcttgtccctgttgataaatctgatgatgaattgaagaaagtaaaccttaatcatgaagtctccaatgaagatgttcttaccaaggaaacaaaaccaaaccgtatcagcagtagaaaactgtctgaggaatgtaattccctgagtgatgtgttagatgcattttcaaaagcgcccacatttcctagtagcaactatttcacagcaatgtggacaattgccaaaagactgtctgatgaccagaagcgctttgaaaaacgactgatgtttagccaccctgcatttaatcagctctgtgaacatatgatgagagaagccaagatcatgcagtataagtacctactgttcagtcttcacgccatagtgaagcttggaatccctcagaacactattttggtgcagactttgctgagggtgacccaggaacgtatcaatgagtgtgatgagatatgcctttcagttttgtcaactgttttagaggcaatggaaccatgcaagaatgttcatgttctacgaacgggattcagaatactagttgatcagcaagtttggaaaatagaagatgtcttcacattacaagttgtgatgaagtgtattggaaaagatgcaccgattgctcttaagaggaaactggagatgaaagccttgagggaattagacagattttctgttttgaatagccaacacatgtttgaagtactagctgccatgaatcaccgatctcttatactcctggatgaatgcagtaaggtggtcctagataatatccatgggtgtcctttaagaataatgatcaacatattgcagtcctgcaaagacctccagtaccataatttggatctcttcaagggacttgcagattatgtggctgcaactttcgacatctggaagttcagaaaagttctttttatcctcattttatttgaaaaccttggctttcgacctgttggtttaatggacctgtttatgaagagaatagtagaggatcctgaatccctaaacatgaaaaacattctatctattcttcatacttactcttctctcaatcatgtctacaaatgccagaacaaagaacagttcgtggaagttatggctagtgctctgactggttatcttcacactatttcttctgaaaacttattggatgcagtatattcattttgcttgatgaattactttcccctggctccttttaatcagcttctgcaaaaagacatcatcagtgagctgctgacatcagatgacatgaagaatgcttacaagctgcatactttggatacttgtctaaaacttgatgatactgtctatctgagggacatagccttgtcactcccacagctgccgcgggagctgccatcgtcacatacaaatgcaaaggtggcagaggtgctgagcagccttctgggaggtgaaggacacttctcaaaggatgtgcacttgccacacaattatcatattgattttgaaatcagaatggacactaacaggaatcaagtgctaccactttctgatgtggatacaacttctgctacagatattcaaagagtagctgtgctatgtgtttccagatctgcttattgtttgggttcaagccaccccagaggattccttgctatgaaaatgcggcatttgaatgcaatgggttttcatgtgatcttggtgagaaaaaaatgcaaatgaaatattctttaattactgatgtacattctaacagctgccaggaatcttgtggttgagactggttactaggactagaggaattgtcagcattattggaatgagtgctttagttactgttttctttgaaaaagaacattgctagtacacgatttgggttctgctcagctgattactgtcattactagagcttttacaaatgttgttctggtcagctttaatccttttttgctaagaagaagaatgcaaataatatattttcatatttaagatacacaaaaccatatttaatttccaggttatcttgaacaagggaaggaaagatgttaaagctttgttttcatggcctgtgtgaagctgttacaggatgtttgttgccagaaaaggctggatggttttaagaagatgggtctttctcttccctcttatgcttcaattttattttgtaccccacagcttctcttgaacagcctcttctgatgtttctaggtagtaggaaccttacaaatacatttatatatatgttgctgttggaatctatctaaatgccactcatttggtcctgcgcataatgtaagatgtaaacattccaagtcttctattattatactttagtattggaaatggattacgtgtggactattgagattaagatgactcctttctcttagtgggctactatttaagactttgttttttatattgctgattatatatattctaaggaagattttctcaagaaagcagtttttgcaccatttagaggacctttaaaatttgtataattttcacagttaaagctttcttaaaccctagcatgtagtcttattatgcctttaaaatatgagtagttataaggtcacatttgctttcaaaaagctattgtcctcatgttactttactatgtttggatctctaaactagctcttttgttagtatcgtctcacaaactgattattttcctctttctttggtaaggtcaataactgggagatggacaaactagagatggaagatgcagtcacatttttgaagactaaaatctattcagtagaagctcttcctgttgctgctgtaaatgtgcaaagcacacaataaagtgaaaatcaaccttttcatattaggagacatgcatttgtaaaaattaataaagatgacaagtcagttgtcaatggaa

SEQ ID NO: 41671 - DNA, 2491 bp, Homo sapiens
gcatcgcccttataagctctgtggtatccccgagccccactcctgtatgcagggaaattagtcattctccttggtaaactttcttcaagtaagtccttcagctacagccgcgaacatatgctttttgacctttgagggaatccgtaagatctcgtgagaagcgcagcttctcggggaagctgtcatggctgctcctgtacgtagtcacggtcttgtgctctaaggtgagtggaggacgagcttgggcttagcggcagcccgtatcacatcctagactttttacttcgaggagaagagtctcacgagttgtcctggaagaaaacgacagcacgtgttctttttcactagtagaagtgacgttggtttcatgttgacaactttgaagccatttggaagtgtttcagtggagagcaaaatgaataacaaagcgggctcctttttctggaaccttagacaattcagtacattagtttcaacaagcagaactatgaggctatgttgtttgggactttgcaaaccaaaaatagttcattcaaactggaacattttaaataactttcataacagaatgcaatcaactgatatcattagatatctctttcaggatgcattcatttttaaatcagatgttggctttcaaacaaagggcataagcactctaacagcccttagaattgaaagactactttatgctaaaagactgttttttgactcaaagcagtctcttgtccctgttgataaatctgatgatgaattgaagaaagtaaaccttaatcatgaagtctccaatgaagatgttcttaccaaggaaacaaaaccaaaccgtatcagcagtagaaaactgtctgaggaatgtaattccctgagtgatgtgttagatgcattttcaaaagcgcccacatttcctagtagcaactatttcacagcaatgtggacaattgccaaaagactgtctgatgaccagaagcgctttgaaaaacgactgatgtttagccaccctgcatttaatcagctctgtgaacatatgatgagagaagccaagatcatgcagtataagtacctactgttcagtcttcacgccatagtgaagcttggaatccctcagaacactattttggtgcagactttgctgagggtgacccaggaacgtatcaatgagtgtgatgagatatgcctttcagttttgtcaactgttttagaggcaatggaaccatgcaagaatgttcatgttctacgaacgggattcagaatactagttgatcagcaagtttggaaaatagaagatgtcttcacattacaagttgtgatgaagtgtattggaaaagatgcaccgattgctcttaagaggaaactggagatgaaagccttgagggaattagacagattttctgttttgaatagccaacacatgtttgaagtactagctgccatgaatcaccgatctcttatactcctggatgaatgcagtaaggtggtcctagataatatccatgggtgtcctttaagaataatgatcaacatattgcagtcctgcaaagacctccagtaccataatttggatctcttcaagggacttgcagattatgtggctgcaactttcgacatctggaagttcagaaaagttctttttatcctcattttatttgaaaaccttggctttcgacctgttggtttaatggacctgtttatgaagagaatagtagaggatcctgaatccctaaacatgaaaaacattctatctattcttcatacttactcttctctcaatcatgtctacaaatgccagaacaaagaacagttcgtggaagttatggctagtgctctgactggttatcttcacactatttcttctgaaaacttattggatgcagtatattcattttgcttgatgaattactttcccctggctccttttaatcagcttctgcaaaaagacatcatcagtgagctgctgacatcagatgacatgaagaatgcttacaactgccatcgtcacatacaaatgcaaaggtggcagaggtgctgagcagccttctgggaggtgaaggacacttctcaaaggatgtgcacttgccacacaattatcatattgattttgaaatcagaatggacactaacaggaatcaagtgctaccactttctgatgtggatacaacttctgctacagatattcaaagagtagctgtgctatgtgtttccagatctgcttattgtttgggttcaagccaccccagaggattccttgctatgaaaatgcggcatttgaatgcaatgggttttcatgtgatcttggtcaataactgggagatggacaaactagagatggaagatgcagtcacatttttgaagactaaaatctattcagtagaagctcttcctgttgctgctgtaaatgtgcaaagcacacaataaagtgaaaatcaaccttttcatattaggagacatgcatttgtaaaaattaataaagatgacaagtcagttgtcaatggaa

SEQ ID NO: 41672 - DNA, 1935 bp, Homo sapiens
gcatcgcccttataagctctgtggtatccccgagccccactcctgtatgcagggaaattagtcattctccttggtaaactttcttcaagtaagtccttcagctacagccgcgaacatatgctttttgacctttgagggaatccgtaagatctcgtgagaagcgcagcttctcggggaagctgtcatggctgctcctgtacgtagtcacggtcttgtgctctaaggtgagtggaggacgagcttgggcttagcggcagcccgtatcacatcctagactttttacttcgaggagaagagtctcacgagttgtcctggaagaaaacgacagcacgtgttctttttcactagtagaagtgacgttggtttcatgttgacaactttgaagccatttggaagtgtttcagtggagagcaaaatgaataacaaagcgggctcctttttctggaaccttagacaattcagtacattagtttcaacaagcagaactatgaggctatgttgtttgggactttgcaaaccaaaaatagttcattcaaactggaacattttaaataactttcataacagaatgcaatcaactgatatcattagatatctctttcaggatgcattcatttttaaatcagatgttggctttcaaacaaagggcataagcactctaacagcccttagaattgaaagactactttatgctaaaagactgttttttgactcaaagcagtctcttgtccctgttgataaatctgatgatgaattgaagaaagtaaaccttaatcatgaagtctccaatgaagatgttcttaccaaggaaacaaaaccaaaccgtatcagcagtagaaaactgtctgaggaatgtaattccctgagtgatgtgttagatgcattttcaaaagcgcccacatttcctagtagcaactatttcacagcaatgtggacaattgccaaaagactgtctgatgaccagaagcgctttgaaaaacgactgatgtttagccaccctgcatttaatcagctctgtgaacatatgatgagagaagccaagatcatgcagtataagtacctactgttcagtcttcacgccatagtgaagcttggaatccctcagaacactattttggtgcagactttgctgagggtgacccaggaacgtatcaatgagtgtgatgagatatgcctttcagttttgtcaactgttttagaggcaatggaaccatgcaagaatgttcatgttctacgaacgggattcagaatactagttgatcagcaagtttggaaaatagaagatgtcttcacattacaagttgtgatgaagtgtattggaaaagatgcaccgattgctcttaagaggaaactggagatgaaagccttgagggaattagacagattttctgttttgaatagccaacacatgtttgaagtactagctgccatgaatcaccgatctcttatactcctggatgaatgcagtaaggtggtcctagataatatccatgggtgtcctttaagaataatgatcaacatattgcagtcctgcaaagacctccagtaccataatttggatctcttcaagggacttgcagattatgtggctgcaactttcgacatctggaagttcagaaaagttctttttatcctcattttatttgaaaaccttggctttcgacctgttggtttaatggacctgtttatgaagagaatagtagaggatcctgaatccctaaacatgaaaaacattctatctattcttcatacttactcttctctcaatcatgtctacaaatgccagaacaaagaacagttcgtggaagttatggctagtgctctgactggttatcttcacactatttcttctgaaaacttattggatgcagtatattcattttgcttgatgaattactttcccctggcttgccaatatccgaaggacctcgagac

SEQ ID NO: 41673 - DNA, 1286 bp, Homo sapiens
ccttacccctcccacaattttaaagacttcatgaaattgtgggaggggtaagggggaaaaaagaaagagaaaggaaggaccccaacaacagtaagactccttaccatctacatctcatctgtcttttaaattaaatatatagctgaattgtgttgtgaatcagacctgaggactattttttcgattatgtgtgttcattctttgttcaaatatttgtccaaattcaactattttgttcaatatgcctgtctacctagtatttggctcgctggggatatagtgatgaataggcatggtctcttgtggaacttacagcatgggttccatgcaagttggtgttattctgcccccaagcacacagacatgcaattactagacatcttagtatgtgccgggcactgctaagtattcatttgtgtgctgccttttcatgatctgaaccctttgaggtgtagctgctattatgattctctctgtgtcttcacttcctcatctctaaaatcaggataggtatttgcccaaggctacacagaagtaggggagggctggagtttgaatgtgagctaacataggcttataagaaaatacaaaaatgggattataggcgtgacccccacccccggtccaagatggctatctcttaacacacttgtaacccatttgtgcacacaggtgtgccgtgactcactggtggatccaaaaaaagctgaagcctacatttcccagagcccctttcagcttgaattccaaatgtgacttagcttcctctatgcagatgtacctacttgaaactgggaaggccaaatgagatagaggtaatgtttctgccaacaaacagccacagagcattttatttttctagaagagcaataacagagaccccagggtgtggtgtggcaggacgaggagcatccattttgctggtggggattgtggctaaaataatgtggctctggagccagcaatgggcagcatcttcatgactttccagcttccaggctgtaagcagagatagcatctcttctggacagccagttatgtgatagtgttctgagagtcattcctggaagtcagactaaaggctgctccttcagcctttccattcatcttgtaagcaggaggcttctgtgcatggccagaaactaacaaaagcacattgtgtctaaactaggttgcagtggtttctgttatcagcaagtaaatcctgattgataaagatactacaatatatgcacatatatatgttatagaatcaataaaaattggatactttgctttaaaaattt

SEQ ID NO: 41674 - DNA, 251 bp, Homo sapiens
aatactagttgatcagcaagtttggaaaatagaagatgtcttcacattacaagttgtgatgaagtgtattggaaaagatgcaccgattgctcttaagaggaaactggaggtaaacacatgaattttctctagtggatgagatttgaaaaaatctttcttataacctgctatcactgcctgaagtcaattttctaggaggacattgctgggcttttaggtttagcttcactaaagtgaatgaatagaagtac

SEQ ID NO: 41675 - DNA, 274 bp, Homo sapiens
agtatgactttttatttcccaaagatgctgtttattgtggactgactgtaggaattgttggtttgatactcaatcgttttattcagtacatcagttcagtggttttgcttgggtaagatagtttactatgggctcatcacctgtagtgtttttgtaattatatttcaataggaacgtatcaatgagtgtgatgagatatgcctttcagttttgtcaactgttttagaggcaatggaaccatgcaagaatgttcatgttctacgaacgggattca

SEQ ID NO: 41676 - DNA, 249 bp, Homo sapiens
ctgctcctgtacgtagtcacggtcttgtgctctaaggtgagtggaggacgagcttgggcttagcggcagcccgtatcacatcctagactttttacttcgaggagaagagtctcacgagttgtcctggaataaaggaggtgggttaatgctgggcggcccagctgcggaaggacaggctcttgaagttggttctggggtctggtgaggctggctggttgtataagatcttcctcttaagcgcaggccacg

SEQ ID NO: 41677 - DNA, 714 bp, Homo sapiens
tatagaaattttggggttatgtcttacatgttagaatctaggaagtatttaagtttgggaatgcgagaagttcaagattgagttggtcattttgaaaaccttcagaaaaggcatatttaaaagtaattttcagatatgttgtatgaaaagcatgtaggaagagatttatttttaaatcagatggaaacgtagaaatcattgtatgccctggttctcagcttaaaaaagattgcttattaacttgatacccaattcaagaattaatagaacagattttgtgagagaaagatgattgttccttttcatggaaatattctgtttcaggatatattctgttgatcaggacagttgaattgctgcttagattttttgagatctaaaaaattactattagcatactgtaattattatagagttttccctcaattttctctttttaaggttctttttatcctcattttatttgaaaaccttggctttcgacctgttggtttaatggacctgtttatgaagagaatagtagaggatcctgaatccctaaacatgaaaaacattctatctattcttcatacttactcttctctcaatcatgtctacaaatgccagaacaaagagtatgtacttgtttttttttaccttttttattgccatataacttacaaaaaaggttataaatcataagcttaatgaattattacaagtgaacacacccat

SEQ ID NO: 41678 - DNA, 1298 bp, Homo sapiens
caattggcttttaaatagtcaaacgtttataataaacatattttccaatctcgaaacgactgtcagtggtaacaatgatcaacgtaacatagatgtaacaggaacatcacgacgttcgactatacttacaggaaacacaagctacagtgaaatactatctcacgcctaccaggtctgcaaaatccagcttgggcaagggtgtcgccggccccctcttatgctggtgggggagggcgatttggtaccacccctttaggggcctaaatacagccctcgcacttctgcaccaaggaatttaacctaagaaaatagtccgacttgggcaaaaaacggtttgtacaagcaatagtcaagctagcattgttcgttataaaagacagcaaaaaccctaaatttctacaggaaaggggataaagtctggtgctataaaactccgtttccggaggaatcccacctgtatctgaatgcatggggcgctctccgagctacgttaagtataagagccccaagtaaagtaactgaccttttgcagaaacgcacgtagatgttcctgcatagactttctttgcagacccgtaagaaacgggtttccctctgccccaggggagaactgggccttggaggttaggactgggaaaaacacatcaagtcttcaccaaataccctttcaggctccttgaattttctactctgtgcacctgaacacacttttgttctcttgcaagcagttgctttgcactggaggcaatgaagacacggcggagtcccagctcgcagggagctcaggttctgacggcgtcagaggacaacacgctctggaccagcgcagcgcccaagggtcagcggcagcagcgagcagggggcacgggatgcggggaggctcttcgggaggcatgaaaggcagacgtgttccgaaacgtgagccgcgctgaggggcacggcgcacgaccggggacagaaggaagacactgcggtcgcaaagccctggccgtgcaaaggccccgtggtcagccaggagcccaggcgtcccctgctctagcgaggtttccttccgaacgtcccgtagcaccgcttaccatggaacggcgggcgctgcctcgcagccccgaccccgcggcggcccccacgggcccacgaggaactcgaggccgagggaaggagtgagagcggccggaaaggggcagggccgagccggaccggtacctggctgggtcccagcggccgccacttaccaccgaggccgcctcttcgtccacagcctgacgccagccaccgccgccgccgtctccactgccgca

SEQ ID NO: 41679 - DNA, 333 bp, Homo sapiens
caattggcttttaaatagtcaaacgtttataataaacatattttccaatctcgaaacgactgtcagtggtaacaatgatcaacgtaacatagatgtaacaggaacatcacgacgttcgactatacttacaggaaacacaagctacagtgaaatactatctcacgcctaccaggtctgcaaaatccagcttgggcaagggtgtcgccggccccctcttatgctggtgggggagggcgattacggacgaaaacatgcattgccacaacactgcctatgctcttctatatctaagaaacgcacgtttgatacataccaaaaaacgcgtcctttata

SEQ ID NO: 41680 - DNA, 315 bp, Homo sapiens
aattatgctaaatataataattagaaaaatgaactagctaaataaaattctcagtaagctggctagaaggaatagagaaaaagaggagcagccaggaatgtggaaggtagacagtattctgtaaacatctgtctcagtacagaagcgaaatcattatagctatagctctggcttcccttaagctccagaagcttggcaaaaaaaaaaaaaaaaaaaaaatcctaaatatacagtttttctcctatgaacatatttttaaggtacaaattttcatttctgtaaaagccctttgagattttataaaactgtatcttt

SEQ ID NO: 41681 - DNA, 371 bp, Homo sapiens
tgttaccactctcttcaacaaagtactggaagtcctagccacagcagtcaggcaagagaaagaaataaagttcacccaaatcagtaaagaggaagtcaaactgtcactgatgatatgatttgctgatgatatgattgtttaccttgaaaaccctaaggactcctccagaaagctcctagaactgatgaaagaattcagcaaagtttctggataaaagattaatgtacacacatcagtagctcttctgtataccaacagtgaccaagtggaggttgaaatcaagaactcaacccctttcacaatagctgcaaaaaacaaacaaacaaaaagcttaggaatatacataaccaggtgccaaaagacctctacaa

SEQ ID NO: 41682 - DNA, 3099 bp, Homo sapiens
gcgactgcgcgcgcagggcctgagcgggcgccggagggaaggggaagcggcggggtagtaacagattatgggcaacagtccttttaattaatctaccgtcatcatggctaatgaggactgtcccaaggctgctgatagtcctttttcatcagataaacatgcccaactcatcttggcccaaatcaataagatgagaaatggacagcatttctgtgatgtgcagctgcaagttggacaggaaagttttaaagctcatcggctggttttggctgccagcagtccttactttgcagctttgttcactggaggaatgaaagagtcctcaaaagatgttgtaccgattctaggaattgaagcaggaatctttcagatacttctagatttcatttacacaggtatagtgaacataggtgtgaataatgtccaggagttgattattgcagcagacatgctacagttgactgaagttgttcatctttgctgtgaatttctgaaaggacaaattgatccactgaactgcattggaatttttcagttctctgagcaaattgcctgccatgatctcttggaattctcagaaaactacattcatgtccatttcttggaggttcatagtggagaagagttcctggcacttacgaaagatcagctgatcaaaattttgcgaagtgaagagcttagcattgaggatgaataccaggtcttcttagctgcaatgcaatggattctgaaagatttgggaaaaagaagaaaacatgtggtggaagtgctagacccaattcgattccctttattacctcctcagagacttttaaagtatatagaaggagtatccgattttaatcttcgtgttgcattgcaaacacttctgaaagagtactgtgaagtatgcaaatctcccaaagagaacaagttttgtagttttctgcagacatctaaggttcgacctcggaagaaagcaagaaagtacctgtatgcagtaggtggatatactcggttgcaggggggtcgctggagtgatagcagagccctcagctgtgtagaacgttttgacacctttagccagtactggaccactgtgtcttcacttcatcaggctcgaagtgggctgggagtaacagttctgggagggatggtctacgctattggaggtgaaaaggattcaatgatttttgattgtactgaatgctatgatccagttactaaacagtggacaactgtagcttcgatgaatcatccccgctgcggcttaggagtgtgtgtgtgttatggggctatctatgctttgggtggatgggttggagctgagatagggaacaccattgaacgatttgatcctgatgaaaataaatgggaagtagttggtaacatggctgtgtcacgctactactttgggtgctgtgaaatgcaaggtttaatttatgtaattgggggcatcagcaatgaaggaatagaacttcgttcttttgaagtctatgatccactttctaagcgttggtctccacttcctccaatgggaaccaggagagcatatcttggtgtggctgcactcaatgactgcatctattctgttggaggatggaatgagacccaagatgctcttcatactgtagaaaaatattcctttgaagaggaaaagtgggttgaagttgcctcaatgaaagtgcctagagcaggcatgtgtgttgtggcagtcaatggtcttctgtatgtttctggaggtcgatcttccagccatgattttttggctccaggtaccttggactcagttgaagtttataaccctcattcagatacatggacagaaattggtaacatgatcaccagtcgttgtgaagggggcgttgctgtgctatgaaatataaagcataacagagcacaaggaacattttgaaaatgcaggacctgaccttttgcaaagcaaacatagatttggtgataagaccctctgattctgtgagttttccatgtatttggtagataaatgactaacgaggctgggcgcagtggcctcatgcctataatcccagcactttggaaggctgaggcagaaggatcacttgagcccaggaatttgaggttgtagtaagctacgatcatgccactgcactccactctgggcaacagaatgagatcctgtctcttaaagaaaaaaaataaactcaagaatgatttttctaaaaatatgagtgagaatggatatggaatatatcccaattaataaagagctcacacagatttgccaggtttactaataatagaaatgccatttatgctgtagaattctccagtttaagtgtagacaactcctattttacaaatttgtagaaattatttactagaagcttcctggcaaatagtccctttagctacttctccagtgcagtataaattgtaacataaaactttatgtgatataggaatagtgtcaatgacacagtttaaagacctctatattcacaattatatccagagcataattttccatggccatagtttgagccacagagaaagccaatgaaatagattcctacttttatttaatgccaagagttttcactagccccaaactttttattggcagcagatatcctaggaggggtgtttgggaaatatctagctattttaatagatagatacctttttgcttgatgataagtttttgcttgctcatattttttgtcttgatcctgagaatgcaagtaaggaattaataggaggttcttagtgaccagatgttgtaatgggctatacagtccagcaggcagtatgcacctagaaatttctcccttttttaggctgggcatggtggctcacgcctgtagtcccagcactttgagaggccgaggtgagacgggaagatggcttgaactcgggagttcgagactagcctgggcaacgtgatgagactccgtctctaccaaaaaatatataaaaattagccgggcgttgtggcttgtacctgtggtcccatctgcttgggaggctgaggttgcaggatcgcttgagcccaggaggtcagggctgcagtgagccgagattgtgccactgcacaccggcctgggtgacagcatgagaacctgtctcaaaaaaaaaaaa

SEQ ID NO: 41683 - DNA, 923 bp, Homo sapiens
ggtgagactaggaatttcagaaaactaggttttctgttaattctttttttctccaccttaagtagagtgattagagactacgttttcaagtgaaaatctaaggtgttgcttttgctgttttaagaaagcttctgcactgggtgcagtggctcacgcctgcaatcctaacactttgggagcctaggcaggaggattgcttgagctcagttcaagaccagcctgggcaacatagggagaccctgtctctacaaaaaattaaaaaattagcttggcatagtggtgcacaactgtagtcccagctactcaggaggctgaggtgggagaattgcttgagcccaggaggtcgaggctgcagtgagccatgaccacaccactacactctggcctgagcaagagtgagaccctgcgtttaaacaaaacaaaacaaaaacaaaaacacaccaaagctaaaagcttctctgtgatttaaaagatgtagaactagaccagcctgtccaacatggtgaaatgccacctctactaaaaatacacaccaaaaaattagttgggcatggtggcacgtgcctataatcccagctactctagagatgctgaggcaggagaatcgcttgaactcgggaggtggaggttgcggtgagccaagatcgtgccactgcactccagcctaggcgacagaatgaaactccatctcaaaaaaaaagatgtagaactagataggcctgctcattagaatatcaagatggctccagcttgacttttctttcctaatttatatgtactagtggctttattttaaatagtttcctttgaaaataatcattttgaccagctattatgtgtttggtggtaagggacaagttgttatctgtaccatgccaaatatcctaataaaaactggaaaacatgtccaacttaaaaaaaaa

SEQ ID NO: 41684 - DNA, 617 bp, Homo sapiens
ggcaaacctaagtaagagcatactgcaaagctactgcttggatgtagagggctaaattgtaggtacttctgaaactttttatagatactgactcataagtgtaatttgaaagtaccccttgacccaaacaaaactgcttctcaaaacttctcattttctccctgagaagcattctaaagaattgttctctgttcatttctaagagaaagatttactgggtgtatgatgcggttacttttaagttatttctactggccagttggagcaatatatattaaaggtcttgcatacagtaaaaaaaatttttttttgagatggaattttgctcttgttgcccaggctggagtgcaaaggcctgagatcataccactgtgttctagcctgggccatagagcaagactttgtctcaaaaaaaaataaaacaaaaaatatttggtttagtctacaactataccttccttataacttaaccatatgcatttattaggaaaagtttatgtaatgcagacaggaagctctatgttcccttctctggggcatcctgaacgtctgaagggtcacagatgtctgtgtagagatctgtaagatgtcaaagaataaagataatttatagacta

SEQ ID NO: 41685 - DNA, 527 bp, Homo sapiens
ggcaaacctaagtaagagcatactgcaaagctactgcttggatgtagagggctaaattgtaggtacttctgaaactttttatagatactgactcataagtgtaatttgaaagtaccccttgacccaaacaaaactgcttctcaaaacttctcattttctccctgagaagcattctaaagaattgttctctgttcatttctaagagaaagatttactgggtgtatgatgcggttacttttaagttatttctactggccagttggagcaatatatattaaaggtcttgcatacagtaaaaaaaaaagatgtagaactagataggcctgctcattagaatatcaagatggctccagcttgacttttctttcctaatttatatgtactagtggctttattttaaatagtttcctttgaaaataatcattttgaccagctattatgtgtttggtggtaagggacaagttgttatctgtaccatgccaaatatcctaataaaaactggaaaacatgtccaacttaaaaaaaaa

SEQ ID NO: 41686 - DNA, 2968 bp, Homo sapiens
gcgactgcgcgcgcagggcctgagcgggcgccggagggaaggggaagcggcggggtagtaacagattatgggcaacagtccttttaattaatctaccgtcatcatggctaatgaggactgtcccaaggctgctgatagtcctttttcatcagataaacatgcccaactcatcttggcccaaatcaataagatgagaaatggacagcatttctgtgatgtgcagctgcaagttggacaggaaagttttaaagctcatcggctggttttggctgccagcagtccttactttgcagctttgttcactggaggaatgaaagagtcctcaaaagatgttgtaccgattctaggaattgaagcaggaatctttcagatacttctagatttcatttacacaggtatagtgaacataggtgtgaataatgtccaggagttgattattgcagcagacatgctacagttgactgaagttgttcatctttgctgtgaatttctgaaaggacaaattgatccactgaactgcattggaatttttcagttctctgagcaaattgcctgccatgatctcttggaattctcagaaaactacattcatgtccatttcttggaggttcatagtggagaagagttcctggcacttacgaaagatcagctgatcaaaattttgcgaagtgaagagcttagcattgaggatgaataccaggtcttcttagctgcaatgcaatggattctgaaagatttgggaaaaagaagaaaacatgtggtggaagtgctagacccaattcgattccctttattacctcctcagagacttttaaagtatatagaaggagtatccgattttaatcttcgtgttgcattgcaaacacttctgaaagagtactgtgaagtatgcaaatctcccaaagagaacaagttttgtagttttctgcagacatctaaggttcgacctcggaagaaagcaagaaagtacctgtatgcagtaggtggatatactcggttgcaggggggtcgctggagtgatagcagagccctcagctgtgtagaacgttttgacacctttagccagtactggaccactgtgtcttcacttcatcaggctcgaagtgggctgggagtaacagttctgggagggatggtctacgctattggaggtgaaaaggattcaatgatttttgattgtactgaatgctatgatccagttactaaacagtggacaactgtagcttcgatgaatcatccccgctgcggcttaggagtgtgtgtgtgttatggggctatctatgctttgggtggatgggttggagctgagatagggaacaccattgaacgatttgatcctgatgaaaataaatgggaagtagttggtaacatggctgtgtcacgctactactttgggtgctgtgaaatgcaaggtttaatttatgtaattgggggcatcagcaatgaaggaatagaacttcgttcttttgaagtctatgatccactttctaagcgttggtctccacttcctccaatgggaaccaggagagcatatcttggtgtggctgcactcaatgactgcatctattctgttggaggatggaatgagacccaagatgctcttcatactgtagaaaaatattcctttgaagaggaaaagtgggttgaagttgcctcaatgaaagtgcctagagcaggcatgtgtgttgtggcagtcaatggtcttctgtatgtttctggaggtcgatcttccagccatgattttttggctccaggtaccttggactcagttgaagtttataaccctcattcagatacatggacagaaattggtaacatgatcaccagtcgttgtgaagggggcgttgctgtgctatgaaatataaagcataacagagcacaaggaacattttgaaaatgcaggacctgaccttttgcaaagcaaacatagatttggtgataagaccctctgattctgtgagttttccatgtatttggtagataaatgactaacgaggctgggcgcagtggcctcatgcctataatcccagcactttggaaggctgaggcagaaggatcacttgagcccaggaatttgaggttgtagtaagctacgatcatgccactgcactccactctgggcaacagaatgagatcctgtctcttaaagaaaaaaaataaactcaagaatgatttttctaaaaatatgagtgagaatggatatggaatatatcccaattaataaagagctcacacagatttgccaggtttactaataatagaaatgccatttatgctgtagaattctccagtttaagtgtagacaactcctattttacaaatttgtagaaattatttactagaagcttcctggcaaatagtccctttagctacttctccagtgcagtataaattgtaacataaaactttatgtgatataggaatagtgtcaatgacacagtttaaagacctctatattcacaattatatccagagcataattttccatggccatagtttgagccacagagaaagccaatgaaatagattcctacttttatttaatgccaagagttttcactagccccaaactttttattggcagcagatatcctaggaggggtgtttgggaaatatctagctattttaatagatagatacctttttgcttgatgataagtttttgcttgctcatattttttgtcttgatcctgagaatgcaagtaaggaattaataggaggttcttagtgaccagatgttgtaatgggctatacagtccagcaggcagtatgcacctagaaatttctcccttttttaggctgggcatggtggctcacgcctgtagtcccagcactttgagaggccgaggtgagacgggaagatggcttgaactcgggacccaggaggtcagggctgcagtgagccgagattgtgccactgcacaccggcctgggtgacagcatgagaacctgtctcaaaaaaaaaaaa

SEQ ID NO: 41687 - DNA, 2731 bp, Homo sapiens
gcgactgcgcgcgcagggcctgagcgggcgccggagggaaggggaagcggcggggtagtaacagattatgggcaacagtccttttaattaatctaccgtcatcatggctaatgaggactgtcccaaggctgctgatagtcctttttcatcagataaacatgcccaactcatcttggcccaaatcaataagatgagaaatggacagcatttctgtgatgtgcagctgcaagttggacaggaaagttttaaagctcatcggctggttttggctgccagcagtccttactttgcagctttgttcactggaggaatgaaagagtcctcaaaagatgttgtaccgattctaggaattgaagcaggaatctttcagatacttctagatttcatttacacaggtatagtgaacataggtgtgaataatgtccaggagttgattattgcagcagacatgctacagttgactgaagttgttcatctttgctgtgaatttctgaaaggacaaattgatccactgaactgcattggaatttttcagttctctgagcaaattgcctgccatgatctcttggaattctcagaaaactacattcatgtccatttcttggaggttcatagtggagaagagttcctggcacttacgaaagatcagctgatcaaaattttgcgaagtgaagagcttagcattgaggatgaataccaggtcttcttagctgcaatgcaatggattctgaaagatttgggaaaaagaagaaaacatgtggtggaagtgctagacccaattcgattccctttattacctcctcagagacttttaaagtatatagaaggagtatccgattttaatcttcgtgttgcattgcaaacacttctgaaagagtactgtgaagtatgcaaatctcccaaagagaacaagttttgtagttttctgcagacatctaaggttcgacctcggaagaaagcaagaaagtacctgtatgcagtaggtggatatactcggttgcaggggggtcgctggagtgatagcagagccctcagctgtgtagaacgttttgacacctttagccagtactggaccactgtgtcttcacttcatcaggctcgaagtgggctgggagtaacagttctgggagggatggtctacgctattggaggtgaaaaggattcaatgatttttgattgtactgaatgctatgatccagttactaaacagtggacaactgtagcttcgatgaatcatccccgctgcggcttaggagtgtgtgtgtgttatggggctatctatgctttgggtggatgggttggagctgagatagggaacaccattgaacgatttgatcctgatgaaaataaatgggaagtagttggtaacatggctgtgtcacgctactactttgggtgctgtgaaatgcaaggtttaatttatgtaattgggggcatcagcaatgaaggaatagaacttcgttcttttgaagtctatgatccactttctaagcgttggtctccacttcctccaatgggaaccaggagagcatatcttggtgtggctgcactcaatgactgcatctattctgttggaggatggaatgagacccaagatgctcttcatactgtagaaaaatattcctttgaagaggaaaagtgggttgaagttgcctcaatgaaagtgcctagagcaggcatgtgtgttgtggcagtcaatggtcttctgtatgtttctggaggtcgatcttccagccatgattttttggctccaggtaccttggactcagttgaagtttataaccctcattcagatacatggacagaaattggtaacatgatcaccagtcgttgtgaagggggcgttgctgtgctatgaaatataaagcataacagagcacaaggaacattttgaaaatgcaggacctgaccttttgcaaagcaaacatagatttggtgataagaccctctgattctgtgagttttccatgtatttggtagataaatgactaacgaggctgggcgcagtggcctcatgcctataatcccagcactttggaaggctgaggcagaaggatcacttgagcccaggaatttgaggttgtagtaagctacgatcatgccactgcactccactctgggcaacagaatgagatcctgtctcttaaagaaaaaaaataaactcaagaatgatttttctaaaaatatgagtgagaatggatatggaatatatcccaattaataaagagctcacacagatttgccaggtttactaataatagaaatgccatttatgctgtagaattctccagtttaagtgtagacaactcctattttacaaatttgtagaaattatttactagaagcttcctggcaaatagtccctttagctacttctccagtgcagtataaattgtaacataaaactttatgtgatataggaatagtgtcaatgacacagtttaaagacctctatattcacaattatatccagagcataattttccatggccatagtttgagccacagaggttcgagactagcctgggcaacgtgatgagactccgtctctaccaaaaaatatataaaaattagccgggcgttgtggcttgtacctgtggtcccatctgcttgggaggctgaggttgcaggatcgcttgagcccaggaggtcagggctgcagtgagccgagattgtgccactgcacaccggcctgggtgacagcatgagaacctgtctcaaaaaaaaaaaa

SEQ ID NO: 41688 - DNA, 1530 bp, Homo sapiens
ggcaaacctaagtaagagcatactgcaaagctactgcttggatgtagagggctaaattgtaggtacttctgaaactttttatagatactgactcataagtgtaatttgaaagtaccccttgacccaaacaaaactgcttctcaaaacttctcattttctccctgagaagcattctaaagaattgttctctgttcatttctaagagaaagatttactgggtgtatgatgcggttacttttaagttatttctactggccagttggagcaatatatattaaaggtcttgcatacagtaaaaaaaatttttttttgagatggaattttgctcttgttgcccaggctggagtgcaaaggcgtgatctcggctcactgcaacctccgcctcccggattcaagcgattctcctgcctcagcctcccaagtagctgggattacaggcgcccaccaccatgcctagctaatttttctgtatggggtttcaccatgttggccaggctggtctcgaactcctgacctcaggtgatccacctgccttggcctcccgaagtgctgggattacaggcatgggccagcgtgcccggctgcatacagtaaaatttaactagttgacttaaggatttgatttcccgtttcttttttttttttttagatggagtcttgccctgtcactcaggctgagatcataccactgtgttctagcctgggccatagagcaagactttgtctcaaaaaaaaataaaacaaaaaatatttggtttagtctacaactataccttccttataacttaaccatatgcatttattaggaaaagtttatgtaatgcagacaggaagctctatgttcccttctctggggcatcctgaacgtctgaagggtcacagatgtctgtgtagagatctgtaagatgtcaaagaataaagataatttatagactaagctataactcatgtgcctttactatttctagttacagagaatctgtattctgattcaaaacagatttacaaaatacttctacaactaatttctcattgtctagtagcaactgaaaatgacactttgaaggggtgtgctttgcacagctgtggcagaaatgtaatgtcaaggcagtcagtgttttaacaggtcccgaagatccctgaaaataggtgactgtaaatatgcttattattcctaggtaatgacaagattggttttgtttttgtttttgttttgagatggagtttcgctcttgttgcggtgagccaagatcgtgccactgcactccagcctaggcgacagaatgaaactccatctcaaaaaaaaagatgtagaactagataggcctgctcattagaatatcaagatggctccagcttgacttttctttcctaatttatatgtactagtggctttattttaaatagtttcctttgaaaataatcattttgaccagctattatgtgtttggtggtaagggacaagttgttatctgtaccatgccaaatatcctaataaaaactggaaaacatgtccaacttaaaaaaaaa

SEQ ID NO: 41689 - DNA, 966 bp, Homo sapiens
aaaaatacaaaaaattggcagcaggtggtggtacatgcctgtaatcccagctgctgaggaggctgaggcaggagaatcacttgaatccaggaggtggaggttgtagtgagctgagatcataccactgtgttctagcctgggccatagagcaagactttgtctcaaaaaaaaataaaacaaaaaatatttggtttagtctacaactataccttccttataacttaaccatatgcatttattaggaaaagtttatgtaatgcagacaggaagctctatgttcccttctctggggcatcctgaacgtctgaagggtcacagatgtctgtgtagagatctgtaagatgtcaaagaataaagataatttatagactaagctataactcatgtgcctttactatttctagttacagagaatctgtattctgattcaaaacagatttacaaaatacttctacaactaatttctcattgtctagtagcaactgaaaatgacactttgaaggggtgtgctttgcacagctgtggcagaaatgtaatgtcaaggcagtcagtgttttaacaggtcccgaagatccctgaaaataggtgactgtaaatatgcttattattcctaggtaatgacaagattggttttgtttttgtttttgttttgagatggagtttcgctcttgttgcggtgagccaagatcgtgccactgcactccagcctaggcgacagaatgaaactccatctcaaaaaaaaagatgtagaactagataggcctgctcattagaatatcaagatggctccagcttgacttttctttcctaatttatatgtactagtggctttattttaaatagtttcctttgaaaataatcattttgaccagctattatgtgtttggtggtaagggacaagttgttatctgtaccatgccaaatatcctaataaaaactggaaaacatgtccaacttaaaaaaaaa

SEQ ID NO: 41690 - DNA, 936 bp, Homo sapiens
ggcaaacctaagtaagagcatactgcaaagctactgcttggatgtagagggctaaattgtaggtacttctgaaactttttatagatactgactcataagtgtaatttgaaagtaccccttgacccaaacaaaactgcttctcaaaacttctcattttctccctgagaagcattctaaagaattgttctctgttcatttctaagagaaagatttactgggtgtatgatgcggttacttttaagttatttctactggccagttggagcaatatatattaaaggtcttgcatacagtaaaaaaaatttttttttgagatggaattttgctcttgttgcccaggctggagtgcaaaggcgtgatctcggctcactgcaacctccgcctcccggattcaagcgattctcctgcctcagcctcccaagtagctgggattacaggcgcccaccaccatgcctagctaatttttctgtatggggtttcaccatgttggccaggctggtctcgaactcctgacctcaggtgatccacctgccttggcctcccgaagtgctgggattacaggcatgggccagcgtgcccggctgcatacagtaaaatttaactagttgacttaaggatttgatttcccgtttcttttttttttttttagatggagtcttgccctgtcactcaggctgagatcataccactgtgttctagcctgggccatagagcaagactttgtctcaaaaaaaaataaaacaaaaaatatttggtttagtctacaactataccttccttataacttaaccatatgcatttattaggaaaagtttatgtaatgcagacaggaagctctatgttcccttctctggggcatcctgaacgtctgaagggtcacagatgtctgtgtagagatctgtaagatgtcaaagaataaagataatttatagacta

SEQ ID NO: 41691 - DNA, 502 bp, Homo sapiens
tcagcagccatagtctcgcttcagggtgtccagtgtttcgaggaggagaggggacaggggccaggtccactcccttggccctcctcttggaccccaaggccaggccggatccttttatcccgtggggagcccctgcctcggccatcgggatgaggtccctcaagtccctgcacaagcaggtcagagacccacccacatgccgttcctgggctacgccacgcgccatcccccggggctgtggacgcacccagcccccgacagacaggcgccctgagagctccgaaggcgcgatccccatccccaccagtggagaagccagaaccgcgattgttgcatctgggaaaacccagctggagccgaacggcccgtgcccccactgtaattgtgctgaaaatgtttctcaaatgacccaaattggctcttattttttctaatggccctttcaaagtattcatgaaattgatgctgtgtcataaaacaaaaataaaagatttcacagcaa

SEQ ID NO: 41692 - DNA, 411 bp, Homo sapiens
aaatagggcggcaggcccaggcaggagtcgaggctccaagcctgctgcatgctccattgtcccatgggactttgcttacaaaacacacactcaaaaataaaattactaagaatttcaagatggtgagcatagggcattacacctggagtgtggagtcctacgtgactacactggtaacatacccacaaggccctgccctaccttggtttagagacacctagccttgagcaggtggcttgacctttccaagcctcagtttcctcatctgcagataagcatgaaaatacctacttcggccaggcatcgtggctcacacttgtaatctcagcactttgggaggccaaggtgggcggatcatgaggtcaggagatcgagaccatcctggctaacatggtgaaaccccatctctac

SEQ ID NO: 41693 - DNA, 300 bp, Homo sapiens
gactctagtgcctgaaagttactatctttatttgtaagttgagccctttcctcttgtgtccttaagttatttgtgggatgatccttttgtattttgccaaatacctagttccttattaaccactcatctattgattattttagcatgcactgaggattgcttcttgtattttcttattagagatatgttattgtttgatgatgtcttttcttgtgtcatatattttattccatcttttatgtgttttcatcatttaaatatttataatctctatcaagttgttcagttttctgaagttct

SEQ ID NO: 41694 - DNA, 879 bp, Homo sapiens
gcggccgccccgagacgccggccccgctgagtgatgagaacagacgtcaaactgccttatgaatattgatgcggaggctaggctgctttcgtagagaagcagaaggaagcaagatggctgccctttaggatttgttagaaaggagacccgactgcaactgctggattgctgcaaggctgagggacgagaacgaggctggcaaacattcagcagcacaccctctcaagattgtttacttgcctttgctcctgttgagttacaacgcttggaagcaggagatgggctcagcagcagccaataggacatgatccaggaagagcagtaagggactgagctgctggtaagacagtggagacagttgacacttgtttgtcaagtatgaatttattcctaatgtaatggtaatctctctcccaaacttcaacttcaagttaccctgcaccctctcaaatacttttctttattgtctatgcttaggacacatggattagattgttaagatttgtgaatttactaaagttgtgtactgacttatgtatagctgtatttttctggagaaagatagatttttatcaattctcaatgtctatggagtttttaaaaagaggtaaggattattcaaatgtaactataaacataagaaaatgtgatatctataaccagttgttagagtatttatcgcctccattttgcttcacttgtagccacttcgtctcaatcttgttaaggaccaaataaatggtatttgtggttacttgctgatctgaaaagtgagtacctcctgcacctggctagtcagtcttgtgacaatttggtgccatagaactagcagagaactaaattatgggaatggcagatctcaggagcagctatgtgatt

SEQ ID NO: 41695 - DNA, 975 bp, Homo sapiens
gcggccgccccgagacgccggccccgctgagtgatgagaacagacgtcaaactgccttatgaatattgatgcggaggctaggctgctttcgtagagaagcagaaggaagcaagatggctgccctttaggatttgttagaaaggagacccgactgcaactgctggattgctgcaaggctgagggacgagaacgagaattcaactagagggcagccttgtggatggccccgaagcaagcctgatggaacaggatagaaccaaccatgttgagggcaacagactaagtccattcctgataccatcacctcccatttgccagacagaacctctggctacaaagctccagaatggaagcccactgcctgagagagctcatccagaagtaaatggagacaccaagtggcactctttcaaaagttattatggaataccctgtatgaagggaagccagaatagtcgtgtgagtcctgactttacacaagaaagtagagggtattccaagtgtttgcaaaatggaggaataaaacgcacagttagtgaaccttctctctctgggctccttcagatcaagaaattgaaacaagaccaaaaggctaatggagaaagacgtaacttcggggtaagccaagaaagaaatccaggtgaaagcagtcaaccaaatgtctccgatttgagtgataagaaagaatctgtgagttctgtagcccaagaaaatgcagttaaagatttcaccagtttttcaacacataactgcagtgggcctgaaaatccagagcttcagattctgaatgagcaggaggggaaaagtgctaattaccatgacaagaacattgtattacttaaaaacaaggcagtgctaatgcctaatggtgctacagtttctgcctcttccgtggaacacacacatggtgaactcctggaaaaaacactgtctcaatattatccagattgtgtttccattgcggtgcagaaaacc

SEQ ID NO: 41696 - DNA, 1121 bp, Homo sapiens
gcggccgccccgagacgccggccccgctgagtgatgagaacagacgtcaaactgccttatgaatattgatgcggaggctaggctgctttcgtagagaagcagaaggaagcaagatggctgccctttaggatttgttagaaaggagacccgactgcaactgctggattgctgcaaggctgagggacgagaacgaggctggcaaacattcagcagcacaccctctcaagattgtttacttgcctttgctcctgttgagttacaacgcttggaagcaggagatgggctcagcagcagccaataggacatgatccaggaagagcagtaagggactgagctgctgaattcaactagagggcagccttgtggatggccccgaagcaagcctgatggaacaggatagaaccaaccatgttgagggcaacagactaagtccattcctgataccatcacctcccatttgccagacagaacctctggctacaaagctccagaatggaagcccactgcctgagagagctcatccagaagtaaatggagacaccaagtggcactctttcaaaagttattatggaataccctgtatgaagggaagccagaatagtcgtgtgagtcctgactttacacaagaaagtagagggtattccaagtgtttgcaaaatggaggaataaaacgcacagttagtgaaccttctctctctgggctccttcagatcaagaaattgaaacaagaccaaaaggctaatggagaaagacgtaacttcggggtaagccaagaaagaaatccaggtgaaagcagtcaaccaaatgtctccgatttgagtgataagaaagaatctgtgagttctgtagcccaagaaaatgcagttaaagatttcaccagtttttcaacacataactgcagtgggcctgaaaatccagagcttcagattctgaatgagcaggaggggaaaagtgctaattaccatgacaagaacattgtattacttaaaaacaaggcagtgctaatgcctaatggtgctacagtttctgcctcttccgtggaacacacacatggtgaactcctggaaaaaacactgtctcaatattatccagattgtgtttccattgcggtgcagaaaacc

SEQ ID NO: 41697 - DNA, 806 bp, Homo sapiens
gcggccgccccgagacgccggccccgctgagtgatgagaacagacgtcaaactgccttatgaatattgatgcggaggctaggctgctttcgtagagaagcagaaggaagcaagatggctgccctttaggatttgttagaaaggagacccgactgcaactgctggattgctgcaaggctgagggacgagaacgaggctggcaaacattcagcagcacaccctctcaagattgtttacttgcctttgctcctgttgagttacaacgcttggaagcaggagatgggctcagcagcagccaataggacatgatccaggaagagcagtaagggactgagctgctgccctcacctttgaaaagcctgagcctctgagatgtgagatgactgctgtaaagtgaagcagcgaatttctagaggctgggttcacgcttcaggtcctctaaatcctaggtcgcttcccactactacatactaccctaaaaaatctgtaattcgcaaatttattttttgatctttttcataacttattaaatttttattgaacaaataaaaaaaataaaaaaaaattaataaagaaattaaaagaaaataaaaataaagataatttaatgaacaaatgaatttaacagtataaagattacaaaaaaaaaaaccttgtggccccctatgcccaagcggcttttaacctggagaaagttattgattgccgcccaaattgaggccactttggcaaattgcccctatagggggcctattaacattaaacgggcccgcgttttccgcgggacctggccaccggggttccccc

SEQ ID NO: 41698 - DNA, 336 bp, Homo sapiens
ccctgtgtaaatcttatttttccaaccaaatagttcaacatgttaaatttgatcctgtgctcagatagcagagaattgtaatatgtggcctcttcctttaaggatcttctaatattacctgagagtttgaatgaatacattatacattattaaaaatatacctgaaaataatatttcttttagaaaaaaatatacctgtattgcaaacttcctaggatgccttgctcactgtttttttttttttaaatctaaatcctaccagtttttcaagtcccaacttggattttatgcctgtgtagagccattcttgacagctatcgcccaagtaaatttctc

SEQ ID NO: 41699 - DNA, 649 bp, Homo sapiens
attatgggctctgaagaatttctatacatggagacactgtctttataatttgaacacattcttgagaaggcatctgactggtaaacaaagcacaatggcataggtcctggaaacattcctttcagatattttcataactgaagtacattttgccattcacagtgagtgttaagctgaaaaaaatgtggttcttttctagccatataaagtatgcttactattattttctcgaaggatgccaaaaaatgtaaaatggatgttgtggattcttcgtggggaggttagctagtttgtatatagagcctcaagaagagttgcctcagcttggtgccatcttgagtctgtccttccactagatgaggcatagcttccattagtgtcagtgcgtgtgtggagggtgaggggaagaatgatccccattaactttgtatattgtttctgatgagtcatggagcatattcactaatggttggagaattattgattgcaaggcagaggattcaagaagagctattggcatatggcattaactgtctctagacatattttttatttttaaatttgaggtagagaaatcggtttttacgtagtgtttttcatattataaaaaataaacgtttatataagcattacagatacatccttgagg

SEQ ID NO: 41700 - DNA, 396 bp, Homo sapiens
ctatgtccaagtcaacaaaaacgatttgatttccacctgcccagtcccctttatcacctgtcctcccacagtcttccccatttcagtaaatggcaccaaactccactgggcatgtaagccaaacatctaagattcacttcgagctctttcctttttctcaaccttcacagggaatccataaacaagtcctactaattctacctccaaaacagatccatttctctgcaactatgctccaggctagcagttctcaactgggagcaatttttcccccggggacattagaaaacgtctggagacatttttggttgtcatgactaggagggtgctaccagcatctagtaggtagaggtcagagatggtgctaaacatcctaaaacgcacagcacagcccca

SEQ ID NO: 41701 - DNA, 273 bp, Homo sapiens
cctctcttctacatcaggcacattagaggaaccaaaaccatactcctacaagtaagtgaggtgcccagctctcaggccacctttgcatttctgaaagtgagggtccatgcagaaaactgttacagaaacatgactggcttttaggagcacagccgtgatcattttcacagcatatgcttctccaaaagcctagacaataatgatttctattttattttattttatttttttatttttttaagacagagtctcacgctgtggctcaggctggag

SEQ ID NO: 41702 - DNA, 237 bp, Homo sapiens
tctgaaatgccttctcctgtggttgcctgttgaagtctgtctcctctccagagtcctgcccaaattacctacctctcaacaagactttcctgagatgtctcatcacaggagactcttttcctccctgaggagattatcgatgtatttatctcagaatcttccattttgagaggctgaggcaagaggattacttgaggccaggagtttgagaccagcccgggtaacatagcaaacccc

SEQ ID NO: 41703 - DNA, 409 bp, Homo sapiens
aactggcttgaaacctgtgacaattctagtcagtaaaagtctaaagctcttctcatgatttttactaattcacaagaattacaccctccagcacctagagttcaagccacctttcatgctctttgcattgtatatactggaaggaccagacaaaaatatggcagggcaccatatgccatatcaggagctgggcagtttctgccttcaaggaactcaagattaggcaaggaatgtgaaacaaaaaatgccaactatgtgccaggcagtatgctagatcctagggatactgcagtgagcaaggtaaatatggttccttggcctcaggaactatagtccatacagagtgaggataacccttaattatcagtgctcagaagtggagtcctatagggagtctcccaaccttttt

SEQ ID NO: 41704 - DNA, 641 bp, Homo sapiens
gtacattccagtttttttccagctccagcactttagattctgagccgtttcagtaaatccagcaataagctccttatttctgttatttcagaatcagtggataccatggctagtgtccactccttcgcatttctctgagaaattttcaggaagatagaaatgaacatttattaaacgtactagaaaatgtactttatgtacaatgtaccttttaatccttaccacagcctgctgaggtagggattactagcaacattgtacaaaaataaggccaggcatgattgctcacaggggtaatcccagtgctttgggaggctgtgagcccttgagcccaggagttcgagatccctctgtgcaacatagtgagacctcatctctacaaaaaataaagattaccagggtgtggtacagcaaaccaccatagcacatgtttacctgtgtaacaaacctgcacatcctgcacgtataccctggaacttaggaaaaaaaaaatattagcagtgtgtggtagtgcatgcctgtagtcccagctacttgggaagcagagggaggaggatggtgttagccaaggagtttgaggttttggtgagttgtgattgtgcctctatcctgggctatagaacaagaccctgtctcaaaca

SEQ ID NO: 41705 - DNA, 808 bp, Homo sapiens
ctaattaaactgagaacataattttacatcttcatataggctaagaaaaacttttggaagaatgatggtgatgggtttgcaggaagcagttttcgtcccctccttgggtccctgtgtgagctctggcatctttttgtggaacagcagccaaggttgaagatgaagccaaggtagcagtgaaacagccctttcgtgatgtagtgctaattggccccacagggaccattctacccaaatgagttcatcaactcaggcaacatatggtcaccaatcaaaattctaaaggttgattaaatgatttactaatatattgttttgcttgctatttatatattgacttttttaaggcaggtagagggtgaaccatccagctttattgattagttctgactctaaatgtcaaatggggaaaaaagatgaaataaattgctatagtaactattttgtgatgttggaattagctgcatttgaaaacattataaaactgaagaattcatacacggatatatgaaaaggcaattcctgataaaatacagacaggtgtctgttctagtcaatcaaaatgtaatttccccataattatgcacagagtgaaaagaacttaggaaatatttaatatgcagaggcttatcatgataactgacaactactgtaggaaatccacatctaattctcctacagaatgccaattcaagactgagctcagtaaagggctctgactcacttaagaaataacaatttactcttcattaatgaaagagcctatcatatagcctaagaaaattatttcagttagcctcaaattaga

SEQ ID NO: 41706 - DNA, 382 bp, Homo sapiens
ctaattaaactgagaacataattttacatcttcatataggctaagaaaaacttttggaagaatgatggtgatgggtttgcaggaagcagttttcgtcccctccttgggtccctgtgtgagctctggcatctttttgtggaacagcagccaaggttgaagatgaagccaagggcatcaccaaaaacttgaagatgttgagtttgaccaaataaaaaagtcgaggatattacggcatttactacactatgagtcatcatcagcttccctgctagactgcgcacttcgtaagaactgtatcttattattcgtggcatccccagcactgtacctgacacacaagagggactcggtaaatgtttgctgaataaactagtatattaat

SEQ ID NO: 41707 - DNA, 265 bp, Homo sapiens
ctaattaaactgagaacataattttacatcttcatataggctaagaaaaacttttggaagaatgatggtgatgggtttgcaggaagcagttttcgtcccctccttgggtccctgtgtgagctctggcatctttttgtggaacagcagccaaggttgaagatgaagccaagactcaccctgaattcatttttgtgcgagatccaagaaccctctcttggggtctggatgaggacctctttcctgtaacaaaaggataacttaaagc

SEQ ID NO: 41708 - DNA, 241 bp, Homo sapiens
actgcatagcaacatatggtgaaaatggactttttacagtaatactgaatagaaatacctagaatagtctctctccttatagtcctcgtaaaacctatgttataaaccttaaagacagcacaaatagtacccttcctgtgaggcaggccctggaaaaactgtatgttttctccttttcactttgaggatattacggcatttactacactatgagtcatcatcagcttccctgctagactgc

SEQ ID NO: 41709 - DNA, 416 bp, Homo sapiens
ttgaactaattacaaatcccaaaacttgtcttcgctgactcatccttcagggagtgagtgcagttagcattgtggtaaagaacatgaaagtcttcagttttaaatatccacaatttccaaatatctgtgttgtctaaatgaaccattttattaagaggtataatttagccctcttcctaaagatccatggactctccttttgtcaggttctacccctataaaattcctctagatttctgcatttaccataacagcatcggaacaattccaagcacactgaaaggaacttttgagaggttaagaacaagcttaggtgaaggagaataaccatgatggaggggaaagtagccaggagagatcgacccagtctctgtgatagggaaagggagagggctgttcaagtgacacatgtgctc

SEQ ID NO: 41710 - DNA, 433 bp, Homo sapiens
ataaccattccattaagggtccttgtagctgaaatgcaggcagggtggcccttgaatgcatatgaacccatgtgatgttgaatgtctagaatttttttttgtggagagataagagtattttctttccccacttctcccatttattgatgttggagaatcatgccagagctagtggccttgatatggctctttctcagtctcttttgagatggaattcaaatttgctatccccagatgcggtttaaaaggctggcaaagtgttgtcatcaagtgagcgatgattgtggatatgatgctaccatttgatttggggtcattggatgccctattcctgattaaggagcactgatgttatcaatgggaaaagtgttcctctggggctccttaaatatagttgcagtgtttatggggaaggggacttgtccctgtgtgt

SEQ ID NO: 41711 - DNA, 273 bp, Homo sapiens
atttatgctaaggcaccaacctgataaagaattcaaacactgaggaaactatctctccaaaactttcttctatggactgttaaatggggcttccctctggctttggactgggttcagccagtgggaaacaccagccggagactggaagacaggaggcgagagaccaagacacatgttccgccggctcctctctcccaggtcaccggggttccctgcaatcccgccaggcagccccctctggacagcagtctctccagatcccctttcctctcc

SEQ ID NO: 41712 - DNA, 812 bp, Homo sapiens
actcagcataggactcttttgagtttatcctacgtggagtttgttgacctttttatatatccatgtcttccctcaaagttggggagttttggccattatttcttcaaataagctctctgcctctttctttccggtataaagattagtgtgggggtgtctccattgttcttttttttcccctcaaacttagagctggaagaaaccttagacatcctgtgggccagaatttcatattaccttccacaaaactaacttccagagaggtcttcaggaagttggcaaattttagttacgtatttttaaagtgtctttgaacttttaagaactacatctcgttaattatatgtattcgtatatattattatccaaattttaacaaattagagtgcattggtgctttaaagtgctgtcaactactctgagaatgcaaaattcttgttttaaaatgtgtatcttacaactccttccttggatgaattagatttttttagatggagaaaccaaaatcaagtacagccataccttggagacattatggtttggttttgttttaggaacccaggctggtcttgaattcctgggctcaggcagtcctcccacctcagtctcctaaagtgctaggattacaggtgtgagccgctgcacctggcccagcatgggttcttttccataccaccacaataaagcaaatattgcaataaaagaagtcacatataaaagttctgttttcactatactctggtctattaagtgtgcagtaacatgtctaaaaaatgcacgtgtcttaattagaaaatgcttcattgctttaa

SEQ ID NO: 41713 - DNA, 599 bp, Homo sapiens
tttttttttattttcagtagagatggggtttcaccagttggccaggatggcctcaatctcctgacctcatgacccacccaccctggcctcccaaagtgctgggattatagacatgagccaccacgcccagcctaaagctcaatttttaaaggacagcacctgacttcaaaaatcctaaggttcttctctcagtgccttgagatctgccatcatttaaaacatttgtgttgaagacttttcaatcttattaaaatatttggctatattaaagtcacatgacattagccgatgataaatatttctcctccccagccctgatttatgaggaccagctagtaaatagtctctgattcaaacagtgattaaccattattcatgaagcaaaatgagcctgccatgtcatgtcataaatttaatgtaatctcatcttgtttcactttttttattcacagtttccttccaaatttcatcttctcccatctccctacaaacttcaaaagaggtgtacaaaggaacttaagagccattttctgcttacccacctctttagaaggtggggaggatgactcaggaaaatgcagtaactgactgatgctaat

SEQ ID NO: 41714 - DNA, 281 bp, Homo sapiens
ctcaaacctaaggcagtgccgactactcatggctggtttgttattctctgccctctctttcatcattccagctggccagaactacaaatatagaaatctttcacttggacgttctgcttcttggttattacatgtttccttccaaatttcatcttctcccatctccctacaaacttcaaaagaggtgtacaaaggaacttaagagccattttctgcttacccacctctttagaaggtggggaggatgactcaggaaaatgcagtaactgactgatgctaat

SEQ ID NO: 41715 - DNA, 690 bp, Homo sapiens
gacaaggtgtcgcttgtcatcctggctggagttcagtggcacgatcatggctcactgcagcctcgatctcctgggttcaagcgatcctcatgcttctcgattataggttgcacaccaccatgagccacagcgcccagcctgatgttttatttatagggtgcactcttcattgtttaaatgtctatttttagatgttgatagacctttgtaggtagtttcacccctgtctttggttctcttgcactgtttgccccatatcattctaaatttttacccaaatgggttttcaaggaccttgctcctcctgcctgtggggaagtgggttacaggttagcaatagttgaaactcccctactgtttttcccagcttagcaggggtggttggagaccagccccaatactcctgagagcccatagagacagtccctggctcagcactgaggacatcttgcaggcagggttggctgagtgttttatggagcgagcttaagaggagatgttctaaaaccagagaggaaacatttttctctgttctctgcaattcagcaggtgatatcccttcatggatttataataaacacagtcctctcattgaccaaggttgaaaaactcagaaagtttgctcagcacagatctgggagtcaggaacgtactatgtgctgtggaagacatttcaactcctctttcaag

SEQ ID NO: 41716 - DNA, 1173 bp, Homo sapiens
caaaaacattagttcacacacaaacattgttttcaagcaatggtgaactagacccctggtcaggaggtggagtaactaaggatatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagtgcgggaaagcagcactgagaaacttttgattgttttcaatttcttcttttatgttcacaccaccacattcccattcactttgattttctacatgtaattaccttcttttgtttatcattagatttgatggggccaaagttgagatagaatagagggtgatgacggtaagagcaagtgtcccatgaatgtgatttcctgggttctcactgtctttgcaccacgtctaggaagaatcttcttgatagctctcccacaccatcagtggccctcataactggagtagagttcctggttgcttttcataagagggagagttactttctttgtatctctgcaagcagagatttctctttggttttgaggttgaagtgtctttggcccatttgtaagtccccatccctaccctacacaaagtaaaagcagaagatagataaaaaatgatgtaattgcagctggtaggatgtctggtgccaatccaggaagtgagagccatttcttttgtactggatttaatgactttgaactgtgctgtaaataaataatacagctggaccttaaaaaaaaaaaaaaaaaaaaaaaaataaaaaagaagaaaaaggagggggggcgaggagaaaacgggagcacgccaatgacgggcccgacactggaaattcgcccgacggcgggaacaggagctggcagaataaaacaagtatcggggggcccagtggcggccacaaataacgagaggatcaataaacaaagacacggcaccaccgacgatcttaccaacacagacgaggcgccaaacaaactccgtatgagtacataggaggaaagacaaccacacttggggagaaacaacaagcggagaacaccccaagcagataagcgccaaagaaacaagcataggaggcacaggaacaaccggggtaatacgggcaaacacacgaag

SEQ ID NO: 41717 - DNA, 793 bp, Homo sapiens
caaaaacattagttcacacacaaacattgttttcaagcaatggtgaactagacccctggtcaggaggtggagtaactaaggatatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagtgcgggaaagcagcactgagaaacttttgattgttttcaatttcttcttttatgttcacaccaccacattcccattcactttgattttctacatgtaattaccttcttttgtttatcattagatttgatggggccaaagttgagatagaatagagggtgatgacggtaagagcaagtgtcccatgaatgtgatttcctgggttctcactgtctttgcaccacgtctaggaagaatcttcttgatagctctcccacaccatcagtggccctcataactggagtagagttcctggttgcttttcataagagggagagttactttctttgtatctctgcaagcagagatttctctttggttttgaggttgaagtgtctttggcccatttgtaagtccccatccctaccctacacaaagtaaaagcagaagatagataaaaaatgatgtaattgcagctggtaggatgtctggtgccaatccaggaagtgagagccatttcttttgtactggatttaatgactttgaactgtgctgtaaataaataatacagctggacctta

SEQ ID NO: 41718 - DNA, 445 bp, Homo sapiens
tttaataaaattcaacatcccttcttgacaaaaactctcaacaaactcggcatagaaggaacatactacaaaataatcaaggccatatatgacaaacccacaactacaagaaaactacaaaacactgaggaaataaatggaagggggccaggtgcagtggctcatatctgtaatcccagcagtttgggaggccatgggaggatcacttgactcaaggagtttgagaccagcctgggcaacatagtgagaacccatctctagaaaaattttaaatttttataaaaaaatttttaaagaacgaaatggaagaggacaccaaacaaaagaaaagacatctcatgctcatggattggaagaattaatactgttaaaatactgcccaaggcaatctacagattccattcaatccctatcaaaataccagtgtcattttcacagaaataga

SEQ ID NO: 41719 - DNA, 576 bp, Homo sapiens
ggggtttgtttgggaaaccgtaaggtatatatggctcagcagagggataacaaggttttttgtgtaatcaaaattcaaaggtatactgtagaatagaacaaccggaattacaactcagaataaattcttagaattactaacagaaatgtgaaaagtcctgatggagatgtagaaagcgactggggacagatataggacccttcaatcctttctttcccactgctgcggttctcagcgcagctgtccctgggacaccagacaccgtgatgtagaatgaaagcatcttgttcacccaagtgacctgctaacgtgagaattctcattttgagacattaaaaacacactttggcaggccaaggctggcagatcacttgagcccaggagttcaagaccagcctcggcaacatggtaaaacccatctctacaaaaaatacaaaagttagccagtcatggtggtgcgtgcctgtggaaggctgaggtgggaggatcacctgaccctgaggcggtcgaggctgcagtgagctgtgaacatgctactgcactccagtccgggtgacagagtgagaccctttcgca

SEQ ID NO: 41720 - DNA, 367 bp, Homo sapiens
ttctcatgaggcataattagctaggagatcttctggttacctatagtctatccattctggcacacctatttccctgagtcttttcattctaccatcactatctgccatagcaattccggcatgtaagctttctttggcataggtcatcactttttccatgcttctaggatccatcctggtagtaagattgtaccatctcctattgtccttgccaggatgttaaatcttgtattttgaaagagagattcctgccgggcgcagtggctcacacctgaaatcccggcactttgggaggccgaggcaggcggatcacaaggtcaggagttcgagaccagcctggccaacatggtgaaatcccgtctctact

SEQ ID NO: 41721 - DNA, 408 bp, Homo sapiens
taccaagccgcaaaagagcccatgtactctttggacattattggttcataaaatgtctggagatttattctagaaaacagaagtctcgtgtgttgcatgtcaagctgaactaaatcagcctggcgtgatgaactagaggactgtgtcgggacagtaggaaagaatccatgaaaaaggattgtccttggcttagggtgcaacccaactctccccacatcagccatgtggttctttctttctttctttctttttttttttttttttttgagatggagtctcgctctgtcacccaggctggagtacagtggtgcaatctcggctcactgcaacctccgcctcccaggatcaagtgattctcctgcctcagcctccccagtagctgggattacaggtgcatgccaccacacc

SEQ ID NO: 41722 - DNA, 282 bp, Homo sapiens
atcaaataggtctttttcttcatggtgatcattcttagccagggttgatttccaaggtagaaacattcacgtgtattttcttccagcatttttacagtctcaatttttacatttggacaggcagcctgtagtagctggaaaaaaatacataaataaataaatttttagatttggatctttaattcatccagaatttattctgatataagatgtcaaagaaggatctaaataattattttttttcaataattagctggttgtccttgtaccgtttatttagtc

SEQ ID NO: 41723 - DNA, 412 bp, Homo sapiens
gtgtgttcctcaaggagcctgaacacggtgattggaacagagacttcagggacagctgctgtgggagtcacagaagcaacagttcccttccatcagttccccaaagggtctgggactaccatgcttcactccagcctctcacatgctccaccttggcaggttgggcttctgtgaatttattcctcctttgtgaccaacctgattttaacttaatctcacccattagacatgacatgtccagagagaggaacattaaggagaacatggtatatttggccccaaacctaaattctcccttgagttgaacctggaaaaactaatcctgagagaggaaagaaaaaaaggaatgattgaacaatttaattaatttttaaaaattaaaaattaaagggaatatatcatttgtcataga

SEQ ID NO: 41724 - DNA, 402 bp, Homo sapiens
gatatttgatgatattgaggaattattgtgaatttttagtgtagtaatgatattgtggtttgtataaatatatttagggataatatgatgcctcagatttgctttaaaataacacaggatgaggataagtggtaggactgcaagggaaacaagactggccatgagctgataactgttgaaggtgggtactgggtatataagggctcaccacaccattctcttgatttgtgtctatttcccataataaaaagtttaaagagagagaaccgatgaaggggagggagagagtcaagcacacaataagagtgacaaacagtgccaaatcagcccacagtattaagttttcacatatttacataaatatcacctggaatgcaatattgaaattaatgtatatcacta

SEQ ID NO: 41725 - DNA, 2973 bp, Homo sapiens
ccccaaatccagtgaaagaaattctcccagtaaaagttgcttcctaactctgtttttctcagaatacctcttacctttctcaaagaaagcttcaaccaccatcatcagaaagaaggtggcctaaaaactgacacatggccagtgcccggaggggtctggaggcataagtctagatgcccagagagcatccaggcactgaactgctcagagcttgagatgaaatgacatacaagcttcagggtaaaactgtctactagcaagattacctccctcaattctaccattgcagatttcttctgaccccaaatgcaaccttacagagaatgctgaatgaggaaggccaattccttacaatgatggcagaacccccaagcgaatgccctattgaggagaaggacatcactgtatttggaattctgcctgctagtgatagctcacacatcacatcccagaatcccactcccaatgcattatttcctgaggcaagaacttaaggtcctcacctaattcctccatcacaaccattaactcttattggacaagctcctcctgtgagtggggcctgtactcacttcctcttagatcataattccatcttcaagagactgatttccagaatagtaatctttttccagcgttctctcttctccaatgccctggttgttatttttcccacctctcctaatattgatcttcttgtcttttggttagaactgcaacttcggagttgagttcatttcctattgctgctcaattcagtagcaacatagctggcttgttcccagacccaggaagtataagtcattgacagtttcctgagtggctctgccaatccataccacccttggtactgtgaaaaaggcttcttgggcagccaggtggcattgaggatggtattcagggcgctttccttctgtcatataagttgtgggatctctaccaagtgtgaaggtgaatgaggtaagggagatcagaaccatgcttcctggtttttcatacatccaaggaagaagtcctggtgtgggttgtttgacaccttctttccactttcaccttttattttttattccttcctttctacccccaaccagtcgagcaaatgagcaattttgtgtttctaatacaggatctggaagtagtgctttctaatcctcatttcctgtaggatgttcctgcactataacaagattatgttttcttccttctgcagcagctttctgcttcttgggtactactagctattgttcaattcaggtgaggcctgtgatgacatatatgtagcatgtgctctgcgctccctgcaagctgagcagatacaaccaatgcatcactgtatactcttgctgagaatgtggatgcagcctcacagatctttgcaacactccaaccagccaggaccagttgatcagaactgatcttattggtctgataaccaatcttatttgtgaactgattcatatctgtctttccactcttggttctcttgccgtagaacaaaaacagtttaggaagcataattacgaacatttaggaaccaatatgtataagtaattcggagactccaattcacctgcccctcccccatcccaggttgtggaggctcgaggaagctgacttcttaggctaaaggacaaaaaaatctctttacctccttggccattttcatgttctctgccaattactataggcagtcttcattttgcagaggtgaggtaagacttcatcttattcttcatgtaatcccaccttctaacaaaaaataaataaatatttaaattccaaggagaagtgttctttgtgtatttctagcagaaaacagatgcttaagcctaagaaggaagatccgtccatgacaaaggaaagtggaaaactgaaccagttatctgaatacttcatgccaggacagttgctattagcaactgttttgcaccttcagggctttaaaatgggctctgcagacagcatttgcatatgcaagactcagtagccaagcctccactgccaattgttgaaggcagtttcagatcgccaccttttgaggtacatttctttaagcacaagagaagtagaaatggcctttgccttgtctccagtggtttgtccctctggtgcctcagcagataccagagcttattcttatgaccatttggaagtagtcctcaaagtaaagatcaagaaaaaattggattctttttccattttctcataatagtagcctagtcaacacaagactcccataaaatatgactcactattgggagccatactattttataagcttacttcctgctgacaaaactagctttcctcaaggaaatataaaggaggggaaagtcacatagtgttaggaaaacattcctgtgttttgaatacgatgaatccataggatagagaaaaatctgcttgttctattctgagagttctctgagatatcccttcactctgcttggcatttggccattgatattcaacaggtcactgaccaagcttttctaaatttttcagagagagttacttaccaataaggtctgttcttaaacctacctagttgattttcatatctttccataaagtgtcatgattctatcatagaccctgacttaacattgtaaggactatgagtcctccattttttaattaatttttttttagcaaattaggacttcggcaggttttcctctcctaaactcattctttcctccacaggattgctttgtccatctcctgctttcatttcaagtgcataaacaaaacctcaaagggcctgggaaggtgaggcaggccagagtctgtgttctgtgttgagtgtcaagctatttgttaagaaggtctgcaacaggcctttggtgtgggctctgccagagactgttctgaacactttgcttgagatccgtgccctgtaaaatggatatgatgttttactgatgtctgtaatacatttgtaaacttccaataaaatttgaataaaagaaa

SEQ ID NO: 41726 - DNA, 3191 bp, Homo sapiens
  misc_feature (3038)..(3038): n is a, c, g, or t
  misc_feature (3085)..(3088): n is a, c, g, or t
  misc_feature (3090)..(3090): n is a, c, g, or t
  misc_feature (3108)..(3108): n is a, c, g, or t
ccccaaatccagtgaaagaaattctcccagtaaaagttgcttcctaactctgtttttctcagaatacctcttacctttctcaaagaaagcttcaaccaccatcatcagaaagaaggtggcctaaaaactgacacatggccagtgcccggaggggtctggaggcataagtctagatgcccagagagcatccaggcactgaactgctcagagcttgagatgaaatgacatacaagcttcagggtaaaactgtctactagcaagattacctccctcaattctaccattgcagatttcttctgaccccaaatgcaaccttacagagaatgctgaatgaggaaggccaattccttacaatgatggcagaacccccaagcgaatgccctattgaggagaaggacatcactgtatttggaattctgcctgctagtgatagctcacacatcacatcccagaatcccactcccaatgcattatttcctgaggcaagaacttaaggtcctcacctaattcctccatcacaaccattaactcttattggacaagctcctcctgtgagtggggcctgtactcacttcctcttagatcataattccatcttcaagagactgatttccagaatagtaatctttttccagcgttctctcttctccaatgccctggttgttatttttcccacctctcctaatattgatcttcttgtcttttggttagaactgcaacttcggagttgagttcatttcctattgctgctcaattcagtagcaacatagctggcttgttcccagacccaggaagtataagtcattgacagtttcctgagtggctctgccaatccataccacccttggtactgtgaaaaaggcttcttgggcagccaggtggcattgaggatggtattcagggcgctttccttctgtcatataagttgtgggatctctaccaagtgtgaaggtgaatgaggtaagggagatcagaaccatgcttcctggtttttcatacatccaaggaagaagtcctggtgtgggttgtttgacaccttctttccactttcaccttttattttttattccttcctttctacccccaaccagtcgagcaaatgagcaattttgtgtttctaatacaggatctggaagtagtgctttctaatcctcatttcctgtaggatgttcctgcactataacaagattatgttttcttccttctgcagcagctttctgcttcttgggtactactagctattgttcaattcaggtgaggcctgtgatgacatatatgtagcatgtgctctgcgctccctgcaagctgagcagatacaaccaatgcatcactgtatactcttgctgagaatgtggatgcagcctcacagatctttgcaacactccaaccagccaggaccagttgatcagaactgatcttattggtctgataaccaatcttatttgtgaactgattcatatctgtctttccactcttggttctcttgccgtagaacaaaaacagtttaggaagcataattacgaacatttaggaaccaatatgtataagtaattcggagactccaattcacctgcccctcccccatcccaggttgtggaggctcgaggaagctgacttcttaggctaaaggacaaaaaaatctctttacctccttggccattttcatgttctctgccaattactataggcagtcttcattttgcagaggtgaggtaagacttcatcttattcttcatgtaatcccaccttctaacaaaaaataaataaatatttaaattccaaggagaagtgttctttgtgtatttctagcagaaaacagatgcttaagcctaagaaggaagatccgtccatgacaaaggaaagtggaaaactgaaccagttatctgaatacttcatgccaggacagttgctattagcaactgttttgcaccttcagggctttaaaatgggctctgcagacagcatttgcatatgcaagactcagtagccaagcctccactgccaattgttgaaggcagtttcagatcgccaccttttgaggtacatttctttaagcacaagagaagtagaaatggcctttgccttgtctccagtggtttgtccctctggtgcctcagcagataccagagcttattcttatgaccatttggaagtagtcctcaaagtaaagatcaagaaaaaattggattctttttccattttctcataatagtagcctagtcaacacaagactcccataaaatatgactcactattgggagccatactattttataagcttacttcctgctgacaaaactagctttcctcaaggaaatataaaggaggggaaagtcacatagtgttaggaaaacattcctgtgttttgaatacgatgaatccataggatagagaaaaatctgcttgttctattctgagagttctctgagatatcccttcactctgcttggcatttggccattgatattcaacaggtcactgaccaagcttttctaaatttttcagagagagttacttaccaataaggtctgttcttaaacctacctagttgattttcatatctttccataaagtgtcatgattctatcatagaccctgacttaacattgtaaggactatgagtcctccattttttaattaatttttttttagcaaattaggacttcggcaggttttcctctcctaaactcattctttcctccacaggattgctttgtccatctcctgctttcatttcaagtgcataaacaaaacctcaaagggcctgggaaggtgaggcaggccagagtctgtgttctgtgttgagtgtcaagctatttgttaagaaggtctgcaacaggcctttggtgtgggctctgccagagactgttctgaacactttgcttgagatccgtgccctgtaaaatggatatgatgttttactgatgtctgtaatacatttgtaaacttccaataaaatttgaataaaagaaaaaaaaaaaaaaaaaaaaactcgacttttgtgaacaatagatcttttctcccctttattttgttcncttgacacttttgtgaaaattacctagcctgataaaaacattttgtnnnnanttgtataatactgttatnaaatatttataatcccagaaaatgttgtgttaaatcttgtgcaaaaacagtatattcagaataaaagtttatcatttaaagtc

SEQ ID NO: 41727 - DNA, 569 bp, Homo sapiens
gcacacaccatttttattaagcagagtggcgagagcgcagtggctgtgaggtccttccaggaccccgcttgtggacagctcccagcagctgcagctcactcccagccccagctgactcccagaccctcagtgagccctgggctggatcaaagtacagggacgatcctgtgggtgcaccccagcatggcaagcttccaggagaccctagaccctggctgggggtcaggaaggctctcgcctccgtgcttctgagtccataggaattgagtctctggccacacgaggacagaatcagctacatctgaagaacctggagctagaagatgagggcaattaagtcatgcgtctcggcaagttcattaaaatgttgacttgctaatggtcccgggtgcaatttggaatgagggtgttaacatagagacttggtctattcgggaactccctggtctgaaaatggagctgccaagcttctaatatgccctccacagactagagctccgacagatgaattattaatgccgcatcatattaattgtattgatatgttaataattaacaacaatatgcta

SEQ ID NO: 41728 - DNA, 173 bp, Homo sapiens
gagcgttcacagtcagccctctgatggtggctggtgtcatggaggtggggaaaggatgcaccagtcctgagtcaggccccataacatctccctcccctgatgaagtggccccaaggcacacaagccagtcttgtgtggggtagggttaattagcataagggtacccctaaagg

SEQ ID NO: 41729 - DNA, 447 bp, Homo sapiens
ttcccttcaacttttaagttctggggtacatgtgcaggatgtgcaggtttgttacataggtaaacgacgtgtgccatggtgattggctgcacagatcaaccaatcacctaggtcttaagcccagcatgcattagctattcttgctgtcttcctgatgctctccccaccccacccccgctgacagggtttgtgttgttccctgccatgtgtccgtataccacattttctttatccattcatccgctgatggacacttgggtcatttccaaatcttagctattgtaaatagtactgcagcaaacatgggagtgcagatatctctttgatatactgatttccttttctttcctttccagcagtgggattgctggatcatgtgacagctcgatttttctttggctttttctttacaattttactttgcctttaatttttctgaggcttact

SEQ ID NO: 41730 - DNA, 389 bp, Homo sapiens
aatttagtgtattagcctgttttcaggctgctgataaagacatacctgaaactgggcaatttacaaaagaaagaggtttaattggacttacagttccacgtggcgggggaagactcacaatcatgtcagaaggcaaggaggagcaagtcaagtctcacgtggagggcagcaggcaaagaggtaacttgtgcagggagactcccatttttcaaaaccatcagatcttgtgagacttattcactatcacaagaacaacatgagaaagacccgcccccatgatttaattacttcccacagggttcctcccagaacatgtgggaattatgggagctacaagatgagatttgggtggggacacagagccaaaccatgtcaactactaatcaaca

SEQ ID NO: 41731 - DNA, 341 bp, Homo sapiens
tatgcatagaactgcagtgattctaactaaagtgaataataattcaagaagcttaggctcttttaaaaacacactcatgaattctctatttaacatgcctcaatttagcaatttagtcaaaagtaaatattttccacctttatggtgattctgccatttccaaattcttcctcccaagtgctctcaattttgttgtgttgttttttttagaaaaaagtatcaccacagccctgttcaaatttaggtaatggctctctaaagcctccatgataacgtctgaatttctgacaaggtgcctccaagttttgttccaaattctcatctcactaatttttgtcata

SEQ ID NO: 41732 - DNA, 1206 bp, Homo sapiens
tggacttctggcctccagggctgtgagagaatacatttctgcagttttaagccacgcaatctgtgtccctgggaagcccaaatagggcgagaccttttgccaagtggtctccaagtgtcacgtcatcgaatccttctcccgggcttgtgccatagtctttccactttagagaggaggaaacggaggctctggggcacaaagccagtcagtggcggggcctgactttcaacccagcctgcatggggtcagagaacccactttccccgtggggcctgcggcctatgctaaggatgcttgttcatctctcctgggcccgggagtggttcttctggcctagaaggcaagagaagccagtctttcggtttcaaggtttcccattagtggagtcaagcaaaaatggtgtgttgcgcttcttcctgagctcagcctgtgagcacggccttaacatgctcagtggatcccaagacggcagcatggcggtgccagcctggcagccttagctccttgcagctgtgcttgtgaagggagcagtgagtggcttccctctgtgaccaccttgggtcctaagtttcactggggctgggatccatgcgtcttgcaattggctaggaatttcccgggctttccctcccttccctgttcagggcactgggtgtgaggcattgcatccgttcttctgctcacctgcttccccctaagagtgtgagctgtataaaggcaggaaccaaacaggagcctccacgtgttcccagttcaagggcagtgtcccttgtgtgtttcttcaataattcagtggatgacttattctgcacggacactgcacacactcggccctgccgtctccggagctgggaggtgtggagctggctcctgacctatttacacaccgaggagggatgtggaaaacaggaggagtcccagggctccaatgcaaagaggagcctcttcattccctctgccgtggccgtgcaagggacagcgccttgtgggattgtgtcctccacccaattatccttagcattagtttgctaaggataatggcctccagctccacccatgtccctgcaaaggacatgatctcattcctttctgtgtctgcatagtattccatggtgtatatgtaccgcgttttctttatcgagtctatcattgatgggcgcttcagttgattccatgtctttgctactgtgactcgtgctgcaatga

SEQ ID NO: 41733 - DNA, 284 bp, Homo sapiens
cataacatatgatctcaagtccatcaagttggatgttgtatctacacaaacaggacttagaaggacatgtgaaactaaattgcttgtgattgtggatggctttgttctttgcttctagtggttttcagtttcctgtaatgcacacattagcttttaaaaagtgaaggttattttttaaaacctgtaaaaaaaaaaaattccaggtgacgctacatcataaggttgagagccactggggtaagttgctgactctggtatgtagttagtatttattctaagtgcaa

SEQ ID NO: 41734 - DNA, 405 bp, Homo sapiens
gcctgaattaggagggtggaagggagagaaattctggaggacttgtgggatttggcagttgaatgctaagtatgaaagaaggagggaaaaaaaaaagttgaaggcagctttaagattttatgcctaggctaggtgtggtggcttacacctgtaatcccagcactttgggaggctgaggcgggtggatcacctgaggtcaagagtttgagaccagcctgaacactgcagtgagccatgatcaccctgctgcactctagcatgggtgacagagtgagactcaatctcaaaaagcaaacaaaaacaaaaaacaagcacaagaccagtgatagagtttcctgtggaagggaggaagacacttctttctcagataaaacagtgaaaaagagcaagatgattaaaaaaaaa

SEQ ID NO: 41735 - DNA, 681 bp, Homo sapiens
ccctctttctctggcctccctccatggctgctacctgatgtcagacttgttccagatgagcttctgtctgcactggccctctccccagctagaatggatgccacgggagactgtgaattgcagctgcctcatttgcgactgcaccccctttgcccatgctctccctctcaccccgcttccttctccctctggggtgtccagagagactcaggaaaggcaggtggatcaaggcgggggtttctaggcaacctctccactgtcatttctctcctgtcttgcagataccgggtcaagtgtgatggtgagggaggatactggtgtccctttcacagctgcgcaaaagagagcagatggaacttgaacttggccgaggctgccacccaggatggctttcaaaggacattttctaggatggcgcctcctcctctgctcccactacctccctcgagagaagggctgttctgggtttattcttgcctcccctgtaccacctctccatatctggccaattcatttgttcattcattcattcattcattcattccacacaaatctgctgagcacctcccctgtcctaggcccttgaatacagaagtgaatgagacagatatgcttcctgccctcaagctactgattgtctagggaagacagacagacaacaaacaagggaataaatacaga

SEQ ID NO: 41736 - DNA, 615 bp, Homo sapiens
ccccgactagcccgacagtccccgactagcccgacagtccccgactagcccgacagtccccgactagcccgactgcaccccctttgcccatgctctccctctcaccccgcttccttctccctctggggtgtccagagagactcaggaaaggcaggtggatcaaggcgggggtttctaggcaacctctccactgtcatttctctcctgtcttgcagataccgggtcaagtgtgatggtgagggaggatactggtgtccctttcacagctgcgcaaaagagagcagatggaacttgaacttggccgaggctgccacccaggatggctttcaaaggacattttctaggatggcgcctcctcctctgctcccactacctccctcgagagaagggctgttctgggtttattcttgcctcccctgtaccacctctccatatctggccaattcatttgttcattcattcattcattcattcattccacacaaatctgctgagcacctcccctgtcctaggcccttgaatacagaagtgaatgagacagatatgcttcctgccctcaagctactgattgtctagggaagacagacagacaacaaacaagggaataaatacaga

SEQ ID NO: 41737 - DNA, 187 bp, Homo sapiens
cctgactgaaataattctataggagctctgaaaatcaatgaaagatctataacaatcaagcaaacaaccaagacaaaaccacatctgaaatggtgggaaatttcatgcatttttagttacccttgcctcactcagtttaggggaagcaggagcctggtcagtctccaggtccctttcatgaactaag

SEQ ID NO: 41738 - DNA, 645 bp, Homo sapiens
gaaatgtagtctccttggcctgcgctctgtaggagtggcagaacagtaagagaaatgacaaagcaagaggaacctaatactcttcctcattggccttcctgtctccatctttattccttccagctcattctctacatgacactgtgaatgccaaactgtctggaggctgccatgagcggccaatttgtgatctctgctttacctgaattatttccgtgaattgtgacatcaacctcgccagataagaaagaagactgaagttcagagaggtgaagggactggctcaggggctacccctatggttgcgggagctaagattccagcccagcagcgtgatccagagcccatctgagctacccagatcttcctgctgttaaacccgtcctggggcagctcttgcctgatgggctacctgaggaacccacaggaaatcaagggaggtgcctgcaaagttgccgtggggtcacagcctgccctttggaaggggctgtttctgggctgctgtgacttcctgccattatttcctctctgttctccctctggaatgaataaagtacttctgaaaaaccatcaacccagtcgatacggaaatgctggtccctacaatagaatgctctgtggtcattaaaaagattaaaaaggtca

SEQ ID NO: 41739 - DNA, 463 bp, Homo sapiens
gatttctgatcttgtttacaacggatttggaggtggctaactatcctgaattcccacaaataagaaagaagactgaagttcagagaggtgaagggactggctcaggggctacccctatggttgcgggagctaagattccagcccagcagcgtgatccagagcccatctgagctacccagatcttcctgctgttaaacccgtcctggggcagctcttgcctgatgggctacctgaggaacccacaggaaatcaagggaggtgcctgcaaagttgccgtggggtcacagcctgccctttggaaggggctgtttctgggctgctgtgacttcctgccattatttcctctctgttctccctctggaatgaataaagtacttctgaaaaaccatcaacccagtcgatacggaaatgctggtccctacaatagaatgctctgtggtcattaaaaagattaaaaaggtca

SEQ ID NO: 41740 - DNA, 525 bp, Homo sapiens
gaaatgtagtctccttggcctgcgctctgtaggagtggcagaacagtaagagaaatgacaaagcaagaggaacctaatactcttcctcattggccttcctgtctccatctttattccttccagctcattctctacatgacactgtgaatgccaaactgtctggaggctgccatgagcggccaatttgtgatctctgctttacctgaattatttccgtgaattgtgacatcaacctcgccagatcttcctgctgttaaacccgtcctggggcagctcttgcctgatgggctacctgaggaacccacaggaaatcaagggaggtgcctgcaaagttgccgtggggtcacagcctgccctttggaaggggctgtttctgggctgctgtgacttcctgccattatttcctctctgttctccctctggaatgaataaagtacttctgaaaaaccatcaacccagtcgatacggaaatgctggtccctacaatagaatgctctgtggtcattaaaaagattaaaaaggtca

SEQ ID NO: 41741 - DNA, 377 bp, Homo sapiens
gggttcaagcgattctcctgcctctgcctcccatgtagctgggattacaggcatgattgattaaaccattggccactggtgctcaacttgaccttcagccactctccactccctggaggttggcctttgtcttttggatcctgcacctggcaccacccagattgataaactggattatctgatcttgtggcccctacccagaaactgactcagcaccagaggacagcttcgactccctttgatttcatctctaacccaaccaatcagcacttttgactcactggcaccccacccaccaagtcctccataataactctgatccctgaatgcttggggagactgatttgggtaataataaaactctggtttcccatgca

SEQ ID NO: 41742 - DNA, 283 bp, Homo sapiens
aatgatatttttttttctcaccagtcatatttaccatggtagtaaaagtcctagccagtacagttaggcaaaaataaatgaataaaatgcatatatatcgggaagagagaaattaaacttcctctattcataggagatagattctttcatgtagaaaagtgtaaagaaattataaaaaaaactcctcggaccaatcagtgagtttagcaaggttgcagggtacaaagttaatatataaaaatcgattatatgccagcagtgaacaattggagtttgaaattaa

SEQ ID NO: 41743 - DNA, 617 bp, Homo sapiens
catttcctgttcctcacgcttctctctgaaaagactgagtttcccattctccagcctccaaatgcatttcgattttattgtccccaaatgtttcttttcttttttttgtttaaccacgtccctctgcccataattcattaattcatacagcagcatgtcctgattctttttctgggccaggcacggtgctcgatccccaatggaaggaaatggaggcagacccatcttgcaggtcatcaccaggaaggagatgagactcatgtcctggagacgaataccccactggaggtgagtgaggggccttggaagcagggccagggggttccctccacacctgctgagcatctgcctctctgggagggctttgggcgttgttggggcctgtcgggcctccaaattctggctttagatgggcactctgggattcccatctggcttcacctgcctaccagctggcctgccatagcctgggccctgcctcttctctgcgctttgcagaaatcatattctcagtccttcagctgtggctcaatacatgttgttctcaaatctcatgacagtttctttaagaaatatctactgatttgaaaattcccgccttatttgaaaaaaaaaaa

SEQ ID NO: 41744 - DNA, 1096 bp, Homo sapiens
tggagctataggacctcatacttaataggaaattgacagctacagatgaccaacaacccacaggagctgatgctgcagatgaacctgctggaactcatccggaagctgcagcagaggggctgctgggcagggaaggcagccctggggctaggaggtccctggcagttgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcagggccaggcagagagtgaggctgggggttctcacaccttactccaccgggcacatcccaacctgcactggggcccactcgagtgcttgttctggtctcagccgctcccttggcagctgcagcccccatgcagaagaggctcccaggcccaagctctgtgtgacccagagaaataaagatgcctcagtgtggcccgcaaaaaacacaaccacacaaacaaacgaagaaaaaacccaacaacaaacagggggagagaacaaaagacgccccaaaggggcccaagataacaagtacacaattattgtacaaggggccacaagagagaccgcgcaataacacagcgacgagacgcgccagacaataacccacgccaacaaggcaaacacgggcaaagagaacactgtggagaaacacacaccacacagcagggcgacaaattgccacacacaccacagaagataacaccgaagggaaaataaaaacccaggcgcggataacacggggacaacccaccgcaaaagctacgaagcagagaagacaacgcgcgcgccggcctgcgcctcgccattacacggccagcgagaaaataccgagggaagcagcaagagcagcgcaccgcaagcaagcgacacagcgagagacacgcgcggcacacacgcccagacgagagacccacaactac

SEQ ID NO: 41745 - DNA, 1158 bp, Homo sapiens
gggactgtcgtaaaaggggcgggacgcgccgcggtcgggatgacgtgagctgggggcgctcgtcgctgcagccggcggctagcgggcgtccgcgccatggagcgctacgcgggcgccttggaggaggtggcggacggtgcccggcagcaggagcgacactaccagctgctgtcggcgttacagagcctggtgaaggagttgcccagctcattccagcagcgcttgtcctacaccacgctgagcgacctggccctggcgcttctcgacggcaccgtgttcgaaatcgtgcaggggctactggagatccagcacctcaccgaaaagagcctgtacaaccagcgcctgcgcctacagaacgagcatcgagtgctcaggcaggcgctgcggcagaagcaccaggaagcccagcaggcctgccggccccataacctgcctgtgcttcaggcggctcagcagcgagaactagaggcggtggagcaccggatccgtgaggagcagcgggcgatggaccagaagatcgtcctggagctggaccggaaggtggctgaccagcagagcacactggagaaggcgggggtggctggcttctacgtgaccaccaacccacaggagctgatgctgcagatgaacctgctggaactcatccggaagctgcagcagaggggctgctgggcagggaaggcagccctggggctaggaggtccctggcagttgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcagggccaggcagagagtgaggctgggggttctcacaccttactccaccgggcacatcccaacctgcactggggcccactcgagtgcttgttctggtctcagccgctcccttggcagctgcagcccccatgcagaagaggctcccaggcccaagctctgtgtgacccagagaaataaagatgcctcagtgtggcccgca

SEQ ID NO: 41746 - DNA, 1040 bp, Homo sapiens
gggactgtcgtaaaaggggcgggacgcgccgcggtcgggatgacgtgagctgggggcgctcgtcgctgcagccggcggctagcgggcgtccgcgccatggagcgctacgcgggcgccttggaggaggtggcggacggtgcccggcagcaggagcgacactaccagctgctgtcggcgttacagagcctggtgaaggagttgcccagctcattccagcagcgcttgtcctacaccacgctgagcgacctggccctggcgcttctcgacggcaccgtgttcgaaatcgtgcaggggctactggagatccagcacctcaccgaaaagagcctgtacaaccagcgcctgcgcctacagaacgagcatcgaggtgcgcgggggcagcgggaggaggtgccgcctcctcggggtcggcgcctcccggcagctcttggtatctgtgcagctcggctccttccttgggagtgttcggaagaggtccctaagattaacaaaatcaagggcgcagagactgagacagcgcctttttggtgaccaatgtgtccaacgagttttgttttcagttgcgcagcacccaccttcttagcagaaactccctgttcgggcttccctgtgccccagccccttccaggcctgatggccctaggcctccgtgcttggttggccggcaggctgactctggtggtagatctgactgcgttgccctccggtaattggagttctgttgacaggtgagcagcgcccttgggtagttggaggtctgttgacagctgtgcgcgcccttcagggtcagttccctctcaggcctgcagggcctcattctagttgcacatcaaattcctaagcactgtctcctgtggcgccctcccaaaccagaagagcttcccacttgagccgcatgcttcctgggcttcggagccctttcctgcaaattatatagggcaggtccccctgcaccatcagatttccacctttgctgttttatttttcccaaacttcttattttaaaagttcaaacatttggaaaaactgaaaagacagtg

SEQ ID NO: 41747 - DNA, 1496 bp, Homo sapiens
tatctggtataactattcttgttttatattttattatactggaacagctcgtgtcctcggtctcttgcctcagcgcctgggtggcttgccgcccacaccagccaccagaagctccccagccccggcccagcagctggtctggggagcggggagagggcagtctgggctcgcggttccggctgggggctgggcaccccggggcgaccacggcaggcccagatggggactccggttccaactctcctggcccagaggctctagggtggtcttgtctgtctcactccgggggcagagaggacgcagacagaccccaacaccactgctcggccgcgatggtgccttagacccaggtcctgtgggctctggcccgagacccctccctctgggaaggccggtgaccgggacagtccacctcgcaggcgcgccggcgcggagcccggacctcagcccgcaatgactcagcaagggccggtgggattctacatggtcctgcgatatccaggcgacggagtctcgcctctaaagtggcccggggagcaggaagctcattccagcagcgcttgtcctacaccacgctgagcgacctggccctggcgcttctcgacggcaccgtgttcgaaatcgtgcaggggctactggagatccagcacctcaccgaaaagagcctgtacaaccagcgcctgcgcctacagaacgagcatcgagtgctcaggcaggcgctgcggcagaagcaccaggaagcccagcaggcctgccggccccataacctgcctgtgcttcaggcggctcagcagcgagaactagaggcggtggagcaccggatccgtgaggagcagcgggcgatggaccagaagatcgtcctggagctggaccggaaggtggctgaccagcagagcacactggagaaggcgggggtggctggcttctacgtgaccaccaacccacaggagctgatgctgcagatgaacctgctggaactcatccggaagctgcagcagaggggctgctgggcagggaaggcagccctggggctaggaggtccctggcagttgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcagggccaggcagagagtgaggctgggggttctcacaccttactccaccgggcacatcccaacctgcactggggcccactcgagtgcttgttctggtctcagccgctcccttggcagctgcagcccccatgcagaagaggctcccaggcccaagctctgtgtgacccagagaaataaagatgcctcagtgtggcccgca

SEQ ID NO: 41748 - DNA, 1688 bp, Homo sapiens
tatctggtataactattcttgttttatattttattatactggaacagctcgtgtcctcggtctcttgcctcagcgcctgggtggcttgccgcccacaccagccaccagaagctccccagccccggcccagcagctggtctggggagcggggagagggcagtctgggctcgcggttccggctgggggctgggcaccccggggcgaccacggcaggcccagatggggactccggttccaactctcctggcccagaggctctagggtggtcttgtctgtctcactccgggggcagagaggacgcagacagaccccaacaccactgctcggccgcgatggtgccttagacccaggtcctgtgggctctggcccgagacccctccctctgggaaggccggtgaccgggacagtccacctcgcaggcgcgccggcgcggagcccggacctcagcccgcaatgactcagcaagggccggtgggattctacatggtcctgcgatatccaggcgacggagtctcgcctctaaagtggcccggggagcaggaagctcattccagcagcgcttgtcctacaccacgctgagcgacctggccctggcgcttctcgacggcaccgtgttcgaaatcgtgcaggggctactggagatccagcacctcaccgaaaagagcctgtacaaccagcgcctgcgcctacagaacgagcatcgaggtgcgcgggggcagcgggaggaggtgccgcctcctcggggtcggcgcctcccggcagctcttggtatctgtgcagctcggctccttccttgggagtgttcggaagaggtccctaagattaacaaaatcaagggcgcagagactgagacagcgcctttttggtgaccaatgtgtccaacgagttttgttttcatgctcaggcaggcgctgcggcagaagcaccaggaagcccagcaggcctgccggccccataacctgcctgtgcttcaggcggctcagcagcgagaactagaggcggtggagcaccggatccgtgaggagcagcgggcgatggaccagaagatcgtcctggagctggaccggaaggtggctgaccagcagagcacactggagaaggcgggggtggctggcttctacgtgaccaccaacccacaggagctgatgctgcagatgaacctgctggaactcatccggaagctgcagcagaggggctgctgggcagggaaggcagccctggggctaggaggtccctggcagttgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcagggccaggcagagagtgaggctgggggttctcacaccttactccaccgggcacatcccaacctgcactggggcccactcgagtgcttgttctggtctcagccgctcccttggcagctgcagcccccatgcagaagaggctcccaggcccaagctctgtgtgacccagagaaataaagatgcctcagtgtggcccgca

SEQ ID NO: 41749 - DNA, 1277 bp, Homo sapiens
gggactgtcgtaaaaggggcgggacgcgccgcggtcgggatgacgtgagctgggggcgctcgtcgctgcagccggcggctagcgggcgtccgcgccatggagcgctacgcgggcgccttggaggaggtggcggacggtgcccggcagcaggagcgacactaccagctgctgtcggcgttacagagcctggtgaaggagttgcccagctcattccagcagcgcttgtcctacaccacgctgagcgacctggccctggcgcttctcgacggcaccgtgttcgaaatcgtgcaggggctactggagatccagcacctcaccgaaaagagcctgtacaaccagcgcctgcgcctacagaacgagcatcgagtgccccgcaccttctggaatcccctggagacttgccgtgacagtggggtgggaggatggaggaggctggcgtcctccccagtgcagacacccctttggcctggctgctctgctgggttgtgctcaggcaggcgctgcggcagaagcaccaggaagcccagcaggcctgccggccccataacctgcctgtgcttcaggcggctcagcagcgagaactagaggcggtggagcaccggatccgtgaggagcagcgggcgatggaccagaagatcgtcctggagctggaccggaaggtggctgaccagcagagcacactggagaaggcgggggtggctggcttctacgtgaccaccaacccacaggagctgatgctgcagatgaacctgctggaactcatccggaagctgcagcagaggggctgctgggcagggaaggcagccctggggctaggaggtccctggcagttgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcagggccaggcagagagtgaggctgggggttctcacaccttactccaccgggcacatcccaacctgcactggggcccactcgagtgcttgttctggtctcagccgctcccttggcagctgcagcccccatgcagaagaggctcccaggcccaagctctgtgtgacccagagaaataaagatgcctcagtgtggcccgca

SEQ ID NO: 41750 - DNA, 907 bp, Homo sapiens
tatctggtataactattcttgttttatattttattatactggaacagctcgtgtcctcggtctcttgcctcagcgcctgggtggcttgccgcccacaccagccaccagaagctccccagccccggcccagcagctggtctggggagcggggagagggcagtctgggctcgcggttccggctgggggctgggcaccccggggcgaccacggcaggcccagatggggactccggttccaactctcctggcccagaggctctagggtggtcttgtctgtctcactccgggggcagagaggacgcagacagaccccaacaccactgctcggccgcgatggtgccttagacccaggtcctgtgggctctggcccgagacccctccctctgggaaggccggtgaccgggacagtccacctcgcaggcgcgccggcgcggagcccggacctcagcccgcaatgactcagcaagggccggtgggattctacatggtcctgcgatatccaggcgacggagtctcgcctctaaagtggcccggggagcaggaagctcattccagcagcgcttgtcctacaccacgctgagcgacctggccctgctgaggagagaccaggtggaccccagctgcctgtcacccttcatctgggacttgctgtcaaaccctaggatagtctcataaaggggaggctgggccagcctgctgctgtctgcttcagggccaggcagagagtgaggctgggggttctcacaccttactccaccgggcacatcccaacctgcactggggcccactcgagtgcttgttctggtctcagccgctcccttggcagctgcagcccccatgcagaagaggctcccaggcccaagctctgtgtgacccagagaaataaagatgcctcagtgtggcccgca

SEQ ID NO: 41751 - DNA, 612 bp, Homo sapiens
tggagctataggacctcatacttaataggaaattgacagctacagatgaccaacaacccacaggagctgatgctgcagatgaacctgctggaactcatccggaagctgcagcagaggggctgctgggcagggaaggcagccctggggctaggaggtccctggcagttgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcagggccaggcagagagtgaggctgggggttctcacaccttactccaccgggcacatcccaacctgcactggggcccactcgagtgcttgttctggtctcagccgctcccttggcagctgcagcccccatgcagaagaggctcccaggcccaagctctgtgtgacccagagaaataaagatgcctcagtgtggcccgca

SEQ ID NO: 41752 - DNA, 1076 bp, Homo sapiens
cggtccgggacatcccaaaggagccaaggctgggtaccagcccagtggcggacggtgcccggcagcaggagcgacactaccagctgctgtcggcgttacagagcctggtgaaggagttgcccagctcattccagcagcgcttgtcctacaccacgctgagcgacctggccctggcgcttctcgacggcaccgtgttcgaaatcgtgcaggggctactggagatccagcacctcaccgaaaagagcctgtacaaccagcgcctgcgcctacagaacgagcatcgagtgctcaggcaggcgctgcggcagaagcaccaggaagcccagcaggcctgccggccccataacctgcctgtgcttcaggcggctcagcagcgagaactagaggcggtggagcaccggatccgtgaggagcagcgggcgatggaccagaagatcgtcctggagctggaccggaaggtggctgaccagcagagcacactggagaaggcgggggtggctggcttctacgtgaccaccaacccacaggagctgatgctgcagatgaacctgctggaactcatccggaagctgcagcagaggggctgctgggcagggaaggcagccctggggctaggaggtccctggcagttgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcagggccaggcagagagtgaggctgggggttctcacaccttactccaccgggcacatcccaacctgcactggggcccactcgagtgcttgttctggtctcagccgctcccttggcagctgcagcccccatgcagaagaggctcccaggcccaagctctgtgtgacccagagaaataaagatgcctcagtgtggcccgca

SEQ ID NO: 41753 - DNA, 1519 bp, Homo sapiens
gggactgtcgtaaaaggggcgggacgcgccgcggtcgggatgacgtgagctgggggcgctcgtcgctgcagccggcggctagcgggcgtccgcgccatggagcgctacgcgggcgccttggaggaggtggcggacggtgcccggcagcaggagcgacactaccagctgctgtcggcgttacagagcctggtgaaggagttgcccagctcattccagcagcgcttgtcctacaccacgctgagcgacctggccctggcgcttctcgacggcaccgtgttcgaaatcgtgcaggggctactggagatccagcacctcaccgaaaagagcctgtacaaccagcgcctgcgcctacagaacgagcatcgaggtgcgcgggggcagcgggaggaggtgccgcctcctcggggtcggcgcctcccggcagctcttggtatctgtgcagctcggctccttccttgggagtgttcggaagaggtccctaagattaacaaaatcaagggcgcagagactgagacagcgcctttttggtgaccaatgtgtccaacgagttttgttttcagttgcgcagcacccaccttcttagcagaaactccctgttcgggcttccctgtgccccagccccttccaggcctgatggccctaggcctccgtgcttggttggccggcaggctgactctggtggtagatctgactgcgttgccctccggtaattggagttctgttgacagtgctcaggcaggcgctgcggcagaagcaccaggaagcccagcaggcctgccggccccataacctgcctgtgcttcaggcggctcagcagcgagaactagaggcggtggagcaccggatccgtgaggagcagcgggcgatggaccagaagatcgtcctggagctggaccggaaggtggctgaccagcagagcacactggagaaggcgggggtggctggcttctacgtgaccaccaacccacaggagctgatgctgcagatgaacctgctggaactcatccggaagctgcagcagaggggctgctgggcagggaaggcagccctggggctaggaggtccctggcagttgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcagggccaggcagagagtgaggctgggggttctcacaccttactccaccgggcacatcccaacctgcactggggcccactcgagtgcttgttctggtctcagccgctcccttggcagctgcagcccccatgcagaagaggctcccaggcccaagctctgtgtgacccagagaaataaagatgcctcagtgtggcccgca

SEQ ID NO: 41754 - DNA, 1642 bp, Homo sapiens
gggactgtcgtaaaaggggcgggacgcgccgcggtcgggatgacgtgagctgggggcgctcgtcgctgcagccggcggctagcgggcgtccgcgccatggagcgctacgcgggcgccttggaggaggtggcggacggtgcccggcagcaggagcgacactaccagctgctgtcggcgttacagagcctggtgaaggagttgcccagctcattccagcagcgcttgtcctacaccacgctgagcgacctggccctggcgcttctcgacggcaccgtgttcgaaatcgtgcaggggctactggagatccagcacctcaccgaaaagagcctgtacaaccagcgcctgcgcctacagaacgagcatcgagtgctcaggcaggcgctgcggcagaagcaccaggaagcccagcaggcctgccggccccataacctgcctgtgcttcaggcggctcagcagcgagaactagaggcggtggagcaccggatccgtgaggagcagcgggcgatggaccagaagatcgtcctggagctggaccggaaggtggctgaccagcagagcacactggagaaggcgggggtggctggcttctacgtgaccaccaacccacaggagctgatgctgcagatgaacctgctggaactcatccggaagctgcagcagaggggctgctgggcagggaaggcagccctggggctaggaggtccctggcagttgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcagggccaggcagagagtgaggctgggggttctcacaccttactccaccgggcacatcccaacctgcactggggcccactcgagtgcttgttctggtctcagccgctcccttggcagctgcagcccccatgcagaagaggctcccaggcccaagctctgtgtgacccagagaaataaagatgcctcagtgtggcccgcaaaaaacacaaccacacaaacaaacgaagaaaaaacccaacaacaaacagggggagagaacaaaagacgccccaaaggggcccaagataacaagtacacaattattgtacaaggggccacaagagagaccgcgcaataacacagcgacgagacgcgccagacaataacccacgccaacaaggcaaacacgggcaaagagaacactgtggagaaacacacaccacacagcagggcgacaaattgccacacacaccacagaagataacaccgaagggaaaataaaaacccaggcgcggataacacggggacaacccaccgcaaaagctacgaagcagagaagacaacgcgcgcgccggcctgcgcctcgccattacacggccagcgagaaaataccgagggaagcagcaagagcagcgcaccgcaagcaagcgacacagcgagagacacgcgcggcacacacgcccagacgagagacccacaactac

SEQ ID NO: 41755 - DNA, 1122 bp, Homo sapiens
gggactgtcgtaaaaggggcgggacgcgccgcggtcgggatgacgtgagctgggggcgctcgtcgctgcagccggcggctagcgggcgtccgcgccatggagcgctacgcgggcgccttggaggaggtggcggacggtgcccggcagcaggagcgacactaccagctgctgtcggcgttacagagcctggtgaaggagttgcccagctcattccagcagcgcttgtcctacaccacgctgagcgacctggccctggcgcttctcgacggcaccgtgttcgaaatcgtgcaggggctactggagatccagcacctcaccgaaaagagcctgtacaaccagcgcctgcgcctacagaacgagcatcgagtgctcaggcaggcgctgcggcagaagcaccaggaagcccagcaggcctgccggccccataacctgcctgtgcttcaggcggctcagcagcgagaactagaggcggtggagcaccggatccgtgaggagcagcgggcgatggaccagaagatcgtcctggagctggaccggaaggtggctgaccagcagagcacactggagaaggcgggggtggctggcttctacgtgaccaccaacccacaggagctgatgctgcagatgaacctgctggaactcatccggaagctgcagcagaggggctgctgggcagggaaggcagccctggggctaggaggtccctggcagttgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctctccagcagcgcttgtcctacaccacgctgagcgacctggccctggcgcttctcgacggcaccgtgttcgaaatcgtgcaggggctactggagatccagcacctcaccgaaaagagcctgtacaaccagcgcctgccgctacagaacgagcatcgagtgctcaggcaggcgctgcggcagaagcaccaggaagcccagcagg

SEQ ID NO: 41756 - DNA, 583 bp, Homo sapiens
ttgttaagctgagttaagtttggctcaaagtgcccattgtacttgcctaattaagtttggcccaaagcggcatccatacatagtgactgtactctaacttaatgtgtagataagttgtaagctaatgtagatatatggacttgtaaccaagcaactgagactcaaccaatcataggagccaaacccttagtcaatcctaggctgaatgctgccaaattatgcccaaataaggcaaatattgaactgcaccaatcagggaaactctgaatataattttatatgttctggttataaatacatctcaccactctggatgtggagtcactctgaacgatctttgttctgggatggtgcctacttctcaaacctttttcttggtcaaataaacttagtgaaatttaacatgtcttagttgcattttttttaaacaacattcaaagacctacaaaataggacagggaacttgtatttagactatactgtctaaatgcaacgtatttatgctagttatttgtgtgttatagagaatatagtgatattgatatactttaagtcatttatgtacatcgggaagaggaaaaaa

SEQ ID NO: 41757 - DNA, 299 bp, Homo sapiens
gagaagagttagcaggcattcgtgtggctgatggtgctgtatccgtaaatgcagctcagcagacactgtcccagaaggtcaggttgtaggctttgtgtacctcctaccatattagctgccacttcacctttttcccaatttaggaggcatatctgagagtgatgttttataggggcaaccttgaaccttactcgcttgtttttaaaagtattaatcagccacaagtatttcttctgacatcctcagaattgattgcaacataccattttggccagacacagacactaaggtgcattcca

SEQ ID NO: 41758 - DNA, 328 bp, Homo sapiens
gcatttaaaagacaagtgggagagaaactaatgaaggagctgaaaatggccaatgacactggaaaagaacgacgacagtaaagtgtcctagtagccaagggaagagagaaagcactttttaaaggatgagatgatcacttgtgtcaacttctgtcaataattaaaggagacaagggacaagatgacatccgtggatatggcaaatagccaataataatgaaagctagcatcacatctgctgcatgcttgtcacatgccaggcacaccacttcaagagttgtacaagtaagaacccatttcatccccaagaaccctaggacgtaagtgt

SEQ ID NO: 41759 - DNA, 969 bp, Homo sapiens
  misc_feature (1)..(1): n is a, c, g, or t
nttacgttttgaacagccccttccccggggtccggagcccaatcctttttcctttaaacccaaagtttctcccctttgttaaacaccagaaaccagactagagtaattaaatccctcccaatttaaggtttccagccttttcaaactatggaggatgcagcaaaagggatgcctttgatctgctgtctctggatgcacaaggagctcagagaaacaaccaggacacagaacaaaacaaagcatggagctctaatttaggggtttcagctaagcgagtcactcagcaccagcactgcacaggaggttcttacagcttcctttatgagaaagatttgttcttctgtttatagcgcacgctctgatgtggacttccagctcagaacccaggttctcgaactcatgaacgcattcagcatcccttgctatcacaaccagcttgacagaaagaccacaggccaagtgcagcagagttccagaaagtgaatgcagcaaaatacccttgctctctttgagggtatcagagccaggagggtggctgactctgatgatagaacaagagccaaatatgctcctgatgctccagtagagtggtcttcaggtgatcgagattccgagctcccaaaccaaggcaagaataaggaaactggaacaggagggcatgctgggctccagcctcccgtgacagtgaaacattgccttagaatgactgttgttaatacaattgaggaaatataacacgtaatcttgtgattaagttatacacaatttgatttaaatttagttcctggcagttgctaggtttcactctggcatactctctcagtgtggaagctgctgattcagaaagagatgttccaaagctcatgtatttcctggacacatccaagtactgaataaaatgctggttaaataaatgagttaattttccaagaaagacaccaaaaaataaaaaccgatggcgccctgaac

SEQ ID NO: 41760 - DNA, 896 bp, Homo sapiens
tcagttacactctgttgattcaaaagaaggttgtttgtccaagcttgtccaagtcagtttcaagaggctcagccaccaaaagtttcatcaaagaggaagccaaggtcatcagtaaagcctcacgagagctacctggaacgggcaggaaagaaaaatgcagataagaaaattaaaaccacagactcctgggcagcgaacaagagccttctgatcctaattcgatctggagttaagaatgaaggggatttctgtagcagtttcttttgcatagcagagctccgacttttccagcaacagcgtgtccctggaagctacacaaagtcctctttgattgcctgtgatcaaagccacgaaggctctcctgcaacatcttagcttcagaaagccaggaaaatcagaatgctgagagtatattaataattcctaaacatatttttaagggtatcagagccaggagggtggctgactctgatgatagaacaagagccaaatatgctcctgatgctccagtagagtggtcttcaggtgatcgagattccgagctcccaaaccaaggcaagaataaggaaactggaacaggagggcatgctgggctccagcctcccgtgacagtgaaacattgccttagaatgactgttgttaatacaattgaggaaatataacacgtaatcttgtgattaagttatacacaatttgatttaaatttagttcctggcagttgctaggtttcactctggcatactctctcagtgtggaagctgctgattcagaaagagatgttccaaagctcatgtatttcctggacacatccaagtactgaataaaatgctggttaaataaatgagttaattttccaagaaagacaccaaaaaataaaaaccgatggcgccctgaac

SEQ ID NO: 41761 - DNA, 1123 bp, Homo sapiens
tcagttacactctgttgattcaaaagaaggttgtttgtccaagcttgtccaagtcagtttcaagaggctcagccaccaaaagtttcatcaaagaggaagccaaggtcatcagtaaagcctcacgagagctacctggaacgggcaggaaagaaaaatgcagataagaaaattaaaaccacagactcctgggcagcgaacaagagccttctgatcctaattcgatctggagttaagaatgaaggggatttctgtagcagtttcttttgcatagcagagctccgacttttccagcaacagcgtgtccctggaagctacacaaagtcctctttgattgcctgtgatcaaagccacgaaggctctcctgcaacatcttagcttcagaaagccaggaaaatcagaatgctgagagtatattaataattcctaaacatatttttaaggttcttcaggcctgtctcagagctatggaggatgcagcaaaagggatgcctttgatctgctgtctctggatgcacaaggagctcagagaaacaaccaggacacagaacaaaacaaagcatggagctctaatttaggggtttcagctaagcgagtcactcagcaccagcactgcacaggaggttcttacagcttcctttatgagaaagatttgttcttctgtttatagggtatcagagccaggagggtggctgactctgatgatagaacaagagccaaatatgctcctgatgctccagtagagtggtcttcaggtgatcgagattccgagctcccaaaccaaggcaagaataaggaaactggaacaggagggcatgctgggctccagcctcccgtgacagtgaaacattgccttagaatgactgttgttaatacaattgaggaaatataacacgtaatcttgtgattaagttatacacaatttgatttaaatttagttcctggcagttgctaggtttcactctggcatactctctcagtgtggaagctgctgattcagaaagagatgttccaaagctcatgtatttcctggacacatccaagtactgaataaaatgctggttaaataaatgagttaattttccaagaaagacaccaaaaaataaaaaccgatggcgccctgaac

SEQ ID NO: 41762 - DNA, 760 bp, Homo sapiens
  misc_feature (1)..(1): n is a, c, g, or t
nttacgttttgaacagccccttccccggggtccggagcccaatcctttttcctttaaacccaaagtttctcccctttgttaaacaccagaaaccagactagagtaattaaatccctcccaatttaaggtttccagccttttcaaactatggaggatgcagcaaaagggatgcctttgatctgctgtctctggatgcacaaggagctcagagaaacaaccaggacacagaacaaaacaaagcatggagctctaatttaggggtttcagctaagcgagtcactcagcaccagcactgcacaggaggggtatcagagccaggagggtggctgactctgatgatagaacaagagccaaatatgctcctgatgctccagtagagtggtcttcaggtgatcgagattccgagctcccaaaccaaggcaagaataaggaaactggaacaggagggcatgctgggctccagcctcccgtgacagtgaaacattgccttagaatgactgttgttaatacaattgaggaaatataacacgtaatcttgtgattaagttatacacaatttgatttaaatttagttcctggcagttgctaggtttcactctggcatactctctcagtgtggaagctgctgattcagaaagagatgttccaaagctcatgtatttcctggacacatccaagtactgaataaaatgctggttaaataaatgagttaattttccaagaaagacaccaaaaaataaaaaccgatggcgccctgaac

SEQ ID NO: 41763 - DNA, 812 bp, Homo sapiens
tagatctcagcttaatatagctccacagaaaaaccttccctcactgccctatttaggtagcccacctgttttactctgtttctctgtcctgtttgcatcttttcataggaattacagttgaccgttgaacaattagggggctagaggtgctaccccatctacacagtcaaaattcctcatgtaacatttgactcctccaaaacttaaccatgaatagcctactattgaccagaagccttaccgatcaacagtcgattaacacatatttggcatgttgtatgtattttttactgtattcttacaataaaggaaactagagaagggacaatgttattaagacaatcataaggaagagaaaatattcttactgttcattaagtggaagtgggtcatcacaaaggtcttcatccttgtcatcttcacgctgagcaggctaacaaggagagggaacaggaagggttggtcgtgctgtcccagaggtggcacaggaggaaggaaatctgcatgtaagtgcgcctgcacagttcaaacccctgttgttgaaggaccagctgtattattactttgttatttgtttccttttaatttttctttctagaaaaattgacagcaggggccatgtctgtttggtttaatgctgtaacattccaagcacacagcaagtaagtgctctacaaatatttgttgaatccttgactcaattagacatttaccatttttttttgttgtttgttttttttagagtcagggacttgctttatccagactggagtttgtggcacaattatggctcactgaagcctcaacctcat

SEQ ID NO: 41764 - DNA, 860 bp, Homo sapiens
tagagatagggtttcaccatattgacgaggctggtctcgaactcctgaccttgtgatctgcccaccttggcctcccaaagtgctgggattacagatgtgagccactgcatccggccaactatgttttatataaaaaatacctgccaagcctatttacaattcctctttcaccccaaattactttagcgacgttctttgcacatgatatgtatcaggatttggccctttgcattttgacttcctctgcgggtatgtgtttttcttttcccttttttcgaggcctctttctcccttaattagacctgtcgggtgctctagtttcctaatttattaagttgccctcatgtatatactttctataccccaggtttttcatttgtggtccttatctgagcacacagtcttttttagcctttttatggttaagtgacctacacagatgagtcaggctaaccccaggacaaaacaagcttaaaaagatcttgaaagccaatctaagattaggtctttggacctgggacagagcaagaaagttgtttttaatcaaactatgcactctccacaaaatgaagggactaatctatactatttctgaatttggtttctttggttttatttcgcatagacaactgctaaaagtgttatattgctgaatttgttgttaccaacagtggacaatggagtgaaaatagaaaacagaattggtaaatttcaggctgttcagtgcttgtttttttttcaaatggcaaataggcataaacagactagtgatttccattagtattgttacttagttttataatactaaatccagaaatctagttctgaggcttcaaatgagaaattcttttccgagtaaa

SEQ ID NO: 41765 - DNA, 759 bp, Homo sapiens
gtcgaattaggggcactgtaaccagggtttgggttttgaagtagtgggtgttcgactttagagttgttttcctggaagcgctgatactggacttagtggaggagaacgacggtatcaatgtgtttctggatgactgcctggacaagggagttcagcttttgggagactgactgggctatgaagtgtacctttctactctgcagaggctggaaaggcaaaaatgatggctaaggcttccttgcaggagaggctgcccctccagaactagactcttccttggctttaagatgtgaagtcgagcagctggaaggacagacacctcatctgaccactgttctatggaccaaaggcaggatgagcatgccgctgatacagaagcctgagggaacacactccccactacgtccttctccaacacagcagagccaggagagtgactctggtcataggacttggtagggtcccagggtccctaggcctccacttctgagggcagcccctctggtgccaagagctctcctccaactcagggttggctgtgtctcttttcttctctgaagacagcgtcctggctccagttggaacactttcctgagatgcacttacttctcagcttctgcgatcagattatcatcaccaccaccctccagagaatttttacgcaagaagagccaaattgactctctaaatctggtgtatgggtattaaataaaattcattctcaaggctaataaaaaccacattggcattttcctctgc

SEQ ID NO: 41766 - DNA, 1183 bp, Homo sapiens
cagggttctacccggctgggtccaggcagaagtttttcctccccacctccgggtttgtcctcatcatcggtcactcccattcacagctttaagattctggaggccaagaatttgactccccccggatccatggtctgtggataccaatgttccgactggagacggggagcccgcgagacccgggtctccagggtctgcccaaggaagttgctcatgggagcagacccctagagcaggatttgaggccaggccaaagagaaccccagagatgaaaggcctcctcccactggcttggttcctggcttgtagtgtgcctgctgtgcaaggaggcttgctggacctaaaatcaatgatcgagaaggtgacagggaagaacgccctgacaaactacggcttctacggctgttactgcggctggggcggccgaggaacccccaaggatggcaccgattggtgctgttgggcgcatgaccactgctatgggcggctggaggagaagggctgcaacattcgcacacagtcctacaaatacagattcgcgtggggcgtggtcacctgcgagcccgggcccttctgccatgtgaacctctgtgcctgtgaccggaagctcgtctactgcctcaagagaaacctacggagctacaacccacagtaccaatactttcccaacatcctctgctcctaggcctccccagcgagctcctcccagaccaagacttttgttctgtttttctacaacacagagtactgactctgcctggttcctgagagaggctcctaagtcacagacctcagtctttctcgaagcttggcggacccccagggccacactgtaccctccagcgagtcccaggagagtgactctggtcataggacttggtagggtcccagggtccctaggcctccacttctgagggcagcccctctggtgccaagagctctcctccaactcagggttggctgtgtctcttttcttctctgaagacagcgtcctggctccagttggaacactttcctgagatgcacttacttctcagcttctgcgatcagattatcatcaccaccaccctccagagaatttttacgcaagaagagccaaattgactctctaaatctggtgtatgggtattaaataaaattcattctcaaggctaataaaaaccacattggcattttcctctgc

SEQ ID NO: 41767 - DNA, 988 bp, Homo sapiens
ctccaacaggaaatgccagagtggacagcatatcagatgagttctataacattccagagacagaaccccagagatgaaaggcctcctcccactggcttggttcctggcttgtagtgtgcctgctgtgcaaggaggcttgctggacctaaaatcaatgatcgagaaggtgacagggaagaacgccctgacaaactacggcttctacggctgttactgcggctggggcggccgaggaacccccaaggatggcaccgattggtgctgttgggcgcatgaccactgctatgggcggctggaggagaagggctgcaacattcgcacacagtcctacaaatacagattcgcgtggggcgtggtcacctgcgagcccgggcccttctgccatgtgaacctctgtgcctgtgaccggaagctcgtctactgcctcaagagaaacctacggagctacaacccacagtaccaatactttcccaacatcctctgctcctaggcctccccagcgagctcctcccagaccaagacttttgttctgtttttctacaacacagagtactgactctgcctggttcctgagagaggctcctaagtcacagacctcagtctttctcgaagcttggcggacccccagggccacactgtaccctccagcgagtcccaggagagtgactctggtcataggacttggtagggtcccagggtccctaggcctccacttctgagggcagcccctctggtgccaagagctctcctccaactcagggttggctgtgtctcttttcttctctgaagacagcgtcctggctccagttggaacactttcctgagatgcacttacttctcagcttctgcgatcagattatcatcaccaccaccctccagagaatttttacgcaagaagagccaaattgactctctaaatctggtgtatgggtattaaataaaattcattctcaaggctaataaaaaccacattggcattttcctctgc

SEQ ID NO: 41768 - DNA, 667 bp, Homo sapiens
cgagtggtccctgccgagtgggtccctgcgagtgggtccctgcgagcccgggcccttctgccatgtgaacctctgtgcctgtgaccggaagctcgtctactgcctcaagagaaacctacggagctacaacccacagtaccaatactttcccaacatcctctgctcctaggcctccccagcgagctcctcccagaccaagacttttgttctgtttttctacaacacagagtactgactctgcctggttcctgagagaggctcctaagtcacagacctcagtctttctcgaagcttggcggacccccagggccacactgtaccctccagcgagtcccaggagagtgactctggtcataggacttggtagggtcccagggtccctaggcctccacttctgagggcagcccctctggtgccaagagctctcctccaactcagggttggctgtgtctcttttcttctctgaagacagcgtcctggctccagttggaacactttcctgagatgcacttacttctcagcttctgcgatcagattatcatcaccaccaccctccagagaatttttacgcaagaagagccaaattgactctctaaatctggtgtatgggtattaaataaaattcattctcaaggctaataaaaaccacattggcattttcctctgc

SEQ ID NO: 41769 - DNA, 806 bp, Homo sapiens
  misc_feature (801)..(801): n is a, c, g, or t
cagggttctacccggctgggtccaggcagaagtttttcctccccacctccgggtttgtcctcatcatcggtcactcccattcacagctttaagattctggaggccaagaatttgactccccccggatccatggtctgtggataccaatgttccgactggagacggggagcccgcgagacccgggtctccagggtctgcccaaggaagttgctcatgggagcagacccctagagcaggatttgaggccaggccaaagagaaccccagagatgaaaggcctcctcccactggcttggttcctggcttgtagtgtgcctgctgtgcaaggaggcttgctggacctaaaatcaatgatcgagaaggtgacagggaagaacgccctgacaaactacggcttctacggctgttactgcggctggggcggccgaggaacccccaaggatggcaccgattggtgagctgatcgctataactgccctttaggctccaggctctgcacccatgttttcttattcaattccatatcagttctggaagatgagtattaaagtaccattttacaaataagaaaactaagcctcaaagaaattagctggcaatcccaagatctcagtggcctaaggtgtcagttggtcaactgtggcgtaacaagtggtcctcaatgtagtagcttatacagcactggtcatttactttgcttatgaatctgccatttgggtagggcttgtggggatggcttgtcgcagcttcagcttggacaactgaggctggacaatccaccttccagatggctcactcctantggct

SEQ ID NO: 41770 - DNA, 279 bp, Homo sapiens
gtaaggctggggcttcccgttcgggccattggaagagcacctgactttaagttcagctgccctagagaacagccagcctgtatcttgttgggggaggaggagttgggtgcagaactgggacgagaggagcaggattattgcagctgtatcagacccccagggtagggctgaatcatccactgggtgcaaaagtgcttgacatgcttcctttttcttgattcccccacaaaatacctgtagagtatgtttaggcttctccattttagacatcaagaaatg

SEQ ID NO: 41771 - DNA, 488 bp, Homo sapiens
cccagaccaagacttttgttctgtttttctacaacacagagtactgactctgcctggttcctgagagaggctcctaagtcacagacctcagtctttctcgaagcttggcggacccccagggccacactgtaccctccagcgagtcccaggagagtgactctggtcataggacttggtagggtcccagggtccctaggcctccacttctgagggcagcccctctggtgccaagagctctcctccaactcagggttggctgtgtctcttttcttctctgaagacagcgtcctggctccagttggaacactttcctgagatgcacttacttctcagcttctgcgatcagattatcatcaccaccaccctccagagaatttttacgcaagaagagccaaattgactctctaaatctggtgtatgggtattaaataaaattcattctcaaggctaataaaaaccacattggcattttcctctgctgtggggga

SEQ ID NO: 41772 - DNA, 868 bp, Homo sapiens
tgaaactcttgtcatctcaaaaataataataatatttacagcatcttgacagactcattaatgatgtcattaccccattttggatgaggattccaagcccctgagaggagaggcgatttactctcagacacccagcctagctataagacagaaccaggatcagaaccaaggtcattttggtgtcaaagccatgcatgttttaaaatgtttttctacaaactgtcttgttttggccacgctctcagaataggtcatgcctacaggcaggtgccattgttgaggcttgttaagagtgtagagaaaaaagaatactggcaggcattgtgcagtggactgtgcatagacgatctcatttattccattgtacggtcagattagctgaggtcaggggcaggattcgaacccatgtctccctgacagcagaactcaggtgctcatccacttgccaaccagctttccacttagatcattaggataatagctactctctcagcactaagtgctaagatctcattaaatacataccaccaggggatgaggtgagaactgttatctctgttacacatagaaggaaatggagacatgattgctttgattttgacctaaatgctctcctgccccctcaccctttgatcttccattgaggtgagattgggggagtgccgcagtgtggtcctcagaagacacaccatagatacactgttagcattggatgaaaaagaagggcttcatacctttccacagaggtcggtcctcttcaagaccatttgaatttaatgctcaaagagtttccttctctccctgagtgctcagcacccctccggccttgcagtttagcctgccttagacttagtcttgcatgtgtaaa

SEQ ID NO: 41773 - DNA, 455 bp, Homo sapiens
tgtgagtgaaatgtgtcccagaacaacaggcacttccttatccttctagcaacatggaattaagcatgacagtgttttgatatatcccaccattatcccatcactttacagttgaggaaactaggtcttaggctaaataaccttcccagttaatacataagaagagaggggacttgaaccgtaggcacaatgctatttctataatttaaggctgattgtttccccctaagggaaagtttttaagtttgcttttggtcagggtgggcatattttgacataaggcattgtctcataaggcagttaagtttcttagtctttagagttccacagtgatacttaagagctctcctctctaccatggttttatgcacagaatgtctgcttttatcagttttacatattagattgtgtttaaggtctactttgaaaaaagtttcaataagcagcaagtggtc

SEQ ID NO: 41774 - DNA, 433 bp, Homo sapiens
tctctgatgtatatcagcacccagaacaatacacagtacaatgatagtactcaaatatttgtcaaatgaatgaaaatactttttaagtaactgtataattcatatgtaaaaagtgtcataaagaaaatatccacaatactgtaagagagtaattaggagatcctgacgtagtcttgggatcttgtaaagtttcctaaggaacacctgagagctgaaggatgaacaggagttagagtgggcaaagtgcaaccataaaaagggaggggaaagatgatctcacaggtatgttttcggccaactaaaatccagagaatgacacatgggagttgagaatctgaaactgcccacacaccactgcagagtctctgtgaactccaaggtgttcaaatgcctgccctgaagacagctggtccacacctgctatctctccttc

SEQ ID NO: 41775 - DNA, 1036 bp, Homo sapiens
  misc_feature (868)..(868): n is a, c, g, or t
  misc_feature (889)..(889): n is a, c, g, or t
  misc_feature (897)..(898): n is a, c, g, or t
  misc_feature (901)..(901): n is a, c, g, or t
  misc_feature (906)..(906): n is a, c, g, or t
  misc_feature (910)..(910): n is a, c, g, or t
  misc_feature (913)..(913): n is a, c, g, or t
  misc_feature (922)..(922): n is a, c, g, or t
  misc_feature (1036)..(1036): n is a, c, g, or t
gtgccacctgggacgtacctgagcaggagccgaagcatgtggtactcacagtatggaaatgaggccatcttggtccgagacaaaaacaagctcgaggtctctagggacacagggcagtccaagttttgcacaattatgtaattccgatgtgagcacctgaacccaggaccacactttgaggaaaacagacctgagtttcattcagttgtcttgttgatttccaatccttgctggaagattttgaataatgaacgtgaagatcaaactgtggtgtaagaacccaagaagcgcagaattggcccccgaacccctcagcacagccgcggtgtgactggtgcacaggacacttcccctctagagtcccctccgtggtcagctgttgtgacatttgaattctccaggtgctgctagggacagcataggcccgggcactgctagatgcttggtttaaaccaggccaagagtaaccctcccatccccattacaaaccaccttttcaagttttttaggttttagttttttgtttttagcataaatggcggagtagcagcagcatctcaccaggagctttgtcgcattacattttgtattttgcttttttgagacggggtctcactctgttacccaggctggaatacagtggcacaatcacagctcactgtaggctctatctcctgggctcaggtgatcctcccaaactcagcctcccaggtagctgtggctccaggcgaactactgtatatagagacagggtttccctatgttgcccaggctggtctggtcttatagtcctgggctcaagcctcccagagtgctgggattacaggcatgggtcaccgcaccaagcccgcatttatattttggtccnatgtctctctggagctctggnggttcagnntgnggccnggcngtnccaccttgnaccggtgttggcttgggccgctccgtgaacggcgaggggccccaagattaccccgccggggttttgccgcgttcaaaagcctcaggggtttctaccaaaggcgctgtttcgtgn

SEQ ID NO: 41776 - DNA, 1246 bp, Homo sapiens
gtgccacctgggacgtacctgagcaggagccgaagcatgtggtactcacagtatggaaatgaggccatcttggtccgagacaaaaacaagctcgaggtctctagggacacagggcagtccaagttttgcacaattatgtaattccgatgtgagcacctgaacccaggaccacactttgaggaaaacagacctgagtttcattcagttgtcttgttgatttccaatccttgctggaagattttgaataatgaacgtgaagatcaaactgtggtgtaagaacccaagaagcgcagaattggcccccgaacccctcagcacagccgcggtgtgactggtgcacaggacacttcccctctagagtcccctccgtggtcagctgttgtgacatttgaattctccaggtgctgctagggacagcataggcccgggcactgctagatgcttggtttaaaccaggccaagagtaaccctcccatccccattacaaaccaccttttcaagttttttaggttttagttttttgtttttagcataaatggcggagtagcagcagcatctcaccaggagctttgtcgcattacattttgtattttgcttttttgagacggggtctcactctgttacccaggctggaatacagtggcacaatcacagctcactgtaggctctatctcctgggctcaggtgatcctcccaaactcagcctcccaggtagctgtggctccaggcgaactactgtatatagagacagggtttccctatgttgcccaggctggtctggtcttatagtcctgggctcaagcctcccagagtgctgggattacaggcatgggtcaccgcaccaagcccgcatttatattttgagttaccaaaatgatcatcatctgtgaagcatcatggtagcttccaagcatttgcggcccactggccagtgcatccaaaacacattcaggaaacccgagagttgtaagttgcacatgtgtggcctacagtgacttccatgtagtaacagggctgagcaaggcaggctctccaccagacttaaagcattcaaccactctgcccccaggccgacactgacatgtgttcactgtcgctgccacagctggccacctgtgttcagtctccatgaaggattcaccttctgctctcactgacatctccttggctacacaaatgtgcaggtgtctcttgtcaaagctaatttttcttttctaaataaacatcctttaatacactcctcccc

SEQ ID NO: 41777 - DNA, 349 bp, Homo sapiens
gtctcattaagttgccgaggccagaatcaaactcctggacttaagcagtcatcccacctcagcctaccaggtagctaggactgcaggtacacaccaccttgctcagtttattttactcttcagtgcattttgttatttttttctctatgccttcttttgatttcatttttttcaaaacttttttcctcttattacctctaaaatttggaaattgtaacatctatagataatcttttagttcttatctaagaagttttaatatgcataattaacttattcaaagccagaagctaatcaggatcttaatcctccaaacaatacgaagactttagaataattcaactctgat

SEQ ID NO: 41778 - DNA, 307 bp, Homo sapiens
catgagattttttgcctttttttttttaagcccatcagctatccttaatgtattttatatgtggcccaagacaattcttcttccaggatggcctggggaagccaaaagattggatacccctgatttgtaggttttcaactttaaaatatatgctataaaataagttcatttaagtaggctaggcatggtggctcatgtctgtaatcctagcactttgggaggccgaggcaggtggattgcctgagctcagcagtttgagaccagcctgggcaaaacggtgaaaccctgtctctactaaaataccaaa

SEQ ID NO: 41779 - DNA, 467 bp, Homo sapiens
ccccttgagtgacttgggtatctccttcctactcaaaggctggtttttctagaatctgggtatctgtcacaattctagaactcctctcccacagcccttttgaaaagtgatcttgggcatgtgcatcataagtcataaatctaagctaacacctttttattctaatcccactccttagaatctgtgccaaagttatgataaaaaattcagaaggccgggcgcggtggctcacgcctgtagtcctggcactttgggaggccgaggcgggtggatcacctgaggttgggagttcgagaccagcctgaccaacatggagaaaccctatctctactaaaaatacaaaattagctgggcgtggtggcacatgactgtaatctcagctactcaggaggccgaggcaggagaatcgcttgaacctgggaggtggaggttgcggtgagccgagatcgcaccattgcactccagcc

SEQ ID NO: 41780 - DNA, 467 bp, Homo sapiens
ggcaaacatatgcaaataactgaattttcaagaaatattcctggctagtagcatcttcaaaagctgactttggagaacagaatcagaaagtgaacggataaatgcgaggcacgcttttacatctggacttaacggtatcctgagcaagatgactaagatgtttatgcagcaatccagaataccctgcccccatcacaggcaataagtagcaaggctaaaaattttacttagtaaaattgactaaatatgggatcctgaaaatattcataaggcagatcagcagtccatgtgtttttgtgggattatgggctatttgaagggataagttccaattctcctctatgtcatggcatagcacctaggaacaattttggaacatggagtgacaattccttgttttcttaggtggaattaaaaaatttaagggacagtggaattaggttttttggggaactggccgaatagag

SEQ ID NO: 41781 - DNA, 746 bp, Homo sapiens
ggaaaggcagagtctggcacctggcaaggcctcctcacaggcctgactcccgtcccttcccacctccctaggcagaaccgggtggaactgcatgagaagcgacggaggcgccagccccagccagctccctgtggctcctggcaccaatcaggcctcgaggcttcctcaacaccagctttccttcccctcccattgggccctgcatccctgccttctgcaacattgtgctcctgaccctggctggctcccagccctccacagctgggccccacctcagagcctttgcatcaggtagccccagagtcagagagaaggcccccgacaaagccgcagatggagctcagccccaggaaacacctttccagagcaaggctccagctcactgtaggaccacagtcaagtctgtatccaggccgagcgacaggtgggcttgggaaccatctcactcccggcctagatcctacaccaaaaggaaaaacttccctcccacaccccttcgtcctgctctggtttcctgactgccagtggggaagcacttcttttggaagccactggaaattgagggatgagacagaaaaaaaaccaaagcaacagagaagcgctcaagtgtggaaatgtccccagccggccctccccttcccgccaggtcgggctgcatagccctggggggagcctagacctggagctgcaggaacatggcagaacctcccatccaggcagggctgagctgcagatctggagcctgg

SEQ ID NO: 41782 - DNA, 375 bp, Homo sapiens
atatatgcattcataattgaaattttggaaaatggcaaagaacataaagaaaatttaaattctttaaaccactaccacctagagttctcccattaacattttatacatatgcccacattaacattttatttctaaaatcaaaatcttattgtatatatttagaggcagcttctgctgctttttaaaaaatacagtacagtggttttcaaactcagtcccacagaaccttaaggtgctgaacctaaggtccccaggtcagggaaccaagcatgcagcattctaggcttcccaacttcccattcccttattatgtttatataccaaggttttacataggatttcttttgaaaatggttgttgctgtgtaaaaaaaaa

SEQ ID NO: 41783 - DNA, 952 bp, Homo sapiens
cctcctgaaagaagtcggaagttgcagtcattcgagattttatgtaatataagctatagtaactatgctgtggatataaattagaatatattcgtatcttttatttgcaataaatgtaaagctgaatcttagaatttcaaacggataaattttaacagcactattcccagggcttttttggtagtgatagaaaagtgtaactgttgagtttttccatattggcaatatactgccaggttcccttatggacagaatgaatcatcggctgggtgcagtggctcatgctgctaatcctcaggaagattgtaaaccttaggacgctgaggtgggtggatcgcttcagcccaggagttccaagaccagcccgggcaacatggcaaaactgcctctctacaaaaaattagcctggtttggtgacgcgcgcctgtaatcctagcctgtactcaggaggctgaggtgggaggatcgcttgagcccaggaaattgaggctgcagtgagccttgagcatgccagtgcactccagcctgggtgacagagtgagacctgtctcaaaaaaaaaaaaagaaaagaaaaagaaaaatgaatcatacgtttatactgtactccagaatccccaagtaagtttctaacacaattgtttctattgaccaagcaattttggcattttacactgaaattacagtggctgttaaatttagtctaaactgccctttaagtgttggcaaaaaggagaagaaacagtgtaatttgtaatccctcttctgtgtagctgtcattatgttgaaaattatgtattctttgtctcatctgtctgtgaaacacagagaattattacctatcttagtggtcaaaatgactttgcaaagttgtttggaatgtttattactacaaaaaattaaaattttttttacacttaaaaatgcttagtaggtttttaaaaataactttgtg

SEQ ID NO: 41784 - DNA, 323 bp, Homo sapiens
agggaagacatgttttgctttgtcacccagcctggagtgcagtggcttgatctcggctcgctgcatcctccgcctcccgggttcaagtggttcttctgcctcagcctcctgagtagctgggattacagctttagataaagtccttccaacatcttgcaacctggataacagccaagtcctattcatccctctcaacctggctcttccatgccctcctgcaaggccttccccagcccttctctgtggatgcccctcctccgttttgaagcagactggataccagccccaccccgccgccatgcttcttttatccttgcaggtgg

SEQ ID NO: 41785 - DNA, 427 bp, Homo sapiens
cctggtttcctaactcaataagcaaaacaaacagatgcaacctccaagtattttgtattcctcacctcagtgaattccccaccacttgctgagaaggccacggcagaagctgaactaatccttgactcctttttctccaatattctccctatcctgccagtcaaaagggcatataactcccagtcactgaatctcttgactcaacctctcttctttaatcccaatgccacagctttagataaagtccttccaacatcttgcaacctggataacagccaagtcctattcatccctctcaacctggctcttccatgccctcctgcaaggccttccccagcccttctctgtggatgcccctcctccgttttgaagcagactggataccagccccaccccgccgccatgcttcttttatccttgcaggtgg

SEQ ID NO: 41786 - DNA, 133 bp, Homo sapiens
cagggagggaaagggttgtggttgggagctgggggctcagccagattcccctttcagtgatttctcaggcatgaggatgacctgccttggccactgcatctgaggaaatattgcaggggagaggcagggcagg

SEQ ID NO: 41787 - DNA, 480 bp, Homo sapiens
tactagttctgaaaattctttctaagctgttgattcaaaataaaagtttatgacttttgtactgttttacctttgcacttgaaagtgcaaatataaaaataaagaaaatactctttatttcctgagaaaaagattgggggatttccattttattttaccaataatgtaaatgtatagatttcagtatattttgcagtgtactcacatcctgaagtttctaagactccattaaaaagttatgctgtttttgcagggattttttcagggcatttagttgtaaaaaaaaaatgctgaatagatgaaaaatgagtaaaatctgtgtttttttttttctttcctattcatcattgctgtttgtcctctgtgtgtaggcaaccaatttgctgttgtttcctgaggggaattcaagtcaaaaagtaatattgaattactaggaaaaggtattcctatctcaaaagaacaaagtaaaatgattcagaa

SEQ ID NO: 41788 - DNA, 387 bp, Homo sapiens
agaggacgttagacttttttctagcccagggaggaacaccagccaagacttgccttgggcattggtggtaataactgatgcatatagagggctttctttgtgccaggagttgttctaaatgctttatttcagggcctctgttcctcagcactgttgatattttaggctgggtaattctttgttggggactgttctgtgcattgtgggatgtttagcagcatctctggcccctacccactagaagctagtggtacctcctctagtccatgtcttttccattttatttcctgcatagcatttagcatagtgttttacttatgagagatgcttaataaatatgtccatttgtttgggttagatgggttcctactcatgtagtgatttctt

SEQ ID NO: 41789 - DNA, 1249 bp, Homo sapiens
gcaagaatccagcatggacgtgtctgacggtcattattggactcatatcacatcatgatgtccaagcagatctcagatattcaagattaggcccctgatcgtgtaggggttggggagggtgctgagtgagatcaccactaatgtgcaactcctagaaagaagcctttcttaaagggccagcccaggtttccagaagcaccattattgtaggtggctgggaaatagcagggaacaagacagaaaagtccttgttctcctggagtttacatgctagtaaggtaagaaagataaataagcgacctacctttagatagtgataaatgctacgaagacataaaatggcatgatgatgatggcagttgaaaaaaattgttaaattattccagcagtacaaggtgagcactggccacggcaggtcccatgacagtttatctgggagcaaatgaaacctgtttggatgactctccatattgaagcaatgatagtaaacacatagctctagccatggttctaaatgctttagatctgtgctgcccaacatggtagacactagcctcatggggacagtacattttaattccaacaaaaaatgaaaaatttctcagacacatgagccacatttcaggtgttcaatagctacatgtggccgcaacagctacagaagagtgtggtcacatctctgagcctcagttctttaaaaacagcataatcatacctatcttgctgattgtttcaagaattaagtgatcatctataagcctggcacctaaggccgcatgcggtggctcacacctgtaatcccagcactttgagaggccaaggcgggcagatcagttgaggtcaggagtttgaaaccagcctggccaacatggtgaaaccttgtctctactaaaaatacaaaaatgagccgggcgtggtggtgcacactggtagtcccagctactcaggagactgaggcaggagaatcgcttaaacccaggaggtcgaggttgcgattgcaccactgcactccagcctggtcaacaaagtgagactccatctcaaaaaaaaaagcaagcctggcagtcagacatttggtgtggctgctttattggacaacagagaatagaatatttacatcatcacagaaagttccattggacagcatctgttcagataaactcaatcttcccccacatcctaatgaggtgtagatactgcttttccattttgcagatgaggaagtaaggcacgggagttacgtgtgact

SEQ ID NO: 41790 - DNA, 1847 bp, Homo sapiens
cccaggtggggagctagcctgaaagagacagcggaaggagtttcctggactgcgctgtcgctcaccgacccgcaccaatcaccatgcagcttgccctcggacccgccccttttagggcgtgtccccagtgagtgatagacggagccgccctgccctgctcagcccagcccacgttgctgcttagattgaaatgcagaactcaagcctctttcatcggggcacagacttccttttacttcttccttttgccctctcgcctcctcctcctgggaagaagcggaggcgccggcggtcggccgggatagcaacaggccgggccactgaggcggtgcggaaagtttctgtctgggagtgcggaactggggccgggttggtgtactgctcggagcaatggagccagccttcggggaggtgaaccagctgggaggagtgttcgtgaacgggaggccgctgcccaacgccatccggcttcgcatcgtggaactggcccaactgggcatccgaccgtgtgacatcagccgccagctacgggtctcgcacggctgcgtcagcaagatcctggcgcgatacaacgagacgggctcgatcttgccaggagccatcgggggcagcaagccccgggtcactacccccaccgtggtgaaacacatccggacctacaagcagagagaccccggcatcttcgcctgggagatccgggaccgcctgctggcggacggcgtgtgcgacaagtacaatgtgccctccgtgagctccatcagccgcattctgcgcaacaagatcggcaacttggcccagcagggtcattacgactcatacaagcagcaccagccgacgccgcagccagcgctgccctacaaccacatctactcgtaccccagccctatcacggcggcggccgccaaggtgcccacgccacccggggtgcctgccatccccggttcggtggccatgccgcgcacctggccctcctcgcactccgtcaccgacatcctgggcatccgctccatcaccgaccaagtgagcgacagctccccctaccacagccccaaggtggaggagtggagcagcctgggccgcaacaacttccccgccgccgccccgcacgcggtgaacgggttggagaagggagccctggagcaggaagccaagtacggtcaggcaccaaatggtctcccagctgtgggcagttttgtgtcagcatccagcatggctccttaccctaccccagcccaagtgtcgccttacatgacctacagtgctgctccttctggttatgttgctggacatgggtggcaacatgctgggggcacctcattgtctccccacaactgtgacattccggcatcgctggcgttcaagggaatgcaggcagccagagaaggtagtcattctgtcacggcttccgcgctctgatgggaaattccgtctccagcagcttcacccgggtctccctgtctcagcacctcctcccccaattcccaggtctcacatcccacccctcctgccctccaacccttctgccttgaaagctggctgtacggactcacatcctttgtgctaatgacacttacatatttcttgccataacttttctcttgcagaaaaactgacatgactttaggatttaaaaacaagagcaacaataagcattgaatgagacatttgtgttgcccacatactgtcttaacataacaaagaaacctacacccctcaaagggtttaaggaactttacaaactagtctttggtaaaaccacatgtgtatatttattctaaatcaacctgaacttttgaaatgtgcaattgttgagattttgcaaaatcaataaaggaaaatacttatag

SEQ ID NO: 41791 - DNA, 2777 bp, Homo sapiens
cccaggtggggagctagcctgaaagagacagcggaaggagtttcctggactgcgctgtcgctcaccgacccgcaccaatcaccatgcagcttgccctcggacccgccccttttagggcgtgtccccagtgagtgatagacggagccgccctgccctgctcagcccagcccacgttgctgcttagattgaaatgcagaactcaagcctctttcatcggggcacagacttccttttacttcttccttttgccctctcgcctcctcctcctgggaagaagcggaggcgccggcggtcggccgggatagcaacaggccgggccactgaggcggtgcggaaagtttctgtctgggagtgcggaactggggccgggttggtgtactgctcggagcaatggagccagccttcggggaggtgaaccagctgggaggagtgttcgtgaacgggaggccgctgcccaacgccatccggcttcgcatcgtggaactggcccaactgggcatccgaccgtgtgacatcagccgccagctacgggtctcgcacggctgcgtcagcaagatcctggcgcgatacaacgagacgggctcgatcttgccaggagccatcgggggcagcaagccccgggtcactacccccaccgtggtgaaacacatccggacctacaagcagagagaccccggcatcttcgcctgggagatccgggaccgcctgctggcggacggcgtgtgcgacaagtacaatgtgccctccgtgagctccatcagccgcattctgcgcaacaagatcggcaacttggcccagcagggtcattacgactcatacaagcagcaccagccgacgccgcagccagcgctgccctacaaccacatctactcgtaccccagccctatcacggcggcggccgccaaggtgcccacgccacccggggtgcctgccatccccggttcggtggccatgccgcgcacctggccctcctcgcactccgtcaccgacatcctgggcatccgctccatcaccgaccaagtgagcgacagctccccctaccacagccccaaggtggaggagtggagcagcctgggccgcaacaacttccccgccgccgccccgcacgcggtgaacgggttggagaagggagccctggagcaggaagccaagtacggtcaggcaccaaatggtctcccagctgtgggcagttttgtgtcagcatccagcatggctccttaccctaccccagcccaagtgtcgccttacatgacctacagtgctgctccttctggttatgttgctggacatgggtggcaacatgctgggggcacctcattgtctccccacaactgtgacattccggcatcgctggcgttcaagggaatgcaggcagccagagaaggtagtcattctgtcacggcttccgcgctctgatgggaaattccgtctccagcagcttcacccgggtctccctgtctcagcacctcctcccccaattcccaggtctcacatcccacccctcctgccctccaacccttctgccttgaaagctggctgtacggactcacatcctttgtgctaatgacacttacatatttcttgccataacttttctcttgcagaaaaactgacatgactttaggatttaaaaacaagagcaacaataagcattgaatgagacatttgtgttgcccacatactgtcttaacataacaaagaaacctacacccctcaaagggtttaaggaactttacaaactagtctttggtaaaaccacatgtgtatatttattctaaatcaacctgaacttttgaaatgtgcaattgttgagattttgcaaaatcaataaaggaaaatacttatagaaaaaattatgctacaccctctaatcaaatatggtaaccaagtaagctttaattcatcattaggaaacaaatcaataagtgacttgtttgagtgatcctttgtttaagacatgacctattttgttgaaaaatatatgtagaacccaagcaatatctgaatctagctctccctggtgttttgacttggttccaaatacaataatgtttatattttctattagtttgtaaatacggactctggatggtgcatttgtgtcttcattccataagatattcccctcccctcagccccaccccctctctatttttttctttcttttttgcaaaggtgactttctggcaacgtctttgtctctgtttggtggtgggctgctcgggctcctggacctggacttgcccccaaattttgtgtatgcagtgaaggcttcaacatctcatgaaggacactttatttctacagcagaggacacgaaaaacagataaaacaagccagtctcccattttgtacctaatcaaacaacacacatgctaagcatataaagacaagagggtggaaaatatctgaacaagaaggctctaaaggaagtcacttagaaacttaagtttaatgtgaaatgttttgcaaagatgcttaaaatgaactttgtgttaagaaaaccactgtgaaactaaattgtcctattattgttggcttacctgtgtgttcagcaatctcagccccaaataatgttgtaatttaaagaaaatggaaaattctgctctaatgaatgtaacaatggcttgctgtgaagtttacattgttgtacagaagcatgtttcgcatgtaggtaaactggtggtggtactagaaatacaatgttatttaattttaacaaattccctttattcatttctgaaattacaggacacagtttaactcataaacctttc

SEQ ID NO: 41792 - DNA, 1614 bp, Homo sapiens
aaatggggccccatccagtatacttctagttacttgaatgctggcacagataaaacattgcgttttagttctgaaaaactatatgcccaaaggcatttttcttcttgctgatttttcttcttggactctaaagaacactccttttcaacttttctggaatgtagacaatcctgggaaaagtatatggatttattttccaccttttcttggcaccctccaactgagctttattcttttccctagcaaaggggtcctaaacccacatgcccagacaacccagacgacctgaacttttcagtgaatctatgctatcctcatatcccggaccatggctgcccctcctgccctccaacccttctgccttgaaagctggctgtacggactcacatcctttgtgctaatgacacttacatatttcttgccataacttttctcttgcagaaaaactgacatgactttaggatttaaaaacaagagcaacaataagcattgaatgagacatttgtgttgcccacatactgtcttaacataacaaagaaacctacacccctcaaagggtttaaggaactttacaaactagtctttggtaaaaccacatgtgtatatttattctaaatcaacctgaacttttgaaatgtgcaattgttgagattttgcaaaatcaataaaggaaaatacttatagaaaaaattatgctacaccctctaatcaaatatggtaaccaagtaagctttaattcatcattaggaaacaaatcaataagtgacttgtttgagtgatcctttgtttaagacatgacctattttgttgaaaaatatatgtagaacccaagcaatatctgaatctagctctccctggtgttttgacttggttccaaatacaataatgtttatattttctattagtttgtaaatacggactctggatggtgcatttgtgtcttcattccataagatattcccctcccctcagccccaccccctctctatttttttctttcttttttgcaaaggtgactttctggcaacgtctttgtctctgtttggtggtgggctgctcgggctcctggacctggacttgcccccaaattttgtgtatgcagtgaaggcttcaacatctcatgaaggacactttatttctacagcagaggacacgaaaaacagataaaacaagccagtctcccattttgtacctaatcaaacaacacacatgctaagcatataaagacaagagggtggaaaatatctgaacaagaaggctctaaaggaagtcacttagaaacttaagtttaatgtgaaatgttttgcaaagatgcttaaaatgaactttgtgttaagaaaaccactgtgaaactaaattgtcctattattgttggcttacctgtgtgttcagcaatctcagccccaaataatgttgtaatttaaagaaaatggaaaattctgctctaatgaatgtaacaatggcttgctgtgaagtttacattgttgtacagaagcatgtttcgcatgtaggtaaactggtggtggtactagaaatacaatgttatttaattttaacaaattccctttattcatttctgaaattacaggacacagtttaactcataaacctttc

SEQ ID NO: 41793 - DNA, 532 bp, Homo sapiens
cggccgccaaggtgcccacgccacccggggtgcctgccatccccggttcggtggccatgccgcgcacctggccctcctcgcactccgtcaccgacatcctgggcatccgctccatcaccgaccaaggtaggggctcagaggctgggcgtgtggatgtgcagcgtctgcccccgcactctcgcggaggtcccagtatctgcagcctcagggacactgtctttcccaccacctgaggctttttcctttggaaacgtaaggagtcttcctagggggtgttctgatctcattaacttgaaactcatgcccctggtttccttgccacacacagtcttctgcctcatctcaaactaccagacccataacatccccccatccccaacacatggttcgcattttccaccctcccccgcctctcgcgccgaggcagcctcagcccggcttgctcacttggagagtgcggccggggctggacttggggcgcagcccgggaggcccgagcctgcttggggctgccggctgcagactccgctgt

SEQ ID NO: 41794 - DNA, 342 bp, Homo sapiens
ggagagtccttataaacgttgataactgggatatctatctataagtcgatttctaaagaagacaaaccactaaaaaaaaaaggagctgttttgtttacctctttatccctattacctagctcattttttggcctatactaggtgtaacactgtgactgtaagtcagcctgtaacttgcactgtagaataccctaagaacaagaattttatgatacctgtataatttttacttactgaaccgaactatcttctcttcatgctagttatttgagttgtatttcttcataccttccaagaatttaaaaataaaagaactttaaatgagtatttgtttctatcata

SEQ ID NO: 41795 - DNA, 324 bp, Homo sapiens
cccagggataagagtgttgtgtgaaacgctccagcatcctggctgtaacattcggagattgtggttggggcgctgtggcctctcccatgagtgctgcttcgacatctccttggtcctcagcagcaaccagaagctggtggagctggacctgagtgacaacgccctcggtgacttcggaatcagacttctgtgtgtgggactgaagcacctgttgtgcaatctgaagaagctctggttggtcagctgctgcctcacatcagcatgttgtcaggatcttgcatcagtattgagcacctgccatttcctgaccagactctatgtggg

SEQ ID NO: 41796 - DNA, 3116 bp, Homo sapiens
gggggttcctgaggctggcatctggatgaggaaactgaagttgaggaatagtgaagagtttgtccaatgtcatagccccgtaatcaacgggacaaaaattttcttgctgatgggtcaagatggcatcgtgaagtggttgttcaccgtaaactgtaatacaatcctgtttatggatttgtttgcatatttttccctccatagggaaacctttcttccatggctcaggacacactcctggatcgagccaacaggagaactttctggtaagcatttggctaacttttttttttttgagatggagtcttgctgtgtcgcctaggctggagtgcagtggcgtgatcttggctcactgcagcctccacctcccgggttcaatcaattctcctacctcaacttcctgagtagctgggattacaggcgcccgccaccacacccggctcatttttgtacttttagtagagacacagttttgccatgttggccaggctggtcttgaattcctcagctcaggtgatctgcctgccttggcctctcaaagtgctgggattacaggcgtgagccactgtgcccggccttggctaacttttcaaaattaaagattttgacttgttacagtcatgtgacatttttttctttctgtttgctgagtttttgataatttatatctctcaaagtggagactttaaaaaagactcatccgtgtgccgtgttcactgcctggtatcttagtgtggaccgaagcctaaggaccctgaaaacagctgcagatgaagatggcaagcacccgctgcaagctggccaggtacctggaggacctggaggatgtggacttgaagaaatttaagatgcacttagaggactatcctccccagaagggctgcatccccctcccgaggggtcagacagagaaggcagaccatgtggatctagccacgctaatgatcgacttcaatggggaggagaaggcgtgggccatggccgtgtggatcttcgctgcgatcaacaggagagacctttatgagaaagcaaaaagagatgagccgaagtggggttcagataatgcacgtgtttcgaatcccactgtgatatgccaggaagacagcattgaagaggagtggatgggtttactggagtacctttcgagaatctctatttgtaaaatgaagaaagattaccgtaagaagtacagaaagtacgtgagaagcagattccagtgcattgaagacaggaatgcccgtctgggtgagagtgtgagcctcaacaaactctacacacgactgcgtctcatcaaggagcaccggagccagcaggagagggagcaggagcttctggccatcggcaagaccaagacgtgtgagagccccgtgagtcccattaagatggagttgctgtttgaccccgatgatgagcattctgagcctgtgcacactgtggtgttccagggggcggcagggattgggaaaacaatcctggcccggaagatgatgttggactgggcgtcggggacactctaccaagacaggtttgactatctgttctatatccactgtcgggaggtgagccttgtgacacagaggagcctgggggacctgatcatgagctgctgccccgacccaaacccacccatccacaagatcgtgagaaaaccctccagaatcctcttcctcatggacggcttcgatgagctgcaaggtgcctttgacgagcacataggaccgctctgcactgactggcataaggccgagcggggagacattctcctgagcagcctcatcagaaagaagctgcttcccgaggcctctctgctcatcaccacgagacctgtggccctggagaaactgcagcacttgctggaccatcctcggcatgtggagatcctgggtttctccgaggccaaaaggaaagagtacttcttcaagtacttctctgatgaggcccaagccagggcagccttcagtctgattcaggagaacgaggtcctcttcaccatgtgcttcatccccctggtctgctggatcgtgtgcactggactgaaacagcagatggagagtggcaagagccttgcccagacatccaagaccaccaccgcggtgtacgtcttcttcctttccagtttgctgcagccccggggagggagccaggagcacggcctctgcgcccacctctgggggctctgctctttggctgcagatggaatctggaaccagaaaatcctgtttgaggagtccgacctcaggaatcatggactgcagaaggcggatgtgtctgctttcctgaggatgaacctgttccaaaaggaagtggactgcgagaagttctacagcttcatccacatgactttccaggagttctttgccgccatgtactacctgctggaagaggaaaaggaaggaaggacgaacgttccagggagtcgtttgaagcttcccagccgagacgtgacagtccttctggaaaactatggcaaattcgaaaaggggtatttgatttttgttgtacgtttcctctttggcctggtaaaccaggagaggacctcctacttggagaagaaattaagttgcaagatctctcagcaaatcaggctggagctgctgaaatggattgaagtgaaagccaaagctaaaaagctgcagatccagcccagccagctggaattgttctactgtttgtacgagatgcaggaggaggacttcgtgcaaagggccatggactatttccccaagattgagatcaatctctccaccagaatggaccacatggtttcttccttttgcattgagaactgtcatcgggtggagtcactgtccctggggtttctccataacatgcccaaggaggaagaggaggaggaaaaggaaggccgacaccttgatatggtgcagtgtgtcctcccaagctcctctcatgctgcctgttctcatgggtaaggaaactcggcttccaggtgcttcctcctgcttcctcgccagcttcttcttggcacctgcctcctctcatctcttttcaactatcttccaaatactgttgccacagctacatcataatgccaccactgtctgtttgagactccttcatgagcaaagattgatgtatggtaggtggataaatgggatgag

SEQ ID NO: 41797 - DNA, 4187 bp, Homo sapiens
atgcactcccagcttcatctcacttcaatccactggttgatagaagtgcagtcaaagactgtcccctcctctgcaagcttttatgttctctctcctctctccctagccacgtcctgttctgttatcaacacacttactcacctcctggccttctccttctattgtctctcatccctcttccctcacaaaaacagaagcaaagagccagagccttcagtttggaggaactgaaaacattctcttctgctttctcattttgtagatgaggaaactgaagttgaggaatagtgaagagtttgtccaatgtcatagccccgtaatcaacgggacaaaaattttcttgctgatgggtcaagatggcatcgtgaagtggttgttcaccgtaaactgtaatacaatcctgtttatggatttgtttgcatatttttccctccatagggaaacctttcttccatggctcaggacacactcctggatcgagccaacaggagaactttctggtaagcatttggctaacttttttttttttgagatggagtcttgctgtgtcgcctaggctggagtgcagtggcgtgatcttggctcactgcagcctccacctcccgggttcaatcaattctcctacctcaacttcctgagtagctgggattacaggcgcccgccaccacacccggctcatttttgtacttttagtagagacacagttttgccatgttggccaggctggtcttgaattcctcagctcaggtgatctgcctgccttggcctctcaaagtgctgggattacaggcgtgagccactgtgcccggccttggctaacttttcaaaattaaagattttgacttgttacagtcatgtgacatttttttctttctgtttgctgagtttttgataatttatatctctcaaagtggagactttaaaaaagactcatccgtgtgccgtgttcactgcctggtatcttagtgtggaccgaagcctaaggaccctgaaaacagctgcagatgaagatggcaagcacccgctgcaagctggccaggtacctggaggacctggaggatgtggacttgaagaaatttaagatgcacttagaggactatcctccccagaagggctgcatccccctcccgaggggtcagacagagaaggcagaccatgtggatctagccacgctaatgatcgacttcaatggggaggagaaggcgtgggccatggccgtgtggatcttcgctgcgatcaacaggagagacctttatgagaaagcaaaaagagatgagccgaagtggggttcagataatgcacgtgtttcgaatcccactgtgatatgccaggaagacagcattgaagaggagtggatgggtttactggagtacctttcgagaatctctatttgtaaaatgaagaaagattaccgtaagaagtacagaaagtacgtgagaagcagattccagtgcattgaagacaggaatgcccgtctgggtgagagtgtgagcctcaacaaactctacacacgactgcgtctcatcaaggagcaccggagccagcaggagagggagcaggagcttctggccatcggcaagaccaagacgtgtgagagccccgtgagtcccattaagatggagttgctgtttgaccccgatgatgagcattctgagcctgtgcacactgtggtgttccagggggcggcagggattgggaaaacaatcctggcccggaagatgatgttggactgggcgtcggggacactctaccaagacaggtttgactatctgttctatatccactgtcgggaggtgagccttgtgacacagaggagcctgggggacctgatcatgagctgctgccccgacccaaacccacccatccacaagatcgtgagaaaaccctccagaatcctcttcctcatggacggcttcgatgagctgcaaggtgcctttgacgagcacataggaccgctctgcactgactggcataaggccgagcggggagacattctcctgagcagcctcatcagaaagaagctgcttcccgaggcctctctgctcatcaccacgagacctgtggccctggagaaactgcagcacttgctggaccatcctcggcatgtggagatcctgggtttctccgaggccaaaaggaaagagtacttcttcaagtacttctctgatgaggcccaagccagggcagccttcagtctgattcaggagaacgaggtcctcttcaccatgtgcttcatccccctggtctgctggatcgtgtgcactggactgaaacagcagatggagagtggcaagagccttgcccagacatccaagaccaccaccgcggtgtacgtcttcttcctttccagtttgctgcagccccggggagggagccaggagcacggcctctgcgcccacctctgggggctctgctctttggctgcagatggaatctggaaccagaaaatcctgtttgaggagtccgacctcaggaatcatggactgcagaaggcggatgtgtctgctttcctgaggatgaacctgttccaaaaggaagtggactgcgagaagttctacagcttcatccacatgactttccaggagttctttgccgccatgtactacctgctggaagaggaaaaggaaggaaggacgaacgttccagggagtcgtttgaagcttcccagccgagacgtgacagtccttctggaaaactatggcaaattcgaaaaggggtatttgatttttgttgtacgtttcctctttggcctggtaaaccaggagaggacctcctacttggagaagaaattaagttgcaagatctctcagcaaatcaggctggagctgctgaaatggattgaagtgaaagccaaagctaaaaagctgcagatccagcccagccagctggaattgttctactgtttgtacgagatgcaggaggaggacttcgtgcaaagggccatggactatttccccaagattgagatcaatctctccaccagaatggaccacatggtttcttccttttgcattgagaactgtcatcgggtggagtcactgtccctggggtttctccataacatgcccaaggaggaagaggaggaggaaaaggaaggccgacaccttgatatggtgcagtgtgtcctcccaagctcctctcatgctgcctgttctcatgggttggggcgctgtggcctctcccatgagtgctgcttcgacatctccttggtcctcagcagcaaccagaagctggtggagctggacctgagtgacaacgccctcggtgacttcggaatcagacttctgtgtgtgggactgaagcacctgttgtgcaatctgaagaagctctggttggtgaattctgccttacgtcagtctgttgttcagctttgtcctcggtactcagcactaatcagaatctcacgcacctttactgcgaggcaacactctcggagacaagggatcaaactactctgtgagggactcttgcaccccgactgcaagcttcaggtgttggaattagacaactgcaacctcacgtcacactgctgctgggatctttccacacttctgacctccagccagagcctgcgaaagctgagcctgggcaacaatgacctgggcgacctgggggtcatgatgttctgtgaagtgctgaaacagcagagctgcctcctgcagaacctggggttgtctgaaatgtatttcaattatgagacaaaaagtgcgttagaaacacttcaagaagaaaagcctgagctgaccgtcgtctttgagccttcttggtaggagtggaaacggggctgccagacgccagtgttctccggtccctccagctgggggccctcaggtggagagagctgcgatccatccaggccaagaccacagctctgtgatccttccggtggagtgtcggagaagagagcttgccgacgatgccttcctgtgcagagcttgggcatctcctttacgccagggtgaggaagacaccaggacaatgacagcatcgggtgttgttgtcatcacagcgcctcagttagaggatgttcctcttggtgacctcatgtaattagctcattcaataaagcactttctttatttttctcttctctgtctaactttctttttcctatctttttttcttctttgttctgtttacttttgctcatatcatcattcccggactgatgagcagtggggaactca

SEQ ID NO: 41798 - DNA, 3353 bp, Homo sapiens
atgcactcccagcttcatctcacttcaatccactggttgatagaagtgcagtcaaagactgtcccctcctctgcaagcttttatgttctctctcctctctccctagccacgtcctgttctgttatcaacacacttactcacctcctggccttctccttctattgtctctcatccctcttccctcacaaaaacagaagcaaagagccagagccttcagtttggaggaactgaaaacattctcttctgctttctcattttgtagatgaggaaactgaagttgaggaatagtgaagagtttgtccaatgtcatagccccgtaatcaacgggacaaaaattttcttgctgatgggtcaagatggcatcgtgaagtggttgttcaccgtaaactgtaatacaatcctgtttatggatttgtttgcatatttttccctccatagggaaacctttcttccatggctcaggacacactcctggatcgagccaacaggagaactttctggtaagcatttggctaacttttttttttttgagatggagtcttgctgtgtcgcctaggctggagtgcagtggcgtgatcttggctcactgcagcctccacctcccgggttcaatcaattctcctacctcaacttcctgagtagctgggattacaggcgcccgccaccacacccggctcatttttgtacttttagtagagacacagttttgccatgttggccaggctggtcttgaattcctcagctcaggtgatctgcctgccttggcctctcaaagtgctgggattacaggcgtgagccactgtgcccggccttggctaacttttcaaaattaaagattttgacttgttacagtcatgtgacatttttttctttctgtttgctgagtttttgataatttatatctctcaaagtggagactttaaaaaagactcatccgtgtgccgtgttcactgcctggtatcttagtgtggaccgaagcctaaggaccctgaaaacagctgcagatgaagatggcaagcacccgctgcaagctggccaggtacctggaggacctggaggatgtggacttgaagaaatttaagatgcacttagaggactatcctccccagaagggctgcatccccctcccgaggggtcagacagagaaggcagaccatgtggatctagccacgctaatgatcgacttcaatggggaggagaaggcgtgggccatggccgtgtggatcttcgctgcgatcaacaggagagacctttatgagaaagcaaaaagagatgagccgaagtggggttcagataatgcacgtgtttcgaatcccactgtgatatgccaggaagacagcattgaagaggagtggatgggtttactggagtacctttcgagaatctctatttgtaaaatgaagaaagattaccgtaagaagtacagaaagtacgtgagaagcagattccagtgcattgaagacaggaatgcccgtctgggtgagagtgtgagcctcaacaaactctacacacgactgcgtctcatcaaggagcaccggagccagcaggagagggagcaggagcttctggccatcggcaagaccaagacgtgtgagagccccgtgagtcccattaagatggagttgctgtttgaccccgatgatgagcattctgagcctgtgcacactgtggtgttccagggggcggcagggattgggaaaacaatcctggcccggaagatgatgttggactgggcgtcggggacactctaccaagacaggtttgactatctgttctatatccactgtcgggaggtgagccttgtgacacagaggagcctgggggacctgatcatgagctgctgccccgacccaaacccacccatccacaagatcgtgagaaaaccctccagaatcctcttcctcatggacggcttcgatgagctgcaaggtgcctttgacgagcacataggaccgctctgcactgactggcataaggccgagcggggagacattctcctgagcagcctcatcagaaagaagctgcttcccgaggcctctctgctcatcaccacgagacctgtggccctggagaaactgcagcacttgctggaccatcctcggcatgtggagatcctgggtttctccgaggccaaaaggaaagagtacttcttcaagtacttctctgatgaggcccaagccagggcagccttcagtctgattcaggagaacgaggtcctcttcaccatgtgcttcatccccctggtctgctggatcgtgtgcactggactgaaacagcagatggagagtggcaagagccttgcccagacatccaagaccaccaccgcggtgtacgtcttcttcctttccagtttgctgcagccccggggagggagccaggagcacggcctctgcgcccacctctgggggctctgctctttggctgcagatggaatctggaaccagaaaatcctgtttgaggagtccgacctcaggaatcatggactgcagaaggcggatgtgtctgctttcctgaggatgaacctgttccaaaaggaagtggactgcgagaagttctacagcttcatccacatgactttccaggagttctttgccgccatgtactacctgctggaagaggaaaaggaaggaaggacgaacgttccagggagtcgtttgaagcttcccagccgagacgtgacagtccttctggaaaactatggcaaattcgaaaaggggtatttgatttttgttgtacgtttcctctttggcctggtaaaccaggagaggacctcctacttggagaagaaattaagttgcaagatctctcagcaaatcaggctggagctgctgaaatggattgaagtgaaagccaaagctaaaaagctgcagatccagcccagccagctggaattgttctactgtttgtacgagatgcaggaggaggacttcgtgcaaagggccatggactatttccccaagattgagatcaatctctccaccagaatggaccacatggtttcttccttttgcattgagaactgtcatcgggtggagtcactgtccctggggtttctccataacatgcccaaggaggaagaggaggaggaaaaggaaggccgacaccttgatatggtgcagtgtgtcctcccaagctcctctcatgctgcctgttctcatgggtaaggaaactcggcttccaggtgcttcctcctgcttcctcgccagcttcttcttggcacctgcctcctctcatctcttttcaactatcttccaaatactgttgccacagctacatcataatgccaccactgtctgtttgagactccttcatgagcaaagattgatgtatggtaggtggataaatgggatgag

SEQ ID NO: 41799 - DNA, 4369 bp, Homo sapiens
atgcactcccagcttcatctcacttcaatccactggttgatagaagtgcagtcaaagactgtcccctcctctgcaagcttttatgttctctctcctctctccctagccacgtcctgttctgttatcaacacacttactcacctcctggccttctccttctattgtctctcatccctcttccctcacaaaaacagaagcaaagagccagagccttcagtttggaggaactgaaaacattctcttctgctttctcattttgtagatgaggaaactgaagttgaggaatagtgaagagtttgtccaatgtcatagccccgtaatcaacgggacaaaaattttcttgctgatgggtcaagatggcatcgtgaagtggttgttcaccgtaaactgtaatacaatcctgtttatggatttgtttgcatatttttccctccatagggaaacctttcttccatggctcaggacacactcctggatcgagccaacaggagaactttctggtaagcatttggctaacttttttttttttgagatggagtcttgctgtgtcgcctaggctggagtgcagtggcgtgatcttggctcactgcagcctccacctcccgggttcaatcaattctcctacctcaacttcctgagtagctgggattacaggcgcccgccaccacacccggctcatttttgtacttttagtagagacacagttttgccatgttggccaggctggtcttgaattcctcagctcaggtgatctgcctgccttggcctctcaaagtgctgggattacaggcgtgagccactgtgcccggccttggctaacttttcaaaattaaagattttgacttgttacagtcatgtgacatttttttctttctgtttgctgagtttttgataatttatatctctcaaagtggagactttaaaaaagactcatccgtgtgccgtgttcactgcctggtatcttagtgtggaccgaagcctaaggaccctgaaaacagctgcagatgaagatggcaagcacccgctgcaagctggccaggtacctggaggacctggaggatgtggacttgaagaaatttaagatgcacttagaggactatcctccccagaagggctgcatccccctcccgaggggtcagacagagaaggcagaccatgtggatctagccacgctaatgatcgacttcaatggggaggagaaggcgtgggccatggccgtgtggatcttcgctgcgatcaacaggagagacctttatgagaaagcaaaaagagatgagccgaagtggggttcagataatgcacgtgtttcgaatcccactgtgatatgccaggaagacagcattgaagaggagtggatgggtttactggagtacctttcgagaatctctatttgtaaaatgaagaaagattaccgtaagaagtacagaaagtacgtgagaagcagattccagtgcattgaagacaggaatgcccgtctgggtgagagtgtgagcctcaacaaactctacacacgactgcgtctcatcaaggagcaccggagccagcaggagagggagcaggagcttctggccatcggcaagaccaagacgtgtgagagccccgtgagtcccattaagatggagttgctgtttgaccccgatgatgagcattctgagcctgtgcacactgtggtgttccagggggcggcagggattgggaaaacaatcctggcccggaagatgatgttggactgggcgtcggggacactctaccaagacaggtttgactatctgttctatatccactgtcgggaggtgagccttgtgacacagaggagcctgggggacctgatcatgagctgctgccccgacccaaacccacccatccacaagatcgtgagaaaaccctccagaatcctcttcctcatggacggcttcgatgagctgcaaggtgcctttgacgagcacataggaccgctctgcactgactggcataaggccgagcggggagacattctcctgagcagcctcatcagaaagaagctgcttcccgaggcctctctgctcatcaccacgagacctgtggccctggagaaactgcagcacttgctggaccatcctcggcatgtggagatcctgggtttctccgaggccaaaaggaaagagtacttcttcaagtacttctctgatgaggcccaagccagggcagccttcagtctgattcaggagaacgaggtcctcttcaccatgtgcttcatccccctggtctgctggatcgtgtgcactggactgaaacagcagatggagagtggcaagagccttgcccagacatccaagaccaccaccgcggtgtacgtcttcttcctttccagtttgctgcagccccggggagggagccaggagcacggcctctgcgcccacctctgggggctctgctctttggctgcagatggaatctggaaccagaaaatcctgtttgaggagtccgacctcaggaatcatggactgcagaaggcggatgtgtctgctttcctgaggatgaacctgttccaaaaggaagtggactgcgagaagttctacagcttcatccacatgactttccaggagttctttgccgccatgtactacctgctggaagaggaaaaggaaggaaggacgaacgttccagggagtcgtttgaagcttcccagccgagacgtgacagtccttctggaaaactatggcaaattcgaaaaggggtatttgatttttgttgtacgtttcctctttggcctggtaaaccaggagaggacctcctacttggagaagaaattaagttgcaagatctctcagcaaatcaggctggagctgctgaaatggattgaagtgaaagccaaagctaaaaagctgcagatccagcccagccagctggaattgttctactgtttgtacgagatgcaggaggaggacttcgtgcaaagggccatggactatttccccaagattgagatcaatctctccaccagaatggaccacatggtttcttccttttgcattgagaactgtcatcgggtggagtcactgtccctggggtttctccataacatgcccaaggaggaagaggaggaggaaaaggaaggccgacaccttgatatggtgcagtgtgtcctcccaagctcctctcatgctgcctgttctcatgggttggggcgctgtggcctctcccatgagtgctgcttcgacatctccttggtcctcagcagcaaccagaagctggtggagctggacctgagtgacaacgccctcggtgacttcggaatcagacttctgtgtgtgggactgaagcacctgttgtgcaatctgaagaagctctggttggtgaattctgccttacgtcagtctgttgttcagctttgtcctcggtactcagcactaatcagaatctcacgcacctttactgcgaggcaacactctcggagacaagggatcaaactactctgtgagggactcttgcaccccgactgcaagcttcaggtgttggaattagacaactgcaacctcacgtcacactgctgctgggatctttccacacttctgacctccagccagagcctgcgaaagctgagcctgggcaacaatgacctgggcgacctgggggtcatgatgttctgtgaagtgctgaaacagcagagctgcctcctgcagaacctggggttgtctgaaatgtatttcaattatgagacaaaaagtgcgttagaaacacttcaagaagaaaagcctgagctgaccgtcgtctttgagccttcttggtaggagtggaaacggggctgccagacgccagtgttctccggtccctccagctgggggccctcaggtggagagagctgcgatccatccaggccaagaccacagctctgtgatccttccggtggagtgtcggagaagagagcttgccgacgatgccttcctgtgcagagcttgggcatctcctttacgccagggtgaggaagacaccaggacaatgacagcatcgggtgttgttgtcatcacagcgcctcagttagaggatgttcctcttggtgacctcatgtaattagctcattcaataaagcactttctttatttttctcttctctgtctaactttctttttcctatctttttttcttctttgttctgtttacttttgctcatatcatcattcccgctatctttctattaactgaccataacacagaactagttgactatatattatgttgaaattttatggcagctatttatttatttaaattttttgtaatagttttgttttctaataagaaaaatccatgctttttgtagctggttgaaaattcaggaatatgtaaaactttttggtatttaattaaattgattccttttcttaatttt

SEQ ID NO: 41800 - DNA, 197 bp, Homo sapiens
tgggtagcatcctttaagaggctttcaaaggcttgaaaccatgagtttagcacagagtttttcagaaagcttggctaagaaatgccgtaataagaaaaggctgtcctcagttgaaactgtcacctttaaagtccataataatcaaaatatgtgaaccacctatccacagacacagttgcaaataaagaattgtcatt

SEQ ID NO: 41801 - DNA, 675 bp, Homo sapiens
tagaaaggggaggcatgaataatcggccaccccttgtttagcatgtcatcaagaaataaccataaaaatgggcaactagcagcccttggggctgctctattctaaaggtttgctctattcttttgttcctttgctcccctaataaacttgctttcaccttactctgtggacttgtcctgaattctttcttgtgcaagatccaagaaccccctcttggggcctggatctggacctctttcctgtaacataataaaccaccccaaacataataaaccataaaaggtggtggtgtttactggtgaaacctttcatcatgctcataattttgtgagtcagatgggggatgtgggagcggcttaccttcatttcaatggtctccactggagtggctcatctggtcagccatggctgcgatgaagaccggggttctatgtctgggcctcgcttctgaatgttgggtacgtcagaatggcttctcctccagcacggctgtgagaactggcatgtccaagttggcttcatcacgtgtatggctggcacttcgaataggatggcgggagcagctggggacagacactagacagctctctccagtcttttcatgtggctagcttgggcctccttacagtggggtggtcttggagtaataggacttattacttgctagtcacccag

SEQ ID NO: 41802 - DNA, 520 bp, Homo sapiens
ctcatctgtaaaacaggactgacactcaccttgcaggaatactggaggtctgtactgcgctgccaacatctattcgccctcatccgtgacaagagtacccacaatttcctctgggaagctgctcctctctgattagtgtctgttcagtggttggaggttgaccctaccccagctctgagacggcctggccagcctatcctaattagcatatccctttcaccctggccacagtgattgacttagggctgggctgtgcagaggtgagcctcagctttttgggtaggaacaccaggacttggattccagtgggtttaatgctaggagggcatcaagcttgtgataactgtggccatttttgttaccataagggtagccagtctgaggatggaagccaatctacaggaaacagagctaagagatactaatgcatccctaaatcacttgagtcctggatcaaaccgttcctgaagctcctactaagctacactgttatgtgaaccaatactcttccttttgttta

SEQ ID NO: 41803 - DNA, 475 bp, Homo sapiens
agtagagacggggtttcaccgtgttagccaggatggtctcgatctcctgacctcgtgatccgcccatctcggcctcccaaagtgctgggattacaggcgtgagccaccgcgcccggccaagttcacagaatttttaatgtgttgaaggtctttagaagataaggtttttaggggatgtgcagaagtggccattcgccatcaggacttgaaggcctcgttcctgctccatagtcactggatgccttgatatccagaccccgagacacgcctgcaggtcatttcacgctggatatggggtgaggttcaagcccatccttggggtaatctggggctggatgtgtaacatcccaggccgctgcagatttctttcaagagcctccagtaacacttagttctttggagaagaaactatccaaatttcagagccagaaggatatcaacaatccatagccatgggcacccatctcaactggaa

SEQ ID NO: 41804 - DNA, 2012 bp, Homo sapiens
tcaggaagccagcctctccctaccactgagttcatgtatcttgttctctaggtctagatgtacttctatagtattctagtcttgctgcatagtattgtaatggcctgttttcttcattttctgactaattgagagctacatctaatttattcttggatcctctagacacagtagtacatggttatctggcatataataagtataggagtatttgttgagttagctagtttgttgaaggaaaaaaggcatgcacctgagaaattaactcagaatagcattagctagaaggtctgcaatatgaatggtaataaaagggattcgtaaagagagaaatatagttgacccggagtaataaaggaagacttcttttccattaaggtagaatttttttgccatctccagttttgactttgaacatatctgccctcattttatctccttgcttattggttacttcatttcatggtgatttttcctagtctcaatctctagtcattttatagacaccttgccagttcattacttttagcttcttgctttctctatcccctctctgtctgcgtgtcctgcctgttctatcacttttttcttttcctctatactgtcttcaagttctttggttttacacaaaacttaccatcaaaaacatatttgagagttccacgaagagagtccagtttactcgtgttgcagtttagatccatggatttaaatagatcagaactttagactgaatctactacatatatcttatatcaattagtttctctaaggtaaaagtagatgtcttcaaacactgtgaggttgcagagctgaggttccctaaaaccttgtatgtatcaaaatgtatgttactcattttattcatgccttggtatgtaatttgtcaaaatatcttgctgcattttcttgttgtgggagttataaaatacaattttaataactacaattgggaaaactcatcaataatgaaagacttaaaagacaaacgtgatcgtcacagttttaaaatttggttttgttttggtatttgtaatattttgttttgtgtaggtaaatacatttgattagttgattcttttcaacttactatattgttttgtgctattgtttttatagtctttaatattattaagaaaagtaaatggggctgggcttgggtagactcacgcctataatcccaacactttgggaggctgagacgggcggatcatgaggtcgagagatcgagaccatcctggccaacatggtgaaaccccgtctctactaaaatacaaaaattagccaggcatggttgcgtgcgcctgtagtcccagctacttgggaggctgaggcagaagaatcacttgaacccgggaggcagaggttgcagtgagccgagattgcgccactgcactgcagcctggcctcacagcaagattccatctcaaaaaaaaaagaaaaagaaaagaaaagtaaatggtatcttaattgttgccaattatgagctctatagcaactgatcttcccctcttctgtcctcttttttctgttacttttatatgtagccaaatgattttgattgctgcttataaaacaaagagctacttgtgaccacttcttcctattatattagtttgatgaaaacaaaatttcaaagtcatacttaactgtctttatatgtattacaaaacaagttgtctgatgacttggctaaataaaccagggctaaagactggaaggcaaaaatgaatcatagtcattcagtacatttggtatatttttttaaaaaggtgctacctgtatgcaccttgttctcattattttgctttaagataaattgtttgattttgtttattgcatttataggaacttacaaatcatttttttttctgtctttttaggacacagctgtatacagaatacattgttcactgtaccttcgtctctaattattattatccttattttgcctttgaatggatacttttttgatgaggatcaactaatggtttaatcataagaattaagag

SEQ ID NO: 41805 - DNA, 539 bp, Homo sapiens
ttttctatttttagtagagacagtgttttgccatgttggcgagaactcctgacgtcaaatgatcagcccgcatcggcatttcagagtgctggtattacaggcgtgagctatcaggcctggccctcaaaaacattctttatcatgctaaatggaaacctcgtacccaacaagcagtttctccccatttcccctcccctagcctctggcagccacctgtctgctctgtctctgggtgtgcctattctggttgtcttctgtaaagggaatcgtgcagggactgtcccttggtgactggcttcttttgctcagtgtcatgtgttcctgggtcatccgtggtatagcatgtgtcagtgcttccttttcatggctgaatagtattccactgtatggatagaccacgttttgttgatccattttcgttgatggacatttgggtgatttccattttttggctactgtgaagagtgctgtcgtgaacatttatgtacacatttctgtttgaggacatgttttcagttttcttgggtgtgtacctagga

SEQ ID NO: 41806 - DNA, 317 bp, Homo sapiens
tgagccaccacacccagcctaatttttgtatttttagcagagacggggtttcaccatattggccaggctggtcttgaactcctgacctcaggtgatctgctggccttggcctcccaaggtgctgggattacaggcatgagccactgtacccggccctcagatcttattttctatggacaccctactttgcttcagccctgaggtcccagctgccccattcaacatttttaccttccttttctgcattgtcctaacctttaggaaatctgaaccccagtagttgactgtcttctgaactaggtgaacctaatatccca

SEQ ID NO: 41807 - DNA, 906 bp, Homo sapiens
cgcatctgaccctgaggtgtccctttttcctcggtgcaggaatttatgttcaagttcacgcggagggagccctggattggactacgcagagttggggacgaattccactgggtcaacggggacccgtttgatccggacacgttcaccatcgcaggtccaggggagtgtgtcttcgtggagcccaccaggctggtgtcgacggagtgtctgatgacccggccctgggtgtgcagcaagatggcctatacttgaggtgggtggggccagaggtggccccgcccctaggcctgtgggaggtgtctggtgtctgctcaagacctgcttccagcggagccgcctgccctctgcaaggcgaagcggtgggtgcgtggcctccgccccaggcccctctcccaggccctggcgctctgagtccctggttcctggcctcctttgtctgcaggcaggtcgtgtggctcagcagttaaatcccatatgctaggtagtgtaggcatctgcccacctacacacacacacatgcataggtacacgcacgcacagacgctgtcccttctgaagctcagtgtccatcctgagccaccccacagatctctctccggccccctagaagccctctcctcactgcagccctggtgctctggggaaggaggggcattgacaggtggtttgactgttcacccagcagccccgcttccccactggtttctctcctggctgccggcggaggtaggctgggaaagcttccccctcacctaggccgggccagccccgccccgggccccagaggtcccctgcatcccccttctttgccttgcctgggttctcagcagggcccctgctgtgtccgtggtgctgttgtattggtcactaacggaataaagagttaatatctcatgtccagagaag

SEQ ID NO: 41808 - DNA, 1237 bp, Homo sapiens
tgatgcccctgccaggcttcccacagtcccctttctcattcatttagtggccacccttttacctccaggcaccaggagaggacagccacatctgcagtgtccctgcaggacgccaaagctgaggcaggggagggagccacagaaagcagagtgggactcgggctgggggggcgggcagggccgagctggtctcttccctgcagcttccaagggctgcatcaagtgcgaagcgccctgcccggaggactggctgctctacggaaggaagtgctacttcttttccgaggaacccagagactggaacacaggcaggcagtactgccacacccacgaggcggtgctggctgtgattcagagccagaaggagctggaatttatgttcaagttcacgcggagggagccctggattggactacgcagagttggggacgaattccactgggtcaacggggacccgtttgatccggacacgttcaccatcgcaggtccaggggagtgtgtcttcgtggagcccaccaggctggtgtcgacggagtgtctgatgacccggccctgggtgtgcagcaagatggcctatacttgaggtgggtggggccagaggtggccccgcccctaggcctgtgggaggtgtctggtgtctgctcaagacctgcttccagcggagccgcctgccctctgcaaggcgaagcggtgggtgcgtggcctccgccccaggcccctctcccaggccctggcgctctgagtccctggttcctggcctcctttgtctgcaggcaggtcgtgtggctcagcagttaaatcccatatgctaggtagtgtaggcatctgcccacctacacacacacacatgcataggtacacgcacgcacagacgctgtcccttctgaagctcagtgtccatcctgagccaccccacagatctctctccggccccctagaagccctctcctcactgcagccctggtgctctggggaaggaggggcattgacaggtggtttgactgttcacccagcagccccgcttccccactggtttctctcctggctgccggcggaggtaggctgggaaagcttccccctcacctaggccgggccagccccgccccgggccccagaggtcccctgcatcccccttctttgccttgcctgggttctcagcagggcccctgctgtgtccgtggtgctgttgtattggtcactaacggaataaagagttaatatctcatgtccagagaag

SEQ ID NO: 41809 - DNA, 2091 bp, Homo sapiens
  misc_feature (1)..(2): n is a, c, g, or t
nnctctgggaattgaagtttctgtggaaggaagcgtgagccgtaaccaggccaacccagaaaggctttctttctgagatttcacttccctgtcaactcttcagctcgtttcagaggcaccaaataatgtcatctgaaatgttgccagcatttattgaaacttctaatgttgacaaaaagcaaggcataaatgaagatcaagaggagagccagaagccaagattaggtgaagggtgtgaaccaatatctaaacgacaaatgaaaaaactaataaaacagaaacaatgggaagagcaacgggaactccgcaaacaaaagcgaaaagaaaaacgcaagaggaaaaaattagagcgacaatgtcaaatggaaccaaactcagatggacatgacagaaaacgtgttcgaagagatgttgttcatagcacccttcgccttattattgactgtagttttgatcacttgatggtattaaaggacattaagaaacttcataagcagattcaacgatgttacgcagaaaaccgacgggcactgcatcctgtgcagttttacttgacaagccacggaggccagctgaaaaagaacatggatgaaaatgacaaaggatgggtcaactggaaggatatccatatcaaaccagagcactatagtgaactcataaagaaagaagacctgatttaccttacgtcagattcacctaatatactgaaggaattagatgaatcaaaggcctatgtgattggaggattagtagatcacaaccatcacaagggactcacatataaacaagcgtcagattatggaatcaatcatgcacagctcccacttggaaattttgtgaagatgaatagtcgaaaagttttggcagttaatcatgtgtttgaaattattctggaatacctggaaacaagagactggcaagaagcattttttactatcttgccccaacggaaaggagctgttcccacagacaaagcctgtgaaagtgcttctcatgacaatcagtctgtcaggatggaggaaggtggatcggacagtgattccagtgaggaggaatatagcagaaatgaactagattcaccacatgaagaaaagcaggataaggaaaatcacactgaatctacagtgaactctctgccacactaatgttacctggtttccttttagtttaaggaaaaattaggagaaagtgaggtgctatatagaatattgaaattggaagaacattttattttctcttatttctgttgtgatttttaaaaacttttttttggacctaaataataataaaaaaaaaaagccctttaaactttgtaaggaaatattttttgattttgcgtaagaagatttaaatgtgtatgtgattttttttgtttttgtttttaaagcctcagtagtttctagataattttactgtattagtatattttcattttctttcattttatattctttagaatgtgccttctgacctttcagttttttaattttatagtcacatcaacatctttatgatctattgcctatatatctgtgagggcacatattcataaatatactgtcaatctatcagcatttgtgtatggtaggttaccctctatttgcagcttttatgtttaaattagttacttgaaagaatgtagtaattttaggaagaagtatcagtttgatagacttaataattcatttcttttggactatggagcgcatatctgttccttctttatgatgcctttttatggttctgaagtaattactgaagagttgagaatctctttaatgcattttcttaattcttacaatggtgataagttacttcaattataaaattgaattttgcagactaaattattttataaggctgttgctattgaaagatcaattttgtctttacctgcatttaaaatggaacagctcttagcagctgtggtttttttttccatattttttttaaatttgttggctcttaagatgaataaagtttataggtgcatctgcctcctcttctctaagaatatgcatactaatgtttgtttctataaatcaaatacacatgtgataatatgcatgtaaatacataactatcctcatc

SEQ ID NO: 41810 - DNA, 1345 bp, Homo sapiens
  misc_feature (1)..(2): n is a, c, g, or t
nnctctgggaattgaagtttctgtggaaggaagcgtgagccgtaaccaggccaacccagaaaggctttctttctgagatttcacttccctgtcaactcttcagctcggtaagtgtcctggcactggttggcgctcccccgcactatggtattctctggacgcaaaggggcgcgtgccatgcagccccctactagcaacaagggcttccgggggagaggggagcagtggtgtggaagtggtttcctgcggcgctcttgctgaaggaaatgacgtcgatgacaggcgccccccgcggcctacccagctgctccctggttcgccagagacagcttaatcccgtctctgaaatgcgtttgctggctgggagcctagaagggatagtgggcgaggctccgccccgtggtggggcgctttccgtcggcgtgtgttttggggttgccatcggcccgtagtatgtgaaaagtgagtttgcaaagaatcagtgggaaatctgtactctaaagggccggaaagcgtgttatggccctgccacttcgtggctagagaccgtgggctttacctctttaaagctgccttacctcatttttcctgcaaagggctgacgtcgctgaactctctgaaatgtagagagcccgaggggaagttgctgcaggtgctgtgagctgaggacagttttataaagatcgaagtgttacttgatttcactgaaatactttaaatttgggaatttttctacagatatgaagaggatggcaacacattacttgtcactttctgaaagaatttcatctgccccttccattcccaaccctctgcccaaaaggcttgacaactgaagtgaacaaagggcttttcgctcctccacgtttagtccgcatgtcttttagaagggcattcctggccgggcgcggtgactcacgtctgtaatccccgcacttcgggagggcagggcgggtggatcacctgaggtcaggagttcgggaccagcctgaccaacatggtgaaaccccgtctctactgaaaatacaaaattagccgggcgtggtggcgcatgccagtaatcccagctactgggggggctgaggcaggagaactacttgaacccagaaggcggaggttgcaatcagccgagattgcgccattgcactccagcctgggcaacaagagcgaaactccgtctcaaacaaacaagaaaggccgggcgcagtggctcatgcctgtaatcccagcactttgggaagccgaggcgggtggatcacgaggtcaagagatggagaccatccaggccaacgtggtgaaaccccgtctctactaaaaataacaaaaattagctgggcgtggtagc

SEQ ID NO: 41811 - DNA, 462 bp, Homo sapiens
caattaaatgacatttatttgtctaaagttttatttatattattttatggtttaactttaatcatattgattatttgagttttttaacttttttgtgcttgtaaattatctattcatgtcaaaagttgtttttcagaggcaccaaataatgtcatctgaaatgttgccagcatttattgaaacttctaatgttgacaaaaagcaaggcataaatgaagatcaagaggagagccagaagccaagattaggtgaagggtgtgaaccaatatctaaacgacaaatgaaatgttgccagcatttattgaaacttctaatgttgacaaaaagcaaggcataaatgaagatcaagaggagagccagaagccaagattaggtgaagggtgtgaaccaatatctgaacgacaaatgaaaaaaataataccacagaaacaatgggaagagcgcggaggaatcagcgagcaa

SEQ ID NO: 41812 - DNA, 3891 bp, Homo sapiens
  misc_feature (1)..(2): n is a, c, g, or t
nnctctgggaattgaagtttctgtggaaggaagcgtgagccgtaaccaggccaacccagaaaggctttctttctgagatttcacttccctgtcaactcttcagctcggtaagtgtcctggcactggttggcgctcccccgcactatggtattctctggacgcaaaggggcgcgtgccatgcagccccctactagcaacaagggcttccgggggagaggggagcagtggtgtggaagtggtttcctgcggcgctcttgctgaaggaaatgacgtcgatgacaggcgccccccgcggcctacccagctgctccctggttcgccagagacagcttaatcccgtctctgaaatgcgtttgctggctgggagcctagaagggatagtgggcgaggctccgccccgtggtggggcgctttccgtcggcgtgtgttttggggttgccatcggcccgtagtatgtgaaaatttcagaggcaccaaataatgtcatctgaaatgttgccagcatttattgaaacttctaatgttgacaaaaagcaaggcataaatgaagatcaagaggagagccagaagccaagattaggtgaagggtgtgaaccaatatctaaacgacaaatgaaaaaactaataaaacagaaacaatgggaagagcaacgggaactccgcaaacaaaagcgaaaagaaaaacgcaagaggaaaaaattagagcgacaatgtcaaatggaaccaaactcagatggacatgacagaaaacgtgttcgaagagatgttgttcatagcacccttcgccttattattgactgtagttttgatcacttgatggtattaaaggacattaagaaacttcataagcagattcaacgatgttacgcagaaaaccgacgggcactgcatcctgtgcagttttacttgacaagccacggaggccagctgaaaaagaacatggatgaaaatgacaaaggatgggtcaactggaaggatatccatatcaaaccagagcactatagtgaactcataaagaaagaagacctgatttaccttacgtcagattcacctaatatactgaaggaattagatgaatcaaaggcctatgtgattggaggattagtagatcacaaccatcacaagggactcacatataaacaagcgtcagattatggaatcaatcatgcacagctcccacttggaaattttgtgaagatgaatagtcgaaaagttttggcagttaatcatgtgtttgaaattattctggaatacctggaaacaagagactggcaagaagcattttttactatcttgccccaacggaaaggagctgttcccacagacaaagcctgtgaaagtgcttctcatgacaatcagtctgtcaggatggaggaaggtggatcggacagtgattccagtgaggaggaatatagcagaaatgaactagattcaccacatgaagaaaagcaggataaggaaaatcacactgaatctacagtgaactctctgccacactaatgttacctggtttccttttagtttaaggaaaaattaggagaaagtgaggtgctatatagaatattgaaattggaagaacattttattttctcttatttctgttgtgatttttaaaaacttttttttggacctaaataataataaaaaaaaaaagccctttaaactttgtaaggaaatattttttgattttgcgtaagaagatttaaatgtgtatgtgattttttttgtttttgtttttaaagcctcagtagtttctagataattttactgtattagtatattttcattttctttcattttatattctttagaatgtgccttctgacctttcagttttttaattttatagtcacatcaacatctttatgatctattgcctatatatctgtgagggcacatattcataaatatactgtcaatctatcagcatttgtgtatggtaggttaccctctatttgcagcttttatgtttaaattagttacttgaaagaatgtagtaattttaggaagaagtatcagtttgatagacttaataattcatttcttttggactatggagcgcatatctgttccttctttatgatgcctttttatggttctgaagtaattactgaagagttgagaatctctttaatgcattttcttaattcttacaatggtgataagttacttcaattataaaattgaattttgcagactaaattattttataaggctgttgctattgaaagatcaattttgtctttacctgcatttaaaatggaacagctcttagcagctgtggtttttttttccatattttttttaaatttgttggctcttaagatgaataaagtttataggtgcatctgcctcctcttctctaagaatatgcatactaatgtttgtttctataaatcaaatacacatgtgataatatgcatgtaaatacataactatcctcatcatgtatggctctcagttcttaattgatgataacatgattgaattgccatatatctgtattacttgtgtgaatggttgtgttgaacacgctaagaacaatttgaattttattaagtacaaaaatccttaacgtttgtatgggaacattggcaagaaagaatagtgtgaaagggaactgttttagtttcctatcagtaattgtacatgcagttaaatgtttaaggtaaaatgattggtctctgtcacagctaaaagatttcagtagccttcattgagtttgggtaaaataagttgctgttcttttgtcttctttttaatatataaaagttatatttaaaaagtatataacatactatatatgttacatactaacatatatatacacaacagaaagtttattggatttagtactgatatttactgtctatttttgttactttgttcttagtaatctattatagttacctattttaaggtaaggtctgtaggcaagatatgtaagtaaagacaagccctacaattttaaaataacaaagcttatgtcttaagttgtattttttcaaaggttcatgtttttctgagtaaatgtggtttattagcatgaaatattatgccttttacttaaattattttatgtaaaatagggcactgtttaattatgaaagggggaaaatcattccaaataagagtttaatttttattaattataaaaaactctgtattagtttcctagatgtgctagaacaaattaccacaaactgggtggctttaaacaacagaaatttattctcttaacagttccagagactaaatgtccagactcaccaatgtcccagtgccatgcttcctccttaggccctaggaaagaatacttcctagcctcttcctggcttttggtggttgccagcaatccctgctgttccttagcctatagtggcttgactccaatctcagttttgttgtcaagtggtcttctaccctgtcttctatgtttgtatccgtgtccaaactctttttctagggagaccagcactggattagagttcaccatgatccaatatgacctcatcttgactacatccgcaaagaccctgtctccaaataaggtcacatttacagggtaccatgtgttaggatttgacatatcttttgggggacacaattctacccactacaggcccatatcttatctaggatgttggtggcaagaaggtgaagattactacctcttttgatataactagtttctgaggtatttaaaaatttggttttaaaaatattaagctttttgctcatttgcatgtatacttttctctcaacattgttttggtttatttaggttatttgttaaaacttcagtaaatactaaagttacttgtattagaacataataaaagtagagaattaaactacctaaataaatgcatcaaaaaatatatgtctgct

SEQ ID NO: 41813 - DNA, 4081 bp, Homo sapiens
  misc_feature (1)..(2): n is a, c, g, or t
nnctctgggaattgaagtttctgtggaaggaagcgtgagccgtaaccaggccaacccagaaaggctttctttctgagatttcacttccctgtcaactcttcagctcggtaagtgtcctggcactggttggcgctcccccgcactatggtattctctggacgcaaaggggcgcgtgccatgcagccccctactagcaacaagggcttccgggggagaggggagcagtggtgtggaagtggtttcctgcggcgctcttgctgaaggaaatgacgtcgatgacaggcgccccccgcggcctacccagctgctccctggttcgccagagacagcttaatcccgtctctgaaatgcgtttgctggctgggagcctagaagggatagtgggcgaggctccgccccgtggtggggcgctttccgtcggcgtgtgttttggggttgccatcggcccgtagtatgtgaaaagtgagtttgcaaagaatcagtgggaaatctgtactctaaagggccggaaagcgtgttatggccctgccacttcgtggctagagaccgtgggctttacctctttaaagctgccttacctcatttttcctgcaaagggctgacgtcgctgaactctctgaaatgtagagagcccgaggggaagttgctgcagtttcagaggcaccaaataatgtcatctgaaatgttgccagcatttattgaaacttctaatgttgacaaaaagcaaggcataaatgaagatcaagaggagagccagaagccaagattaggtgaagggtgtgaaccaatatctaaacgacaaatgaaaaaactaataaaacagaaacaatgggaagagcaacgggaactccgcaaacaaaagcgaaaagaaaaacgcaagaggaaaaaattagagcgacaatgtcaaatggaaccaaactcagatggacatgacagaaaacgtgttcgaagagatgttgttcatagcacccttcgccttattattgactgtagttttgatcacttgatggtattaaaggacattaagaaacttcataagcagattcaacgatgttacgcagaaaaccgacgggcactgcatcctgtgcagttttacttgacaagccacggaggccagctgaaaaagaacatggatgaaaatgacaaaggatgggtcaactggaaggatatccatatcaaaccagagcactatagtgaactcataaagaaagaagacctgatttaccttacgtcagattcacctaatatactgaaggaattagatgaatcaaaggcctatgtgattggaggattagtagatcacaaccatcacaagggactcacatataaacaagcgtcagattatggaatcaatcatgcacagctcccacttggaaattttgtgaagatgaatagtcgaaaagttttggcagttaatcatgtgtttgaaattattctggaatacctggaaacaagagactggcaagaagcattttttactatcttgccccaacggaaaggagctgttcccacagacaaagcctgtgaaagtgcttctcatgacaatcagtctgtcaggatggaggaaggtggatcggacagtgattccagtgaggaggaatatagcagaaatgaactagattcaccacatgaagaaaagcaggataaggaaaatcacactgaatctacagtgaactctctgccacactaatgttacctggtttccttttagtttaaggaaaaattaggagaaagtgaggtgctatatagaatattgaaattggaagaacattttattttctcttatttctgttgtgatttttaaaaacttttttttggacctaaataataataaaaaaaaaaagccctttaaactttgtaaggaaatattttttgattttgcgtaagaagatttaaatgtgtatgtgattttttttgtttttgtttttaaagcctcagtagtttctagataattttactgtattagtatattttcattttctttcattttatattctttagaatgtgccttctgacctttcagttttttaattttatagtcacatcaacatctttatgatctattgcctatatatctgtgagggcacatattcataaatatactgtcaatctatcagcatttgtgtatggtaggttaccctctatttgcagcttttatgtttaaattagttacttgaaagaatgtagtaattttaggaagaagtatcagtttgatagacttaataattcatttcttttggactatggagcgcatatctgttccttctttatgatgcctttttatggttctgaagtaattactgaagagttgagaatctctttaatgcattttcttaattcttacaatggtgataagttacttcaattataaaattgaattttgcagactaaattattttataaggctgttgctattgaaagatcaattttgtctttacctgcatttaaaatggaacagctcttagcagctgtggtttttttttccatattttttttaaatttgttggctcttaagatgaataaagtttataggtgcatctgcctcctcttctctaagaatatgcatactaatgtttgtttctataaatcaaatacacatgtgataatatgcatgtaaatacataactatcctcatcatgtatggctctcagttcttaattgatgataacatgattgaattgccatatatctgtattacttgtgtgaatggttgtgttgaacacgctaagaacaatttgaattttattaagtacaaaaatccttaacgtttgtatgggaacattggcaagaaagaatagtgtgaaagggaactgttttagtttcctatcagtaattgtacatgcagttaaatgtttaaggtaaaatgattggtctctgtcacagctaaaagatttcagtagccttcattgagtttgggtaaaataagttgctgttcttttgtcttctttttaatatataaaagttatatttaaaaagtatataacatactatatatgttacatactaacatatatatacacaacagaaagtttattggatttagtactgatatttactgtctatttttgttactttgttcttagtaatctattatagttacctattttaaggtaaggtctgtaggcaagatatgtaagtaaagacaagccctacaattttaaaataacaaagcttatgtcttaagttgtattttttcaaaggttcatgtttttctgagtaaatgtggtttattagcatgaaatattatgccttttacttaaattattttatgtaaaatagggcactgtttaattatgaaagggggaaaatcattccaaataagagtttaatttttattaattataaaaaactctgtattagtttcctagatgtgctagaacaaattaccacaaactgggtggctttaaacaacagaaatttattctcttaacagttccagagactaaatgtccagactcaccaatgtcccagtgccatgcttcctccttaggccctaggaaagaatacttcctagcctcttcctggcttttggtggttgccagcaatccctgctgttccttagcctatagtggcttgactccaatctcagttttgttgtcaagtggtcttctaccctgtcttctatgtttgtatccgtgtccaaactctttttctagggagaccagcactggattagagttcaccatgatccaatatgacctcatcttgactacatccgcaaagaccctgtctccaaataaggtcacatttacagggtaccatgtgttaggatttgacatatcttttgggggacacaattctacccactacaggcccatatcttatctaggatgttggtggcaagaaggtgaagattactacctcttttgatataactagtttctgaggtatttaaaaatttggttttaaaaatattaagctttttgctcatttgcatgtatacttttctctcaacattgttttggtttatttaggttatttgttaaaacttcagtaaatactaaagttacttgtattagaacataataaaagtagagaattaaactacctaaataaatgcatcaaaaaatatatgtctgct

SEQ ID NO: 41814 - DNA, 3177 bp, Homo sapiens
aagaaaaattgtatgtatatagtcatcccttctgcttattccattcctttaagatcatagaatggccatagacaattttaataactttgctttaaaaattgaactctgtgataggacattaagaaacttcataagcagattcaacgatgttacgcagaaaaccgacgggcactgcatcctgtgcagttttacttgacaagccacggaggccagctgaaaaagaacatggatgaaaatgacaaaggatgggtcaactggaaggatatccatatcaaaccagagcactatagtgaactcataaagaaagaagacctgatttaccttacgtcagattcacctaatatactgaaggaattagatgaatcaaaggcctatgtgattggaggattagtagatcacaaccatcacaagggactcacatataaacaagcgtcagattatggaatcaatcatgcacagctcccacttggaaattttgtgaagatgaatagtcgaaaagttttggcagttaatcatgtgtttgaaattattctggaatacctggaaacaagagactggcaagaagcattttttactatcttgccccaacggaaaggagctgttcccacagacaaagcctgtgaaagtgcttctcatgacaatcagtctgtcaggatggaggaaggtggatcggacagtgattccagtgaggaggaatatagcagaaatgaactagattcaccacatgaagaaaagcaggataaggaaaatcacactgaatctacagtgaactctctgccacactaatgttacctggtttccttttagtttaaggaaaaattaggagaaagtgaggtgctatatagaatattgaaattggaagaacattttattttctcttatttctgttgtgatttttaaaaacttttttttggacctaaataataataaaaaaaaaaagccctttaaactttgtaaggaaatattttttgattttgcgtaagaagatttaaatgtgtatgtgattttttttgtttttgtttttaaagcctcagtagtttctagataattttactgtattagtatattttcattttctttcattttatattctttagaatgtgccttctgacctttcagttttttaattttatagtcacatcaacatctttatgatctattgcctatatatctgtgagggcacatattcataaatatactgtcaatctatcagcatttgtgtatggtaggttaccctctatttgcagcttttatgtttaaattagttacttgaaagaatgtagtaattttaggaagaagtatcagtttgatagacttaataattcatttcttttggactatggagcgcatatctgttccttctttatgatgcctttttatggttctgaagtaattactgaagagttgagaatctctttaatgcattttcttaattcttacaatggtgataagttacttcaattataaaattgaattttgcagactaaattattttataaggctgttgctattgaaagatcaattttgtctttacctgcatttaaaatggaacagctcttagcagctgtggtttttttttccatattttttttaaatttgttggctcttaagatgaataaagtttataggtgcatctgcctcctcttctctaagaatatgcatactaatgtttgtttctataaatcaaatacacatgtgataatatgcatgtaaatacataactatcctcatcatgtatggctctcagttcttaattgatgataacatgattgaattgccatatatctgtattacttgtgtgaatggttgtgttgaacacgctaagaacaatttgaattttattaagtacaaaaatccttaacgtttgtatgggaacattggcaagaaagaatagtgtgaaagggaactgttttagtttcctatcagtaattgtacatgcagttaaatgtttaaggtaaaatgattggtctctgtcacagctaaaagatttcagtagccttcattgagtttgggtaaaataagttgctgttcttttgtcttctttttaatatataaaagttatatttaaaaagtatataacatactatatatgttacatactaacatatatatacacaacagaaagtttattggatttagtactgatatttactgtctatttttgttactttgttcttagtaatctattatagttacctattttaaggtaaggtctgtaggcaagatatgtaagtaaagacaagccctacaattttaaaataacaaagcttatgtcttaagttgtattttttcaaaggttcatgtttttctgagtaaatgtggtttattagcatgaaatattatgccttttacttaaattattttatgtaaaatagggcactgtttaattatgaaagggggaaaatcattccaaataagagtttaatttttattaattataaaaaactctgtattagtttcctagatgtgctagaacaaattaccacaaactgggtggctttaaacaacagaaatttattctcttaacagttccagagactaaatgtccagactcaccaatgtcccagtgccatgcttcctccttaggccctaggaaagaatacttcctagcctcttcctggcttttggtggttgccagcaatccctgctgttccttagcctatagtggcttgactccaatctcagttttgttgtcaagtggtcttctaccctgtcttctatgtttgtatccgtgtccaaactctttttctagggagaccagcactggattagagttcaccatgatccaatatgacctcatcttgactacatccgcaaagaccctgtctccaaataaggtcacatttacagggtaccatgtgttaggatttgacatatcttttgggggacacaattctacccactacaggcccatatcttatctaggatgttggtggcaagaaggtgaagattactacctcttttgatataactagtttctgaggtatttaaaaatttggttttaaaaatattaagctttttgctcatttgcatgtatacttttctctcaacattgttttggtttatttaggttatttgttaaaacttcagtaaatactaaagttacttgtattagaacataataaaagtagagaattaaactacctaaataaatgcatcaaaaaatatatgtctgct

SEQ ID NO: 41815 - DNA, 3536 bp, Homo sapiens
  misc_feature (1)..(2): n is a, c, g, or t
nnctctgggaattgaagtttctgtggaaggaagcgtgagccgtaaccaggccaacccagaaaggctttctttctgagatttcacttccctgtcaactcttcagctcgtttcagaggcaccaaataatgtcatctgaaatgttgccagcatttattgaaacttctaatgttgacaaaaagcaaggcataaatgaagatcaagaggagagccagaagccaagattaggtgaagggtgtgaaccaatatctaaacgacaaatgaaaaaactaataaaacagaaacaatgggaagagcaacgggaactccgcaaacaaaagcgaaaagaaaaacgcaagaggaaaaaattagagcgacaatgtcaaatggaaccaaactcagatggacatgacagaaaacgtgttcgaagagatgttgttcatagcacccttcgccttattattgactgtagttttgatcacttgatggtattaaaggacattaagaaacttcataagcagattcaacgatgttacgcagaaaaccgacgggcactgcatcctgtgcagttttacttgacaagccacggaggccagctgaaaaagaacatggatgaaaatgacaaaggatgggtcaactggaaggatatccatatcaaaccagagcactatagtgaactcataaagaaagaagacctgatttaccttacgtcagattcacctaatatactgaaggaattagatgaatcaaaggcctatgtgattggaggattagtagatcacaaccatcacaagggactcacatataaacaagcgtcagattatggaatcaatcatgcacagctcccacttggaaattttgtgaagatgaatagtcgaaaagttttggcagttaatcatgtgtttgaaattattctggaatacctggaaacaagagactggcaagaagcattttttactatcttgccccaacggaaaggagctgttcccacagacaaagcctgtgaaagtgcttctcatgacaatcagtctgtcaggatggaggaaggtggatcggacagtgattccagtgaggaggaatatagcagaaatgaactagattcaccacatgaagaaaagcaggataaggaaaatcacactgaatctacagtgaactctctgccacactaatgttacctggtttccttttagtttaaggaaaaattaggagaaagtgaggtgctatatagaatattgaaattggaagaacattttattttctcttatttctgttgtgatttttaaaaacttttttttggacctaaataataataaaaaaaaaaagccctttaaactttgtaaggaaatattttttgattttgcgtaagaagatttaaatgtgtatgtgattttttttgtttttgtttttaaagcctcagtagtttctagataattttactgtattagtatattttcattttctttcattttatattctttagaatgtgccttctgacctttcagttttttaattttatagtcacatcaacatctttatgatctattgcctatatatctgtgagggcacatattcataaatatactgtcaatctatcagcatttgtgtatggtaggttaccctctatttgcagcttttatgtttaaattagttacttgaaagaatgtagtaattttaggaagaagtatcagtttgatagacttaataattcatttcttttggactatggagcgcatatctgttccttctttatgatgcctttttatggttctgaagtaattactgaagagttgagaatctctttaatgcattttcttaattcttacaatggtgataagttacttcaattataaaattgaattttgcagactaaattattttataaggctgttgctattgaaagatcaattttgtctttacctgcatttaaaatggaacagctcttagcagctgtggtttttttttccatattttttttaaatttgttggctcttaagatgaataaagtttataggtgcatctgcctcctcttctctaagaatatgcatactaatgtttgtttctataaatcaaatacacatgtgataatatgcatgtaaatacataactatcctcatcatgtatggctctcagttcttaattgatgataacatgattgaattgccatatatctgtattacttgtgtgaatggttgtgttgaacacgctaagaacaatttgaattttattaagtacaaaaatccttaacgtttgtatgggaacattggcaagaaagaatagtgtgaaagggaactgttttagtttcctatcagtaattgtacatgcagttaaatgtttaaggtaaaatgattggtctctgtcacagctaaaagatttcagtagccttcattgagtttgggtaaaataagttgctgttcttttgtcttctttttaatatataaaagttatatttaaaaagtatataacatactatatatgttacatactaacatatatatacacaacagaaagtttattggatttagtactgatatttactgtctatttttgttactttgttcttagtaatctattatagttacctattttaaggtaaggtctgtaggcaagatatgtaagtaaagacaagccctacaattttaaaataacaaagcttatgtcttaagttgtattttttcaaaggttcatgtttttctgagtaaatgtggtttattagcatgaaatattatgccttttacttaaattattttatgtaaaatagggcactgtttaattatgaaagggggaaaatcattccaaataagagtttaatttttattaattataaaaaactctgtattagtttcctagatgtgctagaacaaattaccacaaactgggtggctttaaacaacagaaatttattctcttaacagttccagagactaaatgtccagactcaccaatgtcccagtgccatgcttcctccttaggccctaggaaagaatacttcctagcctcttcctggcttttggtggttgccagcaatccctgctgttccttagcctatagtggcttgactccaatctcagttttgttgtcaagtggtcttctaccctgtcttctatgtttgtatccgtgtccaaactctttttctagggagaccagcactggattagagttcaccatgatccaatatgacctcatcttgactacatccgcaaagaccctgtctccaaataaggtcacatttacagggtaccatgtgttaggatttgacatatcttttgggggacacaattctacccactacaggcccatatcttatctaggatgttggtggcaagaaggtgaagattactacctcttttgatataactagtttctgaggtatttaaaaatttggttttaaaaatattaagctttttgctcatttgcatgtatacttttctctcaacattgttttggtttatttaggttatttgttaaaacttcagtaaatactaaagttacttgtattagaacataataaaagtagagaattaaactacctaaataaatgcatcaaaaaatatatgtctgct

SEQ ID NO: 41816 - DNA, 3557 bp, Homo sapiens
  misc_feature (69)..(69): n is a, c, g, or t
  misc_feature (73)..(73): n is a, c, g, or t
aaagaaaaaaaaaaacaaaaaacacgcaagaaaccaaaccgaaaaacccgaagaagaaaacagataacnaagncaacccaaaaaagcattctttcaaaaaatcacttccctgtcaacacttcaactcgtttcagaggcaccaaataatgtcatctgaaatgttgccagcatttattgaaacttctaatgttgacaaaaagcaaggcataaatgaagatcaagaggagagccagaagccaagattaggtgaagggtgtgaaccaatatctaaacgacaaatgaaaaaactaataaaacagaaacaatgggaagagcaacgggaactccgcaaacaaaagcgaaaagaaaaacgcaagaggaaaaaattagagcgacaatgtcaaatggaaccaaactcagatggacatgacagaaaacgtgttcgaagagatgttgttcatagcacccttcgccttattattgactgtagttttgatcacttgatggtattaaaggacattaagaaacttcataagcagattcaacgatgttacgcagaaaaccgacgggcactgcatcctgtgcagttttacttgacaagccacggaggccagctgaaaaagaacatggatgaaaatgacaaaggatgggtcaactggaaggatatccatatcaaaccagagcactatagtgaactcataaagaaagaagacctgatttaccttacgtcagattcacctaatatactgaaggaattagatgaatcaaaggcctatgtgattggaggattagtagatcacaaccatcacaagggactcacatataaacaagcgtcagattatggaatcaatcatgcacagctcccacttggaaattttgtgaagatgaatagtcgaaaagttttggcagttaatcatgtgtttgaaattattctggaatacctggaaacaagagactggcaagaagcattttttactatcttgccccaacggaaaggagctgttcccacagacaaagcctgtgaaagtgcttctcatgacaatcagtctgtcaggatggaggaaggtggatcggacagtgattccagtgaggaggaatatagcagaaatgaactagattcaccacatgaagaaaagcaggataaggaaaatcacactgaatctacagtgaactctctgccacactaatgttacctggtttccttttagtttaaggaaaaattaggagaaagtgaggtgctatatagaatattgaaattggaagaacattttattttctcttatttctgttgtgatttttaaaaacttttttttggacctaaataataataaaaaaaaaaagccctttaaactttgtaaggaaatattttttgattttgcgtaagaagatttaaatgtgtatgtgattttttttgtttttgtttttaaagcctcagtagtttctagataattttactgtattagtatattttcattttctttcattttatattctttagaatgtgccttctgacctttcagttttttaattttatagtcacatcaacatctttatgatctattgcctatatatctgtgagggcacatattcataaatatactgtcaatctatcagcatttgtgtatggtaggttaccctctatttgcagcttttatgtttaaattagttacttgaaagaatgtagtaattttaggaagaagtatcagtttgatagacttaataattcatttcttttggactatggagcgcatatctgttccttctttatgatgcctttttatggttctgaagtaattactgaagagttgagaatctctttaatgcattttcttaattcttacaatggtgataagttacttcaattataaaattgaattttgcagactaaattattttataaggctgttgctattgaaagatcaattttgtctttacctgcatttaaaatggaacagctcttagcagctgtggtttttttttccatattttttttaaatttgttggctcttaagatgaataaagtttataggtgcatctgcctcctcttctctaagaatatgcatactaatgtttgtttctataaatcaaatacacatgtgataatatgcatgtaaatacataactatcctcatcatgtatggctctcagttcttaattgatgataacatgattgaattgccatatatctgtattacttgtgtgaatggttgtgttgaacacgctaagaacaatttgaattttattaagtacaaaaatccttaacgtttgtatgggaacattggcaagaaagaatagtgtgaaagggaactgttttagtttcctatcagtaattgtacatgcagttaaatgtttaaggtaaaatgattggtctctgtcacagctaaaagatttcagtagccttcattgagtttgggtaaaataagttgctgttcttttgtcttctttttaatatataaaagttatatttaaaaagtatataacatactatatatgttacatactaacatatatatacacaacagaaagtttattggatttagtactgatatttactgtctatttttgttactttgttcttagtaatctattatagttacctattttaaggtaaggtctgtaggcaagatatgtaagtaaagacaagccctacaattttaaaataacaaagcttatgtcttaagttgtattttttcaaaggttcatgtttttctgagtaaatgtggtttattagcatgaaatattatgccttttacttaaattattttatgtaaaatagggcactgtttaattatgaaagggggaaaatcattccaaataagagtttaatttttattaattataaaaaactctgtattagtttcctagatgtgctagaacaaattaccacaaactgggtggctttaaacaacagaaatttattctcttaacagttccagagactaaatgtccagactcaccaatgtcccagtgccatgcttcctccttaggccctaggaaagaatacttcctagcctcttcctggcttttggtggttgccagcaatccctgctgttccttagcctatagtggcttgactccaatctcagttttgttgtcaagtggtcttctaccctgtcttctatgtttgtatccgtgtccaaactctttttctagggagaccagcactggattagagttcaccatgatccaatatgacctcatcttgactacatccgcaaagaccctgtctccaaataaggtcacatttacagggtaccatgtgttaggatttgacatatcttttgggggacacaattctacccactacaggcccatatcttatctaggatgttggtggcaagaaggtgaagattactacctcttttgatataactagtttctgaggtatttaaaaatttggttttaaaaatattaagctttttgctcatttgcatgtatacttttctctcaacattgttttggtttatttaggttatttgttaaaacttcagtaaatactaaagttacttgtattagaacataataaaagtagagaattaaactacctaaataaatgcatcaaaaaatatatgtctgct

SEQ ID NO: 41817 - DNA, 520 bp, Homo sapiens
  misc_feature (1)..(2): n is a, c, g, or t
nnctctgggaattgaagtttctgtggaaggaagcgtgagccgtaaccaggccaacccagaaaggctttctttctgagatttcacttccctgtcaactcttcagctcgtttcagaggcaccaaataatgtcatctgaaatgttgccagcatttattgaaacttctaatgttgacaaaaagcaaggcataaatgaagatcaagaggagagccagaagccaagattaggtgaagggtgtgaaccaatatctaaacgacaaatgaaaaaactaataaaacagaaacaatgggaagagcaacgggaactccgcaaacaaaagcgaaaagaaaaacgcaagaggaaaaaattagagcgacaatgtcaaatggaaccaaactcagatggacatgacagaaaacgtgttcgaagagatgttgttcatagcacccttcgccttattattgactgtagttttgatcacttgatggtattaaaggtatcatgaatcattgtcagaaaaatcttgtatgtgaattaggtcga

SEQ ID NO: 41818 - DNA, 265 bp, Homo sapiens
attgattaagttgaagagcggcgattacatctgtgctgagtgcaacagtagttcaggggctgacttttcaaatcccaacctcctgagttacagactctcttaaatagacttccttaatttccggatgcacttcttgaaattcccaattcttttcaaaattcctgggaaattacaaaggagatgagggtgggggtggggaattatggccgagatttcatcttgtcaggcaaactacctttttgtatgtctgattcctcagttttta

SEQ ID NO: 41819 - DNA, 1775 bp, Homo sapiens
ggaaaaaaagttaaggatacagttgaccgttcgataatgtagcccactgttgaccagaagccctacccacaacataaacaggcaataacacatattttgtatgtgtattatatagtatattcttaacaataaagtaaactagagaaaagaacatgtatcaagaaaatcataaggaagagaaaacacatttacagtactgtactgtatttattggtaccatacatttatgttgctgtttacaagatgaagcatctgtctgaaatggccagcagctacagctgtacctatctactgtacatatcaagcaagtcactttattcttataatgtctatgacttctttctttgaaagcgcttccatcatcactgttggcacttcatatgggtctcatggtgttaaggtttacggcattgcactagacacaatgaaaactacacaagagggccgggcacggtggctcacgcctgtaatcccagcactttgggaggccgaggcgggcggatcatgaggtcaggagattgagaccatcctggctaacacagtgaaaccctgtctctattaaaaataaaaaaattagccaggcatggtggcacgtgcctgtaatcccagctaatcgggaggctgaggcaggagaatcgctttttcccagaaggcgtaggttgcagtgagccgagatcgtgccactgcactccagcctggatgatagagggagactctgtcgcaaaaaaaaagaaaagaaaaagaaaagaaaagaaaaacacacaagagccgtgagagagatagcttttgattgcaatacacaatttactggagagatgagctgatcatacagagatgattagtgtcacacagtgttttaaacagattcttgcaaccctggagttcactgcagtagcaacagaagttagctatgagattttaacagtagtatagtatgtactacagttaatattaggtagctatgatttaatgctgcatctttgcatttgtttacatttatcttgactacaagtggtattatgtctggtcttaaggtttgtgtgcatatgttttgatgaattttaactttttataataggtttgtgtatattttatggcagtaaatgataaaacagactaatctacatatattttatgtagtcatgacataaacctaactttttcttaactttttgatatttctagtctatgtgtttcatctgcaggttttttcaaattgttgaaatctctgaaaaattttattgaaaaaaaatccatatatgtaagtggacccacacatttcaaacctgtgttcaagggtcagctgtgtaaataattttcctcaaaattaaagtggaaaaggagagttactactagtagaaagtagaactgtacccttgggcaggggtgtgtgtgtgtagttaaagatcaatttaacttaaaaggtcttggttagagaataaaactggcccttattagctttaatttacatgaaaaatgaaaaattttaggccaggcacagtggctcaggcctgtaatcccttaactttgggagaccaaggggagtggatcacttgaggtcaggagttcaagacagcctggccaacatgctgactcacccttccctactgaaaatacaaaagttagccaggcgcagtggccatccctacagtgctagctactcgggaggctgaggcaggagaattgcttgaacccgggaggcaaggttgcggtgagctgagatcgcaccactgcactccagactgggtgacagagcgagactccatctcaaaaaa

SEQ ID NO: 41820 - DNA, 1439 bp, Homo sapiens
  misc_feature (1222)..(1222): n is a, c, g, or t
ggaaaaaaagttaaggatacagttgaccgttcgataatgtagcccactgttgaccagaagccctacccacaacataaacaggcaataacacatattttgtatgtgtattatatagtatattcttaacaataaagtaaactagagaaaagaacatgtatcaagaaaatcataaggaagagaaaacacatttacagtactgtactgtatttattggtaccatacatttatgttgctgtttacaagatgaagcatctgtctgaaatggccagcagctacagctgtacctatctactgtacatatcaagcaagtcactttattcttataatgtctatgacttctttctttgaaagcgcttccatcatcactgttggcacttcatatgggtctcatggtgttaaggtttacggcattgcactagacacaatgaaaactacacaagagggccgggcacggtggctcacgcctgtaatcccagcactttgggaggccgaggcgggcggatcatgaggtcaggagattgagaccatcctggctaacacagtgaaaccctgtctctattaaaaataaaaaaattagccaggcatggtggcacgtgcctgtaatcccagctaatcgggaggctgaggcaggagaatcgctttttcccagaaggcgtaggttgcagtgagccgagatcgtgccactgcactccagcctggatgatagagggagactctgtcgcaaaaaaaaagaaaaagaaaaaagaaaattatatagaaataaaattccagctattccaaaactgcaccttgaatacaggtacagaattgctaaaaccgtgtaccattttgtagttttagcatgcttttgtgtaactgcatctggtgtttgatcctcatgagagccctgttaaggaagggtacatattattgtcctcattttccttcgaaaacacatcagagtttgtattttgactgtcagcattcaaatacaagtcttttatttataaaattttggtctttatactgtggctaaaaatcttaaatcacttgtcatgatttgaaatggtttataccgattttttttgacatttatacacacatacacatatttttaaattgtctataataaaatcatgctcatctttgaaaaaatattaggagtactacagtggatacctacatacttgctattcagcatacctggttttttgtttgttttttgagacagtcttctctgtgntccaggttggagtgcagtggcacgatctcagctcattgcaacctccgtctctactaaaaatacaaaaattagccgggcatggtggtgcgcgcctgtagtcccagctacacgggaggctgaggcaggagaatggcgtgaacccgggaggcagagcttgcagtgagccgagatcgcaccactgcactccagcctgggcgacagagcgaaactccgtctc

SEQ ID NO: 41821 - DNA, 1051 bp, Homo sapiens
ggaaaaaaagttaaggatacagttgaccgttcgataatgtagcccactgttgaccagaagccctacccacaacataaacaggcaataacacatattttgtatgtgtattatatagtatattcttaacaataaagtaaactagagaaaagaacatgtatcaagaaaatcataaggaagagaaaacacatttacagtactgtactgtatttattggtaccatacatttatgttgctgtttacaagatgaagcatctgtctgaaatggccagcagctacagctgtacctatctactgtacatatcaagcaagtcactttattcttataatgtctatgacttctttctttgaaaagtgctgggattacaggttgtgagccactgcacctggcctgtttttaaattcacataaatatgttttatatttttcattagggagaagaaggttgtgtctacaatttttaagacattggggagatttagatgccagtagtaacttaaaagagaaataattgcaaattctttttcctcttgagtatactttcatttaaggtacagtgttctgtaagttacttttaccgttaaacttcttaatgttgcttattgtttgtcttacatttttaggttggatttttcttaagtcacatgtctaataaaaaaaacccttaaatacctcatttattcgtcttcgttagtgaatgcattgttgtacatattagatttttctctttagataactcagcttcccctattaagtgccacatgtattacaaaattttatttatgttttattgtttaataaactcttgagaactagatacattttaatcatttgtaatacttacattttctaaaacacttcatttttccctggtttcttcaacaaagagatgcatgtagtacaaggatagctttacctgtgttagaagattgtttcacacatttacatcaactgcatagtcctgtttttgttgggccctaatgccagcatcactttttgctactgctgtttctgccttaaaggcaatatgcctctgtctagtttgctgattctg

SEQ ID NO: 41822 - DNA, 1626 bp, Homo sapiens
acttcggagagagaatgtagaatggaggaggtgaggaatttaactaatagagatgctttttctaacaggcagaaattagagaaatggatcaaaagatttaaacattgattacatataaacgagtttcctttttttctacatagcacacaggtgctcaacatttaatgaataatataacagatactgtcttaaaagtttaaaaacaggatttgtacttaatcctaaattcctcttatcacacaccagaaaataatttggattttatttacaaactacatccaaatactcttaaggaaagagtgtcatttagcttggagtagggactgactggggtctaagtgttggaaattaaattctgccattcagtccaacctcaaaggtgttccaggcaaggagttttgcaaggactagaaaccctttcacacttgaagtgcaggtgttggctgaaagaatagagggacatttcacaaacacagaacacggctcccctacaggaaagggatggagacagctacctttgctcttgctctcacattctctgtcctcatggactttcttctctgtttccctctgcctatctatctgcctggttctcttgcttctcctggccaaccagctttctcattagtgcatatgtagctgaaaaatccacccctcaagaacccactccacacaacctttccttttcagtacccaccacgctctgactagcatctctgtgatgcctaaggcaaatttttgaggatctgattggtttagttcatctgcctatgggtgagccaccctggggtcaggtgcctgtccaatcacctgttaccaaggaggcagggccgtgtcatttaagcatggccccatggactgaccctttcagcagggacttttattgggggctggtacccagaagaaggagcatgagtgggcaagaccttcaaaaagaacctactacacactggaactgactagtactcctgggatgccatgccacgcagcagccagcactcggagagcagtcccctggatactaccacacagagaaaaggggcatcttcacttgcacatcaggtgagggtgcacacacttgaaactctgctagactggccagagctgccccagccacttctcaccccaccaccagttattgatacagccgctgggtctaggaagcgatttctgaacaaggcccagttagcacaatgtcttgctcagcagacaataaatacttgtaaattgaattgcatgatcttagctcaggtgctactaatgtggctcacggccacacacttgcatggataagaaaaccaatgagcccctcaacagagtcttttgaaacaaaattggtttcaagtgaaacttacattattttttggctgtgaccttctgaatataataacttagtgtcctgagaattgaaaggcctcttgatttcttaggtgaactgttacagaatcctagcctgtggtaaatgctaaaatgtaaggtgtttctgagcaaggaatatttaggaaatataattgtgccacacacacattactttagaagatatgcagttgctctgattctgcaggtttaaaaaaaatgggaagtttgtgatatggcagaatctgtctccattggtcaaaccatact

SEQ ID NO: 41823 - DNA, 310 bp, Homo sapiens
tcaaggtggagcccactgaggtgaaggaaggagctgtgagggacacctgcatcctgctgcagaaatgtctgccccccgccttgtcccaccgcagctctatctcacagttggagaagcagaagcaaagcaacctgtcctggaccatgcagcctggtcctctgtttccagagccagaggtctttgtgctctgaaacaaagacagtgaccccattaacccactggcacttactgtgtgccaggcactcagcctgtgttgtctcattgcagcacagagcagccctgggaatggaagcagtgtcatcattcccat

SEQ ID NO: 41824 - DNA, 221 bp, Homo sapiens
taatggagaaagaatttaagagagctttgttttggtaaagatttggggaaatgttcagaaaatggttatagaacgacaccgtgcttaataaataacattttgaaatgggaaaaacaaatatgctgtaacataaagccaacttacctagatttgttattatatgggtcatatatatagcatatatatatagtttctaatttgagaaagaatttttaaaatca

SEQ ID NO: 41825 - DNA, 595 bp, Homo sapiens
tttgggcagtctgttcacaaatattttagaggaagacctgcggaagcaattatgcattgagcttttctacttgctgattgtacctattaaatattttatattcagtcaagagcttaatcatattttttgccagtccgatttgtggtttttgaattttttgtgttacttttatgcctttaacagttctgtgctttccaggtaggcactattttggtgctgccatgctgatgattattattataattattaactgctattaatcagtgagtgtacagtagagcctgtaccaagtgcctttgtaacttgtacaccatgtacataagcatcatctcattgactcatgtaattctctaatgcttgctgcgacactggctgcttgttccacagtgtggttattctccttcctttttcttctgtgtctgctccctggcgccttgcattgggcaggatgccacattgctgctgtggctgaactggcagttctcagaaatggtcctggggggtagcagggaacaactgcagtggctgtgatgctcactggcaggaagagcaggcagaggagtaaaccttcccctggtttctttgcaaaaaaaaa

SEQ ID NO: 41826 - DNA, 717 bp, Homo sapiens
aagtgcccccggacggttacagaggacacttaagtggtttgcaaagcctgtggtaggggaggagggtgtagaagggccaaaccacggaacttagttttattcatttatataaagcagcactccgattctttttgcgcggcctgaaatgcatgtgaccagagaagtaattaacaaaacaatgtcaacttctaaaaccgagacattacttagatgataaggcgcagcaactcggtgaatctgtacaaaccttggaaaaaaaacacattagtctatgggaccttccagttttctcatgctcctttccagctactaacctctcctaaagggaacaaccactttttggatttgattcccaggcctcgctttcaccgggaaattatcgttgcttgtaaaacagaagaagccgggaaggcaggcagggggagctgctactttacactctgtgctttgggatagcaaaatcccgcatttaagcaatccgaggaaacgagcaaatagacctccctcgcctctccgagcacactcaacagttccggttgcaaaatgtttgcctcctgggcttcccagcgtcccgttagttgttctatttacacataattagatacttaatggagagagaaactagaagttgaggcgttcctccaggctgtattgtaaagtatgaagtgaaatccaaaatgaaatggtaatgttagaaagcaacctcattaaaaaaaa

SEQ ID NO: 41827 - DNA, 422 bp, Homo sapiens
agttgtccccctcattggaagttctgggctcattgatttgtcccttgtggaattttatgctgtgccttggcatatgtttgccgaaataaaacccaactaaaagtggttcatactgcaagttgattttttttatcttgcataataagtctagaaataaggtggctctggggttgattaacattgtggctgacttacatcatcagggactcaagttttcaaaaatctgttctgccagagtaccttgggtatttcccttcatgggcagaaaatggcagcagtgtatgttccagatacagagggttgggattagctcttctgacttgtggaaactgtgaaatatttcctacaattaatcccagtcttgagtgagtttctcttgtgctcccatgtccaaaattaagggatcagctcttaaacttatc

SEQ ID NO: 41828 - DNA, 289 bp, Homo sapiens
ggctcaaattcagtcattatgtgtgaacttgatttataccagatttgtatatcttgctgccaatttttctatttctgctttttctgatgaaatatacccaatgttaaacaagttaatcaagtacaacaaatctagccaccaattacctgttcgtggcattgctatatgcacagtttcaccagtgtctggcgtggaatggaggatacctgtatattcatgtatgcctatataggcccttcctgtgtacaaacagtagagcaagttaactttaaatatgttaaaattatat

SEQ ID NO: 41829 - DNA, 168 bp, Homo sapiens
gaccctgtatcccaccggagactaagttagcacagtatttaacaagcaacagtttgtgaggacaaggctaaggggtggcctgtcacatctccgtcctcaggaggacgctgaatagagggaagataaaacagaatggatttcaactggacataaggaacttctgtagcc

SEQ ID NO: 41830 - DNA, 1966 bp, Homo sapiens
atgttcccccgcccgctgaccccgctggcggccccaaatggcgccgagcccctgggccgggcgctgaggcgggcccctctgggcagggcccgggcggggctgggtgggccgcccctgctgctgccgtccatgctgatgtttgcggtgatcgtggcctccagcgggctgctgctcatgatcgagcggggcatcctggccgagatgaagcccctgcccctgcacccgcccggccgcgagggcacagcctggcgcgggaaagcccccaagcctgggggcctgtccctcagggctggggacgcggacttgcaagtgcggcaggacgtccggaacaggaccctgcgggcggtgtgcggacagccaggcatgccccgggacccctgggacttgccggtggggcagcggcgcaccctgctgcgccacatcctcgtaagtgaccgttaccgcttcctctactgctacgtccccaaggtggcctgctctaactggaagcgggtgatgaaggtgctggcaggcgtcctggacagcgtggacgtccgcctcaagatggaccaccgcagtgacctggtgttcctggccgacctgcggcctgaggagattcgctaccgcctgcagcactactttaagttcctgtttgtgcgggagcccttggaacgcctcctctctgcctaccgcaacaagtttggcgagatccgagagtaccagcaacgctatggggctgagatagtgaggcggtacagggctggagcggggcccagccctgcaggcgacgatgtcacattccccgagttcctgagatacctggtggatgaggaccctgagcgcatgaatgagcattggatgcccgtgtaccacctgtgccagccttgtgccgtgcactatgactttgtgggctcctatgagaggctggaggctgatgcaaatcaggtgctggagtgggtacgggcaccacctcacgtccgatttccagctcgccaggcctggtaccggccagccagccccgaaagcctgcattaccacttgtgcagtgccccccgggccctgctgcaggatgtgctgcctaagtatatcctggacttctccctctttgcctacccactgcctaatgtcaccaaggaggcgtgtcagcagtgaccatgggtgtggggccagcagctggtggggactggtttcaacgccagctttctgtgcttctgcctgtcattcggagaaactctggctctggggcttggggcttctcaggatcctggatggcagagactgccctcagaagttccttgtccagggtgggcacccacagtgactcagaggacagggctaggcaggagacctgctgctcctcattggggggatctcttggggggcagacaccagtttgccaatgaagcaacacatctgatctaaagactggctccagaccccgggctgccaggattatgcagtccacttggtctaccttaatttaacctgtggccaaactcagagatggtaccagccaggggcaagcatgaccagagccagggaccctgtggctctgatcccccatttatccaccccatgtgcctcaggactagagtgagcaatcataccttataaatgacttttgtgcctttctgctccagtctcaaaatttcctacacctgccagttctttacatttttccaaggaaaggaaaacggaagcagggttcttgcctggtagctccaggacccagctctgcaggcacccaaagaccctctgtgcccagcctcttccttgagttctcggaacctcctccctaattctcccttccttccccacaaggcctttgaggttgtgactgtggctggtatatctggctgccatttttctgatgcatttatttaaaatttgtactttttgatagaacccttgtaagggctttgttttcctaatagctgactttttaataaagcagttttatatataaaaaaagcatttctgtgatttc

SEQ ID NO: 41831 - DNA, 1262 bp, Homo sapiens
ccacaagaatcatcttccttgtactataacccttgagtagatgacacctgcctttggcaagacttggaggagagacacatgctggtcatttgaccaatttccagtctcctacctgggaccctggggctattcccttactttttgtcataggcattaatagtcaaatagtgggatagagccaacaggtatgattataatatatatgttgtatttgaaaattaggctctgaaaaggagatattaatgtggtgtacttatgtatttcatactttaataatgaagtgaccttatctctccaaaatgtagccactgttaactgctatttatgtattattcactgagtatattactatctttgtattttctacaaagatttatcagcacaattgtgagaaatcttcaaaaccttttagggttccaattaagttggtaataatgatgcacttggcaattgtttataaagggatcattttagaaaaaggaggaaagtattttttccctcttcaaagtgtgacttgtagtcttcacctggattttttttttttctgtttaacccagtagggctttgttctcaatgcagaatctcctgtgacccttgacattttaagggattaattttacaagtcccattaataaaacttgttccttcttactctatactaaataccttcttttccttattatacagctcatacatacccatatctaaaattatttttgttcaaactccaattatcttataggatttaagatgctatttaattgggtaagtctggcccacaccaagataggtgataaaatggtgaaacctcagagttaaacaggctaccctgttgagggtgatctatttggaaaggaaaagaaggttatgataggctgtgaaaacttggaaggaagttaagtcagatgggatgtttgagggtgagggaaaagaaagaatatgtttggtaagagcaaaggagagcccattctataactttaggtgagagctgatatctatcagggtttgaatatagctcctacaaatcattctgcaataattcatctacacgtttgagcactccaactaaattttaattacctcaaaggtagggacttgatcttactcaatattgtatcccaagacttgctgggggcactggctcacaactgtaatcccagcactttaggaggccgaggtgggaggatcagttgagcccaggaattcaagaccagcctgggcaacatagtgagacccatctgtaccaaaaaaaaaaaaaaaac

SEQ ID NO: 41832 - DNA, 239 bp, Homo sapiens
taacaattaacattgctcccatgaaagaaaagctcaggatttgacagcttcactgccgaatttttccaaacatttaaagaactaaataccagttctactcagactattccaaaaaattgaagagaagggaatgcttccaaattcattctacaaggtcattagtatactgacaccaaaactagacaaatatacaacaaaaaagaaaaccacaggctaacatccctgataatcttagatgc

SEQ ID NO: 41833 - DNA, 418 bp, Homo sapiens
ttttctgctgtggcaaggacaaatgcatgcagcagattgacttagggtgtgactggctggccagcgccgtccgcatctcgaactcacctggacacatggacaccaggcgtccgctggcaactctctttattctgggtcctgtgctggtcattgcatttgcaggataaagctgccctctcagaagaggtcctcatgtttagaaagtgtattttagctgtgctggtcattgcatgtgcaggataaaacttctgccctctcagaagaggtccttgtgtttagaaagcgtatttcagctgcctctgggccctcacaccccgtcatgtattcacttccttccatgtgacctctgcccaatgtcaactgtttttggcatcttcacatatattttggattctgtgggttttatctgttttcctaa

SEQ ID NO: 41834 - DNA, 243 bp, Homo sapiens
ctgatgccatgcttgttaagaattcatgatttgccttatagattgactctaccagataattagaggtcattagatgattcttcccccttaaaacaacattcgtatgaataaaacaaaacacagcacagtgaaaataatagaacacaagaatgaaattgttttcaaataataacctcctgatcccacaggtaatagatcacaatcaaatcaaatctgattatatatttctgactccttggagga

SEQ ID NO: 41835 - DNA, 550 bp, Homo sapiens
cctctgtgtgaactagtcacctctgtgtccccaacccttgaacacagtatgttactcagccagtgctcttggtaaaaatgaatgtgaggttttaaaacagcagtgtgccagtatttgttttcttggagtaatcaaagtaatattctgactaatgtttagttgaattttggataaagctcaaaataagcattggattcccgtagctttgggtttctaaaccctggaagtaatgaatgtgacaaatgtgagacaggatattagagttaatagtgggtaatcattccattatttgtgatccactgcacatctgctacactgtacatgttagatgctacagtgacacagagctatggatcttgcctcaaaaaagcttatggatgagtagctaaggtcagcagataatggtgacaatgcagaatagaaaggggtcagaggccgagtatggtaactcatgcctgtaatcccagcacttcgggaggccaaggtgaaaagagtgcttgagcccaggagttcaagtccaacctggacaacatggtaagacgcatctctc

SEQ ID NO: 41836 - DNA, 329 bp, Homo sapiens
gccagcccggctgcagcatcccctcggcacacatccatctggtgctgcctccgtgccccctcctgtcacctgatgctcgtgctcctgaatcttcacacgcgtgctccgtgcagccacctcactggctccctgggaagggtgacaatgtctcacgcctgtcagaatgcacctctctgtgcactgaatattccaacacagaatcattcctctgtgatgatttatgctttgcgctgtagaattggaataaagaaaaagtgaatttagacattacagccatcaggctgaagctgggtaattgcattagggaattaaatgagagcatttgagct

SEQ ID NO: 41837 - DNA, 417 bp, Homo sapiens
aaaaaaccctggaagaaaatctaggcaatgccattcaggacacaggcacaggaaggatttcatgacgaaaatgccaaaagcaattgcaacaaaagcaaaaattgataaatgagatttaattaaactgaaaagcttatgcacagcaaaagaaactatcatcagagtgaacagacaaccctacagaatgggagaaaaattttgcagtctatccatccaacaaaggataatagtggagaagacccaagaactcccaggaagaagagagaaagaagtgtgatttaaaatggcctggaactattccgtagcagtactggaagctagaaagcaacggggctttccgagccagggggaaattgaatccctgaatagactagaaatgtgttgtgaaattgaggcaataatatcctaccaagtaaa

SEQ ID NO: 41838 - DNA, 750 bp, Homo sapiens
agcattccagctttccagatatgcagagataatacattggctatcagctacttggcttggcctattccgtgtttaaaatcttggactctttgctagtttttacagatcagaatttttcacgtattaatccagttttcctagcttctcttgaagaatttttggagatctcttcatactgagccttcattagcccaggacagtactgctgtagcagttcatatattttttcgcttcccaggcctgtgttattcacttaagttcatagcctggtccctgcagggttgtacccgagcacagctacttagatgtcctgaatgtattaccggttaaatggaggtttcaaagaacctgctgtttttggccctgtgctcttgataacagagtgtttgagggacaactttcacatttgagtttttccaaaattaaaggttgtagaagagtcacagtatctattgtcaaaaagaaaagaatttaaaaaggcagcaattgccaggatacttcatttgagcaatgatattttccagtggaaagtcacatcttaagggttaatgccccttaactgttggccgtatttgaaaacaaaccaagctaaaaacaagagacactgacatgttgtatgacggtgtggtgtggatgttgtgtttattttagtcctgagatctagttgtaacttccttgatttctgtatgtagccacggagcaccattacctgtcaccattacctgaatggctatactgcttgctttcatt

SEQ ID NO: 41839 - DNA, 489 bp, Homo sapiens
gtagcataacctcattcttcttggacatggaacaagaacttgagacccaccgaatgtgggcatgaaaaaggctatagcatcccctttggggcttcagggtcactggcatcccttttcaagtgccaccacattccccttgttgggatgccaacgcacagggcggaggcaggtcaaggcacccccagccttggccccagctgtgggctgagtgtggatcctgtggtgaacacggggtccagttagagtacaagcccaggtgtggcctggctcatcgaatggccagggtgcctcctgttgtgacccagggctgagtgaggctcaggtatgtgttttgccagctgtggatatatccagctggccaagcagcactgaaaaaatcctgcgtcactgccacttgcttgcagggtcataatggaaatcagagagtgcatcttttaagggagctcaggtaaagcatgtcctccagtgccagccaagtttcagtcagaa

SEQ ID NO: 41840 - DNA, 389 bp, Homo sapiens
tggtcatttcttaaaaatttaaacatacaccaatcataggacccagacggtgcacttctgggtatttacccaacagaaatgagagcaagtgtctctacaaatatttgtacacaaatgttcatagcagcttttttaggaatagccccaaactggaaacaacccaaatatggtataatcatacaacagaatgcttctcagcagtaaaaaggaacagactaaagacacactatgtaaatggatcacaaaatcatcatgctgagtgaaagaagcaagcaagaaagaaaagagtacatactgtatgagtccgctgacatgaaattattttaaaaacgcaaactattgtatacagacagaaagtaagcgagactctaactctacaaaaataaaaa

SEQ ID NO: 41841 - DNA, 291 bp, Homo sapiens
gatgactctgataggtagttacgacttgagaaccagtgtggtaagttatatgaagtaagatagcaaacactggaacaactagctgtatctagctgaatatacaaattttagtggattttaagttctgaaatacaatagcattatgtccatctgatgtgttaactcttgtgcctcctctcatgttcttccacgccagatcaaaacgttacattaaataaatgcagaaactaatacattattcaagtactaataaatttattcagaaatgcacacactgccgggcgtggtggc

SEQ ID NO: 41842 - DNA, 267 bp, Homo sapiens
ccttctgtctggaatgttcttccccagatacccaaatgtccaactgcctgtgcaacttcaggtcttcatgcatatgccaccttctcagaggggcctgcccctccatcactgtcccctctactcctgacacccctttccctgctccacttgcccacatatcatactatgtaaaattaatgcactgctttttttcttttctttctttttttttttttttgagacagcatctcactctgtcacccaggctggagtgcagtggtgcaatct

SEQ ID NO: 41843 - DNA, 902 bp, Homo sapiens
cctctctcccacccacttcagtctttcttttcctccttcacaccctcctcttctgtctctctgcaacccctcctggtgatctctgagtctctgagcacctccgccttcctctcccactgcctctttctccccctcatcctctgggactcacattccctaaatactaatggcagggatttgctgtgccccatggctcagttaagttctgctccccagctctgccatcatctgcctttgcctgaaggtaccaggatggctctctgcaaggattcccaccaggaatgccaaagccagagacttagggaccaaaggacccagaagggagatctgaaaaattcctgcttaggggcgggtcctggaggctctgatttttctgggtattgagggacccaaactcaaccagattccaaatgccagacgattgtgagtagatacagctggtgagagggtgctctggagacgcctgcagaaaagagaggaaactggcccagcctcctagagacacttctgagtacggctcggtcctgagcctgacggcagtccaggctgtagctgcctttgccaggacatgtgataaaggcccgcagatccttgatcaaggtgtcagccactttgtcggagctcctggaaagggcttctctttccttcatggacattctccaggttggtagtggttctggcgggggaattttctgtgcctctggtcactcatgtgtctatcccccctgagtttgtatgccagttcttttaaactagcgttgggatcatggacagtgctcttatcttccctaagcctcagtgtcctcatctataaaacgggcataataatatacctactgaataaaataatgtatgtgaagtgcttcacactgtgctcagcacattgttaaatgttcaataaa

SEQ ID NO: 41844 - DNA, 298 bp, Homo sapiens
taaagagtttttggggtctggaagcctcttgtgctttatttcactcaaatagctcttgcaggatatcagatttcagttcagtgccctctgcccttaaaaacaaaaacaaaatctggaggtcttctctctactcgcttactacaaggcctctcccagcccttggtcccagagtaacttgagccttctccaatagttggtctgccagtgagacatgatgatgtagtagtttagtcctggttctgccagtcttgtccttgggcgagtgatttcttcctcagcttagggtcaggaagaaagg

SEQ ID NO: 41845 - DNA, 536 bp, Homo sapiens
aatttacaaatacgtaatccgtgaataataagaaatgctaattggacgctatgtttgccaggtgcatagcaattttgatttgttgtatcttctattgaaaggactgttttgtcattacaaatcgttactcagttttttgttgttgttgttgttgttgttttttatacaagaatctcactctgtcacccaggctggagtgcagtggcgcgatctcagctcactgcaacctccgcctcccaggtccaaacgattctcctgcctcagcctcctgagtagctaggattacaggcactcaccaccacacccggctaatttttgtatttttaatagagatggggtttcaccacgttggtcaggctggtctcaaactcctgacctcgtgatccgcctgcctcggcctcccaaagtgctaggattacaggcatgagccaccgcacccggcccgttactcattttttatacctctttcttaccttaaagtctactgtatatgatagtaatgcagtcatatcaactatcttttggttttgattata

SEQ ID NO: 41846 - DNA, 366 bp, Homo sapiens
gatttatgaaaaggtgcctgcctaatcttggtacacttcctgattgtggtttcagcaatgtggagagttcaattatttctaagtgaccaaaaaagcagaaccacagactctattggccatcctaactcacaccttatctctactattctctacctttctccctcctagaatcattatttactctgtgtttttgcacccaagagcataaacggtgcttgggacagtgaaattgggtaaggctgtgtacattcaatttgctcctgatcctcttccactcctttttctccatctttcaaaacccagtttagcacctcacacccattaggatggcaaatacataaataaaataagtgttggtgaagatgt

SEQ ID NO: 41847 - DNA, 339 bp, Homo sapiens
tataaggagctcacagcctagatctcttgcatgctcagttcacaatagggttcacactcctatgagaatctaatgccactgctgatgtgacaggaggagctcaggcgataatgctgtcttgcctgctgctcacctcctgctgtgcggcccagttccaaacaggccatggactggtagttgttcgtgggctgggggttggggacccctgccataaaatactattcagccaggcatgatggctcatgcctataatcccagcgctttgggaggttgaggcaggaggattgcttgaagccaagagtgtgaaaccagcctaggcagtgtactaagaccccacct

SEQ ID NO: 41848 - DNA, 590 bp, Homo sapiens
cctccgcgcaacatttgtatttttttaaagccagagaggaagctttgccttgccacaggctgtgaacctcttgagagctaggcagagacgctggaacttctttgggtcctgtggattctagaacattgctctgagagtggggtcccaaatatttgccccattgagatttttcacattttaaaggttacacatttcttcactagcatgttgctgataacctagaagagttgatcattttattttgcatgtataccttgtgattgctttcaagaaaaattaaatatgggatggactaaagttacgtattaaagatcttaattcagcttttaacttgattttgtttagctttgtttagatttaatttattaaacatcagaaaaaagaagccaaaagccagattgtttatagtgaaagaagaatgaagacttgaaatagtacccagataatttagggtaaagttggtctttgtccgaaaatactctgctgagggcaaaaaaacttctttagagtcaatttgtttttcagtgtattaggtttttttaaatttttaaatgataactttgaaaataattgtacacaaaagaaaaaaa

SEQ ID NO: 41849 - DNA, 487 bp, Homo sapiens
ggatttcagaggaaaaagaggcccatggggaggggggagcagacagcagctcatccaggccaggagaatgaccactcactgcttggaaccagaaaaagaagggggaccagaaacaggaggtgagggagggaagggcctgctcctgtctctgggactccctgattcaactctggaaacagtccttaaggatttgctgcagagcaggagctacttaaaggctaattttaaaaatcggtgagccctttagtcacccctcagaagggtggaagggtggacagtgaccagggaaggtgccctactagaccatccacgtccctcatgatgtgtttatccattttgagtctggagcagattgcagctcggggacttaaagttagagcctgattcaaagtaatgtagggttggcaacccaagtgtccatcgacaggtgaatgataagcaaaatgcggtgtatccagacaatggaatattactcagcctttaaaag

SEQ ID NO: 41850 - DNA, 321 bp, Homo sapiens
tatctagcaggcgtggtggcaaacacctgtagtctcagctactagggagcctaaggcaggaggatcgtttgaggccaggcattctgggccgtagtgtgctatgccgatcaggtgttcacactaagttcggcatcaatatggtgacctcctgggagcggggcaccaccagatttgctaaggaagggtgaaccagcccaggtcggaaatggagcaggtcataagtaactcctgtgctgatcagtagtgggatcgtgcctgtgaatagctgctgcattccagcctgggcaacatagtgagacctcatctcttactaaaaaaaaa

SEQ ID NO: 41851 - DNA, 276 bp, Homo sapiens
aagtgataccaattctacacagtctctttcagaaaaaattaggagagaacactttccaacttatttttttaggtcagcattaccccggtgcaaaaccaaagtaagccaacacaagaaaaaaagtctacaaatccatattcctcatgaactctagacacaaaaatcctcagtaaaaagtaagtaaattgagcaatatataaaaaggataatacatcaagaccaagttggttttatcccaggaatgcaaggctgagtctacatttgaaaatttattag

SEQ ID NO: 41852 - DNA, 436 bp, Homo sapiens
aaaatgtaaataaatctaaatagatcttgactaaagttctagtccaactaaaccatcattaaaataataataattgagagtacacccctaaaggaccctactagtggatgcaattcaggaaaaacaaagttgaactcagaaggaaggagtgaaaccgggcgtggtggctcacgcctgtaatcccagcactttgggaggccaaggcaggcagatcacaaggtcaggagtttgagaccagactgacaaatatggtgaaaccccatctctactaaagtaaatacaaaaattagcagggcgtggtggtgcgcgtctgtagtcccagctactcgggaggctgaggcagaagaattgcttgaacccgggaggtggaggttgcagtgagccgagatcgtgccactgcactccagcttgggtgacagagtgagactctttctca

SEQ ID NO: 41853 - DNA, 403 bp, Homo sapiens
ctgactcagaagtctggtgtgttctgtcagcattcatgaaaccgtgaaagctaacgtgttagtttgcaaacataacaaaatatgattcatcacagttctccacgctcactagctgggcgtccctacacgagttttttaacctctcttagctgcagtttcccttctttatattataaaggggacggtggtgtgtatgtacccgccccatagcttcgtcttggggttaagtaagactgtaaaatccctaccacactggactcttcccaggacttccctttccctctttgaactctgccagagactattctgcatttgaggcctggcgatgctgggcaggggcgggtatgggtgaagcacagggtgggccgcggctggcgggtttggtgcagaaacgggctgtggc

SEQ ID NO: 41854 - DNA, 431 bp, Homo sapiens
atatgtattagattttttaacagacaaaataaaaccttatcaataaatcaccttttcattgttaattctttagtggtattagtgctgctctaataattcaaccttggatcagagaaaaagccaaataaaaagttataaaattaattagtttatttatttatgttcatgctcatggaaaatcagtataagatagagagaagagcttggactctggattgcaaatacatggttttgaaacccaggaacaccacttgggcaattaatggaatgatcattaccttaatttatcctttgtacaatgaggataataaggtcacctaactcacagggatgcttatagaatcaaatgacttaaagtgcttagaagagtgctttgcatgcagtaaattcccactacatgctggctgttgttattattattattatcccca

SEQ ID NO: 41855 - DNA, 655 bp, Homo sapiens
ctgctgcttgtcctgggacttcattttgagaatgactgctcgatttagaacttttgtcattcttatctcctctttcctcttaatctccctttctcatcctcctcctaatctgctgagagctaagaacacaaagatatcttttagtacctctttttttttttctttttttttaaatgagaaaaaggctttgagtcaaggacttgaattgtttcctgtgaataaggtacatgagctttatattatcctttggctgaggctagtatcacttcatttctggttaatgtctgtgttctgaataactagagttattgttgaattcatgaatataggagttgccgatgcttagtcatgaataaatctgggaaacggattccttccaccttggtaatgttagtgagacaaaatataaattagttactataacttttagtttttcaaaatacttaggaaatgagtagcataagtactgtggctgtttaaaatataaaaccctcaagcagagttccatggatggaaaaaaaaaacaaccctatggttctggaactagtaatcagatatcttttatttacatgttacactttaatatgtatgtttttaaattgttacaaaaaaatcaactaaattgttcacatgagaacatgtcctggcaaaaaaa

SEQ ID NO: 41856 - DNA, 953 bp, Homo sapiens
tgcctcggcctcccaaagtgctgggattacaggcatgagccaccgcgcctggcaaaattgtgtattcttaaaatgaaaaactatacagaaatgaaaatgaacaaactgctatatatgagtatggccaaatctcaaaaaacattgtagaatgaaaaaagctggaccaaaataatgtacactttatatgtccttccatgttccatttatgtaaaagttcagaaatagaaaaaaactaatctactgttagcattcaagatagtggttctctttgggaaggttggagggggcttcctgttactgttaatgtactatttctcgacctgtgagatgtttgtgatggatgatgtgtttattttgtgataattcctggagttgtacattttctatatgtgtgttatattttaaaaagtaaaagaacaaaacaaaacgaaaaaaacaggctaggtgcagtagctcatgcttgttattccaacactttgggatgccggcacggcagatcacttgagcccaggagttcaagaccaggagttcgagaccagcctgggcaacatggcaaaaccgcatctctacccaaaaaaaagaaaaagataaattagccagacgtggtggtgtgcgcctatagtcccaagctacttaggaggctgaggtgggaggatcacttgaggtgagccatgatcgtgccactacactccacactgatttgaggtttgctgaaaccagtggttacatatttctctctggaagggggtggacgagaatggctgttactacgagggctatgtgctgattgaagagtatacaatgagcgatctctataggtctgtttgctcgtaggcagatggagcttgttataattatgcctcatagggatagtacaaggaaggggtatggctatgtgctctgtcagggggcttgagaatggtgtgaggcgggggatccgtgtagagactgtc

SEQ ID NO: 41857 - DNA, 917 bp, Homo sapiens
tgcctcggcctcccaaagtgctgggattacaggcatgagccaccgcgcctggcaaaattgtgtattcttaaaatgaaaaactatacagaaatgaaaatgaacaaactgctatatatgagtatggccaaatctcaaaaaacattgtagaatgaaaaaagctggaccaaaataatgtacactttatatgtccttccatgttccatttatgtaaaagttcagaaatagaaaaaaactaatctactgttagcattcaagatagtggttctctttgggaaggttggagggggcttcctgttactgttaatgtactatttctcgacctgtgagatgtttgtgatggatgatgtgtttattttgtgataattcctggagttgtacattttctatatgtgtgttatattttaaaaagtaaaagaacaaaacaaaacgaaaaaaacaggctaggtgcagtagctcatgcttgttattccaacactttgggatgccggcacggcagatcacttgagcccaggagttcaagaccaggagttcgagaccagcctgggcaacatggcaaaaccgcatctctacccaaaaaaaagaaaaagataaattagccagacgtggtggtgtgcgcctatagtcccaagctacttaggaggctgaggtgggaggatcacttgaggtgagccatgatcgtgccactacactccacactgatttgaggtttgctgaaaccagtggttacatatttctctctggaaggaagtggggtaagagcacctgagatacggagaactgatttcatcatatttttcatttcatggtatacttttgtgactaacttgtatgaagccctgctttattttattctcctttatctctcgtcttcatccaattccctttccctcacagttgtccatttgaatatgtctaat

SEQ ID NO: 41858 - DNA, 294 bp, Homo sapiens
taccatgaaatgaaaaatatgatgaaatcagttctccgtatctcaggtgctcttaccccactacactccacactgatttgaggtttgctgaaaccagtggttacatatttctctctggaaggaagtggggtaagagcacctgagatacggagaactgatttcatcatatttttcatttcatggtatacttttgtgactaacttgtatgaagccctgctttattttattctcctttatctctcgtcttcatccaattccctttccctcacagttgtccatttgaatatgtctaat

SEQ ID NO: 41859 - DNA, 446 bp, Homo sapiens
ttaacttcttcatctttacgatctcattttggataaatgctgtaacagattttctgcgtatttgatttgttttatccacacagctctggtttttgtttttaacttgtggttaacagctagtctttgttgttgttgttgttgttgttgttgagattgcggcctgggcaactgagcgagactttgtctcaaaaaaaaggaaagaaaaatttttaaaaaagtttatcattcagttatcatgtctatattttctttcaatagatttttggagtttactatggatattgtaacaaaaacaggggtataggaagcgtacagcaccttcaaaaaatttttaatttaaattactttctcactacctagttcagtgatttggtttttaaccagtaaaaaataaggcagtttccaggcagggcataatagaaaagaaaaaaaatacaatttaaaaa

SEQ ID NO: 41860 - DNA, 983 bp, Homo sapiens
gagctgagattgtgccattgcactccagcttgggcaacaaaagcgaaacttcatctcaaaaaacaaaaaaagaagtccgggcgcggtggctcacgcctgtaatcccagcactttggtaggccaaggcgggtggatcatgaggtcaggagttcaagaccagcctggcctagatggtgaaaccctgtctctactaaaaatacaaatattagctgggcatggtggcatgcacctgtaatctcagctactcagaagtctgatgcaggagaattgctaaaacccgggagggagaggttgcagtgagctgagatcgtgccactgtactctagcctgggtgacagagcaagactccatctcgaaagagagaaagaaaaaagaaattcctcagggaagtacctcggcttatttcgtaaagaggtactgaaggaagcagaggcacgtggaggacttccccacctcgtgcagctatttgggccgtggcgtctgaaatttattatttcacagtcacccctttgatgacgttggcagtggactgcagtcatctgtttaggcctttccatggcccacatcagtgccagtatttctgtttgttgcacatttgatttccttgttgttggcatttagaaggccccctgttttccagatcgcatcatgggcatggaccacagagattgcgtcttgtgagtctgcagaaacagtcaaggccttgtactctcttaggcccagggctcaggttaatgcagattttcccagccgtctgtgctgaagtccctgcggggaggctcctggctggtttcccgtaggttgtcaactacacgtgctgcccttcattggcctcttttcgtgaagctcctgcctcccacaaacgatgtctccctttcttcttgaaccacatctctgttattgaaactctagaagtcggctgggtgtggtggatcatgtctgtaatcccagcactttgggaggccgaggcggggggatcacct

SEQ ID NO: 41861 - DNA, 532 bp, Homo sapiens
caaaaaaccaaggctccgactggacttgtcttctgatttctggctgttctaacttcaaactcatgaacaggagccatagttggacctctaatgcctcccaacgatcactctctaggtcctaatctgttacccttgacaatgacttcttttctctcaaacctctagcacctcctcctcgtcctcacttagctgttcctcccattttactgagcaaatagcaccccaaaaagagcttccagcagctcccaccaccgcatttacccatccctgcctccgtctacatccctgtaccctggatctactgtgctcctaactgtggcctccctcctagttgtcatgactttctccggggtgcttagcaccgtctaccacaccacatgttgtattatttgcttattgtctgtcttcccattagaatggaagctccatgagggcagaggttttattcatttgtttactgctatgttcctgcactgagaacaatgcctgggatgcaggaggtactcactaaatgtttcgtgggtaaacgact

SEQ ID NO: 41862 - DNA, 438 bp, Homo sapiens
agcgagcattaccacttgagctccgcctcctgtcagatcagcaggggcattagattctcataggagcgtgaacctgttgtaaactgcacatgtgagggatctaggttgcacacttcttatgagaatctaatgcctgatgatgtgaggcaaaacagtttcatcctgaaaccatcccccaactcaaccccaatttgtggaaaaatcgtgttccgcaaaactggtccctggtgccaaaaaggttggagactactgctctaggtatcccctactctagcacttaccattctgtattgtactagtttgttttcttggcttttgcctacatcagatcctgagtttcttgagggcatgaactgagtcatctttaattccctagttcggctctgtcatgggttagacagtgtttatagagaggataaatgacataggatagttgaa

SEQ ID NO: 41863 - DNA, 453 bp, Homo sapiens
ctttaacacataagtgttatcaattgtacgtatacaatcttctagtcactcccatttttgacagagtcaaagtcaaagtccatatgatggccccctagacccagagtgatctggccccccacccgctcacccaagcacacacgccctgtggtctctctccctcctgtccggtcactgcagcgacacaagcctccttgcagttgcttggacacaccaggcccatgcccacctcaggacctttgcatgtacctcttcctcagccaggaaagctccttccccagaaatccaaggggatcgcacgcttacctgccactggtcatcatccaaatatcacctatcataagagcttcccgactgccctacacatggatgtacaatccccacacagcattcttcatcccctcggagacttatttttctccaaaatttttatcaccacccagcacagataca

SEQ ID NO: 41864 - DNA, 237 bp, Homo sapiens
gaatatgagacagattgtgctcacagagccttgaagagtgtgacagtatttgagggccacgctgttgtcttagagtgaagtgaggagaacctgcactggtttggtagtcatgggaatggaaggaggaaagaaatgtgaaagctcatcggtggcagagtcaaaatggcttggtctttgtagtcaacgattaagtgagaaggaggaattactggctgacttagaagaagtaaaaaacgt

SEQ ID NO: 41865 - DNA, 761 bp, Homo sapiens
aaatatgatcatagctagtgggcttaccttggcagtacttagactgtgtatcctttgaagtgtccttatctagggatggtttccatgaaaaccatacaggttttctaaatgacacagtctgggtaactgcctagcttatgtaatcatgtgaggggttaataatctctagggtgtagttacactgatgacttttcaaggttcccagggcctgaccaaaattttggcttctcttaatacaaagtggcacctggaattttagctctgtgtacatgatattgggccccaaatgggtttctgtgggatgcaaccccagaaagggtactctgatagtactggagaaggtttactgcttgtcctgtcatcgtagttcatgtttttttccccaaggccaaagattgggctgggattggggtggtagtgtatttgaatgatgctggagataaccaaagccaacagtctttgccagagctgggctggtggtatttaactgtctttgagttaaatgtaaagtttttaataaatacccagaatccattaactgctggaggggtaaagtgaagctctgttgtaaaataaagctgattcccattatgcgtggtcctgtatacacaggctgtgggtgaccattatggaaccaaaaaatacttatttgttattttgtgctatagaataggaacttcaggggtggatacctatgctgtcaggaatgcttgttataagaattaattaaaacactttgcttaattattaaaaaaaaaaaa

SEQ ID NO: 41866 - DNA, 512 bp, Homo sapiens
atgttgaataagtgaagagaaaataggagaactgcattctaatcttatcttggccactgacaggaataaagttgacttttaggctatcaaacaaacattttcttttcttttcttgttttattttctttatctttttcttttttttgcgacggcatcttgctctgttgcccagctggagtacacttgcgcaatctcggctcattgcaacctctgcccccagggactcaagcgattctcccacctcagcttcccgagtagctgggactactggtgtgtgtcatcatgcctggctaatttttgtatttttagtagagatggggtttcactatgttgggccagggctggtctcggactttctgacctcagatgatccacctgcctcggtctcccaaactgctgggattacaggcgtgagctaccacgcccagcccacacgaacatgaaaaaaaaaagctaactcagttttctcacctgtaacatgaagaagtggccatttaaaaaataatagttga

SEQ ID NO: 41867 - DNA, 664 bp, Homo sapiens
taccagaccactaacacagctgcattacattgtctactcagtgttgctgactatatataatgtgtatagttcagtgacattgccaaaagatgtcctgaagaatctcaggtaactggcaataggttggtttttcagtctgtttacttccaggaatggattctttaacaaattatccatgtgagatagaactcattatgaatgataaagatatttctaaggtaaacctatggttaagaaataatatttaactccaaatacgaaaggatgcttgactaaggcataatttatgtacacagtagcttttgttcctcaagcaatgaagtatacgtgaattctgcacctagccgtaattagctttaaaaagccaattacggctgggtgcagtggctcacacctgtaatcccagcactttgagaagctgaagtgggaagattgcctgaacccaggaattcagtacctatctgtgcaacatagtgagaccctgtctctaaaacaattttttttaattaactgggcatggtagcacatgcctgtgattccagctacttggaaggctgaggtgggtggatcacttgagcccaggaggtcaaggctgcagtgagctgtgatcactccactgcactccagtctgggtgacagagtgagaccgtgtcaccgaaaaaaa

SEQ ID NO: 41868 - DNA, 426 bp, Homo sapiens
acccacacaggctggccaaaattgtataaccgcaccacctcattagaaatgctatttgtgttacacaacagccaccacccggttacaaacagttactgcatgcctctattatggtttccttaacatcaatctgtagcaggtttctccatggcaggctggatagtctattgtagaaaccaagcagctgctgagaatacgtctcaaacctgcactaagaaggaaaattaaaacctatctttgtaaacccttcagttcagatgaataagtccacccatgctgcttccagctcagtgaaaagggagattaattttactacctggtaagtttccatttccccaatcagggcccaaagacaattgttttcaaagctcaaaaaatttcagatctcaaggtaggagttcatcattaaaaggtaggcaaagccaa

SEQ ID NO: 41869 - DNA, 423 bp, Homo sapiens
gatatctcagtctctagtcaagcgtggtttatggtgccaaataagtgccaggtgaactcactacatctgacaaaatctcaaggaaccaagtttaccagataatatttatgattatgtgaaaaagactgaggaaatcactcaagtgatccatcatacagcacctccagttccaaagaatactgacttacttcagctgtactggtctggagctgcacattcttttcagacaactcttgttccagtgactcttctcctgtaacagagcctccttcttagaaactatggcctcccgtttctttaagtctgcttccagctcctctaattcttggcgttggttcagaactttctctacttcttcatctaaccatttcttttgctcatccaatttctacattaaaattaaaaaaaaagttacttgttttt

SEQ ID NO: 41870 - DNA, 437 bp, Homo sapiens
ccatccctaggagtgagattactgggtcacatagtatctctaagtttagccttttgaggaactacaagatggttatccaaagcgattgcaccattttccaatttcaccagcagtgtatgaaggtcccaatttctccacctcctcccacacatttcttattatgtttttctgattatagccatcctagtggggagtggggagtggtttacaaccagaatcaagtagtgtattaaacagaatacctgactagatctcaatttcttattttccaggtgactcttctcctgtaacagagcctccttcttagaaactatggcctcccgtttctttaagtctgcttccagctcctctaattcttggcgttggttcagaactttctctacttcttcatctaaccatttcttttgctcatccaatttctacattaaaattaaaaa

SEQ ID NO: 41871 - DNA, 1159 bp, Homo sapiens
ctcgccccactgcccgcctcgagagggttttttcccaggccccgcaccctcacgccgtgcgacctggactcccacggcgggacccgggctcacacctcttcctgctgcggggcggagtcgccgccgctccgggtctttgtccccgcctccgagacccccgcgcgcccccagcacttccggccgcgggagccaagggttcgtgccgggcagcgtctcccggggccaggtcgcctcctgccgggacccgggcgcgctgcagccgcggagccgggtgccccgccctcttcccgccggcggcggagtcgctgccgctccgggttcccgtccccgcctccgagacccccgcgcgcctcctccaggcgagctgcggggcgggaagggtccggccaccgtgggccgctgccagccgcggggctgccgagggccgcgggcacggggcgctggctccgggtctggcggccgctgatgggagtcggagcccgggcgggcgagcggcggcgcggcggccaccatggggaacaagcagaccatcttcaccgaagagcagctagacaactaccaggctgcattcgcgattctatgagctggcccccaacctcgtcccaatggactacaggaagagccccatcgtccacgtgcccatgagcctcatcatccagatgccagagctccgggagaatcccttcaaagaaaggatcgtggcggcgttttccgaggatggtgaggggaacctcactttcaacgactttgtggacatgttttccgtgctctgcgagtcggctccccgagagctcaaggcaaactatgccttcaagatctatgacttcaacactgacaacttcatctgcaaggaggacctggagctgacgctggcccggctcactaagtcagagctggatgaggaggaggtggtgcttgtgtgcgacaaggtcattgaggaggctgacttggacggtgacggcaagctgggctttgctgacttcgagggctcttgctcctgtctctgcctctgggtcatgagtaccaccctgcctgcctccccaacaccgtggaatcctcactggtgtgctgtccacagatttgtgaactcctggtagtaaaacacttttgcatccctttgctctccatgtatgctaatgttaggaaatgtttgagggta

SEQ ID NO: 41872 - DNA, 1744 bp, Homo sapiens
ctcgccccactgcccgcctcgagagggttttttcccaggccccgcaccctcacgccgtgcgacctggactcccacggcgggacccgggctcacacctcttcctgctgcggggcggagtcgccgccgctccgggtctttgtccccgcctccgagacccccgcgcgcccccagcacttccggccgcgggagccaagggttcgtgccgggcagcgtctcccggggccaggtcgcctcctgccgggacccgggcgcgctgcagccgcggagccgggtgccccgccctcttcccgccggcggcggagtcgctgccgctccgggttcccgtccccgcctccgagacccccgcgcgcctcctccaggcgagctgcggggcgggaagggtccggccaccgtgggccgctgccagccgcggggctgccgagggccgcgggcacggggcgctggctccgggtctggcggccgctgatgggagtcggagcccgggcgggcgagcggcggcgcggcggccaccatggggaacaagcagaccatcttcaccgaagagcagctagacaactaccaggctgcattcgcgattctatgagctggcccccaacctcgtcccaatggactacaggaagagccccatcgtccacgtgcccatgagcctcatcatccagatgccagagctccgggagaatcccttcaaagaaaggatcgtggcggcgttttccgaggatggtgaggggaacctcactttcaacgactttgtggacatgttttccgtgctctgcgagtcggctccccgagagctcaaggcaaactatgccttcaagatctatgacttcaacactgacaacttcatctgcaaggaggacctggagctgacgctggcccggctcactaagtcagagctggatgaggaggaggtggtgcttgtgtgcgacaaggtcattgaggaggctgacttggacggtgacggcaagctgggctttgctgacttcgaggacatgattgccaaggcccctgacttcctcagcactttccacatccggatctgaggacactgccgaggctgtaggggcctagaagtccaccatcctgccctgcagtcacatgggtgtggcctccaagctccccaggaaagcagtggcagcctctggggtttacaccacaaatatatcctgtggccctttcagcaaaaaaaaaaccttaaccaggaagggggcctgtgaaggttaggacccttcccacagccccgctgtggtccagccccgggacccatggcctctctccaggccctccgcaccccgccccatgccccagtcctttcctactccagaaatgctccccacccccccaagagggaaaagcagataacccaacaggaggtggtggggtctgacgtgtccaagtgctggcagacaccctggtcacccaggacagagcggaaaaaaaaaaaagaggtcagggttttaacgagctatgcaatctttttccaaaacccaaggttgggctgcttcccacccctgcctgttccccttctcccggcctccttcacaatgtgaagctgtgggtgcagtgggcccaagggctcttgctcctgtctctgcctctgggtcatgagtaccaccctgcctgcctccccaacaccgtggaatcctcactggtgtgctgtccacagatttgtgaactcctggtagtaaaacacttttgcatccctttgctctccatgtatgctaatgttaggaaatgtttgagggta

SEQ ID NO: 41873 - DNA, 1667 bp, Homo sapiens
ctcgccccactgcccgcctcgagagggttttttcccaggccccgcaccctcacgccgtgcgacctggactcccacggcgggacccgggctcacacctcttcctgctgcggggcggagtcgccgccgctccgggtctttgtccccgcctccgagacccccgcgcgcccccagcacttccggccgcgggagccaagggttcgtgccgggcagcgtctcccggggccaggtcgcctcctgccgggacccgggcgcgctgcagccgcggagccgggtgccccgccctcttcccgccggcggcggagtcgctgccgctccgggttcccgtccccgcctccgagacccccgcgcgcctcctccaggcgagctgcggggcgggaagggtccggccaccgtgggccgctgccagccgcggggctgccgagggccgcgggcacggggcgctggctccgggtctggcggccgctgatgggagtcggagcccgggcgggcgagcggcggcgcggcggccaccatggggaacaagcagaccatcttcaccgaagagcagctagacaactaccaggactgcaccttcttcaataagaaggacatcctcaagagaatcccttcaaagaaaggatcgtggcggcgttttccgaggatggtgaggggaacctcactttcaacgactttgtggacatgttttccgtgctctgcgagtcggctccccgagagctcaaggcaaactatgccttcaagatctatgacttcaacactgacaacttcatctgcaaggaggacctggagctgacgctggcccggctcactaagtcagagctggatgaggaggaggtggtgcttgtgtgcgacaaggtcattgaggaggctgacttggacggtgacggcaagctgggctttgctgacttcgaggacatgattgccaaggcccctgacttcctcagcactttccacatccggatctgaggacactgccgaggctgtaggggcctagaagtccaccatcctgccctgcagtcacatgggtgtggcctccaagctccccaggaaagcagtggcagcctctggggtttacaccacaaatatatcctgtggccctttcagcaaaaaaaaaaccttaaccaggaagggggcctgtgaaggttaggacccttcccacagccccgctgtggtccagccccgggacccatggcctctctccaggccctccgcaccccgccccatgccccagtcctttcctactccagaaatgctccccacccccccaagagggaaaagcagataacccaacaggaggtggtggggtctgacgtgtccaagtgctggcagacaccctggtcacccaggacagagcggaaaaaaaaaaaagaggtcagggttttaacgagctatgcaatctttttccaaaacccaaggttgggctgcttcccacccctgcctgttccccttctcccggcctccttcacaatgtgaagctgtgggtgcagtgggcccaagggctcttgctcctgtctctgcctctgggtcatgagtaccaccctgcctgcctccccaacaccgtggaatcctcactggtgtgctgtccacagatttgtgaactcctggtagtaaaacacttttgcatccctttgctctccatgtatgctaatgttaggaaatgtttgagggta

SEQ ID NO: 41874 - DNA, 1232 bp, Homo sapiens
ggacaactaccaggacagcaccttcttcaactgaagaaggacatcctcaagctgcattcgcgattctatgagctggcccccaacctcgtcccaatggactacaggaagagccccatcgtccacgtgcccatgagcctcatcatccagatgccagagctccgggagaatcccttcaaagaaaggatcgtggcggcgttttccgaggatggtgaggggaacctcactttcaacgactttgtggacatgttttccgtgctctgcgagtcggctccccgagagctcaaggcaaactatgccttcaagatctatgacttcaacactgacaacttcatctgcaaggaggacctggagctgacgctggcccggctcactaagtcagagctggatgaggaggaggtggtgcttgtgtgcgacaaggtcattgaggaggctgacttggacggtgacggcaagctgggctttgctgacttcgaggacatgattgccaaggcccctgacttcctcagcactttccacatccggatctgaggacactgccgaggctgtaggggcctagaagtccaccatcctgccctgcagtcacatgggtgtggcctccaagctccccaggaaagcagtggcagcctctggggtttacaccacaaatatatcctgtggccctttcagcaaaaaaaaaaccttaaccaggaagggggcctgtgaaggttaggacccttcccacagccccgctgtggtccagccccgggacccatggcctctctccaggccctccgcaccccgccccatgccccagtcctttcctactccagaaatgctccccacccccccaagagggaaaagcagataacccaacaggaggtggtggggtctgacgtgtccaagtgctggcagacaccctggtcacccaggacagagcggaaaaaaaaaaaagaggtcagggttttaacgagctatgcaatctttttccaaaacccaaggttgggctgcttcccacccctgcctgttccccttctcccggcctccttcacaatgtgaagctgtgggtgcagtgggcccaagggctcttgctcctgtctctgcctctgggtcatgagtaccaccctgcctgcctccccaacaccgtggaatcctcactggtgtgctgtccacagatttgtgaactcctggtagtaaaacacttttgcatccctttgctctccatgtatgctaatgttaggaaatgtttgagggta

SEQ ID NO: 41875 - DNA, 1794 bp, Homo sapiens
ctcgccccactgcccgcctcgagagggttttttcccaggccccgcaccctcacgccgtgcgacctggactcccacggcgggacccgggctcacacctcttcctgctgcggggcggagtcgccgccgctccgggtctttgtccccgcctccgagacccccgcgcgcccccagcacttccggccgcgggagccaagggttcgtgccgggcagcgtctcccggggccaggtcgcctcctgccgggacccgggcgcgctgcagccgcggagccgggtgccccgccctcttcccgccggcggcggagtcgctgccgctccgggttcccgtccccgcctccgagacccccgcgcgcctcctccaggcgagctgcggggcgggaagggtccggccaccgtgggccgctgccagccgcggggctgccgagggccgcgggcacggggcgctggctccgggtctggcggccgctgatgggagtcggagcccgggcgggcgagcggcggcgcggcggccaccatggggaacaagcagaccatcttcaccgaagagcagctagacaactaccaggactgcaccttcttcaataagaaggacatcctcaaatggggaaaccgaggctcagagggatttggtcactcctccagggtcacacaggctgtccacagtctggctccggggccctcctgcttatcctgcacccacagtgattgctgtgtgtgttttcttcaggagaatcccttcaaagaaaggatcgtggcggcgttttccgaggatggtgaggggaacctcactttcaacgactttgtggacatgttttccgtgctctgcgagtcggctccccgagagctcaaggcaaactatgccttcaagatctatgacttcaacactgacaacttcatctgcaaggaggacctggagctgacgctggcccggctcactaagtcagagctggatgaggaggaggtggtgcttgtgtgcgacaaggtcattgaggaggctgacttggacggtgacggcaagctgggctttgctgacttcgaggacatgattgccaaggcccctgacttcctcagcactttccacatccggatctgaggacactgccgaggctgtaggggcctagaagtccaccatcctgccctgcagtcacatgggtgtggcctccaagctccccaggaaagcagtggcagcctctggggtttacaccacaaatatatcctgtggccctttcagcaaaaaaaaaaccttaaccaggaagggggcctgtgaaggttaggacccttcccacagccccgctgtggtccagccccgggacccatggcctctctccaggccctccgcaccccgccccatgccccagtcctttcctactccagaaatgctccccacccccccaagagggaaaagcagataacccaacaggaggtggtggggtctgacgtgtccaagtgctggcagacaccctggtcacccaggacagagcggaaaaaaaaaaaagaggtcagggttttaacgagctatgcaatctttttccaaaacccaaggttgggctgcttcccacccctgcctgttccccttctcccggcctccttcacaatgtgaagctgtgggtgcagtgggcccaagggctcttgctcctgtctctgcctctgggtcatgagtaccaccctgcctgcctccccaacaccgtggaatcctcactggtgtgctgtccacagatttgtgaactcctggtagtaaaacacttttgcatccctttgctctccatgtatgctaatgttaggaaatgtttgagggta

SEQ ID NO: 41876 - DNA, 1194 bp, Homo sapiens
ctcgccccactgcccgcctcgagagggttttttcccaggccccgcaccctcacgccgtgcgacctggactcccacggcgggacccgggctcacacctcttcctgctgcggggcggagtcgccgccgctccgggtctttgtccccgcctccgagacccccgcgcgcccccagcacttccggccgcgggagccaagggttcgtgccgggcagcgtctcccggggccaggtcgcctcctgccgggacccgggcgcgctgcagccgcggagccgggtgccccgccctcttcccgccggcggcggagtcgctgccgctccgggttcccgtccccgcctccgagacccccgcgcgcctcctccaggcgagctgcggggcgggaagggtccggccaccgtgggccgctgccagccgcggggctgccgagggccgcgggcacggggcgctggctccgggtctggcggccgctgatgggagtcggagcccgggcgggcgagcggcggcgcggcggccaccatggggaacaagcagaccatcttcaccgaagagcagctagacaactaccaggactgcaccttcttcaataagaaggacatcctcaagctgcattcgcgattctatgagctggcccccaacctcgtcccaatggactacaggaagagccccatcgtccacgtgcccatgagcctcatcatccagatgccagagctccgggagaatcccttcaaagaaaggatcgtggcggcgttttccgaggatggtgaggggaacctcactttcaacgactttgtggacatgttttccgtgctctgcgagtcggctccccgagagctcaaggcaaactatgccttcaagatctatgacttcaacactgacaacttcatctgcaaggaggacctggagctgacgctggcccggctcactaagtcagagctggatgaggaggaggtggtgcttgtgtgcgacaaggtcattgaggaggctgacttggacggtgacggcaagctgggctttgctgacttcgagggctcttgctcctgtctctgcctctgggtcatgagtaccaccctgcctgcctccccaacaccgtggaatcctcactggtgtgctgtccacagatttgtgaactcctggtagtaaaacacttttgcatccctttgctctccatgtatgctaatgttaggaaatgtttgagggta

SEQ ID NO: 41877 - DNA, 1131 bp, Homo sapiens
tgctgccactacaggggccgggcttgggcagggcagagcagggcaggccgggatgttggggctgaggcccctatcactcgctatttgtgagcagtggtgtgcggccaggaagcaggaggtcacgttcaagccacccttgccctagacgtgtgactggcctttgtcccctgcagggggaaggttgaagacctgggggccccttcagtgataagtgggggcagaactccctgggcaccgctgttcctccgtcttcccccagtgttgattacctgcatccactatgcagggttccctaatgaggcactgtccagcatggggctggggcctgctgtgcttttccctgaggagcctttacctgcccgacccagggcctctcaccctctcttgccctttctctctttctagcactttccacatccggatctgaggacactgccgaggctgtaggggcctagaagtccaccatcctgccctgcagtcacatgggtgtggcctccaagctccccaggaaagcagtggcagcctctggggtttacaccacaaatatatcctgtggccctttcagcaaaaaaaaaaccttaaccaggaagggggcctgtgaaggttaggacccttcccacagccccgctgtggtccagccccgggacccatggcctctctccaggccctccgcaccccgccccatgccccagtcctttcctactccagaaatgctccccacccccccaagagggaaaagcagataacccaacaggaggtggtggggtctgacgtgtccaagtgctggcagacaccctggtcacccaggacagagcggaaaaaaaaaaaagaggtcagggttttaacgagctatgcaatctttttccaaaacccaaggttgggctgcttcccacccctgcctgttccccttctcccggcctccttcacaatgtgaagctgtgggtgcagtgggcccaagggctcttgctcctgtctctgcctctgggtcatgagtaccaccctgcctgcctccccaacaccgtggaatcctcactggtgtgctgtccacagatttgtgaactcctggtagtaaaacacttttgcatccctttgctctccatgtatgctaatgttaggaaatgtttgagggta

SEQ ID NO: 41878 - DNA, 1779 bp, Homo sapiens
ctcgccccactgcccgcctcgagagggttttttcccaggccccgcaccctcacgccgtgcgacctggactcccacggcgggacccgggctcacacctcttcctgctgcggggcggagtcgccgccgctccgggtctttgtccccgcctccgagacccccgcgcgcccccagcacttccggccgcgggagccaagggttcgtgccgggcagcgtctcccggggccaggtcgcctcctgccgggacccgggcgcgctgcagccgcggagccgggtgccccgccctcttcccgccggcggcggagtcgctgccgctccgggttcccgtccccgcctccgagacccccgcgcgcctcctccaggcgagctgcggggcgggaagggtccggccaccgtgggccgctgccagccgcggggctgccgagggccgcgggcacggggcgctggctccgggtctggcggccgctgatgggagtcggagcccgggcgggcgagcggcggcgcggcggccaccatggggaacaagcagaccatcttcaccgaagagcagctagacaactaccaggactgcaccttcttcaataagaaggacatcctcaagctgcattcgcgattctatgagctggcccccaacctcgtcccaatggactacaggaagagccccatcgtccacgtgcccatgagcctcatcatccagatgccagagctccgggagaatcccttcaaagaaaggatcgtggcggcgttttccgaggatggtgaggggaacctcactttcaacgactttgtggacatgttttccgtgctctgcgagtcggctccccgagagctcaaggcaaactatgccttcaagatctatgacttcaacactgacaacttcatctgcaaggaggacctggagctgacgctggcccggctcactaagtcagagctggatgaggaggaggtggtgcttgtgtgcgacaaggtcattgaggaggctgacttggacggtgacggcaagctgggctttgctgacttcgaggacatgattgccaaggcccctgacttcctcagcactttccacatccggatctgaggacactgccgaggctgtaggggcctagaagtccaccatcctgccctgcagtcacatgggtgtggcctccaagctccccaggaaagcagtggcagcctctggggtttacaccacaaatatatcctgtggccctttcagcaaaaaaaaaaccttaaccaggaagggggcctgtgaaggttaggacccttcccacagccccgctgtggtccagccccgggacccatggcctctctccaggccctccgcaccccgccccatgccccagtcctttcctactccagaaatgctccccacccccccaagagggaaaagcagataacccaacaggaggtggtggggtctgacgtgtccaagtgctggcagacaccctggtcacccaggacagagcggaaaaaaaaaaaagaggtcagggttttaacgagctatgcaatctttttccaaaacccaaggttgggctgcttcccacccctgcctgttccccttctcccggcctccttcacaatgtgaagctgtgggtgcagtgggcccaagggctcttgctcctgtctctgcctctgggtcatgagtaccaccctgcctgcctccccaacaccgtggaatcctcactggtgtgctgtccacagatttgtgaactcctggtagtaaaacacttttgcatccctttgctctccatgtatgctaatgttaggaaatgtttgagggta

SEQ ID NO: 41879 - DNA, 1873 bp, Homo sapiens
ctcgccccactgcccgcctcgagagggttttttcccaggccccgcaccctcacgccgtgcgacctggactcccacggcgggacccgggctcacacctcttcctgctgcggggcggagtcgccgccgctccgggtctttgtccccgcctccgagacccccgcgcgcccccagcacttccggccgcgggagccaagggttcgtgccgggcagcgtctcccggggccaggtcgcctcctgccgggacccgggcgcgctgcagccgcggagccgggtgccccgccctcttcccgccggcggcggagtcgctgccgctccgggttcccgtccccgcctccgagacccccgcgcgcctcctccaggcgagctgcggggcgggaagggtccggccaccgtgggccgctgccagccgcggggctgccgagggccgcgggcacggggcgctggctccgggtctggcggccgctgatgggagtcggagcccgggcgggcgagcggcggcgcggcggccaccatggggaacaagcagaccatcttcaccgaagagcagctagacaactaccaggactgcaccttcttcaataagaaggacatcctcaagtagatccgattgctccccaggacacagctcctgcattcccacattgaggccgagtgggcagcccaccctattcagtcaccttgctttttataggctgcattcgcgattctatgagctggcccccaacctcgtcccaatggactacaggaagagccccatcgtccacgtgcccatgagcctcatcatccagatgccagagctccgggagaatcccttcaaagaaaggatcgtggcggcgttttccgaggatggtgaggggaacctcactttcaacgactttgtggacatgttttccgtgctctgcgagtcggctccccgagagctcaaggcaaactatgccttcaagatctatgacttcaacactgacaacttcatctgcaaggaggacctggagctgacgctggcccggctcactaagtcagagctggatgaggaggaggtggtgcttgtgtgcgacaaggtcattgaggaggctgacttggacggtgacggcaagctgggctttgctgacttcgaggacatgattgccaaggcccctgacttcctcagcactttccacatccggatctgaggacactgccgaggctgtaggggcctagaagtccaccatcctgccctgcagtcacatgggtgtggcctccaagctccccaggaaagcagtggcagcctctggggtttacaccacaaatatatcctgtggccctttcagcaaaaaaaaaaccttaaccaggaagggggcctgtgaaggttaggacccttcccacagccccgctgtggtccagccccgggacccatggcctctctccaggccctccgcaccccgccccatgccccagtcctttcctactccagaaatgctccccacccccccaagagggaaaagcagataacccaacaggaggtggtggggtctgacgtgtccaagtgctggcagacaccctggtcacccaggacagagcggaaaaaaaaaaaagaggtcagggttttaacgagctatgcaatctttttccaaaacccaaggttgggctgcttcccacccctgcctgttccccttctcccggcctccttcacaatgtgaagctgtgggtgcagtgggcccaagggctcttgctcctgtctctgcctctgggtcatgagtaccaccctgcctgcctccccaacaccgtggaatcctcactggtgtgctgtccacagatttgtgaactcctggtagtaaaacacttttgcatccctttgctctccatgtatgctaatgttaggaaatgtttgagggta

SEQ ID NO: 41880 - DNA, 1857 bp, Homo sapiens
ctcgccccactgcccgcctcgagagggttttttcccaggccccgcaccctcacgccgtgcgacctggactcccacggcgggacccgggctcacacctcttcctgctgcggggcggagtcgccgccgctccgggtctttgtccccgcctccgagacccccgcgcgcccccagcacttccggccgcgggagccaagggttcgtgccgggcagcgtctcccggggccaggtcgcctcctgccgggacccgggcgcgctgcagccgcggagccgggtgccccgccctcttcccgccggcggcggagtcgctgccgctccgggttcccgtccccgcctccgagacccccgcgcgcctcctccaggcgagctgcggggcgggaagggtccggccaccgtgggccgctgccagccgcggggctgccgagggccgcgggcacggggcgctggctccgggtctggcggccgctgatgggagtcggagcccgggcgggcgagcggcggcgcggcggccaccatggggaacaagcagaccatcttcaccgaagagcagctagacaactaccaggactgcaccttcttcaataagaaggacatcctcaagctgcattcgcgattctatgagctggcccccaacctcgtcccaatggactacaggaagagccccatcgtccacgtgcccatgagcctcatcatccagatgccagagctccggggatcttgtccaaatgccaattcaggctcagtacatgtggagtagagtcaggattctgcttttcgagcaagttcccaggagaatcccttcaaagaaaggatcgtggcggcgttttccgaggatggtgaggggaacctcactttcaacgactttgtggacatgttttccgtgctctgcgagtcggctccccgagagctcaaggcaaactatgccttcaagatctatgacttcaacactgacaacttcatctgcaaggaggacctggagctgacgctggcccggctcactaagtcagagctggatgaggaggaggtggtgcttgtgtgcgacaaggtcattgaggaggctgacttggacggtgacggcaagctgggctttgctgacttcgaggacatgattgccaaggcccctgacttcctcagcactttccacatccggatctgaggacactgccgaggctgtaggggcctagaagtccaccatcctgccctgcagtcacatgggtgtggcctccaagctccccaggaaagcagtggcagcctctggggtttacaccacaaatatatcctgtggccctttcagcaaaaaaaaaaccttaaccaggaagggggcctgtgaaggttaggacccttcccacagccccgctgtggtccagccccgggacccatggcctctctccaggccctccgcaccccgccccatgccccagtcctttcctactccagaaatgctccccacccccccaagagggaaaagcagataacccaacaggaggtggtggggtctgacgtgtccaagtgctggcagacaccctggtcacccaggacagagcggaaaaaaaaaaaagaggtcagggttttaacgagctatgcaatctttttccaaaacccaaggttgggctgcttcccacccctgcctgttccccttctcccggcctccttcacaatgtgaagctgtgggtgcagtgggcccaagggctcttgctcctgtctctgcctctgggtcatgagtaccaccctgcctgcctccccaacaccgtggaatcctcactggtgtgctgtccacagatttgtgaactcctggtagtaaaacacttttgcatccctttgctctccatgtatgctaatgttaggaaatgtttgagggta

SEQ ID NO: 41881 - DNA, 988 bp, Homo sapiens
ggcccttgggttaccccggcccccccggggaattacgggatggcaactatgccttcaagatctatgacttcaacactgacaacttcatctgcaaggaggacctggagctgacgctggcccggctcactaagtcagagctggatgaggaggaggtggtgcttgtgtgcgacaaggtcattgaggaggctgacttggacggtgacggcaagctgggctttgctgacttcgaggacatgattgccaaggcccctgacttcctcagcactttccacatccggatctgaggacactgccgaggctgtaggggcctagaagtccaccatcctgccctgcagtcacatgggtgtggcctccaagctccccaggaaagcagtggcagcctctggggtttacaccacaaatatatcctgtggccctttcagcaaaaaaaaaaccttaaccaggaagggggcctgtgaaggttaggacccttcccacagccccgctgtggtccagccccgggacccatggcctctctccaggccctccgcaccccgccccatgccccagtcctttcctactccagaaatgctccccacccccccaagagggaaaagcagataacccaacaggaggtggtggggtctgacgtgtccaagtgctggcagacaccctggtcacccaggacagagcggaaaaaaaaaaaagaggtcagggttttaacgagctatgcaatctttttccaaaacccaaggttgggctgcttcccacccctgcctgttccccttctcccggcctccttcacaatgtgaagctgtgggtgcagtgggcccaagggctcttgctcctgtctctgcctctgggtcatgagtaccaccctgcctgcctccccaacaccgtggaatcctcactggtgtgctgtccacagatttgtgaactcctggtagtaaaacacttttgcatccctttgctctccatgtatgctaatgttaggaaatgtttgagggta

SEQ ID NO: 41882 - DNA, 739 bp, Homo sapiens
ccgcccgtagaaaagatggctgctgtgcaagttgtcggttcgtggccttccgtgcagccgcgggaggcaccgcgggaagcaatccctgagcgaggcaatgggtttcgcctcttgtctgccaggctctgcgccctgcgcccggatgacagcagctccgcccgcaccgagatccacctgctcttcgatcagctcatctccgagaactacagcgagggcagtggcgtggccccggaggacgttagtgctcttcttgtccaggcttgccgactggtacctcttaatcagaatcatcttgtcagcaaagtgagccagcttatccaccatttacttaacagattacaggtaattgttgatgaacagcacttggatttcctgttggcatatactatttcggctattcatcagtgtagttcctggacacacagggaaattcttcaagccctggcagctctggtgtactgcaatggctccaaatgtcaaaagtacctcccagagctgctaggcaacaccggactcttaatgaagttgagtgacttggctcagtctgatcctgaagtcaggagagctgcagtacattgtatggcaaacttatgtctcagtgtgccaggacagccgtatttggaggagccctaccaaaatgtctgtttccaagcttttctgactattttacagtctccaaaatcatctgatatggatgatatcacattttgcatggtaagtggactatcattgacgtagt

SEQ ID NO: 41883 - DNA, 671 bp, Homo sapiens
ccgcccgtagaaaagatggctgctgtgcaagttgtcggttcgtggccttccgtgcagccgcgggaggcaccgcgggaagcaatccctgagcgaggcaatgggtttcgcctcttgtctgccaggctctgcgccctgcgcccggatgacagcagctccgcccgcaccgagatccacctgctcttcgatcagctcatctccgagaactacagcgagggcagtggcgtggccccggagagacaaggtctcactctgtcatccagactggagtgcagcagcaagatcatagctcactgtgacctaaaactcctgggctcaagccatcctcccacctcagcctcccaagaagctgggactacataccaccatatccagctaatttttttaaaaaagttttttctgtagagatggagtctcactatgttgcccaagctggtcttggactcctgggctcaagcagtcctcccgctttgacctccggaagaactgggattaggtgtgagccactgtgcctggctttttccttcttttttagcacatgctgtttttgtgctatcacttcatttttttccttcctgcctcacattttctttccccattttgaatgtgaatatttacttttattttcccatttggctgtgttttgaggatcttcacttgactaataagtattt

SEQ ID NO: 41884 - DNA, 821 bp, Homo sapiens
ccgcccgtagaaaagatggctgctgtgcaagttgtcggttcgtggccttccgtgcagccgcgggaggcaccgcgggaagcaatccctgagcgaggcaatgggtttcgcctcttgtctgccaggctctgcgccctgcgcccggatgacagcagctccgcccgcaccgagatccacctgctcttcgatcagctcatctccgagaactacagcgagggcagtggcgtggccccggaggacgttagtgctcttcttgtccaggcttgccgactggtacctcttaatcagaatcatcttgtcagcaaagtgagccagcttatccaccatttacttaacagattacagtacctcccagagctgctaggcaacaccggactcttaatgaagttgagtgacttggctcagtctgatcctgaagtcaggagagctgcagtacattgtatggcaaacttatgtctcagtgtgccaggacagccgtatttggaggagccctaccaaaatgtctgtttccaagcttttctgactattttacagtctccaaaatcatctgatatggatgatatcacattttgcatgttattgcaaaatgcattaaaaggtatacagtcacttctaaatggtgggagaatgaaactaacacagactgatgaacttggagcacttttagctgtgctaaagaaattcatgtttcacggactccctggactaaacatagagatgcccacggtgttatacccaactccgcttcctcagtatgatgggcgaacacctatcaaaccacagcaatcagaatccagtgcttctcgaccaactttgaatacatt

SEQ ID NO: 41885 - DNA, 774 bp, Homo sapiens
gcgggttgggcggggggcgctgccgcccaaggcccgaggcagcggcgcgggatcggccaaagcaccggccgccagttcggcgggtctggagagaggggacctcaagcagccagtggagcaaccagcctgggagccttcgacgtaggcgctgtgggcgaaggaaaaggcctggcctgctgcctcttctcttgcagcaaaatccgctgctgtgaaggagctggtaggcggacgctctgtagataagagaatccctgatctgcctgggcatcatcttgctctttatgacctgcttggctgccactgtgtagggcctgcttaaagtcctttgcactctcagcattcccctcaagttcaaggacaagcttctcattatggcaggcataaaactctttataattcgtcctccactctcccagctcagggctccagctgttgtctcacacttccttgaagttccctctgctgagtcgcccttgtgcctgaccaacttacttactaaaataaaaatcccaatttctttccagtcatgtgtgcccaagggcgagttatttaacttttctgagctttcctcagtaaaacgaagctacatatcttgcaaggatgtgatattaaagttatgatattgtaaaacaggtgccacggtgcttggcctagggtgagccttcaacctagaacataccactgtccccatgcaccttgctcacacacccaatcccagacttttcttttgtagtcacctcagttatcacctcattaaataacctgattacccca

SEQ ID NO: 41886 - DNA, 451 bp, Homo sapiens
gtattggacttacagaggtgaatcaaagaggggccttcgtgaggctcatgtgattaagggaatgaaccacataactatttcaaagcaaataaaattagactttggatctggaatttaatttaatccaaatcattttataaatgaataagccgacatccaggcacattaagtgacttgaccaaagtcactcagctattcagtggcagacacaggacagagccaaacctccactgctggtctgttgcagcatgtttcatacatgttcctataagatctggacattctttgcaacatcctcagagaccatctggaaagggaaagaccgagatcatggaatgtgaggccctcaatcctgcttcagtcagagcaggtccttaattatgtggattgcatattcaatctccagggaaagatctgtttgaacaatatgacctgttctattttatatgag

SEQ ID NO: 41887 - DNA, 492 bp, Homo sapiens
aaattatccgggtgtggtggtgcatgcctgtagtcccagctacttgggaggctgaggcaggagaattgcttgaacctgggaggcggaggctgcagtgagctgagattatgcctgtctttggtaaaaacaaaacaaaacaaaacaaaaaaccaccaaaaatttttttttaattttaaaaaagacaagaaataaaaagtcagtccacttactgatagagaattgtagttgaaactagtgctttgaggtacaatacccttcattcacttagtattctgccttcatagcctgatggctagctgtccctgggtaaattttgtaacttctatgaacctcactttcttcaaatgcaaagtgaggctaatagttctgactttactgggctgttgggagcattaaataaaataatgtgtatgaagcacttatactttaacttcagtaaatatttgttgaagaataaataatttagcctgaacttcaatatataatgtggaa

SEQ ID NO: 41888 - DNA, 5311 bp, Homo sapiens
attcttactcatttgtgtttattcttggacttatcctgacataatggggtttttttaattatagattcacactgcatttattcatcacccctgtcctctcatccataactcaaatttactaccagcaacacaaaatacaaagatgtgtccagtttcactacagctcttcgcgtttacaagtgtcgagcgcttgctttcggaacgcccttgtgattggccgagccaatgccagtgacatcaaccaacttacttttgattggaaggctggttgctgggactgtagcgtttgcaggaagtcacttaactgtttgggagctggaaaaccgaagctgaagttctcttttgccataggaacgagcgcaactgactaggaaagatgtgtcccaaagctccgcaagctggaacgtgagccaggaggcccggaccggccacgggaccgcgaggcactccgaaagtgtgcggctgccccttccctgcctcccagctgttacccttttaaatgtcagtgttcgaggctgtaggggtagcacgaggcagcgaaacggaacagtcggattggccgcacgcctcagttctagacgcacctctccaccgaaggccgttctgactggcagggggagaaagtaaacagagttgaatcaccctccccactggccaattggagggggtttggtttgtgacgtgatgggattctgcgaaattgttactgagcaagagaatgccggaacggtgcggaccggccggagcaggggttcagaagccgtcagtggactcgggaaaaagtgtctcttagacctggcgctcggcgggaccctcgccacccgcgtcggggtgatcgggtgaatgtcctggggctttggctcgacggcgaggcggccgagggcgtgcacctctcttgcagtttcctctcccagcgcctcgggggcgttttcagtcgaataaacttgcgaccgccacgtgtggcatctttccaagggagccggctcagaggggccggcgcgcccgtcgggggatcgcggccggcgcggggcaggggcggcggctagaggcggcggcgcggcggagcccggggccgtggatgctgcgtgcggaggcgctgccggttacgtaaagatgaggggctgaggtcgcctcggcgctcctgcgagtcggaagcgccccgcgcccccgcccccttggccgccgcgccgtgccgcgccgcgccgcgctcgtcgtccgaggccagggcagggcgagccgaacctccgcagccaccgccaagtttgtccgcgccgcctgggctgccgtcgcccgcaccatgtccgcggccgcctacatggacttcgtggctgcccagtgtctggtttccatttcgaaccgcgctgcggtgccggagcatggggtcgctccggacgccgagcggctgcgactacctgagcgcgaggtgaccaaggagcacggtgacccgggggacacctggaaggattactgcacactggtcaccatcgccaagagcttgttggacctgaacaagtaccgacccatccagaccccctccgtgtgcagcgacagtctggaaagtccagatgaggatatgggatccgacagcgacgtgaccaccgaatctgggtcgagtccttcccacagcccggaggagagacaggatcctggcagcgcgcccagcccgctctccctcctccatcctggagtggctgcgaaggggaaacacgcctccgaaaagaggcacaagtgcccctacagtggctgtgggaaagtctatggaaaatcctcccatctcaaagcccattacagagtgcatacaggtgaacggccctttccctgcacgtggccagactgccttaaaaagttctcccgctcagacgagctgacccgccactaccggacccacactggggaaaagcagttccgctgtccgctgtgtgagaagcgcttcatgaggagtgaccacctcacaaagcacgcccggcggcacaccgagttccaccccagcatgatcaagcgatcgaaaaaggcgctggccaacgctttgtgaggtgctgcccgtggaagccagggagggatggaccccgaaaggacaaaagtactcccaggaaacagacgcgtgaaaactgagccccagaagaggcacacttgacggcacaggaagtcactgctctttggtcaatattctgattttcctctccctgcattgtttttaaaaagcacattgtagcctaagatcaaagtcaacaacactcggtccccttgaagaggcaactctctgaacccgtctctgactgttggagggaaggcaaatgcttttgggttttttggtttttgtttttgtttttttttctccttttatttttttgcgggggagggtagggagtgggtgggggggagggggtaaggccaagactggggtagaattttaaagattcaacactggtgtacatatgtccgctgggtgagttgacctgtggcctcgcacagtgattctgggccctttatgcttgctgtctctcagaattgttttcttaccttttaatgtaatgacgagtgtgcttcagtttgtttagcaaaaccactctcttgaatcacgttaacttttgagattaaaaaaaaaaacgccatagcacagctgtctttatgcaagcaagagcacatctactccagcatgatctgtcatctaaagacttgaaaacaaaaaacagttacttatagtcaatgggtaagcagagtctgaatttatactaatcaagacaaacctttgaaaggttacactaagtacagaacttttaaaccttgctttgtatgagttgtactttttgaacataagctgcacttttattttctaatgcagaggatgaataagttaaatacatgctttgaggatagaagcagatgttctgtttggcaccacgttataatctgcttattttacaatatacacgtttccctaagaaatcatggcagagatgtgagggcagaatatacacaacagatgctgaaggagaaggagggtagtgttttgcaaaagaaaaagaaaagaaccaacagaattttaactctattaacttttccaaattttcctatgcttttagttaacatcattattgtatcctaatgccactaggggagagagcttttgactctgttgggttttatttgaatgtgtgcataacagtaatgagatctggaaacacctattttttggggaaaaaggtttgttggtctccttcctgtgttcctacaaaactcccactctcaggtgcaagagttatgtagaaggaaagggagctgaaataggaacagaaaaatcaacccctataactagtgaacaccaagggaaaataccacaatgatttcagaggagactctgcaaaatcgtcccttgtggagaatgcaggcaacatggaatactacgaatgaaatcacatcactgtatcttttacatcaatagcctcaccactaatatatcttgtatctaggtgtctataatggctgaaaccactacatccatctatgccatttacctgaaaacttaactgtggcctttatgaggccagaaaagtgaactgagttttcgtagttaagacctcaaatgaggggagtcagcagtgatcatgggggaaatgtttacattttttttttcttcagaagtaacgctttctgatgattttatctgatatttaaaacagggagctatggtgcactctagtttatacttgcgctctgaaatgtgtaaacatagggtgcctacctatttcacctgacccatactcgtttctgattcagaatcagtgtgggctcctgcagtgggcgcgggtcacggctgactccaacttccaatacaacagccatcactagcacagtgtttttttgtttaaccaacgtagttgtattagtagttctataaagagaactgcttttaacattagggactgggagcagtccatgggataaaaaggaaagtgttttctcacgagaaaacatgtcaggaaaaataaagaacactttctacctctgtttcagatttttgaaacacttattttaaaccaaattttaatttctgtgtccaaaataagttttaaggacatctgttcttccatacgaaataggttaggctgcctatttctcactgagctcatggaatggttctgcttatgatactctgcacgctgccttttagtgagtgaggagtttggggttgcctagcaacttgctaacttgtaaaaagtcatctttccctcacagaaagaaacgaaagaaagcaaagcaaagtcagtgaaagacaatctttatagtttcaggagtaaatctaaatgtggcttttgtcaagcacttagatggatataaatgcagcaacttgttttaaaaaaatgcacaatttacttcccaaaaaagttgttacttgccttttcaagttgttgacaaacacacatttgatattctcttatatgttatagtaatgtaacgtataaactcaagcctttttattctttgtgattaaatcctgttttaaaatgtcacaaaacaggaaccagcattctaattagatttactatatcaagatatggttcaaataggactactagagttcattgaacactaaaactatgaaacaattactttttatattaaaaagaccatggatttaacttatgaaaatccaaatgcaggatagtaatttttgtttacttttttaaccaaactgaatttttgaaagactattgcaggtgtttaaaaagaaagaaaagttgttttatctaatactgtaagtagttgtcatattctggaaaatttaatagttttagagttaagatatctcctctctttggttagggaagaagaaagcccttcaccattgtggaatgatgccctggctttaaggtttagctccacatcatgcttctcttgagaattctatttggtagttacaattacagaaactgattagtttgtcagtttgcagatagatttagcacagtactcatcactcggatagattgagatgttctttcacatcagatgatctgtaacactgtaagatactgatctttacaactgtttaatcagttttatttttgtacagtattagtgacctaagttattttgctgtcccgtttttgtaaatcaaatgaaattataaaagaggattctgacagtaggtattttgtacatatgtatatatgttgtccaaataaaaataataaatgataaagaaaacaattcttaaaaatgtaatccattcaattgagtatcatggcagggccatagtccctctactctcttggggggggatggggacctatgattatccttaaatagt

SEQ ID NO: 41889 - DNA, 4979 bp, Homo sapiens
  misc_feature (4904)..(4904): n is a, c, g, or t
attcttactcatttgtgtttattcttggacttatcctgacataatggggtttttttaattatagattcacactgcatttattcatcacccctgtcctctcatccataactcaaatttactaccagcaacacaaaatacaaagatgtgtccagtttcactacagctcttcgcgtttacaagtgtcgagcgcttgctttcggaacgcccttgtgattggccgagccaatgccagtgacatcaaccaacttacttttgattggaaggctggttgctgggactgtagcgtttgcaggaagtcacttaactgtttgggagctggaaaaccgaagctgaagttctcttttgccataggaacgagcgcaactgactaggaaagatgtgtcccaaagctccgcaagctggaacgtgagccaggaggcccggaccggccacgggaccgcgaggcactccgaaagtgtgcggctgccccttccctgcctcccagctgttacccttttaaatgtcagtgttcgaggctgtaggggtagcacgaggcagcgaaacggaacagtcggattggccgcacgcctcagttctagacgcacctctccaccgaaggccgttctgactggcagggggagaaagtaaacagagttgaatcaccctccccactggccaattggagggggtttggtttgtgacgtgatgggattctgcgaaattgttactgagcaagagaatgccggaacggtgcggaccggccggagcaggggttcagaagccgtcagtggactcgggaaaaagtgtctcttagacctggcgctcggcgggaccctcgccacccgcgtcggggtgatcgggtgaatgtcctggggctttggctcgacggcgaggcggccgagggcgtgcacctctcttgcagtttcctctcccagcgcctcgggggcgttttcagtcgaataaacttgcgaccgccacgtgtggcatctttccaagggagccggctcagaggggccggcgcgcccgtcgggggatcgcggccggcgcggggcaggggcggcggctagaggcggcggcgcggcggagcccggggccgtggatgctgcgtgcggaggcgctgccggttacgtaaagatgaggggctgaggtcgcctcggcgctcctgcgagtcggaagcgccccgcgcccccgcccccttggccgccgcgccgtgccgcgccgcgccgcgctcgtcgtccgaggccagggcagggcgagccgaacctccgcagccaccgccaagtttgtccgcgccgcctgggctgccgtcgcccgcaccatgtccgcggccgcctacatggacttcgtggctgcccagtgtctggtttccatttcgaaccgcgctgcggtgccggagcatggggtcgctccggacgccgagcggctgcgactacctgagcgcgaggtgaccaaggagcacggtgacccgggggacacctggaaggattactgcacactggtcaccatcgccaagagcttgttggacctgaacaagtaccgacccatccagaccccctccgtgtgcagcgacagtctggaaagtccagatgaggatatgggatccgacagcgacgtgaccaccgaatctgggtcgagtccttcccacagcccggaggagagacaggatcctggcagcgcgcccagcccgctctccctcctccatcctggagtggctgcgaaggggaaacacgcctccgaaaagaggcacaagtgcccctacagtggctgtgggaaagtctatggaaaatcctcccatctcaaagcccattacagagtgcatacaggtgaacggccctttccctgcacgtggccagactgccttaaaaagttctcccgctcagacgagctgacccgccactaccggacccacactggggaaaagcagttccgctgtccgctgtgtgagaagcgcttcatgaggagtgaccacctcacaaagcacgcccggcggcacaccgagttccaccccagcatgatcaagcgatcgaaaaaggcgctggccaacgctttgtgaggtgctgcccgtggaagccagggagggatggaccccgaaaggacaaaagtactcccaggaaacagacgcgtgaaaactgagccccagaagaggcacacttgacggcacaggaagtcactgctctttggtcaatattctgattttcctctccctgcattgtttttaaaaagcacattgtagcctaagatcaaagtcaacaacactcggtccccttgaagaggcaactctctgaacccgtctctgactgttggagggaaggcaaatgcttttgggttttttggtttttgtttttgtttttttttctccttttatttttttgcgggggagggtagggagtgggtgggggggagggggtaaggccaagactggggtagaattttaaagattcaacactggtgtacatatgtccgctgggtgagttgacctgtggcctcgcacagtgattctgggccctttatgcttgctgtctctcagaattgttttcttaccttttaatgtaatgacgagtgtgcttcagtttgtttagcaaaaccactctcttgaatcacgttaacttttgagattaaaaaaaaaaacgccatagcacagctgtctttatgcaagcaagagcacatctactccagcatgatctgtcatctaaagacttgaaaacaaaaaacagttacttatagtcaatgggtaagcagagtctgaatttatactaatcaagacaaacctttgaaaggttacactaagtacagaacttttaaaccttgctttgtatgagttgtactttttgaacataagctgcacttttattttctaatgcagaggatgaataagttaaatacatgctttgaggatagaagcagatgttctgtttggcaccacgttataatctgcttattttacaatatacacgtttccctaagaaatcatggcagagatgtgagggcagaatatacacaacagatgctgaaggagaaggagggtagtgttttgcaaaagaaaaagaaaagaaccaacagaattttaactctattaacttttccaaattttcctatgcttttagttaacatcattattgtatcctaatgccactaggggagagagcttttgactctgttgggttttatttgaatgtgtgcataacagtaatgagatctggaaacacctattttttggggaaaaaggtttgttggtctccttcctgtgttcctacaaaactcccactctcaggtgcaagagttatgtagaaggaaagggagctgaaataggaacagaaaaatcaacccctataactagtgaacaccaagggaaaataccacaatgatttcagaggagactctgcaaaatcgtcccttgtggagaatgcaggcaacatggaatactacgaatgaaatcacatcactgtatcttttacatcaatagcctcaccactaatatatcttgtatctaggtgtctataatggctgaaaccactacatccatctatgccatttacctgaaaacttaactgtggcctttatgaggccagaaaagtgaactgagttttcgtagttaagacctcaaatgaggggagtcagcagtgatcatgggggaaatgtttacattttttttttcttcagaagtaacgctttctgatgattttatctgatatttaaaacagggagctatggtgcactctagtttatacttgcgctctgaaatgtgtaaacatagggtgcctacctatttcacctgacccatactcgtttctgattcagaatcagtgtgggctcctgcagtgggcgcgggtcacggctgactccaacttccaatacaacagccatcactagcacagtgtttttttgtttaaccaacgtagttgtattagtagttctataaagagaactgcttttaacattagggactgggagcagtccatgggataaaaaggaaagtgttttctcacgagaaaacatgtcaggaaaaataaagaacactttctacctctgtttcagatttttgaaacacttattttaaaccaaattttaatttctgtgtccaaaataagttttaaggacatctgttcttccatacgaaataggttaggctgcctatttctcactgagctcatggaatggttctgcttatgatactctgcacgctgccttttagtgagtgaggagtttggggttgcctagcaacttgctaacttgtaaaaagtcatctttccctcacagaaagaaacgaaagaaagcaaagcaaagtcagtgaaagacaatctttatagtttcaggagtaaatctaaatgtggcttttgtcaagcacttagatggatataaatgcagcaacttgttttaaaaaaatgcacaatttacttcccaaaaaagttgttacttgccttttcaagttgttgacaaacacacatttgatattctcttatatgttatagtaatgtaacgtataaactcaagcctttttattctttgtgattaaatcctgttttaaaatgtcacaaaacaggaaccagcattctaattagatttactatatcaagatatggttcaaataggactactagagttcattgaacactaaaactatgaaacaattactttttatattaaaaagaccatggatttaacttatgaaaatccaaatgcaggatagtaatttttgtttacttttttaaccaaactgaatttttgaaagactattgcaggtgtttaaaaagaaagaaaagttgttttatctaatactgtaagtagttgtcatattctggaaaatttaatagttttagagttaagatatctcctctctttggttagggaagaagaaagcccttcaccattgtggaatgatgccctggctttaaggtttagctccacatcatgcttctcttggatcnattgcggtcccctcccaccgccgttgccgggcgcaattaaccgaccccacggagaggggggccacaacgtgccgg

SEQ ID NO: 41890 - DNA, 5151 bp, Homo sapiens
attcttactcatttgtgtttattcttggacttatcctgacataatggggtttttttaattatagattcacactgcatttattcatcacccctgtcctctcatccataactcaaatttactaccagcaacacaaaatacaaagatgtgtccagtttcactacagctcttcgcgtttacaagtgtcgagcgcttgctttcggaacgcccttgtgattggccgagccaatgccagtgacatcaaccaacttacttttgattggaaggctggttgctgggactgtagcgtttgcaggaagtcacttaactgtttgggagctggaaaaccgaagctgaagttctcttttgccataggaacgagcgcaactgactaggaaagatgtgtcccaaagctccgcaagctggaacgtgagccaggaggcccggaccggccacgggaccgcgaggcactccgaaagtgtgcggctgccccttccctgcctcccagctgttacccttttaaatgtcagtgttcgaggctgtaggggtagcacgaggcagcgaaacggaacagtcggattggccgcacgcctcagttctagacgcacctctccaccgaaggccgttctgactggcagggggagaaagtaaacagagttgaatcaccctccccactggccaattggagggggtttggtttgtgacgtgatgggattctgcgaaattgttactgagcaagagaatgccggaacggtgcggaccggccggagcaggggttcagaagccgtcagtggactcgggaaaaagtgtctcttagacctggcgctcggcgggaccctcgccacccgcgtcggggtgatcgggtgaatgtcctggggctttggctcgacggcgaggcggccgagggcgtgcacctctcttgcagtttcctctcccagcgcctcgggggcgttttcagtcgaataaacttgcgaccgccacgtgtggcatctttccaagggagccggctcagaggggccggcgcgcccgtcgggggatcgcggccggcgcggggcaggggcggcggctagaggcggcggcgcggcggagcccggggccgtggatgctgcgtgcggaggcgctgccggttacgtaaagatgaggggctgaggtcgcctcggcgctcctgcgagtcggaagcgccccgcgcccccgcccccttggccgccgcgccgtgccgcgccgcgccgcgctcgtcgtccgaggccagggcagggcgagccgaacctccgcagccaccgccaagtttgtccgcgccgcctgggctgccgtcgcccgcaccatgtccgcggccgcctacatggacttcgtggctgcccagtgtctggtttccatttcgaaccgcgctgcggtgccggagcatggggtcgctccggacgccgagcggctgcgactacctgagcgcgaggtgaccaaggagcacggtgacccgggggacacctggaaggattactgcacactggtcaccatcgccaagagcttgttggacctgaacaagtaccgacccatccagaccccctccgtgtgcagcgacagtctggaaagtccagatgaggatatgggatccgacagcgacgtgaccaccgaatctgggtcgagtccttcccacagcccggaggagagacaggatcctggcagcgcgcccagcccgctctccctcctccatcctggagtggctgcgaaggggaaacacgcctccgaaaagaggcacaagtgcccctacagtggctgtgggaaagtctatggaaaatcctcccatctcaaagcccattacagagtgcatacaggtgaacggccctttccctgcacgtggccagactgccttaaaaagttctcccgctcagacgagctgacccgccactaccggacccacactggggaaaagcagttccgctgtccgctgtgtgagaagcgcttcatgaggagtgaccacctcacaaagcacgcccggcggcacaccgagttccaccccagcatgatcaagcgatcgaaaaaggcgctggccaacgctttgtgaggtgctgcccgtggaagccagggagggatggaccccgaaaggacaaaagtactcccaggaaacagacgcgtgaaaactgagccccagaagaggcacacttgacggcacaggaagtcactgctctttggtcaatattctgattttcctctccctgcattgtttttaaaaagcacattgtagcctaagatcaaagtcaacaacactcggtccccttgaagaggcaactctctgaacccgtctctgactgttggagggaaggcaaatgcttttgggttttttggtttttgtttttgtttttttttctccttttatttttttgcgggggagggtagggagtgggtgggggggagggggtaaggccaagactggggtagaattttaaagattcaacactggtgtacatatgtccgctgggtgagttgacctgtggcctcgcacagtgattctgggccctttatgcttgctgtctctcagaattgttttcttaccttttaatgtaatgacgagtgtgcttcagtttgtttagcaaaaccactctcttgaatcacgttaacttttgagattaaaaaaaaaaacgccatagcacagctgtctttatgcaagcaagagcacatctactccagcatgatctgtcatctaaagacttgaaaacaaaaaacagttacttatagtcaatgggtaagcagagtctgaatttatactaatcaagacaaacctttgaaaggttacactaagtacagaacttttaaaccttgctttgtatgagttgtactttttgaacataagctgcacttttattttctaatgcagaggatgaataagttaaatacatgctttgaggatagaagcagatgttctgtttggcaccacgttataatctgcttattttacaatatacacgtttccctaagaaatcatggcagagatgtgagggcagaatatacacaacagatgctgaaggagaaggagggtagtgttttgcaaaagaaaaagaaaagaaccaacagaattttaactctattaacttttccaaattttcctatgcttttagttaacatcattattgtatcctaatgccactaggggagagagcttttgactctgttgggttttatttgaatgtgtgcataacagtaatgagatctggaaacacctattttttggggaaaaaggtttgttggtctccttcctgtgttcctacaaaactcccactctcaggtgcaagagttatgtagaaggaaagggagctgaaataggaacagaaaaatcaacccctataactagtgaacaccaagggaaaataccacaatgatttcagaggagactctgcaatcactgtatcttttacatcaatagcctcaccactaatatatcttgtatctaggtgtctataatggctgaaaccactacatccatctatgccatttacctgaaaacttaactgtggcctttatgaggccagaaaagtgaactgagttttcgtagttaagacctcaaatgaggggagtcagcagtgatcatgggggaaatgtttacattttttttttcttcagaagtaacgctttctgatgattttatctgatatttaaaacagggagctatggtgcactctagtttatacttgcgctctgaaatgtgtaaacatagggtgcctacctatttcacctgacccatactcgtttctgattcagaatcagtgtgggctcctgcagtgggcgcgggtcacggctgactccaacttccaatacaacagccatcactagcacagtgtttttttgtttaaccaacgtagttgtattagtagttctataaagagaactgcttttaacattagggactgggagcagtccatgggataaaaaggaaagtgttttctcacgagaaaacatgtcaggaaaaataaagaacactttctacctctgtttcagatttttgaaacacttattttaaaccaaattttaatttctgtgtccaaaataagttttaaggacatctgttcttccatacgaaataggttaggctgcctatttctcactgagctcatggaatggttctgcttatgatactctgcacgctgccttttagtgagtgaggagtttggggttgcctagcaacttgctaacttgtaaaaagtcatctttccctcacagaaagaaacgaaagaaagcaaagcaaagtcagtgaaagacaatctttatagtttcaggagtaaatctaaatgtggcttttgtcaagcacttagatggatataaatgcagcaacttgttttaaaaaaatgcacaatttacttcccaaaaaagttgttacttgccttttcaagttgttgacaaacacacatttgatattctcttatatgttatagtaatgtaacgtataaactcaagcctttttattctttgtgattaaatcctgttttaaaatgtcacaaaacaggaaccagcattctaattagatttactatatcaagatatggttcaaataggactactagagttcattgaacactaaaactatgaaacaattactttttatattaaaaagaccatggatttaacttatgaaaatccaaatgcaggatagtaatttttgtttacttttttaaccaaactgaatttttgaaagactattgcaggtgtttaaaaagaaagaaaagttgttttatctaatactgtaagtagttgtcatattctggaaaatttaatagttttagagttaagatatctcctctctttggttagggaagaagaaagcccttcaccattgtggaatgatgccctggctttaaggtttagctccacatcatgcttctcttgagaattctatttggtagttacaattacagaaactgattagtttgtcagtttgcagatagatttagcacagtactcatcactcggatagattgagatgttctttcacatcagatgatctgtaacactgtaagatactgatctttacaactgtttaatcagttttatttttgtacagtattagtgacctaagttattttgctgtcccgtttttgtaaatcaaatgaaattataaaagaggattctgacagtaggtattttgtacatatgtatatatgttgtccaaataaaaataataaatgataaaga

SEQ ID NO: 41891 - DNA, 5151 bp, Homo sapiens
attcttactcatttgtgtttattcttggacttatcctgacataatggggtttttttaattatagattcacactgcatttattcatcacccctgtcctctcatccataactcaaatttactaccagcaacacaaaatacaaagatgtgtccagtttcactacagctcttcgcgtttacaagtgtcgagcgcttgctttcggaacgcccttgtgattggccgagccaatgccagtgacatcaaccaacttacttttgattggaaggctggttgctgggactgtagcgtttgcaggaagtcacttaactgtttgggagctggaaaaccgaagctgaagttctcttttgccataggaacgagcgcaactgactaggaaagatgtgtcccaaagctccgcaagctggaacgtgagccaggaggcccggaccggccacgggaccgcgaggcactccgaaagtgtgcggctgccccttccctgcctcccagctgttacccttttaaatgtcagtgttcgaggctgtaggggtagcacgaggcagcgaaacggaacagtcggattggccgcacgcctcagttctagacgcacctctccaccgaaggccgttctgactggcagggggagaaagtaaacagagttgaatcaccctccccactggccaattggagggggtttggtttgtgacgtgatgggattctgcgaaattgttactgagcaagagaatgccggaacggtgcggaccggccggagcaggggttcagaagccgtcagtggactcgggaaaaagtgtctcttagacctggcgctcggcgggaccctcgccacccgcgtcggggtgatcgggtgaatgtcctggggctttggctcgacggcgaggcggccgagggcgtgcacctctcttgcagtttcctctcccagcgcctcgggggcgttttcagtcgaataaacttgcgaccgccacgtgtggcatctttccaagggagccggctcagaggggccggcgcgcccgtcgggggatcgcggccggcgcggggcaggggcggcggctagaggcggcggcgcggcggagcccggggccgtggatgctgcgtgcggaggcgctgccggttacgtaaagatgaggggctgaggtcgcctcggcgctcctgcgagtcggaagcgccccgcgcccccgcccccttggccgccgcgccgtgccgcgccgcgccgcgctcgtcgtccgaggccagggcagggcgagccgaacctccgcagccaccgccaagtttgtccgcgccgcctgggctgccgtcgcccgcaccatgtccgcggccgcctacatggacttcgtggctgcccagtgtctggtttccatttcgaaccgcgctgcggtgccggagcatggggtcgctccggacgccgagcggctgcgactacctgagcgcgaggtgaccaaggagcacggtgacccgggggacacctggaaggattactgcacactggtcaccatcgccaagagcttgttggacctgaacaagtaccgacccatccagaccccctccgtgtgcagcgacagtctggaaagtccagatgaggatatgggatccgacagcgacgtgaccaccgaatctgggtcgagtccttcccacagcccggaggagagacaggatcctggcagcgcgcccagcccgctctccctcctccatcctggagtggctgcgaaggggaaacacgcctccgaaaagaggcacaagtgcccctacagtggctgtgggaaagtctatggaaaatcctcccatctcaaagcccattacagagtgcatacaggtgaacggccctttccctgcacgtggccagactgccttaaaaagttctcccgctcagacgagctgacccgccactaccggacccacactggggaaaagcagttccgctgtccgctgtgtgagaagcgcttcatgaggagtgaccacctcacaaagcacgcccggcggcacaccgagttccaccccagcatgatcaagcgatcgaaaaaggcgctggccaacgctttgtgaggtgctgcccgtggaagccagggagggatggaccccgaaaggacaaaagtactcccaggaaacagacgcgtgaaaactgagccccagaagaggcacacttgacggcacaggaagtcactgctctttggtcaatattctgattttcctctccctgcattgtttttaaaaagcacattgtagcctaagatcaaagtcaacaacactcggtccccttgaagaggcaactctctgaacccgtctctgactgttggagggaaggcaaatgcttttgggttttttggtttttgtttttgtttttttttctccttttatttttttgcgggggagggtagggagtgggtgggggggagggggtaaggccaagactggggtagaattttaaagattcaacactggtgtacatatgtccgctgggtgagttgacctgtggcctcgcacagtgattctgggccctttatgcttgctgtctctcagaattgttttcttaccttttaatgtaatgacgagtgtgcttcagtttgtttagcaaaaccactctcttgaatcacgttaacttttgagattaaaaaaaaaaacgccatagcacagctgtctttatgcaagcaagagcacatctactccagcatgatctgtcatctaaagacttgaaaacaaaacaaacctttgaaaggttacactaagtacagaacttttaaaccttgctttgtatgagttgtactttttgaacataagctgcacttttattttctaatgcagaggatgaataagttaaatacatgctttgaggatagaagcagatgttctgtttggcaccacgttataatctgcttattttacaatatacacgtttccctaagaaatcatggcagagatgtgagggcagaatatacacaacagatgctgaaggagaaggagggtagtgttttgcaaaagaaaaagaaaagaaccaacagaattttaactctattaacttttccaaattttcctatgcttttagttaacatcattattgtatcctaatgccactaggggagagagcttttgactctgttgggttttatttgaatgtgtgcataacagtaatgagatctggaaacacctattttttggggaaaaaggtttgttggtctccttcctgtgttcctacaaaactcccactctcaggtgcaagagttatgtagaaggaaagggagctgaaataggaacagaaaaatcaacccctataactagtgaacaccaagggaaaataccacaatgatttcagaggagactctgcaaaatcgtcccttgtggagaatgcaggcaacatggaatactacgaatgaaatcacatcactgtatcttttacatcaatagcctcaccactaatatatcttgtatctaggtgtctataatggctgaaaccactacatccatctatgccatttacctgaaaacttaactgtggcctttatgaggccagaaaagtgaactgagttttcgtagttaagacctcaaatgaggggagtcagcagtgatcatgggggaaatgtttacattttttttttcttcagaagtaacgctttctgatgattttatctgatatttaaaacagggagctatggtgcactctagtttatacttgcgctctgaaatgtgtaaacatagggtgcctacctatttcacctgacccatactcgtttctgattcagaatcagtgtgggctcctgcagtgggcgcgggtcacggctgactccaacttccaatacaacagccatcactagcacagtgtttttttgtttaaccaacgtagttgtattagtagttctataaagagaactgcttttaacattagggactgggagcagtccatgggataaaaaggaaagtgttttctcacgagaaaacatgtcaggaaaaataaagaacactttctacctctgtttcagatttttgaaacacttattttaaaccaaattttaatttctgtgtccaaaataagttttaaggacatctgttcttccatacgaaataggttaggctgcctatttctcactgagctcatggaatggttctgcttatgatactctgcacgctgccttttagtgagtgaggagtttggggttgcctagcaacttgctaacttgtaaaaagtcatctttccctcacagaaagaaacgaaagaaagcaaagcaaagtcagtgaaagacaatctttatagtttcaggagtaaatctaaatgtggcttttgtcaagcacttagatggatataaatgcagcaacttgttttaaaaaaatgcacaatttacttcccaaaaaagttgttacttgccttttcaagttgttgacaaacacacatttgatattctcttatatgttatagtaatgtaacgtataaactcaagcctttttattctttgtgattaaatcctgttttaaaatgtcacaaaacaggaaccagcattctaattagatttactatatcaagatatggttcaaataggactactagagttcattgaacactaaaactatgaaacaattactttttatattaaaaagaccatggatttaacttatgaaaatccaaatgcaggatagtaatttttgtttacttttttaaccaaactgaatttttgaaagactattgcaggtgtttaaaaagaaagaaaagttgttttatctaatactgtaagtagttgtcatattctggaaaatttaatagttttagagttaagatatctcctctctttggttagggaagaagaaagcccttcaccattgtggaatgatgccctggctttaaggtttagctccacatcatgcttctcttgagaattctatttggtagttacaattacagaaactgattagtttgtcagtttgcagatagatttagcacagtactcatcactcggatagattgagatgttctttcacatcagatgatctgtaacactgtaagatactgatctttacaactgtttaatcagttttatttttgtacagtattagtgacctaagttattttgctgtcccgtttttgtaaatcaaatgaaattataaaagaggattctgacagtaggtattttgtacatatgtatatatgttgtccaaataaaaataataaatgataaaga

SEQ ID NO: 41892 - DNA, 5150 bp, Homo sapiens
attcttactcatttgtgtttattcttggacttatcctgacataatggggtttttttaattatagattcacactgcatttattcatcacccctgtcctctcatccataactcaaatttactaccagcaacacaaaatacaaagatgtgtccagtttcactacagctcttcgcgtttacaagtgtcgagcgcttgctttcggaacgcccttgtgattggccgagccaatgccagtgacatcaaccaacttacttttgattggaaggctggttgctgggactgtagcgtttgcaggaagtcacttaactgtttgggagctggaaaaccgaagctgaagttctcttttgccataggaacgagcgcaactgactaggaaagatgtgtcccaaagctccgcaagctggaacgtgagccaggaggcccggaccggccacgggaccgcgaggcactccgaaagtgtgcggctgccccttccctgcctcccagctgttacccttttaaatgtcagtgttcgaggctgtaggggtagcacgaggcagcgaaacggaacagtcggattggccgcacgcctcagttctagacgcacctctccaccgaaggccgttctgactggcagggggagaaagtaaacagagttgaatcaccctccccactggccaattggagggggtttggtttgtgacgtgatgggattctgcgaaattgttactgagcaagagaatgccggaacggtgcggaccggccggagcaggggttcagaagccgtcagtggactcgggaaaaagtgtctcttagacctggcgctcggcgggaccctcgccacccgcgtcggggtgatcgggtgaatgtcctggggctttggctcgacggcgaggcggccgagggcgtgcacctctcttgcagtttcctctcccagcgcctcgggggcgttttcagtcgaataaacttgcgaccgccacgtgtggcatctttccaagggagccggctcagaggggccggcgcgcccgtcgggggatcgcggccggcgcggggcaggggcggcggctagaggcggcggcgcggcggagcccggggccgtggatgctgcgtgcggaggcgctgccggttacgtaaagatgaggggctgaggtcgcctcggcgctcctgcgagtcggaagcgccccgcgcccccgcccccttggccgccgcgccgtgccgcgccgcgccgcgctcgtcgtccgaggccagggcagggcgagccgaacctccgcagccaccgccaagtttgtccgcgccgcctgggctgccgtcgcccgcaccatgtccgcggccgcctacatggacttcgtggctgcccagtgtctggtttccatttcgaaccgcgctgcggtgccggagcatggggtcgctccggacgccgagcggctgcgactacctgagcgcgaggtgaccaaggagcacggtgacccgggggacacctggaaggattactgcacactggtcaccatcgccaagagcttgttggacctgaacaagtaccgacccatccagaccccctccgtgtgcagcgacagtctggaaagtccagatgaggatatgggatccgacagcgacgtgaccaccgaatctgggtcgagtccttcccacagcccggaggagagacaggatcctggcagcgcgcccagcccgctctccctcctccatcctggagtggctgcgaaggggaaacacgcctccgaaaagaggcacaagtgcccctacagtggctgtgggaaagtctatggaaaatcctcccatctcaaagcccattacagagtgcatacaggtgaacggccctttccctgcacgtggccagactgccttaaaaagttctcccgctcagacgagctgacccgccactaccggacccacactggggaaaagcagttccgctgtccgctgtgtgagaagcgcttcatgaggagtgaccacctcacaaagcacgcccggcggcacaccgagttccaccccagcatgatcaagcgatcgaaaaaggcgctggccaacgctttgtgaggtgctgcccgtggaagccagggagggatggaccccgaaaggacaaaagtactcccaggaaacagacgcgtgaaaactgagccccagaagaggcacacttgacggcacaggaagtcactgctctttggtcaatattctgattttcctctccctgcattgtttttaaaaagcacattgtagcctaagatcaaagtcaacaacactcggtccccttgaagaggcaactctctgaacccgtctctgactgttggagggaaggcaaatgcttttgggttttttggtttttgtttttgtttttttttctccttttatttttttgcgggggagggtagggagtgggtgggggggagggggtaaggccaagactggggtagaattttaaagattcaacactggtgtacatatgtccgctgggtgagttgacctgtggcctcgcacagtgattctgggccctttatgcttgctgtctctcagaattgttttcttaccttttaatgtaatgacgagtgtgcttcagtttgtttagcaaaaccactctcttgaatcacgttaacttttgagattaaaaaaaaaaacgccatagcacagctgtctttatgcaagcaagagcacatctactccagcatgatctgtcatctaaagacttgaaaacaaaaaacagttacttatagtcaatgggtaagcagagtctgaatttatactaatcaagacaaacctttgaaaggttacactaagtacagaacttttaaaccttgctttgtatgagttgtactttttgaacataagctgcacttttattttctaatgcagaggatgaataagttaaatacatgctttgaggatagaagcagatgttctgtttggcaccacgttataatctgcttattttacaatatacacgtttccctaagaaatcatggcagagatgtgagggcagaatatacacaacagatgctgaaggagaaggagggtagtgttttgcaaaagaaaaagaaaagaaccaacagaattttaactctattaacttttccaaattttcctatgcttttagttaacatcattattgtatcctaatgccactaggggagagagcttttgactctgttgggttttatttgaatgtgtgcataacagtaatgagatctggaaacacctattttttggggaaaaaggtttgttggtctccttcctgtgttcctacaaaactcccactctcaggtgcaagagttatgtagaaggaaagggagctgaaataggaacagaaaaatcaacccctataactagtgaacaccaagggaaaataccacaatgatttcagaggagactctgcaaaatcgtcccttgtggagaatgcaggcaacatggaatactacgaatgaaatcacatcactgtatcttttacatcaatagcctcaccactaatatatcttgtatctaggtgtctataatggctgaaaccactacatccatctatgccatttacctgaaaacttaactgtggcctttatgaggccagaaaagtgaactgagttttcgtagttaagacctcaaatgaggggagtcagcagtgatcatgggggaaatgtttacattttttttttcttcagaagtaacgctttctgatgattttatctgatatttaaaacagggagctatggtgcactctagtttatacttgcgctctgaaatgtgtaaacatagggtgcctacctatttcacctgacccatactcgtttctgattcagaatcagtgtgggctcctgcagtgggcgcgggtcacggctgactccaacttccaatacaacagccatcactagcacagtgtttttttgtttaaccaacgtagttgtattagtagttctataaagagaactgcttttaacattagggactgggagcagtccatgggataaaaaggaaagtgttttctcacgagaaaacatgtcaggaaaaataaagaacactttctacctctgtttcagatttttgaaacacttattttaaaccaaattttaatttctgtgtccaaaataagttttaaggacatctgttcttccatacgaaataggttaggctgcctatttctcactgagctcatggaatggttctgcttatgatactctgcacgctgccttttagtgagtgaggagtttggggttgcctagcaacttgctaacttgtaaaaagtcatctttccctcacagaaagaaacgaaagaaagcaaagcaaagtcagtgaaagacaatctttatagtttcaggagtaaatctaaatgtggcttttgtcaagcacttagatggatataaatgcagcaacttgttttaaaaaaatgcacaatttacttcccaaaaaagttgttacttgccttttcaagttgttgacaaacacacatttgatattctcttatatgttatagtaatgtaacgtataaactcaagcctttttattctttgtgattaaatcctgttttaaaatgtcacaaaacaggaaccagcattctaattagatttactatatcaagatatggttcaaataggactactagagttcattgaacactaaaactatgaaacaattactttttatattaaaaagaccatggatttaacttatgaaaatccaaatgcaggatagtaatttttgtttacttttttaaccaaactgaatttttgaaagactattgcaggtgtttaaaaagaaagaaaagttgttttatctaatactgtaagtagttgtcatattctggaagcccttcaccattgtggaatgatgccctggctttaaggtttagctccacatcatgcttctcttgagaattctatttggtagttacaattacagaaactgattagtttgtcagtttgcagatagatttagcacagtactcatcactcggatagattgagatgttctttcacatcagatgatctgtaacactgtaagatactgatctttacaactgtttaatcagttttatttttgtacagtattagtgacctaagttattttgctgtcccgtttttgtaaatcaaatgaaattataaaagaggattctgacagtaggtattttgtacatatgtatatatgttgtccaaataaaaataataaatgataaaga

SEQ ID NO: 41893 - DNA, 2681 bp, Homo sapiens
attcttactcatttgtgtttattcttggacttatcctgacataatggggtttttttaattatagattcacactgcatttattcatcacccctgtcctctcatccataactcaaatttactaccagcaacacaaaatacaaagatgtgtccagtttcactacagctcttcgcgtttacaagtgtcgagcgcttgctttcggaacgcccttgtgattggccgagccaatgccagtgacatcaaccaacttacttttgattggaaggctggttgctgggactgtagcgtttgcaggaagtcacttaactgtttgggagctggaaaaccgaagctgaagttctcttttgccataggaacgagcgcaactgactaggaaagatgtgtcccaaagctccgcaagctggaacgtgagccaggaggcccggaccggccacgggaccgcgaggcactccgaaagtgtgcggctgccccttccctgcctcccagctgttacccttttaaatgtcagtgttcgaggctgtaggggtagcacgaggcagcgaaacggaacagtcggattggccgcacgcctcagttctagacgcacctctccaccgaaggccgttctgactggcagggggagaaagtaaacagagttgaatcaccctccccactggccaattggagggggtttggtttgtgacgtgatgggattctgcgaaattgttactgagcaagagaatgccggaacggtgcggaccggccggagcaggggttcagaagccgtcagtggactcgggaaaaagtgtctcttagacctggcgctcggcgggaccctcgccacccgcgtcggggtgatcgggtgaatgtcctggggctttggctcgacggcgaggcggccgagggcgtgcacctctcttgcagtttcctctcccagcgcctcgggggcgttttcagtcgaataaacttgcgaccgccacgtgtggcatctttccaagggagccggctcagaggggccggcgcgcccgtcgggggatcgcggccggcgcggggcaggggcggcggctagaggcggcggcgcggcggagcccggggccgtggatgctgcgtgcggaggcgctgccggttacgtaaagatgaggggctgaggtcgcctcggcgctcctgcgagtcggaagcgccccgcgcccccgcccccttggccgccgcgccgtgccgcgccgcgccgcgctcgtcgtccgaggccagggcagggcgagccgaacctccgcagccaccgccaagtttgtccgcgccgcctgggctgccgtcgcccgcaccatgtccgcggccgcctacatggacttcgtggctgcccagtgtctggtttccatttcgaaccgcgctgcggtgccggagcatggggtcgctccggacgccgagcggctgcgactacctgagcgcgaggtgaccaaggagcacggtgacccgggggacacctggaaggattactgcacactggtcaccatcgccaagagcttgttggacctgaacaagtaccgacccatccagaccccctccgtgtgcagcgacagtctggaaagtccagatgaggatatgggatccgacagcgacgtgaccaccgaatctgggtcgagtccttcccacagcccggaggagagacaggatcctggcagcgcgcccagcccgctctccctcctccatcctggagtggctgcgaaggggaaacacgcctccgaaaagaggcacaagtgcccctacagtggctgtgggaaagtctatggaaaatcctcccatctcaaagcccattacagagtgcatacaggtgaacggccctttccctgcacgtggccagactgccttaaaaagttctcccgctcagacgagctgacccgccactaccggacccacactggggaaaagcagttccgctgtccgctgtgtgagaagcgcttcatgaggagtgaccacctcacaaagcacgcccggcggcacaccgagttccaccccagcatgatcaagcgatcgaaaaaggcgctggccaacgctttgtgaggtgctgcccgtggaagccagggagggatggaccccgaaaggacaaaagtactcccaggaaacagacgcgtgaaaactgagccccagaagaggcacacttgacggcacaggaagtcactgctctttggtcaatattctgattttcctctccctgcattgtttttaaaaagcacattgtagcctaagatcaaagtcaacaacactcggtccccttgaagaggcaactctctgaacccgtctctgactgttggagggaaggcaaatgcttttgggttttttggtttttgtttttgtttttttttctccttttatttttttgcgggggagggtagggagtgggtgcctttatatccaccccctcaacccattaaattacctagtaccactgactttacgtgccctcagcgacaacgtctgcgatacactaatcaacttcctcttaacgatgttaaccagtctctcccccttcgtatgccccaccaccctctacaaacttactatgccctcaagctgttctcccactacctaaaatttgcccgacaatcgcagtttacctccaattcccgcaaactatcctactcgcgtctcgctttctttggagttgacacctcacatcccccctccccctcctcgccttttaaactagcct

SEQ ID NO: 41894 - DNA, 5205 bp, Homo sapiens
attcttactcatttgtgtttattcttggacttatcctgacataatggggtttttttaattatagattcacactgcatttattcatcacccctgtcctctcatccataactcaaatttactaccagcaacacaaaatacaaagatgtgtccagtttcactacagctcttcgcgtttacaagtgtcgagcgcttgctttcggaacgcccttgtgattggccgagccaatgccagtgacatcaaccaacttacttttgattggaaggctggttgctgggactgtagcgtttgcaggaagtcacttaactgtttgggagctggaaaaccgaagctgaagttctcttttgccataggaacgagcgcaactgactaggaaagatgtgtcccaaagctccgcaagctggaacgtgagccaggaggcccggaccggccacgggaccgcgaggcactccgaaagtgtgcggctgccccttccctgcctcccagctgttacccttttaaatgtcagtgttcgaggctgtaggggtagcacgaggcagcgaaacggaacagtcggattggccgcacgcctcagttctagacgcacctctccaccgaaggccgttctgactggcagggggagaaagtaaacagagttgaatcaccctccccactggccaattggagggggtttggtttgtgacgtgatgggattctgcgaaattgttactgagcaagagaatgccggaacggtgcggaccggccggagcaggggttcagaagccgtcagtggactcgggaaaaagtgtctcttagacctggcgctcggcgggaccctcgccacccgcgtcggggtgatcgggtgaatgtcctggggctttggctcgacggcgaggcggccgagggcgtgcacctctcttgcagtttcctctcccagcgcctcgggggcgttttcagtcgaataaacttgcgaccgccacgtgtggcatctttccaagggagccggctcagaggggccggcgcgcccgtcgggggatcgcggccggcgcggggcaggggcggcggctagaggcggcggcgcggcggagcccggggccgtggatgctgcgtgcggaggcgctgccggttacgtaaagatgaggggctgaggtcgcctcggcgctcctgcgagtcggaagcgccccgcgcccccgcccccttggccgccgcgccgtgccgcgccgcgccgcgctcgtcgtccgaggccagggcagggcgagccgaacctccgcagccaccgccaagtttgtccgcgccgcctgggctgccgtcgcccgcaccatgtccgcggccgcctacatggacttcgtggctgcccagtgtctggtttccatttcgaaccgcgctgcggtgccggagcatggggtcgctccggacgccgagcggctgcgactacctgagcgcgaggtgaccaaggagcacggtgacccgggggacacctggaaggattactgcacactggtcaccatcgccaagagcttgttggacctgaacaagtaccgacccatccagaccccctccgtgtgcagcgacagtctggaaagtccagatgaggatatgggatccgacagcgacgtgaccaccgaatctgggtcgagtccttcccacagcccggaggagagacaggatcctggcagcgcgcccagcccgctctccctcctccatcctggagtggctgcgaaggggaaacacgcctccgaaaagaggcacaagtgcccctacagtggctgtgggaaagtctatggaaaatcctcccatctcaaagcccattacagagtgcatacaggtgaacggccctttccctgcacgtggccagactgccttaaaaagttctcccgctcagacgagctgacccgccactaccggacccacactggggaaaagcagttccgctgtccgctgtgtgagaagcgcttcatgaggagtgaccacctcacaaagcacgcccggcggcacaccgagttccaccccagcatgatcaagcgatcgaaaaaggcgctggccaacgctttgtgaggtgctgcccgtggaagccagggagggatggaccccgaaaggacaaaagtactcccaggaaacagacgcgtgaaaactgagccccagaagaggcacacttgacggcacaggaagtcactgctctttggtcaatattctgattttcctctccctgcattgtttttaaaaagcacattgtagcctaagatcaaagtcaacaacactcggtccccttgaagaggcaactctctgaacccgtctctgactgttggagggaaggcaaatgcttttgggttttttggtttttgtttttgtttttttttctccttttatttttttgcgggggagggtagggagtgggtgggggggagggggtaaggccaagactggggtagaattttaaagattcaacactggtgtacatatgtccgctgggtgagttgacctgtggcctcgcacagtgattctgggccctttatgcttgctgtctctcagaattgttttcttaccttttaatgtaatgacgagtgtgcttcagtttgtttagcaaaaccactctcttgaatcacgttaacttttgagattaaaaaaaaaaacgccatagcacagctgtctttatgcaagcaagagcacatctactccagcatgatctgtcatctaaagacttgaaaacaaaaaacagttacttatagtcaatgggtaagcagagtctgaatttatactaatcaagacaaacctttgaaaggttacactaagtacagaacttttaaaccttgctttgtatgagttgtactttttgaacataagctgcacttttattttctaatgcagaggatgaataagttaaatacatgctttgaggatagaagcagatgttctgtttggcaccacgttataatctgcttattttacaatatacacgtttccctaagaaatcatggcagagatgtgagggcagaatatacacaacagatgctgaaggagaaggagggtagtgttttgcaaaagaaaaagaaaagaaccaacagaattttaactctattaacttttccaaattttcctatgcttttagttaacatcattattgtatcctaatgccactaggggagagagcttttgactctgttgggttttatttgaatgtgtgcataacagtaatgagatctggaaacacctattttttggggaaaaaggtttgttggtctccttcctgtgttcctacaaaactcccactctcaggtgcaagagttatgtagaaggaaagggagctgaaataggaacagaaaaatcaacccctataactagtgaacaccaagggaaaataccacaatgatttcagaggagactctgcaaaatcgtcccttgtggagaatgcaggcaacatggaatactacgaatgaaatcacatcactgtatcttttacatcaatagcctcaccactaatatatcttgtatctaggtgtctataatggctgaaaccactacatccatctatgccatttacctgaaaacttaactgtggcctttatgaggccagaaaagtgaactgagttttcgtagttaagacctcaaatgaggggagtcagcagtgatcatgggggaaatgtttacattttttttttcttcagaagtaacgctttctgatgattttatctgatatttaaaacagggagctatggtgcactctagtttatacttgcgctctgaaatgtgtaaacatagggtgcctacctatttcacctgacccatactcgtttctgattcagaatcagtgtgggctcctgcagtgggcgcgggtcacggctgactccaacttccaatacaacagccatcactagcacagtgtttttttgtttaaccaacgtagttgtattagtagttctataaagagaactgcttttaacattagggactgggagcagtccatgggataaaaaggaaagtgttttctcacgagaaaacatgtcaggaaaaataaagaacactttctacctctgtttcagatttttgaaacacttattttaaaccaaattttaatttctgtgtccaaaataagttttaaggacatctgttcttccatacgaaataggttaggctgcctatttctcactgagctcatggaatggttctgcttatgatactctgcacgctgccttttagtgagtgaggagtttggggttgcctagcaacttgctaacttgtaaaaagtcatctttccctcacagaaagaaacgaaagaaagcaaagcaaagtcagtgaaagacaatctttatagtttcaggagtaaatctaaatgtggcttttgtcaagcacttagatggatataaatgcagcaacttgttttaaaaaaatgcacaatttacttcccaaaaaagttgttacttgccttttcaagttgttgacaaacacacatttgatattctcttatatgttatagtaatgtaacgtataaactcaagcctttttattctttgtgattaaatcctgttttaaaatgtcacaaaacaggaaccagcattctaattagatttactatatcaagatatggttcaaataggactactagagttcattgaacactaaaactatgaaacaattactttttatattaaaaagaccatggatttaacttatgaaaatccaaatgcaggatagtaatttttgtttacttttttaaccaaactgaatttttgaaagactattgcaggtgtttaaaaagaaagaaaagttgttttatctaatactgtaagtagttgtcatattctggaaaatttaatagttttagagttaagatatctcctctctttggttagggaagaagaaagcccttcaccattgtggaatgatgccctggctttaaggtttagctccacatcatgcttctcttgagaattctatttggtagttacaattacagaaactgattagtttgtcagtttgcagatagatttagcacagtactcatcactcggatagattgagatgttctttcacatcagatgatctgtaacactgtaagatactgatctttacaactgtttaatcagttttatttttgtacagtattagtgacctaagttattttgctgtcccgtttttgtaaatcaaatgaaattataaaagaggattctgacagtaggtattttgtacatatgtatatatgttgtccaaataaaaataataaatgataaaga

SEQ ID NO: 41895 - DNA, 5151 bp, Homo sapiens
attcttactcatttgtgtttattcttggacttatcctgacataatggggtttttttaattatagattcacactgcatttattcatcacccctgtcctctcatccataactcaaatttactaccagcaacacaaaatacaaagatgtgtccagtttcactacagctcttcgcgtttacaagtgtcgagcgcttgctttcggaacgcccttgtgattggccgagccaatgccagtgacatcaaccaacttacttttgattggaaggctggttgctgggactgtagcgtttgcaggaagtcacttaactgtttgggagctggaaaaccgaagctgaagttctcttttgccataggaacgagcgcaactgactaggaaagatgtgtcccaaagctccgcaagctggaacgtgagccaggaggcccggaccggccacgggaccgcgaggcactccgaaagtgtgcggctgccccttccctgcctcccagctgttacccttttaaatgtcagtgttcgaggctgtaggggtagcacgaggcagcgaaacggaacagtcggattggccgcacgcctcagttctagacgcacctctccaccgaaggccgttctgactggcagggggagaaagtaaacagagttgaatcaccctccccactggccaattggagggggtttggtttgtgacgtgatgggattctgcgaaattgttactgagcaagagaatgccggaacggtgcggaccggccggagcaggggttcagaagccgtcagtggactcgggaaaaagtgtctcttagacctggcgctcggcgggaccctcgccacccgcgtcggggtgatcgggtgaatgtcctggggctttggctcgacggcgaggcggccgagggcgtgcacctctcttgcagtttcctctcccagcgcctcgggggcgttttcagtcgaataaacttgcgaccgccacgtgtggcatctttccaagggagccggctcagaggggccggcgcgcccgtcgggggatcgcggccggcgcggggcaggggcggcggctagaggcggcggcgcggcggagcccggggccgtggatgctgcgtgcggaggcgctgccggttacgtaaagatgaggggctgaggtcgcctcggcgctcctgcgagtcggaagcgccccgcgcccccgcccccttggccgccgcgccgtgccgcgccgcgccgcgctcgtcgtccgaggccagggcagggcgagccgaacctccgcagccaccgccaagtttgtccgcgccgcctgggctgccgtcgcccgcaccatgtccgcggccgcctacatggacttcgtggctgcccagtgtctggtttccatttcgaaccgcgctgcggtgccggagcatggggtcgctccggacgccgagcggctgcgactacctgagcgcgaggtgaccaaggagcacggtgacccgggggacacctggaaggattactgcacactggtcaccatcgccaagagcttgttggacctgaacaagtaccgacccatccagaccccctccgtgtgcagcgacagtctggaaagtccagatgaggatatgggatccgacagcgacgtgaccaccgaatctgggtcgagtccttcccacagcccggaggagagacaggatcctggcagcgcgcccagcccgctctccctcctccatcctggagtggctgcgaaggggaaacacgcctccgaaaagaggcacaagtgcccctacagtggctgtgggaaagtctatggaaaatcctcccatctcaaagcccattacagagtgcatacaggtgaacggccctttccctgcacgtggccagactgccttaaaaagttctcccgctcagacgagctgacccgccactaccggacccacactggggaaaagcagttccgctgtccgctgtgtgagaagcgcttcatgaggagtgaccacctcacaaagcacgcccggcggcacaccgagttccaccccagcatgatcaagcgatcgaaaaaggcgctggccaacgctttgtgaggtgctgcccgtggaagccagggagggatggaccccgaaaggacaaaagtactcccaggaaacagacgcgtgaaaactgagccccagaagaggcacacttgacggcacaggaagtcactgctctttggtcaatattctgattttcctctccctgcattgtttttaaaaagcacattgtagcctaagatcaaagtcaacaacactcggtccccttgaagaggcaactctctgaacccgtctctgactgttggagggaaggcaaatgcttttgggttttttggtttttgtttttgtttttttttctccttttatttttttgcgggggagggtagggagtgggtgggggggagggggtaaggccaagactggggtagaattttaaagattcaacactggtgtacatatgtccgctgggtgagttgacctgtggcctcgcacagtgattctgggccctttatgcttgctgtctctcagaattgttttcttaccttttaatgtaatgacgagtgtgcttcagtttgtttagcaaaaccactctcttgaatcacgttaacttttgagattaaaaaaaaaaacgccatagcacagctgtctttatgcaagcaagagcacatctactccagcatgatctgtcatctaaagacttgaaaacaaaaaacagttacttatagtcaatgggtaagcagagtctgaatttatactaatcaagacaaacctttgaaaggttacactaagtacagaacttttaaaccttgctttgtatgagttgtactttttgaacataagctgcacttttattttctaatgcagaggatgaataagttaaatacatgctttgaggatagaagcagatgttctgtttggcaccacgttataatctgcttattttacaatatacacgtttccctaagaaatcatggcagagatgtgagggcagaatatacacaacagatgctgaaggagaaggagggtagtgttttgcaaaagaaaaagttagttaacatcattattgtatcctaatgccactaggggagagagcttttgactctgttgggttttatttgaatgtgtgcataacagtaatgagatctggaaacacctattttttggggaaaaaggtttgttggtctccttcctgtgttcctacaaaactcccactctcaggtgcaagagttatgtagaaggaaagggagctgaaataggaacagaaaaatcaacccctataactagtgaacaccaagggaaaataccacaatgatttcagaggagactctgcaaaatcgtcccttgtggagaatgcaggcaacatggaatactacgaatgaaatcacatcactgtatcttttacatcaatagcctcaccactaatatatcttgtatctaggtgtctataatggctgaaaccactacatccatctatgccatttacctgaaaacttaactgtggcctttatgaggccagaaaagtgaactgagttttcgtagttaagacctcaaatgaggggagtcagcagtgatcatgggggaaatgtttacattttttttttcttcagaagtaacgctttctgatgattttatctgatatttaaaacagggagctatggtgcactctagtttatacttgcgctctgaaatgtgtaaacatagggtgcctacctatttcacctgacccatactcgtttctgattcagaatcagtgtgggctcctgcagtgggcgcgggtcacggctgactccaacttccaatacaacagccatcactagcacagtgtttttttgtttaaccaacgtagttgtattagtagttctataaagagaactgcttttaacattagggactgggagcagtccatgggataaaaaggaaagtgttttctcacgagaaaacatgtcaggaaaaataaagaacactttctacctctgtttcagatttttgaaacacttattttaaaccaaattttaatttctgtgtccaaaataagttttaaggacatctgttcttccatacgaaataggttaggctgcctatttctcactgagctcatggaatggttctgcttatgatactctgcacgctgccttttagtgagtgaggagtttggggttgcctagcaacttgctaacttgtaaaaagtcatctttccctcacagaaagaaacgaaagaaagcaaagcaaagtcagtgaaagacaatctttatagtttcaggagtaaatctaaatgtggcttttgtcaagcacttagatggatataaatgcagcaacttgttttaaaaaaatgcacaatttacttcccaaaaaagttgttacttgccttttcaagttgttgacaaacacacatttgatattctcttatatgttatagtaatgtaacgtataaactcaagcctttttattctttgtgattaaatcctgttttaaaatgtcacaaaacaggaaccagcattctaattagatttactatatcaagatatggttcaaataggactactagagttcattgaacactaaaactatgaaacaattactttttatattaaaaagaccatggatttaacttatgaaaatccaaatgcaggatagtaatttttgtttacttttttaaccaaactgaatttttgaaagactattgcaggtgtttaaaaagaaagaaaagttgttttatctaatactgtaagtagttgtcatattctggaaaatttaatagttttagagttaagatatctcctctctttggttagggaagaagaaagcccttcaccattgtggaatgatgccctggctttaaggtttagctccacatcatgcttctcttgagaattctatttggtagttacaattacagaaactgattagtttgtcagtttgcagatagatttagcacagtactcatcactcggatagattgagatgttctttcacatcagatgatctgtaacactgtaagatactgatctttacaactgtttaatcagttttatttttgtacagtattagtgacctaagttattttgctgtcccgtttttgtaaatcaaatgaaattataaaagaggattctgacagtaggtattttgtacatatgtatatatgttgtccaaataaaaataataaatgataaaga

SEQ ID NO: 41896 - DNA, 5151 bp, Homo sapiens
attcttactcatttgtgtttattcttggacttatcctgacataatggggtttttttaattatagattcacactgcatttattcatcacccctgtcctctcatccataactcaaatttactaccagcaacacaaaatacaaagatgtgtccagtttcactacagctcttcgcgtttacaagtgtcgagcgcttgctttcggaacgcccttgtgattggccgagccaatgccagtgacatcaaccaacttacttttgattggaaggctggttgctgggactgtagcgtttgcaggaagtcacttaactgtttgggagctggaaaaccgaagctgaagttctcttttgccataggaacgagcgcaactgactaggaaagatgtgtcccaaagctccgcaagctggaacgtgagccaggaggcccggaccggccacgggaccgcgaggcactccgaaagtgtgcggctgccccttccctgcctcccagctgttacccttttaaatgtcagtgttcgaggctgtaggggtagcacgaggcagcgaaacggaacagtcggattggccgcacgcctcagttctagacgcacctctccaccgaaggccgttctgactggcagggggagaaagtaaacagagttgaatcaccctccccactggccaattggagggggtttggtttgtgacgtgatgggattctgcgaaattgttactgagcaagagaatgccggaacggtgcggaccggccggagcaggggttcagaagccgtcagtggactcgggaaaaagtgtctcttagacctggcgctcggcgggaccctcgccacccgcgtcggggtgatcgggtgaatgtcctggggctttggctcgacggcgaggcggccgagggcgtgcacctctcttgcagtttcctctcccagcgcctcgggggcgttttcagtcgaataaacttgcgaccgccacgtgtggcatctttccaagggagccggctcagaggggccggcgcgcccgtcgggggatcgcggccggcgcggggcaggggcggcggctagaggcggcggcgcggcggagcccggggccgtggatgctgcgtgcggaggcgctgccggttacgtaaagatgaggggctgaggtcgcctcggcgctcctgcgagtcggaagcgccccgcgcccccgcccccttggccgccgcgccgtgccgcgccgcgccgcgctcgtcgtccgaggccagggcagggcgagccgaacctccgcagccaccgccaagtttgtccgcgccgcctgggctgccgtcgcccgcaccatgtccgcggccgcctacatggacttcgtggctgcccagtgtctggtttccatttcgaaccgcgctgcggtgccggagcatggggtcgctccggacgccgagcggctgcgactacctgagcgcgaggtgaccaaggagcacggtgacccgggggacacctggaaggattactgcacactggtcaccatcgccaagagcttgttggacctgaacaagtaccgacccatccagaccccctccgtgtgcagcgacagtctggaaagtccagatgaggatatgggatccgacagcgacgtgaccaccgaatctgggtcgagtccttcccacagcccggaggagagacaggatcctggcagcgcgcccagcccgctctccctcctccatcctggagtggctgcgaaggggaaacacgcctccgaaaagaggcacaagtgcccctacagtggctgtgggaaagtctatggaaaatcctcccatctcaaagcccattacagagtgcatacaggtgaacggccctttccctgcacgtggccagactgccttaaaaagttctcccgctcagacgagctgacccgccactaccggacccacactggggaaaagcagttccgctgtccgctgtgtgagaagcgcttcatgaggagtgaccacctcacaaagcacgcccggcggcacaccgagttccaccccagcatgatcaagcgatcgaaaaaggcgctggccaacgctttgtgaggtgctgcccgtggaagccagggagggatggaccccgaaaggacaaaagtactcccaggaaacagacgcgtgaaaactgagccccagaagaggcacacttgacggcacaggaagtcactgctctttggtcaatattctgattttcctctccctgcattgtttttaaaaagcacattgtagcctaagatcaaagtcaacaacactcggtccccttgaagaggcaactctctgaacccgtctctgactgttggagggaaggcaaatgcttttgggttttttggtttttgtttttgtttttttttctccttttatttttttgcgggggagggtagggagtgggtgggggggagggggtaaggccaagactggggtagaattttaaagattcaacactggtgtacatatgtccgctgggtgagttgacctgtggcctcgcacagtgattctgggccctttatgcttgctgtctctcagaattgttttcttaccttttaatgtaatgacgagtgtgcttcagtttgtttagcaaaaccactctcttgaatcacgttaacttttgagattaaaaaaaaaaacgccatagcacagctgtctttatgcaagcaagagcacatctactccagcatgatctgtcatctaaagacttgaaaacaaaaaacagttacttatagtcaatgggtaagcagagtctgaatttatactaatcaagacaaacctttgaaaggttacactaagtacagaacttttaaaccttgctttgtatgagttgtactttttgaacataagctgcacttttattttctaatgcagaggatgaataagttaaatacatgctttgaggatagaagcagatgttctgtttggcaccacgttataatctgcttattttacaatatacacgtttccctaagaaatcatggcagagatgtgagggcagaatatacacaacagatgctgaaggagaaggagggtagtgttttgcaaaagaaaaagaaaagaaccaacagaattttaactctattaacttttccaaattttcctatgcttttagttaacatcattattgtatcctaatgccactaggggagagagcttttgactctgttgggttttatttgaatgtgtgcataacagtaatgagatctggaaacacctattttttggggaaaaaggtttgttggtctccttcctgtgttcctacaaaactcccactctcaggtgcaagagttatgtagaaggaaagggagctgaaataggaacagaaaaatcaacccctataactagtgaacaccaagggaaaataccacaatgatttcagaggagactctgcaaaatcgtcccttgtggagaatgcaggcaacatggaatactacgaatgaaatcacatcactgtatcttttacatcaatagcctcaccactaatatatcttgtatctaggtgtctataatggctgaaaccactacatccatctatgccatttacctgaaaacttaactgtggcctttatgaggccagaaaagtgaactgagttttcgtagttaagacctcaaatgaggggagtcagcagtgatcatgggggaaatgtttacattttttttttcttcagaagtaacgctttctgatgattttatctgatatttaaatagggtgcctacctatttcacctgacccatactcgtttctgattcagaatcagtgtgggctcctgcagtgggcgcgggtcacggctgactccaacttccaatacaacagccatcactagcacagtgtttttttgtttaaccaacgtagttgtattagtagttctataaagagaactgcttttaacattagggactgggagcagtccatgggataaaaaggaaagtgttttctcacgagaaaacatgtcaggaaaaataaagaacactttctacctctgtttcagatttttgaaacacttattttaaaccaaattttaatttctgtgtccaaaataagttttaaggacatctgttcttccatacgaaataggttaggctgcctatttctcactgagctcatggaatggttctgcttatgatactctgcacgctgccttttagtgagtgaggagtttggggttgcctagcaacttgctaacttgtaaaaagtcatctttccctcacagaaagaaacgaaagaaagcaaagcaaagtcagtgaaagacaatctttatagtttcaggagtaaatctaaatgtggcttttgtcaagcacttagatggatataaatgcagcaacttgttttaaaaaaatgcacaatttacttcccaaaaaagttgttacttgccttttcaagttgttgacaaacacacatttgatattctcttatatgttatagtaatgtaacgtataaactcaagcctttttattctttgtgattaaatcctgttttaaaatgtcacaaaacaggaaccagcattctaattagatttactatatcaagatatggttcaaataggactactagagttcattgaacactaaaactatgaaacaattactttttatattaaaaagaccatggatttaacttatgaaaatccaaatgcaggatagtaatttttgtttacttttttaaccaaactgaatttttgaaagactattgcaggtgtttaaaaagaaagaaaagttgttttatctaatactgtaagtagttgtcatattctggaaaatttaatagttttagagttaagatatctcctctctttggttagggaagaagaaagcccttcaccattgtggaatgatgccctggctttaaggtttagctccacatcatgcttctcttgagaattctatttggtagttacaattacagaaactgattagtttgtcagtttgcagatagatttagcacagtactcatcactcggatagattgagatgttctttcacatcagatgatctgtaacactgtaagatactgatctttacaactgtttaatcagttttatttttgtacagtattagtgacctaagttattttgctgtcccgtttttgtaaatcaaatgaaattataaaagaggattctgacagtaggtattttgtacatatgtatatatgttgtccaaataaaaataataaatgataaaga

SEQ ID NO: 41897 - DNA, 5204 bp, Homo sapiens
attcttactcatttgtgtttattcttggacttatcctgacataatggggtttttttaattatagattcacactgcatttattcatcacccctgtcctctcatccataactcaaatttactaccagcaacacaaaatacaaagatgtgtccagtttcactacagctcttcgcgtttacaagtgtcgagcgcttgctttcggaacgcccttgtgattggccgagccaatgccagtgacatcaaccaacttacttttgattggaaggctggttgctgggactgtagcgtttgcaggaagtcacttaactgtttgggagctggaaaaccgaagctgaagttctcttttgccataggaacgagcgcaactgactaggaaagatgtgtcccaaagctccgcaagctggaacgtgagccaggaggcccggaccggccacgggaccgcgaggcactccgaaagtgtgcggctgccccttccctgcctcccagctgttacccttttaaatgtcagtgttcgaggctgtaggggtagcacgaggcagcgaaacggaacagtcggattggccgcacgcctcagttctagacgcacctctccaccgaaggccgttctgactggcagggggagaaagtaaacagagttgaatcaccctccccactggccaattggagggggtttggtttgtgacgtgatgggattctgcgaaattgttactgagcaagagaatgccggaacggtgcggaccggccggagcaggggttcagaagccgtcagtggactcgggaaaaagtgtctcttagacctggcgctcggcgggaccctcgccacccgcgtcggggtgatcgggtgaatgtcctggggctttggctcgacggcgaggcggccgagggcgtgcacctctcttgcagtttcctctcccagcgcctcgggggcgttttcagtcgaataaacttgcgaccgccacgtgtggcatctttccaagggagccggctcagaggggccggcgcgcccgtcgggggatcgcggccggcgcggggcaggggcggcggctagaggcggcggcgcggcggagcccggggccgtggatgctgcgtgcggaggcgctgccggttacgtaaagatgaggggctgaggtcgcctcggcgctcctgcgagtcggaagcgccccgcgcccccgcccccttggccgccgcgccgtgccgcgccgcgccgcgctcgtcgtccgaggccagggcagggcgagccgaacctccgcagccaccgccaagtttgtccgcgccgcctgggctgccgtcgcccgcaccatgtccgcggccgcctacatggacttcgtggctgcccagtgtctggtttccatttcgaaccgcgctgcggtgccggagcatggggtcgctccggacgccgagcggctgcgactacctgagcgcgaggtgaccaaggagcacggtgacccgggggacacctggaaggattactgcacactggtcaccatcgccaagagcttgttggacctgaacaagtaccgacccatccagaccccctccgtgtgcagcgacagtctggaaagtccagatgaggatatgggatccgacagcgacgtgaccaccgaatctgggtcgagtccttcccacagcccggaggagagacaggatcctggcagcgcgcccagcccgctctccctcctccatcctggagtggctgcgaaggggaaacacgcctccgaaaagaggcacaagtgcccctacagtggctgtgggaaagtctatggaaaatcctcccatctcaaagcccattacagagtgcatacaggtgaacggccctttccctgcacgtggccagactgccttaaaaagttctcccgctcagacgagctgacccgccactaccggacccacactggggaaaagcagttccgctgtccgctgtgtgagaagcgcttcatgaggagtgaccacctcacaaagcacgcccggcggcacaccgagttccaccccagcatgatcaagcgatcgaaaaaggcgctggccaacgctttgtgaggtgctgcccgtggaagccagggagggatggaccccgaaaggacaaaagtactcccaggaaacagacgcgtgaaaactgagccccagaagaggcacacttgacggcacaggaagtcactgctctttggtcaatattctgattttcctctccctgcattgtttttaaaaagcacattgtagcctaagatcaaagtcaacaacactcggtccccttgaagaggcaactctctgaacccgtctctgactgttggagggaaggcaaatgcttttgggttttttggtttttgtttttgtttttttttctccttttatttttttgcgggggagggtagggagtgggtgggggggagggggtaaggccaagactggggtagaattttaaagattcaacactggtgtacatatgtccgctgggtgagttgacctgtggcctcgcacagtgattctgggccctttatgcttgctgtctctcagaattgttttcttaccttttaatgtaatgacgagtgtgcttcagtttgtttagcaaaaccactctcttgaatcacgttaacttttgagattaaaaaaaaaaacgccatagcacagctgtctttatgcaagcaagagcacatctactccagcatgatctgtcatctaaagacttgaaaacaaaaaacagttacttatagtcaatgggtaagcagagtctgaatttatactaatcaagacaaacctttgaaaggttacactaagtacagaacttttaaaccttgctttgtatgagttgtactttttgaacataagctgcacttttatttcctcttgctgagtttgtctcttttaattcctttcttactcttaaccctttttttcttttctcccctccttccttctcttccttattttacaatatacacgtttccctaagaaatcatggcagagatgtgagggcagaatatacacaacagatgctgaaggagaaggagggtagtgttttgcaaaagaaaaagaaaagaaccaacagaattttaactctattaacttttccaaattttcctatgcttttagttaacatcattattgtatcctaatgccactaggggagagagcttttgactctgttgggttttatttgaatgtgtgcataacagtaatgagatctggaaacacctattttttggggaaaaaggtttgttggtctccttcctgtgttcctacaaaactcccactctcaggtgcaagagttatgtagaaggaaagggagctgaaataggaacagaaaaatcaacccctataactagtgaacaccaagggaaaataccacaatgatttcagaggagactctgcaaaatcgtcccttgtggagaatgcaggcaacatggaatactacgaatgaaatcacatcactgtatcttttacatcaatagcctcaccactaatatatcttgtatctaggtgtctataatggctgaaaccactacatccatctatgccatttacctgaaaacttaactgtggcctttatgaggccagaaaagtgaactgagttttcgtagttaagacctcaaatgaggggagtcagcagtgatcatgggggaaatgtttacattttttttttcttcagaagtaacgctttctgatgattttatctgatatttaaaacagggagctatggtgcactctagtttatacttgcgctctgaaatgtgtaaacatagggtgcctacctatttcacctgacccatactcgtttctgattcagaatcagtgtgggctcctgcagtgggcgcgggtcacggctgactccaacttccaatacaacagccatcactagcacagtgtttttttgtttaaccaacgtagttgtattagtagttctataaagagaactgcttttaacattagggactgggagcagtccatgggataaaaaggaaagtgttttctcacgagaaaacatgtcaggaaaaataaagaacactttctacctctgtttcagatttttgaaacacttattttaaaccaaattttaatttctgtgtccaaaataagttttaaggacatctgttcttccatacgaaataggttaggctgcctatttctcactgagctcatggaatggttctgcttatgatactctgcacgctgccttttagtgagtgaggagtttggggttgcctagcaacttgctaacttgtaaaaagtcatctttccctcacagaaagaaacgaaagaaagcaaagcaaagtcagtgaaagacaatctttatagtttcaggagtaaatctaaatgtggcttttgtcaagcacttagatggatataaatgcagcaacttgttttaaaaaaatgcacaatttacttcccaaaaaagttgttacttgccttttcaagttgttgacaaacacacatttgatattctcttatatgttatagtaatgtaacgtataaactcaagcctttttattctttgtgattaaatcctgttttaaaatgtcacaaaacaggaaccagcattctaattagatttactatatcaagatatggttcaaataggactactagagttcattgaacactaaaactatgaaacaattactttttatattaaaaagaccatggatttaacttatgaaaatccaaatgcaggatagtaatttttgtttacttttttaaccaaactgaatttttgaaagactattgcaggtgtttaaaaagaaagaaaagttgttttatctaatactgtaagtagttgtcatattctggaaaatttaatagttttagagttaagatatctcctctctttggttagggaagaagaaagcccttcaccattgtggaatgatgccctggctttaaggtttagctccacatcatgcttctcttgagaattctatttggtagttacaattacagaaactgattagtttgtcagtttgcagatagatttagcacagtactcatcactcggatagattgagatgttctttcacatcagatgatctgtaacactgtaagatactgatctttacaactgtttaatcagttttatttttgtacagtattagtgacctaagttattttgctgtcccgtttttgtaaatcaaatgaaattataaaagaggattctgacagtaggtattttgtacatatgtatatatgttgtccaaataaaaataataaatgataaaga

SEQ ID NO: 41898 - DNA, 430 bp, Homo sapiens
tttatgtttccaacggcctcagagtcccttgagaaaactggtctttcaacttttccttgtaaaccctctttctacagataaagtccttcagaagtctgcaaggtcatattagggaccagtttctccaacttacactttgctcctcctcgctttccccaagacacagttttctgttcttcaccagaaacccttacacaaattaacttatacatcccagagttaggctcaagttattgatgcacttgctcaatgtgtacacatacacagatatacacatatttatcttaaccacttgtatgcatatgtgtttgtgtctatttctttaaacaaggtagggttatgtagtgatgactagaatatgagaaaaatatgtgtaatgaaaaaacattctaatatgtaatgctgtcaaaagcttacagataattccatc

SEQ ID NO: 41899 - DNA, 428 bp, Homo sapiens
atctcgctcgctctgtcacccaggctggagtgcagtggtgtgatcatggcttactgcagcctcaaactccttggctcaaataacccttccacctcagcctcctgagtaggtggaactatagacacacaccaccatgcctgctaattattttttattgtagagatgggggtcttgctatgttgcccaggctgacctcaaactcctggcctcaagcaattctcccacctcatcctcccaaagtgctgagattacaagtgtaagccactgcattcggcctccagctttcttttgattagtgtttgtgtggtctttcaatctatctccttatgtttcagtgttttagatatgccaccatatgcagcatagagctggattctaaaaaatccaatctaacaatatgtattttaaatagcacacatagactttta

SEQ ID NO: 41900 - DNA, 366 bp, Homo sapiens
ataaaggcaattcaaagattaacaattatttttgtatatactacataataaagccaaagaaatacactaacaaattttaaaaacatttaaaaccaatggttgattcaatgcctttgtagttttcctcttggttttactgatcacttttggtaactttcctctttttctattcaaggttctgggtggggtaatttttaggggcttgaaatatataatcttgatattggaaacatttccaattctcctcttccctgccacataacatgctgtcttagtgaacacttctaaacaaatttgaacccacgaagacccaagggcatcattatggacctcagttgttatgaattctggatagagcagatgagg

SEQ ID NO: 41901 - DNA, 410 bp, Homo sapiens
tctacaagccagaaggcctaacagtaagagttagaatcctagtcagactgcctaggttcaaatcccggttccagcagttcactgtgggaccttggacaagttattgacctgagattgttacctcatgttactcaggaagtaaatggaaatgctaatagcacccactggagggccatggtgaggattatttgagacaatgcaagcaaagcagttagcacagtgccccgcacacaataggagctggtacttgttagcaactgctgatcttgtggccccaacattgctccttcatcccctgttctctagatccaggactcaaaccatgtgttctggaactaattcctggaaataatagaccagaaatatgtatagtgagtgactatgaaaacaagactagctgggtgtggtgg

SEQ ID NO: 41902 - DNA, 1252 bp, Homo sapiens
gaactctggaaactgcatattttctcacacaataattgaatcatactttgaaactattgtaaattgactagagtactcggtctaggccaccccttgcccttgaagagctcagaatagcagagtgtgggagaataactttgattgtatgtttgtggtgcctgaggaaactatctcaaagtactcacggatcatacccttacacaggccccactgtgagctacagcaagacaagccccccaaagcatgagcacaaacaggggtgctcaccctgctctgtccttcaccaaactgcatcactttggaatgcagcagctggagctataactaatatctgaagctaccacaattgccttaaattgtattcttagcaatgagttaagcttactgccttcacttagcaaatatttgtcagtgcgcgatgtgtaccaggcaccatgatagacaggtagacactgtgtagacaaggtaaaatagcccatttgtattcctgacattatctgtttgtcgataaaatttgtcactaattggctttgcttttttgtttcccaccaaaaactgaacttgtagaattgagttatttatgttgcaggcagtatcactttaatagtactcacacttatttaagcttggaaaataatattttaccaattctttgatactttgtggtcccttaaatttaaccatctctgggacctatgttggagtgcagtggctcaatcatagctcactgcagcctactgggtagctgggactataggcacgcattaccacactctgctaattttttcactttttgaagagacacggtctccctatattgcccagcctggtctccaactcccggactcaagcgatcctcccgcctcagcctctcaaagtgctgggattacaggggtgatctaccacccagccccaccttcttgaggagttaggtttcaccttggagatcagtgcttcttatctataaaatttccctggagagctatgatgaggtttggaaacctggacttaaaacaatttttttcccccagatattcttaggatagctcgattcactgtcataacaatgtttggagactatacatatatataggtacgtatacattctcttctcaaaagaagcttcatgacttccatcaatttctgggtaacctctgacctctctaatatgagaaaactacatcagtaaatgagtggccttcaaatacatttacaaataattcacaggcaaaactgttttacatcacatagc

SEQ ID NO: 41903 - DNA, 424 bp, Homo sapiens
ggccaggagggcagaggcacactccatcttcgtgctcctcacaggccctgcctccctgcctgctaaggacacagggaagggggtccccacctcagtgcctgcctcccttccctgtgcctgtgtacctggcagtcacagccacctggcgtgtcccagaaaccaaccggctgacctcatctcctgcccggccccacctccattggctttggcttttggcgtttgtgctgcccgaccctttctcctgtccggatgcgcagggcagggcctgagccgtcgagctgcacccacagcaggctgcctttggtgactcaccgggtgaacgggggcattgcgaggcatcccctccctgggtttggctcctgcccacggggctgacagtagaaatcacaggctgtgagacagctggagcccagctctgcttgaa

SEQ ID NO: 41904 - DNA, 554 bp, Homo sapiens
cccccagccccccacgtctcgttctggaccaggaaccccctccccaacaaccgcgcagcaagtggcgactctgggagctgaactggagtggagctcgaagtggctggggcgggcaaagactcccgcttcactctgggacacaactgggacggcgcttcaacctctgcctgcaggcgtgcttctcgcgcgcaccagcaagctctctatccacctcgcctgggcctttgcagcgccctgccgcccaggctccagcgcctctactaccctagccccttctcaacacgcggctctgccttcttccccagtaccactgcactgccgaaaataagcccggagactaaggcaccttgtagggaagagaaggacatctgtatctccaagcttatccaagcaaaggcctccagagtccctcccatggcccgaaacacctccctctgaccgaagagcgtcctttctttccgccgcctcctggactcatcctaaatagggcagacccgggctaaaccagtgatttttttccatgaatacgaagaaccccgattgcactttgcgaa

SEQ ID NO: 41905 - DNA, 1531 bp, Homo sapiens
cccaagttccacattagatcacgcagtgtagggtgtagtggatgctgagactctgcccagatatccctcccaggactaagatgctcatttcccccagtggctgggtgtgtcggttgctgatggctccagccatcttctctaaggattatccttgtatataccttctgtatcatgccccccaggttgagattcaaaaaacaaacatccacagttttttcataacattctgctgtgtcccttcccagttaagtcactaaaagatgactgtcgactgccgtaaattagttttacctatgttcttaaaattttaacaattgaattactcagtatgtactcttttgtcttctttctctcaataaagtgcctatgagattcatctaccttgttccatgtgtcagtagttcataatttttattgttgtctagtatccccttgtatcaatgcactacaatttatttatccattctcctattgagggacatttgtgttgtttccagttgttggatatatgcattgtcaatctcttcaatcagtctgtggcttgtcttttcactttcctggtgatgtcttttaatagtcttattttaattaagttaaacatttttttcttttatgattatcttttgttttgtctcttcaagaactcttttcctacacctgaggctttaaaagatactgatggccaggactcactcagaccaattaaatcaggattatgggcatttttaaaaaaagcttctcaggtgatcctaaagtataactagatttgagaaccagaagactcagactgtgagcttcttgagggtagaaattgtgactgcttgtttatacagctcaggactcaatgctggacaccgtggtgcttcataatcaccgggtgatttttgatgaatttaattcatctctccaagatcatctcaaattccatgttttctaagaatccttcacattattaccaataggtcttattctcagaatattttgccctataagtgtttcttaattgctgttattagtccattttcacactactatacagaactacctgagactgggtaacttataaagaaaagaggtctaattgactcacagttccacctggctggggaggcctcaggaaacttacaatcatggcggaagtcaaaggggaagcaatacatgccttacatggcacaggagagagagtgcaaagtgggaggtgccacacacttttaaaccatcagatctcgtgagaactcactcatgagccatcactagggcgatggtactaaacaattagaaaccacccccatgatctaatcacttcccaccaggccccaccttcaacacgtgggaattacagtttgagatgagatttgggtggggagacagagccaaaccatatcaattgctttaagtatttacaccttctctccccaatcaatttgcaaaactgttaggataaagaatgtttacgggaagcccttattgtctctttctcctgtttctatgaggagatttggctccaatctctggaaggaatattatcttt

SEQ ID NO: 41906 - DNA, 1476 bp, Homo sapiens
cccaagttccacattagatcacgcagtgtagggtgtagtggatgctgagactctgcccagatatccctcccaggactaagatgctcatttcccccagtggctgggtgtgtcggttgctgatggctccagccatcttctctaaggattatccttgtatatactcataacattctgctgtgtcccttcccagttaagtcactaaaagatgactgtcgactgccgtaaattagttttacctatgttcttaaaattttaacaattgaattactcagtatgtactcttttgtcttctttctctcaataaagtgcctatgagattcatctaccttgttccatgtgtcagtagttcataatttttattgttgtctagtatccccttgtatcaatgcactacaatttatttatccattctcctattgagggacatttgtgttgtttccagttgttggatatatgcattgtcaatctcttcaatcagtctgtggcttgtcttttcactttcctggtgatgtcttttaatagtcttattttaattaagttaaacatttttttcttttatgattatcttttgttttgtctcttcaagaactcttttcctacacctgaggctttaaaagatactgatggccaggactcactcagaccaattaaatcaggattatgggcatttttaaaaaaagcttctcaggtgatcctaaagtataactagatttgagaaccagaagactcagactgtgagcttcttgagggtagaaattgtgactgcttgtttatacagctcaggactcaatgctggacaccgtggtgcttcataatcaccgggtgatttttgatgaatttaattcatctctccaagatcatctcaaattccatgttttctaagaatccttcacattattaccaataggtcttattctcagaatattttgccctataagtgtttcttaattgctgttattagtccattttcacactactatacagaactacctgagactgggtaacttataaagaaaagaggtctaattgactcacagttccacctggctggggaggcctcaggaaacttacaatcatggcggaagtcaaaggggaagcaatacatgccttacatggcacaggagagagagtgcaaagtgggaggtgccacacacttttaaaccatcagatctcgtgagaactcactcatgagccatcactagggcgatggtactaaacaattagaaaccacccccatgatctaatcacttcccaccaggccccaccttcaacacgtgggaattacagtttgagatgagatttgggtggggagacagagccaaaccatatcaattgctttaagtatttacaccttctctccccaatcaatttgcaaaactgttaggataaagaatgtttacgggaagcccttattgtctctttctcctgtttctatgaggagatttggctccaatctctggaaggaatattatcttt

SEQ ID NO: 41907 - DNA, 372 bp, Homo sapiens
ttttcgacatggagtcttgctctgtcgcccaggctggagtgcagcggtgtgatctcagcttaccacaacctccacctcccgggttcaagtgattctcccacgtcaacctcccgagtagctgggattaccaggcacccgccaccacacctggctacttttttggtatttttttttagtagagaaagggtttcaccatgttggtcaggctggtcttgaactcctgacctcaggcgatccgctgcctcagcctcccagagtgctgggatgacaggcttgagcccccgcgcccggcccctactttctgtctcagggtctgtgccttacttcagactcataccatgtctcttctggactcttgccttgtagtcgacg

SEQ ID NO: 41908 - DNA, 351 bp, Homo sapiens
tcgcccgcccctgtcttttcggggtcgagtccgagggggaagaggtttgttaatacgttcgccatgtgctacgatcttgggacgaactgagccacgagcgtggctttgagggccgtccgaacgctgcaggccggccaggtccctgggcgtccaggcctggcctacgcaccactttgtcccttagcgtttaaaggtttcttcccgaatctcaggccctcagctacctgcaggtttcgtcgcgagccggctgcaagttttgaacctaagtaaacctcaatccggagggcctagcggtaaggtgggcgctgtgtctattgaggtgcttagcaataaagaaaggtagtgagttga

SEQ ID NO: 41909 - DNA, 995 bp, Homo sapiens
  misc_feature (403)..(403): n is a, c, g, or t
tcgcccgcccctgtcttttcggggtcgagtccgagggggaagaggtttgttaatacgttcgccatgtgctacgatcttgggacgaactgagccacgagcgtggctttgagggccgtccgaacgctgcaggccggccaggtccctgggcgtccaggcctggcctacgcaccactttgtcccttagcgtttaaaggtttcttcccgaatctcaggccctcagctacctgcaggtttcgtcgcgagccggctgcaagttttgaacctaagtaaacctcaatccggagggcctagcggtaaggtgggcgctgtgtctattgaggtgcttagcaataaagaaaggtagtgagttgaaaaaaaaaaaacaaaaaaaaaaaaaaaaaaaaacacaaaaaaaaaaaacaanacacacaaccaccaccccacaacaaacaacacaaaaaaacaaccacagacacacacgacgggggaccaaaacaacaagaacgaagagggcagaacgagcacaggaaaaagaacagaaaacctacaagcgaggagcacaaacggggggacagaaaagaggagagacgaaacaacagcaagagaagaagaagcgaaacacaggaaagaagaagaaagccacacaacccacagagaggagggaagggaaccgagccgaagagacagatgcccaccgatagcgaaacagagccgatagcgagggagaaaacagcaaccgccgagcagggcagctggagcggaacatgaccgacaacacagcacccagagacagtcgacaacaaagcacactacgagtggaccaacgcaaccacggacaaagagcgacgcggaacgcgcgccaacgcccggcagcgccccgagacagagcgcggcgcgacaaccagcggcgaaaaagaggcacgagccgtcggacgtgggaacgaccaggcacggaggcgaacagcgaacgtcgtggtgccacacgcacaagcgagggcagaagacacgaggcgcag

SEQ ID NO: 41910 - DNA, 571 bp, Homo sapiens
tcgcccgcccctgtcttttcggggtcgagtccgagggggaagaggtttgttaatacgttcgccatgtgctacgatcttgggacgaactgagccacgagcgtggctttgagggccgtccgaacgctgcaggccggccaggtccctgggcgtccaggcctggcctacgcaccactttgtcccttagcgtttaaaggtttcttcccgaatctcaggccctcagctacctgcaggtaagactgggccgggcttgggttcccttattctcccagtctgtgatgaattgctttgacttctgacacctcgtatgaaaactgcacgtgcagtctgattatttagcaagactgaggcttgagggtgcgcactcctgacggggagctgagagtggaaacaggtgttgcccgaaacgaaggagtggggacttaatgtctgtattttggcgctgactttcaggtttcgtcgcgagccggctgcaagttttgaacctaagtaaacctcaatccggagggcctagcggtaaggtgggcgctgtgtctattgaggtgcttagcaataaagaaaggtagtgagttga

SEQ ID NO: 41911 - DNA, 214 bp, Homo sapiens
ctactaaatgcaggccgcgtcgaccgaatctcaggccctcagctacctgcaggtttcgtcgcgagccggctgcaagttttgaacctaagtaaacctcaatccggagggcctagcggtaaggtgggcgctgtgtctattgaggtgcttagcaataaagaaaggtagtgagttgaaataaagacagtaaagtcgaccggccgcgaatttagtagta

SEQ ID NO: 41912 - DNA, 173 bp, Homo sapiens
ctactaaatgcaggccgcgtcgaccgaatctcaggccctcagctacctgcaggtttcgtcgcgagccggctgcaagttttgaacctaagtaaacctcaatccggagggcctagcggtaaggtgggcgctgtgtctattgaggtgcttagcaataaagaaaggtagtgagttga

SEQ ID NO: 41913 - DNA, 446 bp, Homo sapiens
gggactggccatcctgctcctctcccctctgcaaagtggacagagctcctccccttcctgctgtgtgttgcccgttttgaaatcttactcccatccccaaagtatgcttttggataccaggtgaaggggaaggatggtgatggtggggaacagctgttttaatttgcctcaggcctatgaatctccctacctgaaccccagcttgccatagagtctaactggtccgtggtcagaaggtgggctccatagctgtctgggggttggggctccctcccccatttctgagcattcccagggtttgggagtctgcttatgattctctgccagaggcacggccaccagccctgagtgtgggaaacaatggggacagatgggttggttcaaggcctttgggcagctggtggtgggtcttggagagctgggaaccccttcctagggaggctgga

SEQ ID NO: 41914 - DNA, 379 bp, Homo sapiens
aagatttagtgaaatccaggggaaaagcctaattcacacaaacatatttcaaataaacccccccaataatcactggcacatatgccttgactcttattgttggtgtttcttggaaatctgtgtgtgtgtgtgttttttttttctgcagaagtaaaaagcatctttaggtttaggtctgtttttgttttgggtttgtggagggctggtgaaggaccttttttttagacaataatagaaatatattcatgtggcctggtgcagtggctcacgcccgtaatcctaatactttgggaggccgaggtgggcggatcgtttgaagtcagaagttcgagaccagcctggccaacatggtgaaaccccgtctctactaaaaatacaa

SEQ ID NO: 41915 - DNA, 383 bp, Homo sapiens
gttttttatatgaaatctgcatggccccttctttgtgtggggggttggagatggggagggcattgacagaagggttggagatcaagctttagagggacttggaacagatgggcacatcacctctctggggcccctgaatttgagagctctgctcccagccttttcccaccaggggagctcatgactggctgtcttctactgtgtgctccagtttatctccaagggtcaagcaaccccaccttgagagctccctacctaggctcatgtgaaaagcaaaggactatgtgatgaggatgaatggatacagcgtttgacctgctagggtgaggcaagtgaattgagaagttcctgactttcctcattgccaactagtcatgttcctc

SEQ ID NO: 41916 - DNA, 389 bp, Homo sapiens
gaatagtgaaatttcacctgatttaaggaaagcctaaatggttaaatgttaaacaatgtgtttttaccatgtataacatcacctaattatttgaatccaaccctttgttttaatacatgagtgagttgacccatatatttagttttagtatactcatcaccccataaatttctgttgatgatataagcattacgtgtgatataggctgtggactggtatttacatatgcttcaaaatttcaatactcatgctaggaaattgcttggtctatgcttttttgccttggtgtgactttttgccttaagtattattattatctttattatggcataaagcagtattttatacactaactccttttatttatttatttttgagaccctgtctca

SEQ ID NO: 41917 - DNA, 501 bp, Homo sapiens
gaagttccacaggtgattttgatgtgtgagccgtggttgaaagccacagctggactgcgttggaagggaaatggaggtcagcttaggccagttggttcacatggaaatcaacaaaaccagcgtggctttgaaggatgtataattctgttactctttgttggacccacacaactcagcagttgaaatttattattagtttttttttctcctgcgttttcatctcctaatttgggctccccttcatatagagcttttggaagcaagtaagaattcaagttcatcaggcacattttcactacacctggcagaacatattaaggtgttgtgttttataaaatccagccagaaactataggtggtctccagctccacacacttagcaaggcccctgctcaactccccacccaaccccagttttccagtccttcctgcgttcaccagaggcacagtcaggatcaccttagacgctgagttcagaaatggagaaggaatacagttaaa

SEQ ID NO: 41918 - DNA, 704 bp, Homo sapiens
taaatttatgtggctatttgactatttgtcttagaccagccttttgctcattccagtaaccacacataccacatagttcactgatgcaaatcctctgcgatgaacaggagatggggacagaaaaaataaatggcgatattttaagggtttagagcactctgaatgttcattcagacaatgcttgccccaaattctaatctccctctgattttgttccattttgtaatgaagactttgggaagtggtgagaggtcctgggcagtgggggaaacagggtacagccctgtggaccactgaatggactgtcttgagttgacagcattacttttgggtcagcatgacagagttctgctggctttcaccaccagcagctctgtgatcttgggtaagtcaccacaccttttgcagccttaatttgcttatctgtatttcaaagagtcctgctggatgagtatttctccaagtcctgccaatcaccatcacctagagcttgttaaaaaatgtggcctctggcctaaaagcaatggcaacaaaagccaaaatagacaaacgggatctaactaaactaaagagcttctgcacagcaaaagaaactaccatcagagtgaataggcaacctacagaatgggagaaaatttttgcaatctacccatctgacaaagggctaatatccgaatctacaaagaacttaaataaatttacaa

SEQ ID NO: 41919 - DNA, 426 bp, Homo sapiens
ggagacattttagcatatatgaattttctaaaaatatagttttatttgtaaaaattgctttgctttacatcataaaagtttgtcattacatatctattaattgctacaactggataatattttgtgataattagagatatagcagttatagaggggtgctattagcaaatggattcaagattaaataaaagagatatgtgtatggatatagaactgattcagaagcaagaaccatccacttaaatattcatgctgtttcattcctgttatgttggaactgcagaaactataggcctatggaaacgggcctaaccttagtagattttccatgtcctaattttcttaaagttgagaactcttcagccagatagaactgccttttgcattcagtccttgatataaaaagaagttcttagtagaaatgtc

SEQ ID NO: 41920 - DNA, 512 bp, Homo sapiens
tctcttcttcggcctcttgaacctggtgccgtccccattggagtcagtaggggtttggcacaatactgtgctctcccgtgcctcagcctcctcatcaggctatgggccactttgagacagaactagccttcgaagggagcagtgcaggcagcaccccacgtgggctgtgaggcagctgggcttcacagagttcctggtagcattcgaggctcttcctgtcagccctgcagcctggagctgagacagtatccttttcagttggggtcccactatgagcatctgtttgtcattggtggtggccgtgcactgtaattctcttctgcgaagtgatagttgttgtgacttgctatttctgtgccctgtgtggccagtggagccccacatgttccctgaagagccctggccctttcatacaactggacttggatcctcccacgcacacagtaggttgtccagttccttcatactcctccagcctgggtgacagagtgagatccgtctcaaaaaaaaaa

SEQ ID NO: 41921 - DNA, 354 bp, Homo sapiens
gacatactaccctgtacagttattatacatgacatacatagcatacacattacacactctccataaaatatttctactggaaagaaaagtaaactgtaaaataatgcctatgtctaaggttacttagacataacaagagttcatgacaagagatctttgtaaactttattgacttttcaaaaatgttttctttgttattaaattaggattacaaatttgttaaatatctttggctaattttcaagattaaaaatttttaaatatacacttgaacaaacatgtcctggagaagcaaattaaggtacaaaataaagggcagtttatagataatgcatctcatttcaatagaacttt

SEQ ID NO: 41922 - DNA, 377 bp, Homo sapiens
atggggagagcaacaggaggttcacaaaacagagcagatcagggatggctgctctggtcttccgggatgtgcagggccaccaaccctttctggccccttcccccgcatgtcctcctgatgctcctccctgcctctgccccgagctctgggccctctctgtcctcctctcctgccagttcacccctgatgatattcctatttaaaaataaatcactgcagtctttaattgcagactaaataattgcttcattttatttaaatgtggctcttggaggctctggaaacaattagaagaaaacatagggcagtgctgggtgcatgttttcaagcatataatttttttttgttattatcataccgacgttcgtaggatctgg

SEQ ID NO: 41923 - DNA, 278 bp, Homo sapiens
aattcagattgaactgggtgtcttatatttttatttgataaatctggcaaccctacatcaagacaaaatagcctgcgcccaggcagcaatttatctgatttttctttaaataactgcccaaagcactccaagagagctagcttcacatctagttgcttatacagtatatacagaacataagtatttcaaccttgcaaaacttagcacattttatgcatcatatcttactactattgtattagtaatatctgtttaatatacctaagtctgtttagccc

SEQ ID NO: 41924 - DNA, 448 bp, Homo sapiens
tagtagtcaaaaatagaaacaacctatatgtctgtcaatgatgattgtgtaaataaagtgtgatatatttatacaatggaattttattcagtgatgaaaatgaatgaagtactgatacaacctggaagacccttgaacacattgttaagtgaaagaagtaagtcagaaaagactatttattgtattgattttgcttatatgaaatgtccagaataggcaaatccatagaaaatagattcgtctttccaaaggttggtggatggttgggaagaaataaggggtaattgttaaaagggtactgtgtttctttttggggtaatgaaaaggttctaaagttgattgtggttatgtttggacaactgtgaatatactgaaaaccagggaattgtatgtactttaaaccagtcagttgtatggtatgtcgattatatcttaattaggctgttag

SEQ ID NO: 41925 - DNA, 304 bp, Homo sapiens
gagaccgaggcaggagactcgcttgaactctggaggcagaggttgcagtgagcagagattccaccactgcactccagcctgggcagaaaagggagaccctatctcaaaaaaagtaataataataaagaaagaaagaaagaaaggaaataaataaataaaagaaaagcagggtcccctgcttagcaggggtttatggttttgatgggggaaacaaggaaagcaacaagcaatagaggggatcccagggaatcatgggtacacagaggtgggacattctacttagactgcagaggaaggcaaccag

SEQ ID NO: 41926 - DNA, 244 bp, Homo sapiens
ctaatggggtcataccctatactcagaggccaagaagaatctaactaacaggccttgctaagttccccccaggctattaccattaggttatatccccttctttttcctccacaactatctacttcattcatcagacttagcagaaacatagaattttccctgggactttgagtcttcatttctgaagactcatgtgtcatgtaaaattttggttaaatacatttattatgcttttctctcgtta

SEQ ID NO: 41927 - DNA, 865 bp, Homo sapiens
ttggagcgttcgtgtcctgcgccgcgttggtgtgtttcgtccccactgtgcctgtaggagggcaccgggtccccgtctatcctacttcatggctgaggaagctaaggcacagagtggccccgtcctgcgcccagggctctgcgttggcacagggcagagctgggctgtgaatcagggccgccttgtctcttgctgtggtgtgaggctgtgggagactcaggaatgaggcacagccaggtgcccagtgcccgtgggacccgcctccccacagtggggtggcgccgctcacacctggtaatttcacgctgggggaggccttggttcctatagcccatctcgaatcacctggatcccagggctatctctggggaacatctcctctccatcacgactactgtctttttcaccagcattttctatcctaaaatcagactcctcagctgagggccctccaggaccgcccttccccagctggaggtaaccagatttctcgtgtatgctaggaagttccccttctggtcacacctcaatatttcctgctgctggtgggaactgcaggtgcttgtacttgtcaccttctccccgtcctctctcgtcagttcccttggatgctggacacgggagccacctgggcgaggggagcccatccaagtggctgtgcgtcgggaagagtctgcccaggactgggctagaccagaacttagaattaaggagtggtggccaggcttggtggctcacacctgcaatcccagcactttgggaggccgaggcgggtggatagcttgagcctaggagtttgagaacagccaacatggcgaaactctgtctcttaaaaaataaataaaaacattagccaggtgtggtg

SEQ ID NO: 41928 - DNA, 168 bp, Homo sapiens
aaccaattcccactgcctcccttgtgaccagttgggtcatgcccccacccttctgtgccctagtcctggtccttggaacacctgagtcatgtcacttctctgcgtcaaccctctagtggctctccccattcactcagagtgaaaagcagagtccttgaaatggccagc

SEQ ID NO: 41929 - DNA, 683 bp, Homo sapiens
ggatcgactgatcacagagtcttggttttaatctaggtgtaccacttactggctgttaacagtgtgtcttagttaattcctgagtttgtatcttatttttcagcataatttttaggaaaagcactttgtaaactatgaagtgctatagaatattggttatgatgagggcctcggacttactggtataatccagaccttctcatgggtttattttccttgtttagttgctgtgtttttgatttcttcttttttcacagtatgacttaccctccatcccatgccctcctccagagttctctactccctctcagatggcagctcttcaaatctttgtttatgtactgatgggacaaggctcaagcacccacttcttctctttcagctgttacatttgaacagctttctagatcatatttctctaggacttctatgtttaatagtgggcatttcaaggtttagttttgaatcaggttgacagggcagtggttttgttcttaataacaaaatcactttaggataattagaaccgtatagcaatttaaccttcaaatcacactacttttggctggtcgcagtggctcatgcctgttatcttagcactttgggaagctgaggtgggaggatcactcaagcccaggagtttgagaccagcttggtcaacacagcaagaccctgtttcttta

SEQ ID NO: 41930 - DNA, 459 bp, Homo sapiens
gtgaatgaatgaataagtgaatgattgcagagttctatacagaatcaaggacaaattcccacagcatgccatgaaatgttcatttttaggctgatttaaacctgatcatctcagaactttggttgcagttaagtcattggttcattcactttgtcatttatccacctatttattctatacaggagtcatttctttatttgtttctttgtaaaatttattgagtacttaaaatgctgcaaagtcactgaggtaaaggctatggggaaagacaaaggccacgatggaggtatagaaaaaatgctttcaggattcagagaagcaaaatcatttccatagctcagagaggatgatggtggtgggagttaacatggatgagtgaagggggtagtagtgggcaaacgttttccttctttaattttaattggatcaattaaataaataaatttgatttgggccttg

SEQ ID NO: 41931 - DNA, 446 bp, Homo sapiens
ataaaaccaagtaaatgtaactgtagctggctagacttcttgtagcagagaacaggactaggctcaccatgtgaaactgggtgaagatagaaagtgtcaggaaaaattacaaaagacttcgaaatggataaaaaagattagtgggtgtcctgtctagctttaccatcctggttatctccagaggctttgcaactctcaaagacagtaaattctgaaaaaccggtaatagtgccaatgattcttgctcacaaaagtgcaattgacttgtgtctggtgaaatgtaatggattatggtattggagatagaccagttttttaaatctgtttgtaaattcatttcaacatttctttatgcatataaacatgtgcttctttgaaacaactgtaacatcttaccggttccctcattagttaatgaattaaataaaatatttgacaagcatgga

SEQ ID NO: 41932 - DNA, 751 bp, Homo sapiens
gtggggctgagacttcgcgtcttaacaagctgctctcagttgatgctgatcctcatggtccaatgtatgacaatgctgttgaatgtgcctcttcatttcagcacactgccttcaggcagggaatgggccactcctggcaccctgcacattttagcatttgtttcctgtctctccccactagaatgcaagctgcagaggaattgtatccgtagcacctggcttcgcagaccaagagcaagtcggcacaccaggacaggcactcgcatgggtgcccagaagtttcaagatctgaccttggagagaccaggtccgggaggctgccgggaagtctccatcacaccggcctcagccgagtcacaggaacgcaggctctgccatgcccagaagcctgagatgcaacttcaaggacaacgggagccagaacgcttgacctcacacggaaggtgactcctaaccaccaccacacttgacgtagcaccagcacacggagattaggcctacaccaatggctaattgagaccatgcatcactattaaggcatcttcagcaaaaggaactatggaagttctgcatgaaacatagacacctgttagaaaaggaactaaatttcaaaccgggaatgtggtgttgaatcacagcaaagtgtccagaaggaactcccaaagtactgttttccaaaatatagaatgatatagaagattgttttaggtggaattcctggaaataaatttttaaatgttaaaatttgact

SEQ ID NO: 41933 - DNA, 389 bp, Homo sapiens
ggctggagtgcagtgatgtgatatcccctcactgtaacgtctgcctctcaggttcaagtgagtctcctgcctcagtctcccgagtagctgtgactacaggcgtacaccatcacacccagctaatttttgtatatttagtagagatggggtttcgccatcttggccaggctggtcttgaactcctgacctcaagtgaaccacctaccttggcttcccaaagtgctgggattacaggtgtgagccactgtgcctggcctcaagccagggcttttgggcttcaaagccatattaatcatcatcatacggggtccccataactctcccatcacatccaaagaatttcagctattctcacctagtttagaaactaacccactctccgggttaaa

SEQ ID NO: 41934 - DNA, 435 bp, Homo sapiens
tgatccgcccacctcggcctcccaaagtgctgggattacaggcgtaagctaccatgcccagccaagtattctattcttaatgaacacatatatgcataatatatctattttttataatatatatatttagaattgaatgtcagagtacatatcagtgttggaggaagggaataaggaggaagcacagaaagtaaaaaggaaaaataggcaccaaaaaagatttggagaatggcagatggccaaggagatgcagctgggaagtgcctcttccatggagaggaacataatatctagtaaaccttcacattttaaacagatcttttgagagaaaacactgaaagttgacacagaggtgacacagacaccatggttgaagagggaagaaatggggcagtctgctcagagtcactagacaccaggactggcccatatacc

SEQ ID NO: 41935 - DNA, 431 bp, Homo sapiens
ctcgatgcaaaaggcaatattaaaagagaatgaaaagaacacaatggatactagaaaacaaaaagtaatgtgtattcaacttatcaataataaatgttaatgaatttaatcaggcagagactatcagattggattaaaaatacattccaactctatgttatctatgctcccatagataacacactttaggctcaaagacacagatagattaaaaggatacaaaaagaaatagtgcaaacaattgccataagaaagctggactggctatactagtgtcagacaaagtagactttaagacaaaaatgctcctagagatagagacattttataatgataaaaaggttaacccatcaaaaagatataacagttgtaaacatatgtatgaacttaacagtatcaaaacacagaaagcaaaaactgacagaaatgga

SEQ ID NO: 41936 - DNA, 497 bp, Homo sapiens
tctgcccgcctcggcctcccaaagtgctgggattacaggtgtgagccatcgtgcccggcctgggattatatttttaaatggaaactacaccctgtatgagtgacttttaagccagagactgaggtgcattagttggttataattaatatagttgcctgcaatcagcatttgaagaaaatgaagtagaattaaaaatcagtaggctgggcctaatgggttatgcttctaatcccagcactttgggaggcctaggcaggaggattgcttgacgtcaggagtttaacatcatcttgagcaacatagtaagatgctatcaaaaaaataaaataaaatagatatgcatggtggcatgtgcctgtagtcctagctactcaagcagctgaatgagatgtgctgtgggaggatcgcttcagcctgggaggtagatgctgcagtgggttacgatagtaccactgcactccagcctgggtaacagaatgagacgctgtcctaaaaca

SEQ ID NO: 41937 - DNA, 320 bp, Homo sapiens
atcaagcatttatccagactttcctatatacaatataccttaaggtaggcagatagttgatacagggaaattataagtaatccaactaacccataaagaaggaaaaatagaattataaaagtaacattttataaccccttaacctctaatgaaatgctgtaattatctaggcaataattataattactaatttaaaaaaattaaaaagaggtaaacagacttgtgatggaaatttacatcacccataaagtatttttgacaaaacaatttgatctagcctttttgttgctagtcaccaaatatgtcccacctctcctcag

SEQ ID NO: 41938 - DNA, 228 bp, Homo sapiens
gctaagtcaatggattctccctgaaagagggacacagctctgctgataccttgattttagcagggtaagacctatttcatacttcttaactacagtggtgtaagtttttttaggctgccccatttgtggcaatttgttataacagccatagaaaatgaatataaggagcatttgctccttatagtacagtgagtataaatcagcctgacttacaacctgttgatctgg

SEQ ID NO: 41939 - DNA, 330 bp, Homo sapiens
tagagtatcagcagagcaggcgacactgtgcttgggtaggcttttaccatgctgttcttcacactggaaattggtcagagtgttgctgtttattagctatacctaggaatttaatgatgtatcctttttctagtgatttaaatggacataattgcaggaaaggttggtaattcagcaagaagattacttagaaaacttttagaattggtttcatgatgctagggacatttctgatttctgtccatggtggcataggacatccatatgaagttgtagctatcacaacatgcatcttttaatctggagactgagaaaatattctgcctggtg

SEQ ID NO: 41940 - DNA, 480 bp, Homo sapiens
ctctattaaaaatacaaaaattagctgggtgtggtggtatgtgcctgtaatcccagcaactcgggaggctgaggcaggagaatcgcttgaacccaagaggcagagattgcagtgagccgagatcacgccattgcactccagcctggcgacagaacaagacttcatttcaaaaaaaaaaaaggaagaaacaagggctcagacacgtgacaaagtgacagagggagggttatggggtgggggaggcttatcttggggtaacttgtaagctgaggtctgaaggatgaatagaaacgtcctctatcggctggtcatgggattgcacacctgtaacccgggagctccgggaggcccaggcaggaggactgcttgagtccaggagttcaagaccagcctgggcaatatagcaagatcccatctctactaaattaaaaaaaaaattttttttaaagaaacctcttctatcccgtcacttctgtaatc

SEQ ID NO: 41941 - DNA, 413 bp, Homo sapiens
aaacaaagctggctttgccccagcctcagtggttctgattaattcagtaggtctggggtggagcctgagaatttgcatttctactaagttcccaagtgacactaattctgtctgtggaccatactttaaaaaccagctgggtgtggtggctcaccctgtaatgccaacacttggggaggctgacatgggaggattgcttgaggccagaatttcaagaccagcctgggcagcatagcaagaccccatctctaaaaaaaaaaaaaatagccaggcacggtatacctgtagacctaactactcaggaggctgaaaatttagagcccctttcaagaccctaggaggagggctagcaattagatcacatggtttatataaaatgattttgcaaaaggaagataaattttgtattctta

SEQ ID NO: 41942 - DNA, 400 bp, Homo sapiens
tgaagctgtggttttaaaatatacactcaaaaatgttggctcggcacccacgaggcccaggaggttgtccagatgcactgggtctggggctgctcccagcagcctttcagtgcccccgcccccaccgctggcctttggggatagatggaatgggcaggagttgctgtaagagactggtccaaccacaggcaagcttctggccaaatattttaaattcgactctgagaaactagcaggaatcttgttctggtggcttcccaagcacacactcagggatcagaacctgcagaagcagaattcccagtttcagataaaatgttcattcatctccaatatgcagtgctggtccccatcgcccttccatccatgctgaaagtgtgtgcagcacggtacttaggga

SEQ ID NO: 41943 - DNA, 284 bp, Homo sapiens
caggtacagtctgtcatggcagactgtcaaagggaaatcctccgaccccttgtgcttcctgggtgaggcgatgccccacccagcttcggctcaccctccgtggcctccacccactgtccaaccagtcccagtgagatgaaccaggtacctcaattggaaatgcagaaatcacttgtcttctgcattggtcatgttgggagctgcagaccggagctgttcctatttggccatcatggaatggaaggtgatttttttttaactgtttaatcagccctgcatttctg

SEQ ID NO: 41944 - DNA, 643 bp, Homo sapiens
ttctatggcatatagaggccttaacaaataatacccaaaaggccctaaatgatagctgcatggctatctctttgctaaacaatgaggactcacgtataagaaaaaccatgctgcaaaattgtatggcgttagatatgctcactgcagcccaaggtggaacctttgccacaatcaaaactgaattttggatttatatcttagaggaatcaaatgacaaaacctgacttatgactgacataaaaacccagataaccaacctgtcagatccaaagcccttacgaatcgactagttgagtggtttgtttggatcctggggaacttggtggcagaagctattgctcataataggaatcataataataatttgtgttctgtcctgtttttttacttaggttgtcgtaatggtatgtgcttgcaactaagacaatgtgcaactgagaagtctagagtaatggttgcccaaagaagtgctctaactgaggaggcagtagcatagcctgaaccaacttccaggtgcagaacagaggacagaaatcaaagtcatctctctgctcacctgagacaaacacatatctgactgcttcttctgccatattgtctatgttgtcttatgttaaaataaagattcactgagccagacaaa

SEQ ID NO: 41945 - DNA, 519 bp, Homo sapiens
ctttcctttttgttcagtcctaaatttttaaaatgaaagtaacgtattatttctcttgatagatactgtcatgagagtacgtagatatgacctattgctaaaagtctagaatgtaatatccaaactgtgttccttttggagcatctcaggaagccataacgctggagatgcattctaacaagtgagctaaacactcgagggcacatgtccacttattttaggcaaaaaagtactattgaatcgacttattcaaataatgaagtctaagtctcagtttttctttattttctagactactgcctgaattcttgtttctctttttctaacagactctatgtattttcatattttcattgagaaatcgttttttgaaggcttactgttgtctggtactggattagatggggtaaggaggtgtaaggaactagacactcccatcccccactctcaccgcccatacacaaataatccccatacctaaaagatttacagaaacttactaaatctttctgcagttgc

SEQ ID NO: 41946 - DNA, 439 bp, Homo sapiens
tcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaaaaaaaaaaagaggccatttaaaaagcaatgaaataatattaaattaaatcatgaatatttattaaagaatgtgtacatttgaatatacatgtttgagttaaagtgcattcagtaaatcacttttatttttacaccatcaaccgagagctctccatgaaagcttttactccacgtacttcatctcttcttgaggtattacgtcttctgcatcatcttatgcaaccattcacaggaagaacattgctacaatgtttgcattatctttttggtcccacaagcca

SEQ ID NO: 41947 - DNA, 438 bp, Homo sapiens
tgaacatttcctcaaattattttctgattttgctttgctcagttgtctttagtgctaggttttgggacccagagcgttaacagtctttcctaaggagtcctgactagcactgtagtgcttaagaagaacaaaggtgttgggggggtgtctgttagagggcggcagagccccttctcatccctcagcccattcagttcccatgaccactctgggagggggaggtgttttcagatgaggaccctgagattctaaaggttgtgggatttgccacagtcacctctcaggtaagggcgcaactgcgaccgactgtttcgggtttcctgccttcacagtctgggttctttccaccacagcgcgatagaaccctgtcattgcaccagtaattgtttgctttctctggacttgttttgggaccctcagctccataagggatgttag

SEQ ID NO: 41948 - DNA, 575 bp, Homo sapiens
ggggtggggagggggctagatgctcggggtccaggcctgtgaacagtagcagttgtttcatactgaggtggacaaactctgtaaagggccaagtcgtgaatattttcatctttgcaggccataaagctgactgcagctacccagttctgctgggtagcgtccataggcaatgcatacataaagcagtggggctgtgtttcaataaagctttgtttatggacaccaaaatttgaaccttatgtaattttcacagatcacaaaatattaattttttaaccacttaaaatgtaaaaaccaggccaagcatgatggctcacgcctataacctctgcactttagaaggccaaggcaggaaaatcacttgaggccaggagttcgagacgagcctgggaaacatagccagacctcatctcttaaaaaaaaaaaaaaaaaaaaaaaattagctgggtgcagtgcacctgtaccccacctactcgaggtgagaggatcacctgaccccaggaggttgaggctgcagtgagccatgatcacaccactgtactccagcctgggcaacaaagtgaaaccctgtctca

SEQ ID NO: 41949 - DNA, 347 bp, Homo sapiens
tctccagccaattcccctcctctgaagaagggtggaatttaaagggtgttggtagagaagcctgcatcctgaattgttttggtttttgtgatactggtttctacttctgaggcccaaagaaaaggaaaatcacttgaggccaggagttcgagacgagcctgggaaacatagccagacctcatctcttaaaaaaaaaaaaaaaaaaaaaaaattagctgggtgcagtgcacctgtaccccacctactcgaggtgagaggatcacctgaccccaggaggttgaggctgcagtgagccatgatcacaccactgtactccagcctgggcaacaaagtgaaaccctgtctca

SEQ ID NO: 41950 - DNA, 1680 bp, Homo sapiens
aggaagctcccacagtgagagaaattacaagcagtctctgacgggggctggtcctctctgtggcctttagtagggtgatcctcttgggtggaggtggcagtaattcttggctgccttcccagtgtgggcagcatcttgcctaagctcaccacagaatacgtgtttgtccaaatgttacactacaagccatatagtgtggactgcttgcttttcattaatgggttctcagtcttcccattgtctctctttgtaggtattttcccccaggtcatggattgatgtctaactccaaatcaatttttaagcttaaatttcaacaaagaaagtgcttataaccacttgtcatcctcaattatccattgtgaggaggtggatgtaagatgacttctggaggccagtacttcctaatgattaagagcccacgctctagagtcaaaatgatgtaggcacaaatcctggcttccccacttattgtgtgatcttcagcaagttactcacctcggctttctcatctatacaattatgagtacctatctcaaagggttgctatgagcattaaatgagttaatgaacataaagcattcatcacttaccatgcttggcacatggtaagtgctcagcaaatgttaattgttgctagatctattgtgggcaatgatatttacacttcttggacaaaattggtttgatggtgccttagaggttaggatgtttctagatcaacgctggaagaaccaggatcaaagtgtggtctgggagtcaaagtcatgaatgaaaatgaagcaagccagaacctcatcagtggtgtccatgaatctgaaggtacagatgagggttggacctggagtctcaaaagagaagggtcagaaaactgaaactcaacatgtgtccagcactattcagttttatctcataatcaagcctccaaaatccaaacacattgtcagcatctgctttgaaggtaagcattgcaggtaggatgaggcaacccaaagatggcattgagaaagaggcagagcctcttggacactgtgcctggtgagtgtgggttggtgggggaaaggcaggtgatcattctgatacagggccttggggttaactagttttagttgtcctgtgacacttttgggaaagtcttcaaacctttgtgagatttaattccttatcaataaaatgtgggtaataaaaatatcaccccatagggttttttgtaaagatcaagtgaaactagctttgtaaactatcaactatcataaaaatataaagattcataattataaaaaaaaaggttggtcctatttctttaaaaattggtgcatacttccatttttttaaaggtgagtagatgtgaatgaaaattaaagtgcttattcagaaagcataaatggcttagccagaaattgggtttgacagtaaatgttgaacattatgccttgggaacttaagattctcagaatgctgcctcatccagccttgagtcctactttcttaaaacccaatcaatcccgttttcagtagattcctccacacacctcatgtccatttgctgtctggctcggctgaatcattgaaatgagtaataggcactgaaatgaaagacaccatatgaatcttgtaaaacctgaaaagaaacaagtgcgagacagtgaacagtcctggtgagtctgagaactggcagaa

SEQ ID NO: 41951 - DNA, 1626 bp, Homo sapiens
aggaagctcccacagtgagagaaattacaagcagtctctgacgggggctggtcctctctgtggcctttagtagggtgatcctcttgggtggaggtggcagtaattcttggctgccttcccagtgtgggcagcatcttgcctaagctcaccacagaatacgtgtttgtccaaatgttacactacaagccatatagtgtggactgcttgcttttcattaatgggttctcagtcttcccattgtctctctttgtaggtattttcccccaggtcatggattgatgtctaactccaaatcaatttttaagcttaaatttcaacaaagaaagtgcttataaccacttgtcatcctcaattatccattgtgaggaggtggatgtaagatgacttctggaggccagtacttcctaatgattaagagcccacgctctagagtcaaaatgatgtaggcacaaatcctggcttccccacttattgtgtgatcttcagcaagttactcacctcggctttctcatctatacaattatgagtacctatctcaaagggttgctatgagcattaaatgagttaatgaacataaagcattcatcacttaccatgcttggcacatggtaagtgctcagcaaatgttaattgttgctagatctattgtgggcaatgatatttacacttcttggacaaaattggtttgatggtgccttagaggttaggatgtttctagatcaacgctggaagaaccaggatcaaagtgtggtctgggagtcaaagtcatgaatgaaaatgaagcaagccagaacctcatcagtggtgtccatgaatctgaaggtacagatgagggttggacctggagtctcaaatctcataatcaagcctccaaaatccaaacacattgtcagcatctgctttgaaggtaagcattgcaggtaggatgaggcaacccaaagatggcattgagaaagaggcagagcctcttggacactgtgcctggtgagtgtgggttggtgggggaaaggcaggtgatcattctgatacagggccttggggttaactagttttagttgtcctgtgacacttttgggaaagtcttcaaacctttgtgagatttaattccttatcaataaaatgtgggtaataaaaatatcaccccatagggttttttgtaaagatcaagtgaaactagctttgtaaactatcaactatcataaaaatataaagattcataattataaaaaaaaaggttggtcctatttctttaaaaattggtgcatacttccatttttttaaaggtgagtagatgtgaatgaaaattaaagtgcttattcagaaagcataaatggcttagccagaaattgggtttgacagtaaatgttgaacattatgccttgggaacttaagattctcagaatgctgcctcatccagccttgagtcctactttcttaaaacccaatcaatcccgttttcagtagattcctccacacacctcatgtccatttgctgtctggctcggctgaatcattgaaatgagtaataggcactgaaatgaaagacaccatatgaatcttgtaaaacctgaaaagaaacaagtgcgagacagtgaacagtcctggtgagtctgagaactggcagaa

SEQ ID NO: 41952 - DNA, 216 bp, Homo sapiens
agtgatggaaacaggaggtgcatgactatattagtttgctaaggctgcaaataacaaattaccaaaaattcagtggctgaaaatagaaatttattgtcatacggttctggaaaccagaagaagatcaaggtgtcagcgcagccatgctccctctgatggctctaggggagaaggcttccttgttcttttccacctcctggtggctccaggcctctt

SEQ ID NO: 41953 - DNA, 507 bp, Homo sapiens
agaatgtctttgaaatgtgaaggcaaacttaagtattgaaaactattttgtcctccagtcttacttgaatctccttcctgatgtggcccttccgtttgctacatcctgagtataattttaatttattaaaaaaatggctgcactagctggaagaagccagctaaattgcagatggtgtgagaggtttgtttaccaacccaataaacttagtggctcaagacttttgaaaggatcttgagaaacaatggctctcttcctatactctgagctagaatggccattgtcaggtacataagttgatttaatcttcagattcagcctaagccttaagctgaatttttgctgtggagccttttcttaatttctctaatgtttaaaatagccagtcaattctctaccttttttttttttaactttcctaccttgtttggagggtttatcagatttagctcagaaatatgatgtgagccatgaatgtcattttaaatttttttatgttaaggtaag

SEQ ID NO: 41954 - DNA, 406 bp, Homo sapiens
cctgctcagtctgtatcaggcccgggatgaaatcgtcacttagacgctcaggggtcctcccacccatctggccaacacaaacctgccagcatagcactgagtggaaggttccagtgcacccacaggcctggctgttaaaatgtccggcctctccagaggacaggttaagttcacactgagaaagcctggctctctccagctagcctgaattaaagtgagaaggatgagcacagcacctgtggaaatggcgctggaaagcaagtgtacctagggaactgcctctgggccaccgaagtgcgccggcccagtgttctcagacaacccaggaggagtcctccatctggccacttcccacccgttaggccccgaggggacaccaggttggtgagacccggaccccaccagc

SEQ ID NO: 41955 - DNA, 402 bp, Homo sapiens
ctcagaaggacagtgtccacattcatcctgaccaccagctccatctacgagagagagcccaaagctgccccctgggcgatggagtcacaccgctgctggcctcttgggagtactcacttggacagaactgcaacgaagccatgcctgaattgaagggtgtgggtctcgttggccaaagaccgtctttcattggaactaggaataagagtgttagttcatagcacacctgctttgtacatagcaagtgcttcttaaaaagggcttcgctctgttgcccaggcaggagtgcagtgttgcagtgagccgagatcacgccacagcactccagcctgggcgacagagcgagactgtctcaaaaaataaataaataaataaaaggctttcagagataagcaaaaaaaa

SEQ ID NO: 41956 - DNA, 429 bp, Homo sapiens
agccaggagaacttggcccacaaatccctgtggatgctacttaccttgagccctcctggctttcctgggttatgtttctttcctgatctgctttccgtaggggcaggtgaccttctaatatcttccactcaaggccagctcgtgttggccctctgccccttcttccgtctggtgttcttgttatcagaccccaaagtcatatgggctacctattttcagcacctctttctttcagccccctagtaatcatgagtccctctccagagaactctggacaagtcctggaggggctggaagtgcatctgagcagagcatccccacgagcttgatgggctcctcctttgttcccatccccagtcccaactatccagttctagccagacaccacagtctccccacaggttagttgtttctcctgagagcttttat

SEQ ID NO: 41957 - DNA, 265 bp, Homo sapiens
aggcgtaggttgcggtgagctgagatcgcgcgttgcactccagcctggacaaacaagagcgagactccacctcaaaaaaaaaaaaaaaaaaggttagaatgagatgactggtcatggcattctagttgttgtccctgcacataaccattttgtattccatactgaacggaccagtgtgtgccatgcctgtgctagcatgcggttaagataaggctactttctttagatgagagatgtcacaagaacacaggaaagtcacagaagc

SEQ ID NO: 41958 - DNA, 429 bp, Homo sapiens
caaggctggagcaaggcacagctcactctgacaagataaactgcaagaaatgtgagaggcgacaagagaaggaaaaggcagaatgcccttatctggagacctggcttagaccacacccattccatgacgccaccccggattgcccctttcctgtgctttcagagcccaccagcccttctcagcctccaaggacacaggacatcagctcagggccttgaaggagccctagtcagcgtggtcctgagtcaccaagtctgtcaaggccaacaggactgagacctccacaaactgacgctgaagtctaaggacctttttccttgttccaccccactgcgcctcagatgtttccaggagtttctgaaggtcatgttaactagaatttactcttaaaaccaaagacacagaaataaacgttaagcatagtaaatg

SEQ ID NO: 41959 - DNA, 544 bp, Homo sapiens
caaggctggagcaaggcacagctcactctgacaagataaactgcaagaaatgtgagaggcgacaagagaaggaaaaggcagaatgcccttatctggagacctggcttagaccacacccattccatgacgccaccccggattgcccctttcctgtgctttcagagcccaccagcccttctcagcctccaaggatggacaggacctgataatgaacagaatgtcaggatggggacactgaaggaactcgagaatgacttctgtgttagaagcctcaccacaagacagaagatgctgcccttacccaggacacaggacatcagctcagggccttgaaggagccctagtcagcgtggtcctgagtcaccaagtctgtcaaggccaacaggactgagacctccacaaactgacgctgaagtctaaggacctttttccttgttccaccccactgcgcctcagatgtttccaggagtttctgaaggtcatgttaactagaatttactcttaaaaccaaagacacagaaataaacgttaagcatagtaaatg

SEQ ID NO: 41960 - DNA, 501 bp, Homo sapiens
tgagtatatgagccacagtaaggcgaggatggggggataccagcaggggctactgcaggagtctgggagtgaggcagtgggagctgcagccaggggaggggccacagaaggagagcaggggactaacctgaggtcaccttgggggaggatggacaggacctgataatgaacagaatgtcaggatggggacactgaaggaactcgagaatgacttctgtgttagaagcctcaccacaagacagaagatgctgcccttacccaggacacaggacatcagctcagggccttgaaggagccctagtcagcgtggtcctgagtcaccaagtctgtcaaggccaacaggactgagacctccacaaactgacgctgaagtctaaggacctttttccttgttccaccccactgcgcctcagatgtttccaggagtttctgaaggtcatgttaactagaatttactcttaaaaccaaagacacagaaataaacgttaagcatagtaaatg

SEQ ID NO: 41961 - DNA, 692 bp, Homo sapiens
tgagtatatgagccacagtaaggcgaggatggggggataccagcaggggctactgcaggagtctgggagtgaggcagtgggagctgcagccaggggaggggccacagaaggagagcaggggactaacctgaggtcaccttgggggaggatggacaggacctgataatgaacagaatgtcaggatggggacactgaaggaactcgagaatgacttctgtgttagaagcctcaccacaagacagaagatgctgcccttacccaggtaggatgatgggggcagtgagggggaaaagctctggagggcagatgtgagcagtacagagtctgaatgtttcctttagagaggatgctgagcctggccatgatggctcatgcctgtattcccagcactttgggaggccgaggcagatggatcacctgaggtcaggagttcaaaaccagcctggccaacatggtgaaaccccatctctactaaaaatacaaaaattagctgggcgtggtggcgggtgcctgtaatcccagctacttgggaggctgaggcaggagaatcacttgaacctaggaggcggaagttgcagtgagctgaaatcgcgccatcgcactccagctagggcaacaggggcaagactccatcttaaaaaaagaaaaaagagagaggatgttgagtgctgtcagggcggcaggatgagttc

SEQ ID NO: 41962 - DNA, 293 bp, Homo sapiens
tatgagccacagtaaggcgaggatggggggataccagcaggggctactgcaggagtctgggagtgaggcagtgggagctgcagccaggggaggggccacagaaggagagcaggggactaacctgaggtcaccttgggggaggatggacaggacctgataatgaacagaatgtcaggatggggacactgaaggaactcgagaatgacttctgtgttagaagcctcaccacaagacagaagatgctgcccttacccaggtaggatgatgggggcagtgagggggaaaagctctgg

SEQ ID NO: 41963 - DNA, 379 bp, Homo sapiens
gttgcccacgctggtctcaaactcctggccttaacaattctcctgcttcagccaccccaaatgctaggattacaagtacaagttaccatgcctagcctatgcccattttatgaataaaaatatgtaaataatgtacccaagtttctccagctgaatccagctgtctgatccaagagccctgatgaacacgtcaatcttctgccctctgctgtggggtcttccttaactacaccagacaaaaatccattcctcttttctctacttgttcctctgtttcaggtttcttgaaagttaatatggatacaaacctcctaggatcttgttaaagtatagattctgattcaatgggactggggtgcagcctgagaatttgcgtttc

SEQ ID NO: 41964 - DNA, 488 bp, Homo sapiens
tagaggagggaaaggccgtggcgtccgctccctccgcggctcatggcgacgacgcttggcacatccgggaccctcaggccgctgcagtcgcgtcgccggctgctcgggccccagccccggccgctgtggtgactccgccgcgccttgccgtcgcccccgtcccgcccgccgccccagccgccagggacatgtctaacctcggaggccgtaggaacgggcctgtcgaagtgcgcctgacatggacatgtcacccccattttaggaaaacttgtatttggtttgaaaaggaattgaaatcacgacgttatcctaccttcaccatttacccctgataaattgtccacgtttatatttggacacaatctgggagcaatatggaggatggactggaatgggagccatgaagactggttttaggataactggttaagaagattcaacagcagccatcgttcagattttttttcttgtttgaacatttatttcca

SEQ ID NO: 41965 - DNA, 409 bp, Homo sapiens
aactatgtgctcatacaaactttagagcaaactttctcttactctccccaccctcccccttcctttttctaaatggaaaataatgtccggaggggttgctagatagaagactacacttacaaagtgtttatgattccaggcgcatgaaatctttaacattacaggtacatttttgcttacagtgccatttttggtattcttacatggacatgtcacccccattttaggaaaacttgtatttggtttgaaaaggaattgaaatcacgacgttatcctaccttcaccatttacccctgataaattgtccacgtttatattccgatgagtggtgagaaagataattttccgtagaggatttgtgtgtgcgtgcacgtgtacgaataaactgtaattatgtttgtccacacta

SEQ ID NO: 41966 - DNA, 994 bp, Homo sapiens
atgttggccaggctggtcttgaactcccaacctcaggtaatccgctggcctcggcctcccaaagtgctaggattataggcgtgagccaccgtgcctggcaaacaaatgagttctaaggaacacactctgtcttctactgtaaagtatggtaaaaacacaatcctcttaaaatgctcatcaatgtgctttgtagtggtcaattttatttaataggatcaaacatgatgtattaaaaatgttgtaacaatatgtcagaaagacaattagctttttaaagtttggtgtaaatagatgaatagccatcttgacatcccttgaaaagaaatcccctttgatgagatgtttctttgtaattccaataagaaagatctcagtttttcattaccatttgcccagtgcaaatgcactatttccagtcattcaacaaattcaacagcactgatggctttcctaagtgctgggacacatcagatttcaacttgtgtcaaattgccaatttatgttatatgcccgttttttgggggtttcgttttaatctaaaggcagcaagtgagggccaagtacagaggtttgctgtctttgcaaagctaccttgagagcattgtaacttagcaggtgattgagttgtctactaagtggtgctctttatgtctcagataatgctgccagatttatctttctgaatcatagatgtgatcacatcggagtctgctcaaagccttggccgcatacagggtatggtctaaacactgctgacattcagagcttgctgttccggtgccaatactcctttctagacatttctgcccttctcttcaccccttcatgggcctcacctcccccatcagctcttcactgtctcccggcatacccatcaacatttaatgtacatctgtagtgaggtgagaagcacttacaccctgtgatcaggcagatctggtttgagttctgcctctcccttttcctagctaggtgaccttgggcaaggaacttc

SEQ ID NO: 41967 - DNA, 940 bp, Homo sapiens
atgttggccaggctggtcttgaactcccaacctcaggtaatccgctggcctcggcctcccaaagtgctaggattataggcgtgagccaccgtgcctggcaaacaaatgagttctaaggaacacactctgtcttctactgtaaagtatggtaaaaacacaatcctcttaaaatgctcatcaatgtgctttgtagtggtcaattttatttaataggatcaaacatgatgtattaaaaatgttgtaacaatatgtcagaaagacaattagctttttaaagtttggtgtaaatagatgaatagccatcttgacatccatctcagtttttcattaccatttgcccagtgcaaatgcactatttccagtcattcaacaaattcaacagcactgatggctttcctaagtgctgggacacatcagatttcaacttgtgtcaaattgccaatttatgttatatgcccgttttttgggggtttcgttttaatctaaaggcagcaagtgagggccaagtacagaggtttgctgtctttgcaaagctaccttgagagcattgtaacttagcaggtgattgagttgtctactaagtggtgctctttatgtctcagataatgctgccagatttatctttctgaatcatagatgtgatcacatcggagtctgctcaaagccttggccgcatacagggtatggtctaaacactgctgacattcagagcttgctgttccggtgccaatactcctttctagacatttctgcccttctcttcaccccttcatgggcctcacctcccccatcagctcttcactgtctcccggcatacccatcaacatttaatgtacatctgtagtgaggtgagaagcacttacaccctgtgatcaggcagatctggtttgagttctgcctctcccttttcctagctaggtgaccttgggcaaggaacttc

SEQ ID NO: 41968 - DNA, 327 bp, Homo sapiens
ctgggcgatagagcaagactcagtcttggaaaaaaaaaaaaaataagaaattatttatagccttgaagaatattacagggacacgtggcagatctaaataagaatcgtctattcaataacgtcactgtctcatgttaaactgcatgatgatgacaatgacactgtagttctgcaggcggacatccctgttcttaagagctgactgctggaggccaggtacggtggctcacggctgtaatcccaggacatttggaggccgaggcagggggattgcttgaacccaggagtttgagatcagcctaggcaacatggtgacaccctgtctct

SEQ ID NO: 41969 - DNA, 359 bp, Homo sapiens
tatttttttttttgagatggagtctcactctgtcactcaggctcgagtgcagtggcgcaatctctctcaccgcaacctctgcctcctgggctcaagcaattctccagccttgggaacagagtaaaactctgtctaaaaaaaaaataataaaagagtctgaggcaggagcatcacttgaggccatgcattcaggaccccatctctacaaaataaaaaaattactagcatggtggcatgcacctgtcatcccagctactcaggaagtgggaggattgctagagcccaggagtcgaggctgcagtgagcaatgactgcgccactgcactccagcctgagtgacagaacaagatcgtatctca

SEQ ID NO: 41970 - DNA, 591 bp, Homo sapiens
tcatgtctgtactactttatttttataaatacacattttccactcgtaactaaaaactgtgattgaaaatcatcccgtgtcacagtgtctcacgcctgtaatcccaacactgtaagaggcagaggatttgggaggctgaggtgagcggatcacttgaggtcaagagttcaagaccagcctggccaacacggtgaaaccccatctctactaaaaacacaaaaattagccacgcgtggcggtgcacgcctataatcccagctactcgggagactgaggcaggagaatcacttgaacctgggatgcattgcagtgagctgagattgcaccactgcactccagccttgggaacagagtaaaactctgtctaaaaaaaaaataataaaagagtctgaggcaggagcatcacttgaggccatgcattcaggaccccatctctacaaaataaaaaaattactagcatggtggcatgcacctgtcatcccagctactcaggaagtgggaggattgctagagcccaggagtcgaggctgcagtgagcaatgactgcgccactgcactccagcctgagtgacagaacaagatcgtatctca

SEQ ID NO: 41971 - DNA, 925 bp, Homo sapiens
tttaagaatagctaggttgtattaaaacatgtaagctactttaagtgataaatcaatagctaaagttttctcctaactttaagtctggtaaatatctctcaggaatggaagtgtcaatgagtagtcagtattactatactcttgtttgtaagaatatattttccttattgttggagtctccagaggttattggaaggaataaaaaaggacatgttttctaacgaaactctcaaattcattatctacttcatgagaatttatttgtattcattaacattagtaatacctatttttcttaagagccttcttttttccctttgtttcttgtcaccaagaagttatcacacttatacttattctataaggccaaagccttatctagaaagatcatgaagagtttggatatttttaaaactatactcgaattttcattttttcctgtcctgtaaaggagagaattcttaagatatcaggcataatgtatgtaccttttccagactgaagttcaaagaatgattaggttcaatctttcagtggcaggccagctaaactttctatagtttaatgattagctgtggttatgatcttgagccctaacatgccacattactcaagatttacacaggcaagtgacttcatttggcactgctaataatggcaggtgaacattcctctcaggtgtgagatatttcctatgaaacagtccactggcaggctggagatatcttacacttgagttgttttttttacacaaggtcattttgccgaagaattacttgtcagaactttgccctggggtccatgcattgccggccaattaggctcacaaaatccacagtttgggtagagcgcagggcacaagggtatgggggcaaaaaacaaaagccaacaaaaaaaattggggcacaaatagcggaaagtaata

SEQ ID NO: 41972 - DNA, 1945 bp, Homo sapiens
tttaagaatagctaggttgtattaaaacatgtaagctactttaagtgataaatcaatagctaaagttttctcctaactttaagtctggtaaatatctctcaggaatggaagtgtcaatgagtagtcagtattactatactcttgtttgtaagaatatattttccttattgttggagtctccagaggttattggaaggaataaaaaaggacatgttttctaacgaaactctcaaattcattatctacttcatgagaatttatttgtattcattaacattagtaatacctatttttcttaagagccttcttttttccctttgtttcttgtcaccaagaagttatcacacttatacttattctataaggccaaagccttatctagaaagatcatgaagagtttggatatttttaaaactatactcgaattttcattttttcctgtcctgtaaaggagagaattcttaagatatcaggcataatgtatgtaccttttccagactgaagttcaaagaatgattaggttcaatctttcagtggcaggccagctaaactttctatagtttaatgattagctgtggttatgatcttgagccctaacatgccacattactcaagatttacacaggcaagtgacttcatttggcactgctaataatggcaggtgaacattcctctcaggtgtgagatatttcctatgaaacagtccactggcaggctggagatatcttacactttgaagttatatatatataaaacaagtgtctatttctagctgaaagagtttacctcttctagacatttatgcccaatggtgtcacacatgatcatttgctcctgctctaattttaatgtgcatacaaaaaatataccaaaaatgttattgtaattttaatgagcatgtaaagagtgtatcaaaaattgatgggatattagtgttaggttttgcttaaatgaaaattaataaattcaaaaatactaaaagtcaccttctttgtcacgttagcaaccagtttctactattctgtgcccatccagtgtcaatatcattgatttctttttcatatgaagatccacatgcattgtaagattgtgaagatatataaaattgatgaattaagagaaattatgccactttcctatagtttctgtgttctgtttattgtatggtgtattcactcttggaaaatatgtaatagttgtgtatccagaatatgtgtcttcacctgaatatttaatctttatatttacaaaaaaataagttccacaagatggacaaaaatggtccatgatatttagcttaaattgtaaccttttgttgtgtatataaaacttccttggaagaaaataaccttattgttttcttaaagctaaacagaataggattggtactcattaattatgtcttgcaaatattttctaaaaattcaaccactctcctaaaatggtgtttaaatattttgtagggcagaatatgcatattgcctgttagcaagtaataattcattctcatagagaaatgggtttttacccatggaagtaatcttttttttttcttttttttttttaattttttttttaatatactttaagttttagggtacatgtgcacattgtgcaggttagttacatatatatacatgtgccatgctggtgcgctgcacccactaactcgtcatctagcattaggtatatctcccaatgctatccctccccactccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccagtttcatccatgtccctacaaaggacatgaactcatcattttgtatggctgcatagtattccatggtgtatatgtgccacatt

SEQ ID NO: 41973 - DNA, 495 bp, Homo sapiens
aatacagacaaggtctcgctatgttacccaggatggtcttgattgaactcctggcctcaagctatcccctcctacctcggcctcccaaagagttgggattagaggtgtgagccaccatgtatggcttttttacatttcaaataagagaaattgggtaacttcaaggatgcaaatattacccaggaaaatcctatgatcttactttttgtgtgtgaaataattctttttctaagtgaatgcaaattaatgggatagttcattgaaattactctactaaaaaatccttatctgagctcccaaagccttaattattaactatttcaaagtactgtctctttatcttattaatctgacccagtatttaaatatacttcatttgagaagctccttcctatttctagactaaatttttcttactataataaatcaacaaggccagctgaattcatctggccttaagtgcaaaaatgacttccgtgaaaaaaatacggtgaa

SEQ ID NO: 41974 - DNA, 201 bp, Homo sapiens
agtctcttgcttttcattgattcttctgatatcaattgactttcagccacctctttgatttttggcaaaaggcatcaaaacctataaactcggctgggtgcggtggctcatgcctgtaatcccagcacttggggaggctgaagcaggaggatcgcttgaggccaggagtttgagaccaacctgggtaacataatgagaccc

SEQ ID NO: 41975 - DNA, 257 bp, Homo sapiens
aattacagtaacaacttgctttaagtatgtggcttccaagggaagccagattttaagagagtggtataagcagcaaggaaagtaaaaaaacttagaaaattcatggaaacattttatatgtttcaaaaatgaaaccaaaagaggaaattgaacagtcaaggaagccgggagtggcagcacgcacttgatctggttgagtgtgcccctgagtggggggcagctggtgctggaaccctggaacctgaccgcagaattgg

SEQ ID NO: 41976 - DNA, 598 bp, Homo sapiens
atcttggctcattgcaacctccacctcctgggttcaagtaattctcctgcctcagcctcctgagtagctgggattacaggcgtccaccaccacgtccagataatttttgtatttttcatagagacggggttttaccatgttggccaggctggtctcaaactcctaacctcaaatgatctacctaccttggccttctgaagtgctgggattacaggcgtgagccactgcgcccagcccagaatgtattgtagaagatgactggtagtggggcaaatagatttgcaggtagagactggcagcaaggagttatgagggcagggaagttattagaaagatatttaggagaagtgaagtatggaagaggcaggagttaaagatgtttctgggccagagtatgatggacagttgtgatatttttacacccagacttcatcccccccttttcaggttcagaatgctcgttgagttttaggaggaagaatcattctctagaggcttttaaaaacaagattgacaatatcaggattgatttacaatttgttaggaccatcactgaaagggttgtgcttacccccagctaagaccatgtgaccctagt

SEQ ID NO: 41977 - DNA, 579 bp, Homo sapiens
taaaaacctgttaaagcactattttgggtgtgtctgggaggatgttttcagaggacattagtgtgtgagtctgagtggactaggtagggaagatctgacctcactgtggcaccatcaattggccagaagccaagagagcaaatacagaaaatggattggtctctgagagttaggacaagacttttcttctgcttccttggatatgagaacttcaggctcaggggcctttgtactccaggacttacactaagcagcccctcagggtcctcgaagctttcaatctcccactgagagttacaccaccagcttccttggttgaggccttaggaactggactgagctttgctactgcaaccccagagtctctggcttgcagatggactgttgtggaactcctcagccaccagaatctcttatgtgaattctcctaataaatctcttctcatatatctatatacatatcctattggttctctctctggagaaccctaatacagacctagtattggagaagccaatcattccttcttattgtattccttacaacacaatggaagacatctacggaactgtcccctc

SEQ ID NO: 41978 - DNA, 334 bp, Homo sapiens
tctatgcttaagcagttttcagtgtcctctcaggttgttgatgaacttctggatcttgtttgagagactatttcaatgtttttcaaattcattaatgatacatttcaatgagcatgtcagtaaaagttatcagtaagagaaattaaagttccttttttgtcagtggttcttatttgaacaaaattgtgttaaaagaataatgggtcataagatttattttgatactgatgctttataatttagaattatgcctgcttaccctaaaaaagttaattcaaaataaaaacataaaaaaaacacattctttttttaaaaggtaagaccagaaagaaaa

SEQ ID NO: 41979 - DNA, 520 bp, Homo sapiens
ccttctctgctcagaaccctcctctccactaccatccccgcaagttccagctgcctgcactctgatctcggtttcttgtgctcagctctctggtggcctctgcttcccttgtaccttggttttgaaggcactcccagacagaaagccagagtgaatgtggggcttgactcacatgcttccagttggaccaaagacctgcactgagtgttgttccattctcgaaaacagttccttcatgcattctgtccaatatcacaattgcttgggaaagaagagtaagtctgatattcattatgccatcatgtctgggattggaagtctgattacattttaaaaggtgactctggttgctgcatagaagaaactgccaggtgaactacatacactaagaccagatgaaaaagggtgatgagggagtatttcttgaagcagaaaacctaatgtttctgcacgtgttaaacatctctgcaaattttgcaaggcatcaggagtaaaacgtgtaccttcaataaacccatgg

SEQ ID NO: 41980 - DNA, 431 bp, Homo sapiens
agatgtacatttgatcagttgccttaaaagggatgaataatcagtaatactgcctttgattgttttccttttagttgtttgcttgtcatgtttacagtagctatttatcaatttggatatcatctatttaagttagcttttactgttgtagcccatgtggagaaagagtttgaaatgcccatttatatttgatcacagatgtatggtttttcaaataaggttttttttgtgattttggtttggtttttttgtttgtttgtttgtttgtttgtttttgaaacagagtgtcactctgttgcccaggctggagtgcagtggtataatcatggctcaccacagcctcagtctcctgggctcaggagatcctcccacctcagcctctcaaatagctgggaccagaggtgtgcaccgccacacctggctttaaaaaa

SEQ ID NO: 41981 - DNA, 873 bp, Homo sapiens
gccaaaccccaataaaagaagcaattagattttttaaactctcaccaattttttccaaacagcctacatacaaatggtacagcaacagaaaaaaaggttgaaaatcaaagctcactattggcccatattttaaatatgtaaactcaaaattttatatctctacatatatgtatacacatattatcatacacaatcacacactcctctcccagaatccagcacactacttctatttcatatcacaatactcttttgaaagttgaatcatatagtctagtactttctaacccttcacgtcaagacattaatagaaaacaattgttttgacattctggtgttcaggactaaggggatcactaactcagcatcttttcttagggcaagtctgttagggaaaacgaggatttctagctgtttgccagggctggtccttgtctatcgtgatttataattctgtctacaactttctaggtgacctattatcattaagacttactatctggcattcttaaaaattatagatatatccatattctaatataaaagaagagcgggcatttcagacaagtatgttaactttctcatattaggaattctaaaggaaatatattctcaaaagacatctaatcatggctcacttgtgacagataaagtaattgtgctatttcattcggcagttctgaatcaaggacgtatccctgaatctggggagctctctatcaaaatatacatgctggaaccctaccaaaggaataataaatctggaatgaggctctgactgtctaattaggaaaagactccttcctggaattctgcacatctccctacaccttagtgacggttaaataaataattattaagcttctggaaaat

SEQ ID NO: 41982 - DNA, 785 bp, Homo sapiens
ggaagcgggacgtaccaagcggcaggcggcggaggggtgcgggccggaactccgcccttcgtgctggtcggtctccacgccccactcggactagtgtcaccgcctccccgccgcagacactatccgacaaaggagggggaatcaaaggctgggcgaagaggcagggcaggcgccggtgacgctgctgggcaagcgggctctgcagtagcatttgtggcgaccgtggcagtggctgtgactggaagcttctggaaatggcggcgatgaggacccccacatagggatggccatagcagccacaaaaggaagcaaacaagaacaagtcctgatggagcaatttatgaagacaggcagcatagagggagaagaacctgtctgtcaaccccacacacgctttcccagtttcattttagacgtctcctgaaagctgagcatttggtatcttaaagcctcttaccagtttggatagatatggatcttccaaaattaatgagctccttaatatcgacactgtttatcaacataaaggatcaatttaggaagattataaaaactgaagtttccggaacaataaatgggagaattaatcttctgaatcaaggacgtatccctgaatctggggagctctctatcaaaatatacatgctggaaccctaccaaaggaataataaatctggaatgaggctctgactgtctaattaggaaaagactccttcctggaattctgcacatctccctacaccttagtgacggttaaataaataattattaagcttctggaaaat

SEQ ID NO: 41983 - DNA, 939 bp, Homo sapiens
atgttgccctggctggtcttgaatttgtgggctcaaacaatctgtccgcctcaacctcccaaagtgctgggattacaggtgagccactgtgcccggcctgtaattttttatgttgcctattgataggcaccactgctgctctttaaatgtcaatgaaattattttggagaaactttcttcacctttactaggtttcttcttacggtttaagctcagctacctcttcttttctgcctaaaacttttctcttgatcaaatatcagaatggaatatgatttaaaagtttcattttagacgtctcctgaaagctgagcatttggtatcttaaagcctcttaccagtttggatagatatggatcttccaaaattaatgagctccttaatatcgacactgtttatcaacataaaggatcaatttaggaagattataaaaactgaagtttccggaacaataaatgggagaattaatcgtaagtacttcctgagttcttcacaggattatagaattttatatatggaagtaattttaaaaataatctggtctagagtttcctaaagtttgttccataaaattacaatcccatggcattgtatagaaaaacgggagtcccagtgatccagtatgtctggctgtaaacctcccttcctcgccattcacacagtgtaccttaaaatactacaaaggctacaaaaatcctccaataaagcctataattttgtttaatctactaaaaatgtaaccccccctttcatctgtaaacatgcctcagaacactcaagaggcagtgagctagccctatccactcacctgacagccacaatttacactagtgtttttcacttactaaacaaaaaatgattttcctgatatctcatgcttaaaatgccatctaataattacatcttcactaaaatttaaaaagtatggttcgtcagtca

SEQ ID NO: 41984 - DNA, 364 bp, Homo sapiens
  misc_feature (35)..(35): n is a, c, g, or t
  misc_feature (37)..(37): n is a, c, g, or t
gcgtcgacccccttcctgtgtccatgtgttctcantnttcaactcctacttatgagagagaacatgcggtgcttggttttctgttcctgtgttagacaaggggaagaagagcattaggacaaatacctaatgcacatggggcttaaaacctagatgacaggttggttggtgcagcaaaccaccatggcacatgtatacctatgtaacaaacctgcacattctgcacatgtatcccggaacttaaagttaaaaaaaaaataatttctaaataaaataaccaatgcaactgatactacctgacatgtaattagtatctccagaacaacctaagataacagccccagtttaatgatttgaagtcgac

SEQ ID NO: 41985 - DNA, 307 bp, Homo sapiens
atccttcccttcagtctgactgagccaattattttgccagtccacccctggagcaataattgattccaggagaaggccacacatggattgttagactaatcagaagctacatccatagagctgggatggggtctgcttccctgtgactcatgtcggggagtaattctattaggaaggaagaagtggaggtcggacgtgttggctcacgcctgtaatcccaacactttgggaggctgaggtggctggatcatctgaggtcaggagttcaagaccagcctgaccaacatggtgaaaccccgtctttact

SEQ ID NO: 41986 - DNA, 438 bp, Homo sapiens
cttttagttaatccgtttaggattgggagggcctggaagaaaaacatctagctatgttaatagatgttctttacagatgcacattttaccccacaaaggatagcttttgggggaaaatgctgtcctttatggaagaaattgcaaaatagggcaaggaaacatgttttggggtaaaatattttgactttctttttgtcacgtaatgttatgccagagtcagaatggaaagtaagtcatcatatataggattaaataaaacccatctgatgagaatttatggtttgtaggtcatgactccccagatcccttagataggaatttgggcaggattaaaaaaatcaagagtttaggctggtcgtggtggctcacgcctataatcccagcattttgggaggccaaggcaggtggatcgcttgaggtcagaagtttaagaccagc

SEQ ID NO: 41987 - DNA, 298 bp, Homo sapiens
tttaaaaaacttgatttccatttcccttacattagttaaccttgatttcatagtatcatcctgcacaaagtacaggttgcagaatactcaaactgtgcttatatagctgttttttaaaataacagttgtttgaaaatcttatttttttgatgctgcttcatccctcacacagcacttatttcccttggttgagcatgtggcatgtgacagtccatagcgccttcctttgcattactctgttatttcctgcctttgtatgttttatgtaaataatgcatttataaagtcttccactgat

SEQ ID NO: 41988 - DNA, 552 bp, Homo sapiens
ctcagagccctgcaggctggggtccgtggcgtgctgaccacctgacaaccaaggggccgttggccacatttctcagacactgcagaggtcctttcccttgcactccttcttggggtccttccaatgccctctgttgtgagggtctacctccagccttggcagggatcggaggtccgggtgaacaactaaggctaagaagaaacctctgaggctggaaaggggtgatttgaggtaggggggaatcctcccaccacacccatctgtgtgtgatgtcaatgagttcctgtgcaacccagcctcagttagcccatattggggtcattgcagcctacccctaacctgtgaggggtagctgacttcagccagctctgcagagctcctcctgtgtgctcaactctgcgcactgcagggagccaagatgagagcgcacagagctcactgctcaggagatggctgctttggggacctgtgtggacagacaggtagaggccccagggggctatgggagtgccccacagagcaggcaggggactgtggggaagtagagtgggc

SEQ ID NO: 41989 - DNA, 654 bp, Homo sapiens
gttaaaactcctagtagagcagtacgtctggaaggtaaatgcataaaataagattggataaaatttttcataaaagtgaatgttctctggtttataagtactatcccaattaatgtttgtaacactgcgcattattgtaaaagagatcccatgtgatagctaagacatttaataaatccaaaagatccaatgtgttctaaattctcatggtagttgaactgagtcatcttcttaggcatcagttccagtgattattagtactgacaactttgctgattccatttttaagatgattaagctagattttgaggcccagaagtaatacagcttgtccacattttcacttgatggagccaaagactgtgtagtatgagctcatgtatgcacacagctactgttaggcagaagccctgtgcatgaaattccagaaaaatcttcattatcatagtaactgccaaaaatctgtaacaactatatgattctgctttagcaatatccaaaatctaggtgttaacatggaaaatgtccagaggaaccatgggagaacatgtttgtgctaaaaatgaaaggaggaacacacagataacttctaattagcatgcagtgggtcttcgtggccacgtttatttattttgttttattttatttcattta

SEQ ID NO: 41990 - DNA, 1050 bp, Homo sapiens
actagtccacggttggctttaggtaaactctccaagaaagcctgctgaatcgtaagccattgctttctccatcaagttccagtttttctctagatcacaaagatgaagctggcagaacccgagtggatattcattattacgaacagaagaacagccaacaggagccgtgccatgtgcaaccccgagttgacagatgcctccccgcttcttctgtgtttgccagttgttacaaaatgatctagagaaaaactggaacttgatggagaaagcaatggcttacgattcagcaggctttcttggagagtttacctaaagtctatgtggacggtggctcagctcacctctgagaacaatacgatcttcacttttcaatctttctgcagctctaattagtgccacagggaaccatggatgaaaatggcttctcgtgttgatatccatttggggaataggatggatgcagctgcttttgctcaagggcagagttttgacttcaaagaccctgaagagaacccagaaggaaaactctcagaggtcaatggactatattctttacctgggggatcgttgacaccacagcagtaaaagcgaagtcagtgtcgtgctgtcttgaaattagatgacaagaatgactgacaccaatagagctggaactgcacttggagcctgagtagccggtctcaggctaaccacacctgtgctgaccacagcgtggcccgtgttgttcatgaggcattctggctgtacctccacagggatgcaagacttccagtgagaggctgcttctgcaagaaaatacctgcctagaaatggtccgctttctcttcctaataaagtgataagctttcttagtccaatggtactaaatagaaacctttttcttccatcagccagagaggtactttatttcctttgtttgggagtgtcagttaaatattgttgaaacatttcactagaacttcctgtcagttacctagtgaattcatgtgacttcatcagtcttgaatacagagaccgtttaataacaatacaattggttctagtcttaaa

SEQ ID NO: 41991 - DNA, 1948 bp, Homo sapiens
  misc_feature (1)..(1): n is a, c, g, or t
  misc_feature (3)..(3): n is a, c, g, or t
  misc_feature (5)..(5): n is a, c, g, or t
  misc_feature (7)..(7): n is a, c, g, or t
  misc_feature (9)..(9): n is a, c, g, or t
  misc_feature (12)..(12): n is a, c, g, or t
  misc_feature (15)..(15): n is a, c, g, or t
  misc_feature (17)..(17): n is a, c, g, or t
  misc_feature (20)..(21): n is a, c, g, or t
  misc_feature (23)..(24): n is a, c, g, or t
  misc_feature (26)..(26): n is a, c, g, or t
  misc_feature (28)..(28): n is a, c, g, or t
nantncntntangtnantanntnncncncaagtctctggacaaacctgaacagttcctttatgaactgtcactaatccccaacttttcagagcgagtcttttgcatcctgttccagtccacattttcagaaagcatttgctcaattcgtcgcaaactggaattactacagaaattgtgtgagacattaaaaaatggcccaggggttatgcaggttctaggtttggttcttgcctttggcaactacatgaatggaggaaataagactcgaggacaggcagatggctttggattagacattcttccaaaactgaaagatgtcaagagcagtgacaatagcagaagccttttgtcatatattgtttcgtattatctccgaaattttgatgaggatgctggaaaagaacagtgcctctttccactgccagaaccccaggacctttttcaggcctcacagatgaagtttgaagattttcaaaaagatctcagaaaactgaagaaagacttgaaagcctgtgaagttgaagcagggaaagtataccaggtctcctcaaaagagcatatgcagcctttcaaggaaaacatggaacaatttattattcaagccaaaattgaccaagaggcagaggaaaattcactgacagagactcataaatgctttttggagaccacggcatatttcttcatgaaaccaaaacttggagagaaggaggtgtccccaaatgctttcttcagtatctggcatgaattcagctctgactttaaagacttctggaagaaagagaacaaacttcttctacaagagagagtaaaagaagccgaagaggtgtgtagacagaagaaaggaaaatcactttataaaataaaaccaagacatgactctggaattaaagcaaagataagcatgaaaacttgaacaatgaaaagcagaatgaaaatgagtcattgcaacgactttcacaaaattcagctgacctgagagtgggagggaaactaccgtcattctgctcatgtttcttcttgacctcttgcataatctttttgttttctagacagttcactaattgttgaattttactgtatattcatataaaaatgcaaacgtactagaccagtggagaatttgacaccttttctttttgtaaaagtttatggtattataccgatagaccaaaacagcatgtgtaagaggcagtatctgcactaattctcaacatgctaaacattaactacaattcactgttgtgagaatattcctcgtcacagcaaaaacactttcctttctactgacaaccagtcctccacatcacagcatttagacatatgggtaaaatgttatttctagtgaattgtttgtatcagtttcatgtctaagtataaattttctattttaaaatttaagaaccgtttataatcagtgctttcccaactcttgggttgctctccataactatgtatttgtgaaagaaaatggtcatttttttttactgaagtcatataatgacttgggtcagctcgtaatgcattgtgatggttttgtatgagctgggtgtttttttccattacttttaatgatcttcgttgcaagttatagttgtggataaaggggagaatttattgctcttgcaaaccaattatggaaagcaacttaagaaaaccaatgttctaaatcataattgtttgtatttatgtaaagtatggtctcttactttttagtttgtagtttaagtgcaaagaaacagtagtggttttttttctattgttttgtagtcttcctgtccccttcagtccctccagtgtgtatattaccattctccaatgaaataatagggcatttaacaaagatcgctatgtgcaatactgtatttagtgtttctatttcaatttttctaggatgttaatttatatgaaaataaaatgaataataaaagaataaagatacttgcaaaa

SEQ ID NO: 41992 - DNA, 1366 bp, Homo sapiens
ctggaggcccagcagagcaaggcttcccaggtggaaagctgtagtttcatgccttggatgttcgggccatgtgctttttggagaccacggcatatttcttcatgaaaccaaaacttggagagaaggaggtgtccccaaatgctttcttcagtatctggcatgaattcagctctgactttaaagacttctggaagaaagagaacaaacttcttctacaagagagagtaaaagaagccgaagaggtgtgtagacagaagaaaggaaaatcactttataaaataaaaccaagacatgactctggaattaaagcaaagataagcatgaaaacttgaacaatgaaaagcagaatgaaaatgagtcattgcaacgactttcacaaaattcagctgacctgagagtgggagggaaactaccgtcattctgctcatgtttcttcttgacctcttgcataatctttttgttttctagacagttcactaattgttgaattttactgtatattcatataaaaatgcaaacgtactagaccagtggagaatttgacaccttttctttttgtaaaagtttatggtattataccgatagaccaaaacagcatgtgtaagaggcagtatctgcactaattctcaacatgctaaacattaactacaattcactgttgtgagaatattcctcgtcacagcaaaaacactttcctttctactgacaaccagtcctccacatcacagcatttagacatatgggtaaaatgttatttctagtgaattgtttgtatcagtttcatgtctaagtataaattttctattttaaaatttaagaaccgtttataatcagtgctttcccaactcttgggttgctctccataactatgtatttgtgaaagaaaatggtcatttttttttactgaagtcatataatgacttgggtcagctcgtaatgcattgtgatggttttgtatgagctgggtgtttttttccattacttttaatgatcttcgttgcaagttatagttgtggataaaggggagaatttattgctcttgcaaaccaattatggaaagcaacttaagaaaaccaatgttctaaatcataattgtttgtatttatgtaaagtatggtctcttactttttagtttgtagtttaagtgcaaagaaacagtagtggttttttttctattgttttgtagtcttcctgtccccttcagtccctccagtgtgtatattaccattctccaatgaaataatagggcatttaacaaagatcgctatgtgcaatactgtatttagtgtttctatttcaatttttctaggatgttaatttatatgaaaataaaatgaataataaaagaataaagatacttgcaaaa

SEQ ID NO: 41993 - DNA, 1172 bp, Homo sapiens
atacacactctgcatagaaattcttatgtagtaaaagaagccgaagaggtgtgtagacagaagaaaggaaaatcactttataaaataaaaccaagacatgactctggaattaaagcaaagataagcatgaaaacttgaacaatgaaaagcagaatgaaaatgagtcattgcaacgactttcacaaaattcagctgacctgagagtgggagggaaactaccgtcattctgctcatgtttcttcttgacctcttgcataatctttttgttttctagacagttcactaattgttgaattttactgtatattcatataaaaatgcaaacgtactagaccagtggagaatttgacaccttttctttttgtaaaagtttatggtattataccgatagaccaaaacagcatgtgtaagaggcagtatctgcactaattctcaacatgctaaacattaactacaattcactgttgtgagaatattcctcgtcacagcaaaaacactttcctttctactgacaaccagtcctccacatcacagcatttagacatatgggtaaaatgttatttctagtgaattgtttgtatcagtttcatgtctaagtataaattttctattttaaaatttaagaaccgtttataatcagtgctttcccaactcttgggttgctctccataactatgtatttgtgaaagaaaatggtcatttttttttactgaagtcatataatgacttgggtcagctcgtaatgcattgtgatggttttgtatgagctgggtgtttttttccattacttttaatgatcttcgttgcaagttatagttgtggataaaggggagaatttattgctcttgcaaaccaattatggaaagcaacttaagaaaaccaatgttctaaatcataattgtttgtatttatgtaaagtatggtctcttactttttagtttgtagtttaagtgcaaagaaacagtagtggttttttttctattgttttgtagtcttcctgtccccttcagtccctccagtgtgtatattaccattctccaatgaaataatagggcatttaacaaagatcgctatgtgcaatactgtatttagtgtttctatttcaatttttctaggatgttaatttatatgaaaataaaatgaataataaaagaataaagatacttgcaaaa

SEQ ID NO: 41994 - DNA, 2647 bp, Homo sapiens
tggtcgatctagaggtatcccccacaacgctttatacttcctgtaaaggagagaaagagacctatctctgatactatctcaaagacgaaggctaaacaagttgtcaagttattaagcaacaaaagatcacaagcagttggaatactaatgtctagccttcatttagatatgaaagacatacaacatgctgttgtgaacttggataattctgtggttgacctggagacccttcaagctctctatgagaatagagcacagtcagacgaactcgaaaaaatagaaaagcatggccgatcttccaaagacaaggaaaatgccaagtctctggacaaacctgaacagttcctttatgaactgtcactaatccccaacttttcagagcgagtcttttgcatcctgttccagtccacattttcagaaagcatttgctcaattcgtcgcaaactggaattactacagaaattgtgtgagacattaaaaaatggcccaggggttatgcaggttctaggtttggttcttgcctttggcaactacatgaatggaggaaataagactcgaggacaggcagatggctttggattagacattcttccaaaactgaaagatgtcaagagcagtgacaatagcagaagccttttgtcatatattgtttcgtattatctccgaaattttgatgaggatgctggaaaagaacagtgcctctttccactgccagaaccccaggacctttttcaggcctcacagatgaagtttgaagattttcaaaaagatctcagaaaactgaagaaagacttgaaagcctgtgaagttgaagcagggaaagtataccaggtctcctcaaaagagcatatgcagcctttcaaggaaaacatggaacaatttattattcaagccaaaattgaccaagaggcagaggaaaattcactgacagagactcataaatgctttttggagaccacggcatatttcttcatgaaaccaaaacttggagagaaggaggtgtccccaaatgctttcttcagtatctggcatgaattcagctctgactttaaagacttctggaagaaagagaacaaacttcttctacaagagagagtaaaagaagccgaagaggtgtgtagacagaagaaaggaaaatcactttataaaataaaaccaagacatgactctggaattaaagcaaagataagcatgaaaacttgaacaatgaaaagcagaatgaaaatgagtcattgcaacgactttcacaaaattcagctgacctgagagtgggagggaaactaccgtcattctgctcatgtttcttcttgacctcttgcataatctttttgttttctagacagttcactaattgttgaattttactgtatattcatataaaaatgcaaacgtactagaccagtggagaatttgacaccttttctttttgtaaaagtttatggtattataccgatagaccaaaacagcatgtgtaagaggcagtatctgcactaattctcaacatgctaaacattaactacaattcactgttgtgagaatattcctcgtcacagcaaaaacactttcctttctactgacaaccagtcctccacatcacagcatttagacatatgggtaaaatgttatttctagtgaattgtttgtatcagtttcatgtctaagtataaattttctattttaaaatttaagaaccgtttataatcagtgctttcccaactcttgggttgctctccataactatgtatttgtgaaagaaaatggtcatttttttttactgaagtcatataatgacttgggtcagctcgtaatgcattgtgatggttttgtatgagctgggtgtttttttccattacttttaatgatcttcgttgcaagttatagttgtggataaaggggagaatttattgctcttgcaaaccaattatggaaagcaacttaagaaaaccaatgttctaaatcataattgtttgtatttatgtaaagtatggtctcttactttttagtttgtagtttaagtgcaaagaaacagtagtggttttttttctattgttttgtagtcttcctgtccccttcagtccctccagtgtgtatattaccattctccaatgaaataatagggcatttaacaaagatcgctatgtgcaatactgtatttagtgtttctatttcaatttttctaggatgttaatttatatgaaaataaaatgaataataaaagaataaagatacttgcaaaaaaaaaaaaaaaaaaaaaaaaaaaaaaaaaaaaaaaaaaagaaaaaaccaaaccaaacaagaaagaacataccacaaaaaagacagcaccaaaaggtagaacaaaaaacactaacaacaagtatcaacaaaaagacgtgaaacaaaaagaagaaacccaaaaagagaagaaacagaagaggacacaaatacaacaaacacacaaccaagcaaaacaagaaagaccaaaagaaacaccggaaaacaacaccaacaaacaccacaaaacaacaaaccagaaaccaaacccgacaacaaaccaacaacaacagcaaaacacagaaaaaaacaagcgcaaggacaaaacagagagaaacgtgagaagccacacagaaaacagaaacaagaaaataaaatcacgagagaaacaaac

SEQ ID NO: 41995 - DNA, 1986 bp, Homo sapiens
tggtcgatctagaggtatcccccacaacgctttatacttcctgtaaaggagagaaagagacctatctctgatactatctcaaagacgaaggctaaacaagttgtcaagttattaagcaacaaaagatcacaagcagttggaatactaatgtctagccttcatttagatatgaaagacatacaacatgctgttgtgaacttggataattctgtggttgacctggagacccttcaagctctctatgagaatagagcacagtcagacgaactcgaaaaaatagaaaagcatggccgatcttccaaagacaaggaaaatgccaagtctctggacaaacctgaacagttcctttatgaactgtcactaatccccaacttttcagagcgagtcttttgcatcctgttccagtccacattttcagaaagcatttgctcaattcgtcgcaaactggaattactacagaaattgtgtgagacattaaaaaatggcccaggggttatgcaggttctaggtttggttcttgcctttggcaactacatgaatggaggaaataagactcgaggacaggcagatggctttggattagacattcttccaaaactgaaagatgtcaagagcagtgacaatagcagaagccttttgtcatatattgtttcgtattatctccgaaattttgatgaggatgctggaaaagaacagtgcctctttccactgccagaaccccaggacctttttcaggcctcacagatgaagtttgaagattttcaaaaagatctcagaaaactgaagaaagacttgaaagcctgtgaagttgaagcagggaaagtataccaggtctcctcaaaagagcatatgcagcctttcaaggaaaacatggaacaatttattattcaagccaaaattgaccaagaggcagaggaaaattcactgacagagactcataaatgctttttggagaccacggcatatttcttcatgaaaccaaaacttggagagaaggaggtgtccccaaatgctttcttcagtatctggcatgaattcagctctgactttaaagacttctggaagaaagagaacaaacttcttctacaagagagagtaaaagaagccgaagaggtgtgtagacagaagaaaggaaaatcactttataaaataaaaccaagacatgactctggaattaaagcaaagataagcatgaaaacttgaacaatgaaaagcagaatgaaaatgagtcattgcaacgactttcacaaaattcagctgacctgagagtgggagggaaactaccgtcattctgctcatgtttcttcttgacctcttgcataatctttttgttttctagacagttcactaattgttgaattttactgtatattcatataaaaatgcaaacgtactagaccagtggagaatttgacaccttttctttttgtaaaagtttatggtattataccgatagaccaaaacagcatgtgtaagaggcagtatctgcactaattctcaacatgctaaacattaactacaattcactgttgtgagaatattcctcgtcacagcaaaaacactttcctttctactgacaaccagtcctccacatcacagcatttagacatatgggtaaaatgttatttctagtgaattgtttgtatcagtttcatgtctaagtataaattttctattttaaaacttaagaaaaccaatgttctaaatcataattgtttgtatttatgtaaagtatggtctcttactttttagtttgtagtttaagtgcaaagaaacagtagtggttttttttctattgttttgtagtcttcctgtccccttcagtccctccagtgtgtatattaccattctccaatgaaataatagggcatttaacaaagatcgctatgtgcaatactgtatttagtgtttctatttcaatttttctaggatgttaatttatatgaaaataaaatgaataataaaagaataaagatacttgcaaaa

SEQ ID NO: 41996 - DNA, 311 bp, Homo sapiens
atttaggtttttattccatttcgagttaattttttatatagtgtaaggtaagggtccatctttacttttttgcatgtgggtatctggctttcccaggaccatttgttgaggagactatccttttcccattgagcggtcttggtatctttgctgaagatcatttgaccatatacatgaaggtttatttctatgctttctattatatttcacaggttttatatatttttattctaataccaactgttttgattactgtagcttttaatgtgttttgaagtcagaaagtgtgagctcttcacagtttgtttgtt

SEQ ID NO: 41997 - DNA, 1834 bp, Homo sapiens
gcgattctcctgtatcagcctcccaagtagctgggattataggcatgtgccaccatgcccagcaaattttgtatttttttttggtagagacagggttcaaccatgttggtcaggctggtctcgaactcctgaccgcaagtgatccacacgccttggtctcccaaagtgctgggattacggtgttagccactacacctggcctggattgtgtattatttatgtctgtagtttatatgcttagttgttgcctatagtgatctgggtaagattcaaacatttatcttttgtatcttctacagaagtgctttgagcatcaaatttgttttaacgttaaattgtagtttgctgtattaaaatagatcaatgaatataattcagtcttttaggggcaccaagtaaagcataaggtcatatatactatacaatatgtttattgcacttcccatggggataaatcactctgtcattcctagttattttaaaaaaagaactttatgattacggtcctctttctcacatactgcaaacttaaaagatacatacaccaaatataggtctgttttaaaggagaggaaaaatagttcaaggagtttttgcctctttgtttttcaatagattattctgccattttttaaaggaaagggaaaatgaaaacagcatgtctttttaaacattgaaaagaaatatggaggctttaaaccgcaaactgaaaaagctgagtagaacaaaggcagtggagcatacaatacaattctatttatttgaggttaattgaagttaataatttttaaatttttttctaattttatgccttaaaataggtttctgattacataaaatttgaatagaacactcaagaagtatgtagatttttgaaaaacccaaacaatattcttcttagatttttggaggcaaaatttagaccagtatactaattcaaaagacaaatatttcagaggaagtggagtacagtatttaacattttgtttgcaattttactttttcttcccttcttccctattgaaccttgattaaaatgtatgaatacaatacttggatttttttttttcagcttagactctgataatttcagtggtagtggggaaacctgaatttgtcagcatgattatttgtaactcagattgttcaaatgtatatagaaggtccccttcaagtgttgtttctccaagtagtcataaatgtagcaagtataaatcagaatatcatcttataatcttacagagttaacctaatgagtcaatacctttataagcaaaaccatgataaatttaaaaacaacagaaatgtggcatgattacttatttatttgttccaggtgactctaaatagttgatttttctgcctgaaggatcctgaacatatttagttaccctgtagttatttaggaatttaaaccagaagactttgaagttgtatattcttgcaatgcataaaatgacattataatcaacaaacttatggtttgtttcaattgatgcacacaaaaaataacttatagttagacttttctatttcaagtaaagctttgagttacttatttttatacatattcatcatgtaccctttattgtttctaggtgttgatatactttaataaaaatgatatgtttaatattttcccattaatatatttctttgaagctatttgttttaaaagatgtaacacttatttgctgtcaaattctgaattaaaaaatctgttggtggccaggcgcagtggctcatgcctgtaatcccaacattttgggaggccaaggagatggatcacttgaggccaggagttcaagaccagcctggccaacatggcaaaacc

SEQ ID NO: 41998 - DNA, 5409 bp, Homo sapiens
gcagggcggtcacggcggcctgcccagggcgcagcggggtcgacctttgtgcggggcgggtccctggcagcctcggcccggactcgccgccaacgaggagccgagcgccctggagaacgcgtcggggctgagccggggtccagcagccgccgctatggacatcccgccgctggccggcaagatcgcggcgctgtcgctgagcgccctcccggtgtcctacgcgctcaaccacgtctcggcgctctcgcaccccctgtgggtggcattgatgagcgccctaatcctgggtctgcttttcgtggcggtctacagcttgtcccatggcgaggtctcctatgacccactctatgctgtcttcgctgtcttcgccttcacctcggttgtggacctcatcatcgctcttcaggaagacagctatgtggtgggcttcatggagttctacaccaaggaggtacttgggggacgaccagggagccccctaccgcactgcccgtctgagtctcccacctgcccccacagggagagccatacctgcgcacagcgcacggagtcttcatctgctactgggatggcactgttcactacctcctctacctggccatggccggcgccatctgcagaaggaagagataccggaattttggactctactggctgggttccttcgccatgagcatcctggtgttccttacaggaaacattcttggtgcaagaggaacaaagaaagggactcctgcagcgtccggctgacctggcccttgtcatatatctcatccttgctggcttcttcactctgttccggggcctggtggtgcttgattgccccacagatgcctgctttgtctatatctaccagtatgagccatacctgcgggaccctgtggcctaccctaaggtgcagatgctgatgtacatgttttatgtcctgcctttctgcggcctggctgcctatgctctcaccttccctggttgctcctggcttccagactgggccttggtgtttgctggaggcatcggccaggcagacgccgggattgcgccgcctgcagggacctgcccagtcttaaccgggtgtgcggggagcgcagtccgggtgcgtaggggccgctcggcgggggccgcgcgggcaagatggtgtgcgctcgggcggccctcggtcccggcgcgctctgggccgcggcctggggcgtcctgctgctcacagcccctgcgggggcgcagcgtggccggaagaaggtcgtgcacgtgctggagggtgagtcgggctcggtagtggtacagacagcgcctgggcaggtggtaagccaccgtggtggcaccatcgtcttgccctgccgctaccactatgaggcagccgcccacggtcacgacggcgtccggctcaagtggacaaaggtggtggacccgctggccttcaccgacgtcttcgtggcactaggcccccagcaccgggcattcggcagctaccgtgggcgggctgagctgcagggcgacgggcctggggatgcctccctggtcctccgcaacgtcacgctgcaagactacgggcgctatgagtgcgaagtcaccaatgagctggaagatgacgctggcatggtcaagctggacctggaaggcgtggtctttccctaccacccccgtggaggccgatacaagctgaccttcgcggaggcgcagcgcgcgtgcgccgagcaggacggcatcctggcatctgcagaacagctgcacgcggcctggcgcgacggcctggactggtgcaacgcgggctggttgcgcgacggctcagtgcaataccccgtgaaccggccccgggagccctgcggcggcctgggggggaccgggagtgcagggggcggcggtgatgccaacgggggcctgcgcaactacgggtatcgccataacgccgaggaacgctacgacgccttctgcttcacgtccaacctgccggggcgcgtgttcttcctgaagccgctgcgacctgtacccttctccggagctgcgcgcgcgtgtgctgcgcgtggcgcggccgtggccaaggtggggcagctgttcgccgcgtggaagctgcagctgctagaccgctgcaccgcgggttggctggccgatggcagtgcgcgctaccccatcgtgaacccgcgagcgcgctgcggaggccgcaggcctggtgtgcgcagcctcggcttcccggacgccacccgacggctcttcggcgtctactgctaccgcgctccaggagcaccggacccggcacctggcggctggggctggggctgggcgggcggcggcggctgggcagggggcgcgcgcgatcctgctgcctggacccctctgcacgtctaggctgggagtaggcggacagccagggcgcttgaccactggtctagagccctgtggtcccctggagcctggccacgcccttgaagccctggacactggccacattccctgtggtcccttacaaactaactgtgcccctggggtccctgaagactggctagtcctggcagaacagtactttggagttccctggagcctggccagccctcacctcttctggatagaggattcccccaactccccaactttctccatgagggtcacgccccctgaggacctcaggaggccagcagaacccgcaggctcctgaagactggccacgcctcctgagaccacttggaaacagaccaactgcccccgtggtcgcctggtggctggacccccgggattgactagagaccggccgtacaccttctgcatctcactggagactgaacactagtcccttgcggtcacgtgggacactgggcgcctcctcctccccctcctcctcacctggagagactacaggaacttcagggtcactccccgtggtcacatggaggttgtgggccgaggcgcttattttcccttatggtgacctgagtcctggagactcccattctccccctctccctgagagtcccctgcagtttctgggtaacagggcacacccctctagtttcatgggcgagcacccccatctgccacctcagactgacacacagccagctggctcacttactgggggccacgtcccacccctcagatatttctttgaagggagagcaaacccaccctgtcctctgacgtccctttcccaactgtcaccaaacagaccatcttcccaggcctggggaccggtaagatccatgtcactagttatgcagagcagttgccttgggtcccactgtcaccaaggcaaccagtcctgctgctacctgtcacctagagtcacacaccccttccctcatcaggcacacccatgaagacagtgcctccctcctccagctgtaaccatggataccacacatttctcatctcattggcccccaccccagagacctccacctcaacttctggctgtccctaccctgactcaccgccatggagatcaccctccccgaagctgtcgccagggtgacccaacatccagttctccggctctcaccatggaaacaaactgtccctgtccccaggcccactccagttccagaccaccctccatgctccacccccaggcggtttggaccccaccactgttgccatggtgaccaaactctggagtccgaggtaacagaacacctgtccccctaggcttttccttgtggacaacggggccctgttcaccaagctgttgccatagagactgtcaacgttgtcctcatgacaaccagacttccagttctcaggaacttctcattgtgggccagaagtcctgggtgcctcctactagggctaccctactgcaccccatcaggggcctgatggctgccccttccccagacagggctggacttctggagctgctaagccaccctccgtttgcacgttaactctatgccggatagcagctgtgcacgagacaatcttgcaacacccgggcatgtttgtcgtcgtcctacaaatgaggaaaccgagcctatggcgtgccctggtctgttgagatatgcaagcactgagctcctcttttgtcctctgagaccccatctccattctcacccagttcctctctccttccctgacccccacccacatttccctccttagagatccaggagggatggaatgttctttaaaattcaacacccaccaggctctaagcggcgatctgtgctaagaggtcaggacccagccgaagtcctcggcgttgacaggcagctggggggacatgatccatggacaaggccatcccggccgtgggagaccccagtcccgaagtcttgcctgcaggagtactggggtccccctggggccctctttactgtcacgtcatctctaggaaacctatctctgagttttgggaccaggtcggtttgggtttgaattctgcctcttcttgctcactgtgtgaccaagtgacaaactccttctgaacctgtgttctcccactgtaccagggctgttctgtggtccccgtgagtgccaagcatacagtaggggctcaataaatccttgtttcttttgatgaatgagaaaatgaggcagccagtgggtaattcctgtataaatgcactttggtagataagatgttacaagcttggggggcttggggttttttttgttttgtttttttgagatggagtcctgccctgtcgcccaggctggagtgcagtcgtgcaatcttggctcactgcaacctctgcctcccgggttcaagtgattctcctgcctcagcctcccgagtagctgggattacaggtgcctgccaccacacccggctaatttttgtatttttagtagagacagggtttcaccatgttggccaggctggtcttgaactcctgacctcaggtgatctacccacctcggcctcccaaagtgttggggttacaggtgtgagccactgcgcctggccgggcttgatttttattctctttggaagtggggtccttcattcctcccccacctccccaatctcttgctcctctttcttcccccatcctgtgcccactgtctccctttagccacccaccatgggtctgctccttgtcaactctgtcctgactgggtcattgacaagatccagggcatgaaattcgggaaactggaaggggggttcctgtaccaggaagggagagacattacaaactttccctgacatgaatatgtgggctgagggcaggggctgaggaagcactggaagtttctaggatacaacaaagcatgaagagaaaaaatagtgtaaggtcctgaccgtgcacagtggatcatgcctataatcccagcactttaagagaccaaggtgggaggattgcttgagccagaaggtcgaggctgcagtgagccatgattgtaccactgcactccagcttgggcgacggagtgagaccctgtctcaaaaaataaaaataagtaaatctcctcttcctc

SEQ ID NO: 41999 - DNA, 1876 bp, Homo sapiens
gcagggcggtcacggcggcctgcccagggcgcagcggggtcgacctttgtgcggggcgggtccctggcagcctcggcccggactcgccgccaacgaggagccgagcgccctggagaacgcgtcggggctgagccggggtccagcagccgccgctatggacatcccgccgctggccggcaagatcgcggcgctgtcgctgagcgccctcccggtgtcctacgcgctcaaccacgtctcggcgctctcgcaccccctgtgggtggcattgatgagcgccctaatcctgggtctgcttttcgtggcggtctacagcttgtcccatggcgaggtctcctatgacccactctatgctggaagacagctatgtggtgggcttcatggagttctacaccaaggaggtacttgggggacgaccagggagccccctaccgcactgcccgtctgagtctcccacctgcccccacagggagagccatacctgcgcacagcgcacggagtcttcatctgctactgggatggcactgttcactacctcctctacctggccatggccggcgccatctgcagaaggtgcaggaggcagggagagggtggcccctgaccctgggagagaagttgcatcctcagatggggtcccagggcagggtggagccagaagtgtctgtaggagaaatcaggacgcctctctagggctccagccaggggtggccaggagaaggttccagggaacgtctcaggtgtaggtggtggcctagcattgcttacatccaccctgtgcctgggcagccacttctgttcttggacagagggtctcactgttatttccccgttcaactccctgttgtcccttccatcctgggcaaaactgaaagggacccggagctgggaaacccacggtggtctccaggccctggctggggctctgagattacggagtgactacctgctggtcacccctccatcccctgctcaggaagagataccggaattttggactctactggctgggttccttcgccatgagcatcctggtgttccttacaggaaacattcttggtgcaagaggaacaaagaaagggactcctgcagcgtccggctgacctggcccttgtcatatatctcatccttgctggcttcttcactctgttccggggcctggtggtgcttgattgccccacagatgcctgctttgtctatatctaccagtatgagccatacctgcgggaccctgtggcctaccctaaggtgcagatgctgatgtacatgttttatgtcctgcctttctgcggcctggctgcctatgctctcaccttccctggttgctcctggcttccagactgggccttggtgtttgctggaggcatcggccaggcacagttctcgcacatgggggcttccatgcacctgcgcacacccttcacctaccgtgtgcctgaggacacctggggctgcttcttcgtgtgcaatctgctgtatgcgctgggcccccacctgctggcctaccgttgccttcagtggcccgcattcttccaccagccaccaccctccgaccccctagccctccacaagaagcagcattgagagagctgtggactcaggacccaggactctgtttacgtgcccagtcagccctacctggggaagcgggggttgggtgttttagagacaggagggacatctccgggtgtctttagtcttggctatggtagtttcagtccagtgggtgggatggagaccaacgaccaagtgttcctgcaaggagagcctcccacagctgtcaccatgctccaactcccacacaaacgcttctaccccttccagaacttacccatcatccccccatggatcctttcagtaaaaaccctttcaatttcca

SEQ ID NO: 42000 - DNA, 1786 bp, Homo sapiens
  misc_feature (561)..(561): n is a, c, g, or t
  misc_feature (1341)..(1341): n is a, c, g, or t
  misc_feature (1582)..(1582): n is a, c, g, or t
  misc_feature (1777)..(1777): n is a, c, g, or t
gattggcccagcgtgaatcacttgcccatcccttactgagcatcatggacagggggctggaatgctccgactggctaggccagggtcgcatgccactttcagagaaaggttagtaggtttggtgtatgtgttcgggggttgggggcaaggatccccaagggaaatagaggagcactttgcagagagcctgggtggggtctgaggccatccagatccttcctcagggcctccacctcaggggtctcaggagacccacctggggtagctgctcatctcacaggctggtgcccctctcctcccgcccctgcagatgctgatgtacatgttttatgtcctgcctttctgcggcctggctgcctatgctctcaccttccctggttgctcctggcttccagactgggccttggtgtttgctggaggcatcggccaggtgaggtggcggatgggtgggtgagcaggcatgtgggagggaatttctgtctactcatcaatgcctttggtgtcctccctgggcactgtaatgatgagcccccaagaggccccagccccaggcccaatatnccaggattccctagtctaggggagacaaagccagatacagacactccaagccccatgaaaatagggacaggggctgtgaaggattccagaggggaaaggtttcctagaagcaaggcataggagctaggctttgatgtacgaggatgagttctccaggcagggaagggcattccaggaatgggaacagcacaaggagaagcacagagggagagagtgacttagcagggccataacccaggtaaaggcagataagagaaattggcagctggatgctgaaggctttgaactctgggactaggggcttgtactgagggtgatggggcgtttgaggaggagtttgagcagtgaggggcccagtcagagctaggagcctttttctgggttcctgatgaaaagtgctaaatcctgggccccggccagggaagtagggaccaggaaaacatttagaatccacaggatttgtgccaagacctctggggtggggaagactgggaggaggatctggagccaggtcagagagagatggggtgcagggcccaggagatggggttaggcaagttgggggggactcaccaggtgaggtggctcacacctgtaatcccagcattttgggaggccgaggtgggagggctgcttgagcccaggagtctgagaccagcctaggcaacatggcaaaaacctgtctctacaaaaagtacaaaaattagctgggcatggtagcacgtgcctgctgtgctagctactcgggaggctgagattggaggatcacttgagcccagnaggttggggctgcagtgagccatgattgtgccactgcactccagcctggccaacagagcaagaccctatctctaaatagatagatagatggatggatggatagatagatagatagatagatagatagatagatagatagatagaaattttaaaaataggccaggcatggtggcttatgcctgtaatcctagcactttgggaggccaagatggatggattgcctgacctcaggagttcgagnccagcctgggcaacatgatgataccccatctctactaaaaatacaaaaaattaactgggcatagaggtgcacgcctgtagtcccagctactcagaggaggctgaagcacgagaatcacttgaacccaggaggcagcggaggttgcagtgaaccgagattgcaccactgcactccagcatgggcaacagaatgagnctgtgtctc

SEQ ID NO: 42001 - DNA, 2286 bp, Homo sapiens
tcgaacctggcgccgttacttagggcacctctcttgtgccctgttggaccggggaaaacccagtggcgagctattttatgcagagcagttgccttgggtcccactgtcaccaaggcaaccagtcctgctgctacctgtcacctagagtcacacaccccttccctcatcaggcacacccatgaagacagtgcctccctcctccagctgtaaccatggataccacacatttctcatctcattggcccccaccccagagacctccacctcaacttctggctgtccctaccctgactcaccgccatggagatcaccctccccgaagctgtcgccagggtgacccaacatccagttctccggctctcaccatggaaacaaactgtccctgtccccaggcccactccagttccagaccaccctccatgctccacccccaggcggtttggaccccaccactgttgccatggtgaccaaactctggagtccgaggtaacagaacacctgtccccctaggcttttccttgtggacaacggggccctgttcaccaagctgttgccatagagactgtcaacgttgtcctcatgacaaccagacttccagttctcaggaacttctcattgtgggccagaagtcctgggtgcctcctactagggctaccctactgcaccccatcaggggcctgatggctgccccttccccagacagggctggacttctggagctgctaagccaccctccgtttgcacgttaactctatgccggatagcagctgtgcacgagacaatcttgcaacacccgggcatgtttgtcgtcgtcctacaaatgaggaaaccgagcctatggcgtgccctggtctgttgagatatgcaagcactgagctcctcttttgtcctctgagaccccatctccattctcacccagttcctctctccttccctgacccccacccacatttccctccttagagatccaggagggatggaatgttctttaaaattcaacacccaccaggctctaagcggcgatctgtgctaagaggtcaggacccagccgaagtcctcggcgttgacaggcagctggggggacatgatccatggacaaggccatcccggccgtgggagaccccagtcccgaagtcttgcctgcaggagtactggggtccccctggggccctctttactgtcacgtcatctctaggaaacctatctctgagttttgggaccaggtcggtttgggtttgaattctgcctcttcttgctcactgtgtgaccaagtgacaaactccttctgaacctgtgttctcccactgtaccagggctgttctgtggtccccgtgagtgccaagcatacagtaggggctcaataaatccttgtttcttttgatgaatgagaaaatgaggcagccagtgggtaattcctgtataaatgcactttggtagataagatgttacaagcttggggggcttggggttttttttgttttgtttttttgagatggagtcctgccctgtcgcccaggctggagtgcagtcgtgcaatcttggctcactgcaacctctgcctcccgggttcaagtgattctcctgcctcagcctcccgagtagctgggattacaggtgcctgccaccacacccggctaatttttgtatttttagtagagacagggtttcaccatgttggccaggctggtcttgaactcctgacctcaggtgatctacccacctcggcctcccaaagtgttggggttacaggtgtgagccactgcgcctggccgggcttgatttttattctctttggaagtggggtccttcattcctcccccacctccccaatctcttgctcctctttcttcccccatcctgtgcccactgtctccctttagccacccaccatgggtctgctccttgtcaactctgtcctgactgggtcattgacaagatccagggcatgaaattcgggaaactggaaggggggttcctgtaccaggaagggagagacattacaaactttccctgacatgaatatgtgggctgagggcaggggctgaggaagcactggaagtttctaggatacaacaaagcatgaagagaaaaaatagtgtaaggtcctgaccgtgcacagtggatcatgcctataatcccagcactttaagagaccaaggtgggaggattgcttgagccagaaggtcgaggctgcagtgagccatgattgtaccactgcactccagcttgggcgacggagtgagaccctgtctcaaaaaataaaaataagtaaatctcctcttcctc

SEQ ID NO: 42002 - DNA, 5452 bp, Homo sapiens
gcagggcggtcacggcggcctgcccagggcgcagcggggtcgacctttgtgcggggcgggtccctggcagcctcggcccggactcgccgccaacgaggagccgagcgccctggagaacgcgtcggggctgagccggggtccagcagccgccgctatggacatcccgccgctggccggcaagatcgcggcgctgtcgctgagcgccctcccggtgtcctacgcgctcaaccacgtctcggcgctctcgcaccccctgtgggtggcattgatgagcgccctaatcctgggtctgcttttcgtggcggtctacagcttgtcccatggcgaggtctcctatgacccactctatgctgtcttcgctgtcttcgccttcacctcggttgtggacctcatcatcgctcttcaggaagacagctatgtggtgggcttcatggagttctacaccaaggaggtacttgggggacgaccagggagccccctaccgcactgcccgtctgagtctcccacctgcccccacagggagagccatacctgcgcacagcgcacggagtcttcatctgctactgggatggcactgttcactacctcctctacctggccatggccggcgccatctgcagaaggtgcaggaggcagggagagggtggcccctgaccctgggagagaagttgcatcctcagatggggtcccagggcagggtggagccagaagtgtctgtaggagaaatcaggacgcctctctagggctccagccaggggtggccaggagaaggttccagggaacgtctcaggtgtaggtggtggcctagcattgcttacatccaccctgtgcctgggcagccacttctgttcttggacagagggtctcactgttatttccccgttcaactccctgttgtcccttccatcctgggcaaaactgaaagggacccggagctgggaaacccacggtggtctccaggccctggctggggctctgagattacggagtgactacctgctggtcacccctccatcccctgctcaggaagagataccggaattttggactctactggctgggttccttcgccatgagcatcctggtgttccttacaggaaacattcttggtgcaagaggaacaaagaaagggactcctgcagcgtccggctgacctggcccttgtcatatatctcatccttgctggcttcttcactctgttccggggcctggtggtgcttgattgccccacagatgcctgctttgtctatatctaccagtatgagccatacctgcgggaccctgtggcctaccctaaggtgcagatgctgatgtacatgttttatgtcctgcctttctgcggcctggctgcctatgctctcaccttccctggttgctcctggcttccagactgggccttggtgtttgctggaggcatcggccaggcagacgccgggattgcgccgcctgcagggacctgcccagtcttaaccgggtgtgcggggagcgcagtccgggtgcgtaggggccgctcggcgggggccgcgcgggcaagatggtgtgcgctcgggcggccctcggtcccggcgcgctctgggccgcggcctggggcgtcctgctgctcacagcccctgcgggggcgcagcgtggccggaagaaggtcgtgcacgtgctggagggtgagtcgggctcggtagtggtacagacagcgcctgggcaggtggtaagccaccgtggtggcaccatcgtcttgccctgccgctaccactatgaggcagccgcccacggtcacgacggcgtccggctcaagtggacaaaggtggtggacccgctggccttcaccgacgtcttcgtggcactaggcccccagcaccgggcattcggcagctaccgtgggcgggctgagctgcagggcgacgggcctggggatgcctccctggtcctccgcaacgtcacgctgcaagactacgggcgctatgagtgcgaagtcaccaatgagctggaagatgacgctggcatggtcaagctggacctggaaggcgtggtctttccctaccacccccgtggaggccgatacaagctgaccttcgcggaggcgcagcgcgcgtgcgccgagcaggacggcatcctggcatctgcagaacagctgcacgcggcctggcgcgacggcctggactggtgcaacgcgggctggttgcgcgacggctcagtgcaataccccgtgaaccggccccgggagccctgcggcggcctgggggggaccgggagtgcagggggcggcggtgatgccaacgggggcctgcgcaactacgggtatcgccataacgccgaggaacgctacgacgccttctgcttcacgtccaacctgccggggcgcgtgttcttcctgaagccgctgcgacctgtacccttctccggagctgcgcgcgcgtgtgctgcgcgtggcgcggccgtggccaaggtggggcagctgttcgccgcgtggaagctgcagctgctagaccgctgcaccgcgggttggctggccgatggcagtgcgcgctaccccatcgtgaacccgcgagcgcgctgcggaggccgcaggcctggtgtgcgcagcctcggcttcccggacgccacccgacggctcttcggcgtctactgctaccgcgctccaggagcaccggacccggcacctggcggctggggctggggctgggcgggcggcggcggctgggcagggggcgcgcgcgatcctgctgcctggacccctctgcacgtctaggctgggagtaggcggacagccagggcgcttgaccactggtctagagccctgtggtcccctggagcctggccacgcccttgaagccctggacactggccacattccctgtggtcccttacaaactaactgtgcccctggggtccctgaagactggctagtcctggcagaacagtactttggagttccctggagcctggccagccctcacctcttctggatagaggattcccccaactccccaactttctccatgagggtcacgccccctgaggacctcaggaggccagcagaacccgcaggctcctgaagactggccacgcctcctgagaccacttggaaacagaccaactgcccccgtggtcgcctggtggctggacccccgggattgactagagaccggccgtacaccttctgcatctcactggagactgaacactagtcccttgcggtcacgtgggacactgggcgcctcctcctccccctcctcctcacctggagagactacaggaacttcagggtcactccccgtggtcacatggaggttgtgggccgaggcgcttattttcccttatggtgacctgagtcctggagactcccattctccccctctccctgagagtcccctgcagtttctgggtaacagggcacacccctctagtttcatgggcgagcacccccatctgccacctcagactgacacacagccagctggctcacttactgggggccacgtcccacccctcagatatttctttgaagggagagcaaacccaccctgtcctctgacgtccctttcccaactgtcaccaaacaaggcccactccagttccagaccaccctccatgctccacccccaggcggtttggaccccaccactgttgccatggtgaccaaactctggagtccgaggtaacagaacacctgtccccctaggcttttccttgtggacaacggggccctgttcaccaagctgttgccatagagactgtcaacgttgtcctcatgacaaccagacttccagttctcaggaacttctcattgtgggccagaagtcctgggtgcctcctactagggctaccctactgcaccccatcaggggcctgatggctgccccttccccagacagggctggacttctggagctgctaagccaccctccgtttgcacgttaactctatgccggatagcagctgtgcacgagacaatcttgcaacacccgggcatgtttgtcgtcgtcctacaaatgaggaaaccgagcctatggcgtgccctggtctgttgagatatgcaagcactgagctcctcttttgtcctctgagaccccatctccattctcacccagttcctctctccttccctgacccccacccacatttccctccttagagatccaggagggatggaatgttctttaaaattcaacacccaccaggctctaagcggcgatctgtgctaagaggtcaggacccagccgaagtcctcggcgttgacaggcagctggggggacatgatccatggacaaggccatcccggccgtgggagaccccagtcccgaagtcttgcctgcaggagtactggggtccccctggggccctctttactgtcacgtcatctctaggaaacctatctctgagttttgggaccaggtcggtttgggtttgaattctgcctcttcttgctcactgtgtgaccaagtgacaaactccttctgaacctgtgttctcccactgtaccagggctgttctgtggtccccgtgagtgccaagcatacagtaggggctcaataaatccttgtttcttttgatgaatgagaaaatgaggcagccagtgggtaattcctgtataaatgcactttggtagataagatgttacaagcttggggggcttggggttttttttgttttgtttttttgagatggagtcctgccctgtcgcccaggctggagtgcagtcgtgcaatcttggctcactgcaacctctgcctcccgggttcaagtgattctcctgcctcagcctcccgagtagctgggattacaggtgcctgccaccacacccggctaatttttgtatttttagtagagacagggtttcaccatgttggccaggctggtcttgaactcctgacctcaggtgatctacccacctcggcctcccaaagtgttggggttacaggtgtgagccactgcgcctggccgggcttgatttttattctctttggaagtggggtccttcattcctcccccacctccccaatctcttgctcctctttcttcccccatcctgtgcccactgtctccctttagccacccaccatgggtctgctccttgtcaactctgtcctgactgggtcattgacaagatccagggcatgaaattcgggaaactggaaggggggttcctgtaccaggaagggagagacattacaaactttccctgacatgaatatgtgggctgagggcaggggctgaggaagcactggaagtttctaggatacaacaaagcatgaagagaaaaaatagtgtaaggtcctgaccgtgcacagtggatcatgcctataatcccagcactttaagagaccaaggtgggaggattgcttgagccagaaggtcgaggctgcagtgagccatgattgtaccactgcactccagcttgggcgacggagtgagaccctgtctcaaaaaataaaaataagtaaatctcctcttcctc

SEQ ID NO: 42003 - DNA, 877 bp, Homo sapiens
gattggcccagcgtgaatcacttgcccatcccttactgagcatcatggacagggggctggaatgctccgactggctaggccagggtcgcatgccactttcagagaaaggttagtaggtttggtgtatgtgttcgggggttgggggcaaggatccccaagggaaatagaggagcactttgcagagagcctgggtggggtctgaggccatccagatccttcctcagggcctccacctcaggggtctcaggagacccacctggggtagctgctcatctcacaggctggtgcccctctcctcccgcccctgcagatgctgatgtacatgttttatgtcctgcctttctgcggcctggctgcctatgctctcaccttccctggttgctcctggcttccagactgggccttggtgtttgctggaggcatcggccaggcacagttctcgcacatgggggcttccatgcacctgcgcacacccttcacctaccgtgtgcctgaggacacctggggctgcttcttcgtgtgcaatctgctgtatgcgctgggcccccacctgctggcctaccgttgccttcagtggcccgcattcttccaccagccaccaccctccgaccccctagccctccacaagaagcagcattgagagagctgtggactcaggacccaggactctgtttacgtgcccagtcagccctacctggggaagcgggggttgggtgttttagagacaggagggacatctccgggtgtctttagtcttggctatggtagtttcaagctgtcaccatgctccaactcccacacaaacgcttctaccccttccagaacttacccatcatccccccatggatcctttcagtaaaaaccctttcaatttcca

SEQ ID NO: 42004 - DNA, 1447 bp, Homo sapiens
gcagggcggtcacggcggcctgcccagggcgcagcggggtcgacctttgtgcggggcgggtccctggcagcctcggcccggactcgccgccaacgaggagccgagcgccctggagaacgcgtcggggctgagccggggtccagcagccgccgctatggacatcccgccgctggccggcaagatcgcggcgctgtcgctgagcgccctcccggtgtcctacgcgctcaaccacgtctcggcgctctcgcaccccctgtgggtggcattgatgagcgccctaatcctgggtctgcttttcgtggcggtctacagcttgtcccatggcgaggtctcctatgacccactctatgctgtcttcgctgtcttcgccttcacctcggttgtggacctcatcatcgctcttcaggaagacagctatgtggtgggcttcatggagttctacaccaaggagggagagccatacctgcgcacagcgcacggagtcttcatctgctactgggatggcactgttcactacctcctctacctggccatggccggcgccatctgcagaaggaagagataccggaattttggactctactggctgggttccttcgccatgagcatcctggtgttccttacaggaaacattcttggcaaatacagctccgagatcaggcctgccttcttcctcaccatcccctacctgctggtgccatgctgggctggcatgaaggtcttcagccagccccgggcgctaacccgctgcaccgccaacatggtgcaagaggaacaaagaaagggactcctgcagcgtccggctgacctggcccttgtcatatatctcatccttgctggcttcttcactctgttccggggcctggtggtgcttgattgccccacagatgcctgctttgtctatatctaccagtatgagccatacctgcgggaccctgtggcctaccctaaggtgcagatgctgatgtacatgttttatgtcctgcctttctgcggcctggctgcctatgctctcaccttccctggttgctcctggcttccagactgggccttggtgtttgctggaggcatcggccaggcacagttctcgcacatgggggcttccatgcacctgcgcacacccttcacctaccgttgccttcagtggcccgcattcttccaccagccaccaccctccgaccccctagccctccacaagaagcagcattgagagagctgtggactcaggacccaggactctgtttacgtgcccagtcagccctacctggggaagcgggggttgggtgttttagagacaggagggacatctccgggtgtctttagtcttggctatggtagtttcaagctgtcaccatgctccaactcccacacaaacgcttctaccccttccagaacttacccatcatccccccatggatcctttcagtaaaaaccctttcaatttcca

SEQ ID NO: 42005 - DNA, 935 bp, Homo sapiens
gattggcccagcgtgaatcacttgcccatcccttactgagcatcatggacagggggctggaatgctccgactggctaggccagggtcgcatgccactttcagagaaaggttagtaggtttggtgtatgtgttcgggggttgggggcaaggatccccaagggaaatagaggagcactttgcagagagcctgggtggggtctgaggccatccagatccttcctcagggcctccacctcaggggtctcaggagacccacctggggtagctgctcatctcacaggctggtgcccctctcctcccgcccctgcagatgctgatgtacatgttttatgtcctgcctttctgcggcctggctgcctatgctctcaccttccctggttgctcctggcttccagactgggccttggtgtttgctggaggcatcggccaggcacagttctcgcacatgggggcttccatgcacctgcgcacacccttcacctaccgtgtgcctgaggacacctggggctgcttcttcgtgtgcaatctgctgtatgcgctgggcccccacctgctggcctaccgttgccttcagtggcccgcattcttccaccagccaccaccctccgaccccctagccctccacaagaagcagcattgagagagctgtggactcaggacccaggactctgtttacgtgcccagtcagccctacctggggaagcgggggttgggtgttttagagacaggagggacatctccgggtgtctttagtcttggctatggtagtttcagtccagtgggtgggatggagaccaacgaccaagtgttcctgcaaggagagcctcccacagctgtcaccatgctccaactcccacacaaacgcttctaccccttccagaacttacccatcatccccccatggatcctttcagtaaaaaccctttcaatttcca

SEQ ID NO: 42006 - DNA, 909 bp, Homo sapiens
ataccaactttattctaattttgaagctaactggacactccacttatgtattgacatgtttaactaattacatcaaatcacgctatgcaagaaaattaatacacattccattagtaggaatgaatacttacttaaagatcaggcctggccaccttacaactccaaaagtttgggaagtacacaagataaaattgatatcttttttttaaagaaaggaatgtcaacagataaaaacagatcaagtaggtaccagaatatcatcaaaatgtcacttagcaaaaatctagtttcattgggaatattcaatattgtacaaatcttcaaataaaagataattgctaatcatacagtgacttatgaaaacatttgttacaggattcaatctaaacagattttattatatctatatctgacagatatagtaatgttaataagagccaactgttggaaattgtactggatattacaatattgttacacagaaatggttattgaacaatattcgttaaaatgggagtttatactagttgcaattaactcccaccattggaaatgcatatttattttaaaatatcccaaaaatacacacacaaaaaccttaatgcatacataaataaatcttacttcttagatatttgaatcattttaattagccttacttttgagaatatttcattttgaggccagagaattgaagtttgtccttaacattaatctaactgctacttaagtgattctcatttagactgtagctctttcaatacaaaggcctaactccttttaaagttctttcctagatctccttccctgaataacataaataatgttgagtatttgttgaattgtatctaacaaatatctggaatcacaccatcttccatttataatgagaagttaggtctgtcagat

SEQ ID NO: 42007 - DNA, 413 bp, Homo sapiens
attattatcacttctactattatcattctcattgctcccaaattacattagctagaagcaattcagttcacataaaacatacagataatgaaagttttaataacaatatcactctgtttccagaaagacctaatatttgctgttgtggtggcaaataccttgcccagagctcccagatagtctgccacctcccccgtcctccctccagggcatgtacagtaaagttggatgattgaagtgttccagatgactcggctttgggcactcaaactgctttgtccccagcacctggtttattcctcctcctctcttccacaccttgttttccttctttgaaggaatggagggacgcttcagcagaaggagtaggaaaggatgcaatggtggttggttgtaataaacaggagcctggg

SEQ ID NO: 42008 - DNA, 395 bp, Homo sapiens
taagctgttatatttaaaaatgcttgaaaaaataagagttgttctccagaaattattcattttcctatgattagcacagctgagaccttacaggtgcactgctattgagtattctcccaaccttttaaattttataggtctaattgttggtaaggtattgtggaaggagttctaagacttgctcctgctttaattgacgttgcaataaaatataataaattttggtcagagtagccaggggggttgttagaaagaaaaaaaagaattgaaggtaagagaatgatcaccaaagtaaatggttaattagaagtgttttctgctgggcactcagggagatactgacatacactccattctcccttgctaatatctagatttttttagtacctctaata

SEQ ID NO: 42009 - DNA, 445 bp, Homo sapiens
aatattagagtacagtgtcttaaaatattcatgttttacttggatatctagaagataaaaggcattctgtattttatgtcaactattgctagtagcttttacctatgggagtaaatccgtggaagaagttttgctcaatgtatgctaacatgaagcagctttctgttttcagtttattccctcagatattagtttgttttttctctttttaatttgggaaagcaaaatgaggccagcattcgttctatgtttgtgttagagcagcggtctccagaatgtattgaagggccacaagtgttataaagttaaatgatgactgctgactttcagtcttcctctctatacttaggtacttctttttaaaaatggagttttgttacaggtttaggatgatttttttttttacaaaataaaaatttaataaattaattttcagaaatcaata

SEQ ID NO: 42010 - DNA, 464 bp, Homo sapiens
atcccaggcacagcataattatccaatcttgcctgacatgcgaggattagaaagaaatgacatagcatctggctctgctactcttggtcctcatagttttcatagggaagctgcagacccatatggattgctgtcttatcagaccacctgagcagagcaggttttgtgtgtatttctgtcttctttcattgaaaatattagcctagatttccagaaatccagcatcttcacgggcattggtgctgcaggagagccatttttcactgtgacagggtcagcttaactgccctctggtgtagttatttgattgcagttttctttgatataaactgctctgagatgtccttaaaaaaattgtggatgttgacagacttcaaagtatgttggaattaatgaccaggtttctcctagcacccctctgatctgattttagatatagtctgtcttcatagtggtttgtcaga

SEQ ID NO: 42011 - DNA, 406 bp, Homo sapiens
ggttctttgaaaacatccattaagattaataaaacttgaaatgattaaagttctgccaaaattttaaaaaaagacacaaacagtattagaaatggaaaaatgaggcctaaatagagacgctgcagagattagaccattaacagaaatgaacaattttatggtaataaatttaaatgttggtaaaatgaatcaattcctagaagacatcaaacatcaacttaccaaaactgactctggaagagacagaaaatcaaataggcacagaccatcaagaaaatcgaatcagttattaaataatcttctcaaaataaaaacactaggcccacatgacatagatgacattataggtaaatcctaccaaatagacacacaatcctgttcttaaactatcaaaagtttaaaaaaa

SEQ ID NO: 42012 - DNA, 266 bp, Homo sapiens
agtatatcttatttcatgtgatattttcagattgcagttgactatggataattgaaactgaggaaagcgaaatcacacataaggggggaactactatattttattaagggaaacaatctgttcccataaatcaaacctcagctagcagaattaaaggtaaacttgaggagttagggatcatcacggtgatgggaagaaggactagaatgcagctctacacagagcagcacacggagtcttgcgttgtgaattttaggtccagattg

SEQ ID NO: 42013 - DNA, 1217 bp, Homo sapiens
aagtgtttgctgatatagaaacggaataacggcgctgtgggctggggaggacggagttgccttcaggcttctggtctccagccgcggggcactcacagctgccgctgtgaaaatgcagacctgtggggcaggaattccgagtccggggtggagcgcgatgtggaatctgactcgcttgaaacagcaccgcggtggattcggatccgggtgagtagggaaatgcgcctcagcccctcccacgggccgcccacggattccaggatccgaaaacgcttccagctcgctccgccaccccaggaaggcagcgcctgcctctgggcggttctgacggaaactggctcctccgcctgcaggaaaactcacaactaaggggccaggagaaagcctctcagggtcccgccccttcagtgaggatcctaaatttacatcccgagtgtggccccatcaaagactggagcgacgttgactgaaatgatacaagaccagcagggcgcaggcgctgcggccctcagaatgcggtgacagcgccgcctcgcgtcccttccccgacctgccccaggcggacgcggtgacgtgtgttggcctcgaggctggaatacaccggggatcaagtgcagagaagggagaaagtagggaaggatggctggggggtgggggtggggggagcgtgttgaagaaaaaagggaagagagaggaaggaaagaggagaaaaaaggtgaagaagagaataacatttaaaatatagagttttattatttctaacttttatttttggtttttatctagttttggtatgtatgaatattcttaacatagctttatctctgtctctctctctgaatctgtaaatatacagtaatatatatacacacgtaagcctctacctgccgatgtgtcagggtgtgtctcttgggcacaaaaacaaggtttttgttttgttttgttttacataagcaaagtacaaatctcaaagaagatatattttaaaagccattttattgggacttgctttgcatacaatcaaatgtatctaaaatgtatctatttgaaatgcatagctcgttgtgttttggctgttgtacacacccacatctccactaccacaatgaagatgtagaacatttccatcgtcctccaaagaactgctatgcaatacaattttatagggtcaataaaagaggtaagatcagttttaagtattgttatgagaagatgtg

SEQ ID NO: 42014 - DNA, 443 bp, Homo sapiens
gagagaatagctataactaagtcagagtccagtgggataggtactaaggacaatctcagtagcagctatctagaggtgaacttttccatctaatctatttaggcctcaagagcctttcatttttgaagctatctcaagtgacagcagaacaattaacaattggaaaaaagattaggattcatatttatcaacaaagagaggggttgggcagtgtctcacgtctgtaatctcagcactttgggaagctgaggtgggagcatcacttgaggctaggagtttgagaccagtctgggcaacacagtgagaccccatctgtacaaaaaataatttttaaaaattagccaggcatggtggcacatgcctatagtcctagatactcaggaggctgagacaggaggatcacttgagctcaggagtttgagatgtgccattgcactccagcc

SEQ ID NO: 42015 - DNA, 422 bp, Homo sapiens
gcagggtgaccttaggagagtgacttacctcctctgtgcctcagtttccacatgcctggaataaggacaataatagcatccactttataatattgtggcaaaggtaatctgaaatgaggcatgtaaaagtgttcataataggatctggcacatagtaagtttcaataaatgttagctctgatcaacttcatcattgtcatcattgtaatcaccagcacagacaagaagcaggcatgccttgctctgaaaataggttgcaagaatttcaaacagtggttttcaaacctggctacatattaaaatcagctgccccagattccccaaccctggaccaattagatcagaatctcccaggtggtattgtttaaagctctttacatgattccagtgtgctaccagggttgagactcactgatgttgag

SEQ ID NO: 42016 - DNA, 491 bp, Homo sapiens
tggagtctccaccacctattattcctgtctgtatgttaatgtgtatacattgtttagctccttcttataagtgagaacatgcagtgaaattaaaattttagaactgacaaatataatacctgaaataaaaatctactcagtggatttaaaagtagattgcactgtccacaatagctaagatttggaagcaacctacgtgtccatcaacagatgaatggataaagaaaatgtggtatatatacacaatggagtactattcagtcataaaaaagaatgagatcctgtcatttgccacaacatggatggaattggagcttattatgttaactgaaataagccaggcacagaaagacaaacatcacatgttctcacttattcgtgggatcgaaagatcaaaacaattgaactcatggacacagagaatagaggatggacatcgagagtagagggtagtgggggactgagggggagacagggatggttagtaagta

SEQ ID NO: 42017 - DNA, 625 bp, Homo sapiens
tcatggacaactgaactttttgaaaaataatatattttaagtgaaagttccccaaaatgatacatttaccatagaaaatttacagcagtgcatgctagttttatattaaacctttcagtaccttctatttctcccttgttcaggttataagcataagtcctgaaatgctattaaaagcagtgactcaccttgtttaccttaagtttgaatacagagtataacaaaactaccattcctgacaagagtggcctctagaccggtagctctcaaccaggagtgattttgtccctaggagacatttggcaacgtctgaacaatttttggctatcataatcgggttctactggcatctagtgggtagaggccagggatgcttctaatgcacaggagagcccctcacaacaaagaattctctgtcccaaaatgtctatatgttgctcttgagaaactgctctagattatagatcatactagccaagtattgtggtgcacacctatagtcccctgtagtcctgactacttgggaggctgaagcagaaggattgcttgagcccaggagtgggagaccacatagagttatgaccatgccaccgcactgtgtagccagggcaacagccagcctggg

SEQ ID NO: 42018 - DNA, 753 bp, Homo sapiens
gaaagatgtataatgtagagaactgacttctctcttaaaaagtacagagagcctgtgctgtgaacccccttcaatgggaaaaagctgcagtggtgatggcaggctcctaaagactgctgctaaaagacacaagaattatacagtttccctctataagtgaatccaaaattcactgacgaattcagagattgagggcacttgcttgaaatcaaggtgctccaacttagtttaagacctccagactctaactttatagatcatctcttctagagtgtgcatggatgtgtgttgcagggtggagaagtggggagaagtgtatagtagtacacggggggaagaggggacctccatgtccctttgttggatacatattacagaaatatgtgccactcactttttgttggttctgaatcttcctgaagtgtactgacatttgggctgcacagagccccacaccttcacttacacctcctcttctagaattgctttgctctatttttgtatatataaatatgttatgatgattattaataatgttaatgatattgctgcaaatggtgccatatataaggttaggcttcttggaacatttataaacccaaaccaatacctgtaacctcttatgttgctttcagatccttcaattttaagtaactttttaatcttacaagtctgcttgattgtactttacacttatctaccctgaaaagctctgcccagttctctgggtcaagctggatggtgatgagtagc

SEQ ID NO: 42019 - DNA, 350 bp, Homo sapiens
tttcgattatactatagagcaaaaaaaatcgtgtaggtgtggataagtgagtatgtatgtgagtgtgccatgtggatttgcttgtatgaagacatgaagaaaatacaaagggaaactcttatttctgagaggtaggattgtgggtgagttttttcctttatggttgtttttattttagatattttctacagtgatcatgtattttattataaaagtgttataaaaatgagtttttacatgctatatagaactaaaaacacttacaaatgcaaaaacattatgtcttttgaaatgcaaggcctctacagaaacagtatccctcctgtttttaaaatcacacttttgatacc

SEQ ID NO: 42020 - DNA, 1433 bp, Homo sapiens
atactgcgccggacagacccagttgcctggtgctgcggcccggcgtgggcctcgtgggcagagccagagccagagccatggacagcctcttcgtggaggaggtggccgcctccttggtcagggagttcctcagcagaaagggcttaaagaagacatgtgtgaccatggaccaggaacgcccacgctctgacctcagcataaacaacagaaatgatcttcgaaaggttttgcatcttgaatttctctataaggagaacaaggcaaaggaaaatcctctaaaaacaagccttgaactcatcaccagatactttctggatcactttggaaatacggctaacaatttcactcaagataccccaatccctgcactctcagttccaaagaaaaataacaaagtgccatcaagatgctcagagactacactggtaaatatatatgacctttcagatgaagatgcaggatggagaacatcattgtcagaaacaagcaaagccagacatgacaatcttgatggagatgtacttggtaattttgtatcatctaaaaggcccccgcacaaaagtaagcccatgcagacggtcccgggtgaaactcctgtgttgacttctgcatgggagaagatagacaagcttcactcggagccttccttggatgtgaagaggatgggagagaattccaggccaaagtctggtctgattgtgcgaggcatgatgtctgggcccatcgccagctccccacaggattcttttcacagacactatctgagacggtcctcaccgtcaagcagctccacccaaccccaagaagagagccggaaggtccctgagctctttgtctgcacccaacaggacattctggcttcgagcaacagctccccctccaggacctccctgggtcagcttagtgaactgaccgtagaaaggcagaaaaccactgccagcagccctccccatctgcccagcaaacggctgcccccatgggacagggccaggccgagggatccctccgaggacaccccagcagtggacggcagcacagacatggacaggatgcccttgaagctctacttgcctggtggtaattccaggatgacccaggagaggctggaaagagcgttcaaacggcagggcagccagcccgcacctgtcaggaaaaatcagttgctgccgtctgacaaggtggatggtgagctgggtgccctgcggctcgaggatgtggaggatgagttgataagggaagaggtcatcctgtcgccagtcccatcagtgctcaagttgcagacagcatcaaaaccaattgacctctcagtagcaaaggaaataaagacccttctgtttggttccagcttttgctgtttcaatgaagaatggaaacttcagagtttttcctttagtaacacagcctcattaaaatacggcatagtgcagaacaag

SEQ ID NO: 42021 - DNA, 873 bp, Homo sapiens
ccctgccttatccacctccctgccagccgcctctctgatatcagtgactcgcccatggggtgcagccctcccctgttggggccacacaggatgctggaattctggggtctcaggcccagagctgccgtagggccacctgaaccctgacgactccagcggtaccggccagcctttcactcacatacagcttacgcttcacagtttgacctgctatgaggacctggtgacttttcttcaacaaagcattcatcagtttgaagtgggcccctatggctgcatcctgctcaccctttctgccatcctgtccaggtctacagagctcatccgccaggactttgatgtccccaccagccacctgattggagcacatggctactgtacacaggtcagggggcgctgtggggcccaggtggtccttccccctcctctgtccctcagagagggagaggtcctcctccctcctcttgccccagaaaaagacaagtctttcttgcctctgccaacactcttcaagcagctttcacgtgcccacctctgctgggtttcactgtcatgtcatggagacccagaaagagagctcagtttagcttctgtttctggacagctttatgtgcactgatgtatgtgctcagagctgcagaggatgcaaaagaggctgaactcagaccaaagtgctacacagcccggagcccaggacacagggagtgatgtctcaggcatgggccaggggaccctgggtccagctggggagatgatggccctggcctcttctatgtttgcacaaggtattgtctttatagccacccttccctttgcatctttacagaggggccctcaatggacctcacaggggcaaagaagaccctgagcaca

SEQ ID NO: 42022 - DNA, 2740 bp, Homo sapiens
atactgcgccggacagacccagttgcctggtgctgcggcccggcgtgggcctcgtgggcagagccagagccagagccatggacagcctcttcgtggaggaggtggccgcctccttggtcagggagttcctcagcagaaagggcttaaagaagacatgtgtgaccatggaccaggaacgcccacgctctgacctcagcataaacaacagaaatgatcttcgaaaggttttgcatcttgaatttctctataaggagaacaaggcaaaggaaaatcctctaaaaacaagccttgaactcatcaccagatactttctggatcactttggaaatacggctaacaatttcactcaagataccccaatccctgcactctcagttccaaagaaaaataacaaagtgccatcaagatgctcagagactacactggtaaatatatatgacctttcagatgaagatgcaggatggagaacatcattgtcagaaacaagcaaagccagacatgacaatcttgatggagatgtacttggtaattttgtatcatctaaaaggcccccgcacaaaagtaagcccatgcagacggtcccgggtgaaactcctgtgttgacttctgcatgggagaagatagacaagcttcactcggagccttccttggatgtgaagaggatgggagagaattccaggccaaagtctggtctgattgtgcgaggcatgatgtctgggcccatcgccagctccccacaggattcttttcacagacactatctgagacggtcctcaccgtcaagcagctccacccaaccccaagaagagagccggaaggtccctgagctctttgtctgcacccaacaggacattctggcttcgagcaacagctccccctccaggacctccctgggtcagcttagtgaactgaccgtagaaaggcagaaaaccactgccagcagccctccccatctgcccagcaaacggctgcccccatgggacagggccaggccgagggatccctccgaggacaccccagcagtggacggcagcacagacatggacaggatgcccttgaagctctacttgcctggtggtaattccaggatgacccaggagaggctggaaagagcgttcaaacggcagggcagccagcccgcacctgtcaggaaaaatcagttgctgccgtctgacaaggtggatggtgagctgggtgccctgcggctcgaggatgtggaggatgagttgataagggaagaggtcatcctgtcgccagtcccatcagtgctcaagttgcagacagcatcaaaaccaattgacctctcagtagcaaaggaaataaagacccttctgtttggttccagcttttgctgtttcaatgaagaatggaaacttcagagtttttcctttagtaacacagcctcattaaaatacggcatagtgcagaacaagggtggtccttgcggagtcctggcagctgtccaaggctgtgtcctacagaaactcctgtttgaaggagatagcaaagccgactgtgctcagggactgcagccttcagatgcccaccggacccgctgcctcgtcctggccctcgcagacattgtgtggcgggcagggggccgagagagagccgttgttgcactggcttcgagaacacagcagttcagtccaacagggaaatacaaagcagatggagtcttagaaacacttacgcttcacagtttgacctgctatgaggacctggtgacttttcttcaacaaagcattcatcagtttgaagtgggcccctatggctgcatcctgctcaccctttctgccatcctgtccaggtctacagagctcatccgccaggactttgatgtccccaccagccacctgattggagcacatggctactgtacacaggaacttgtcaatctgctcctgactgggaaagctgtgtccaaacgttttcaacgatgtggttgagctggattctggggatgggaacatcacacttctcagaggcattgctgcacgcagtgatattggcttcttatctctctttgagcattacaacatgtgccaggttggctgcttcctgaagaccccgaggttccccatctgggtggtttgcagtgagagccacttcagcatcctctttagcctgcagccggggctcctgcgtgactggaggactgagaggctctttgacttgtactactacgatggcctggccaaccagcaggagcagatccggctgaccattgacaccacccaaaccatctctgaggacacagacaacgaccttgtcccacccctcgagctctgcatcagaaccaagtggaagggggcatcagtgaactggaacggctcagaccccatcctgtgaccgttggatgtgggtaaaccctgtggtccaccactcatcacctcatcaccgaggatgacagctgaaccccaagcctctggggcaggtctcatgtaccccaacctgggtcagcatgactgcagaagcatccagagcctccctgccccttccatgaagggcccacccaagactgtgctggggacccagtgtgttgctgggtcccctcccagctgagctgtgactgctgagtactggaaggaggttgccagggtctctgctacctttgtctgcatccctcccttgctccctgctgggtggtccctcacccaggcctccaatgtggttggccctggggactcattacttctggtagctggctttctataaaaatgggtcaaacccaaatcaa

SEQ ID NO: 42023 - DNA, 1077 bp, Homo sapiens
  misc_feature (41)..(41): n is a, c, g, or t
  misc_feature (69)..(69): n is a, c, g, or t
  misc_feature (80)..(80): n is a, c, g, or t
agcccacaggaatacaagcagatgaatctaaaaaaattacnctcacagttgcccgctatgagacctgtnactttctcaanaagcatcatcatttgaagtgggcccctatggctgcatcctgctcaccctttctgccatcctgtccaggtctacagagctcatccgccaggactttgatgtccccaccagccacctgattggagcacatggctactgtacacaggaacttgtcaatctgctcctgactgggaaagctgtgtccaaacgttttcaacgatgtggttgagctggattctggggatgggaacatcacacttctcagaggcattgctgcacgcagtgatattggcttcttatctctctttgagcattacaacatgtgccaggttggctgcttcctgaagaccccgaggttccccatctgggtggtttgcagtgagagccacttcagcatcctctttagcctgcagccggggctcctgcgtgactggaggactgagaggctctttgacttgtactactacgatggcctggccaaccagcaggagcagatccggctgaccattgacaccacccaaaccatctctgaggacacagacaacgaccttgtcccacccctcgagctctgcatcagaaccaagtggaagggggcatcagtgaactggaacggctcagaccccatcctgtgaccgttggatgtgggtaaaccctgtggtccaccactcatcacctcatcaccgaggatgacagctgaaccccaagcctctggggcaggtctcatgtaccccaacctgggtcagcatgactgcagaagcatccagagcctccctgccccttccatgaagggcccacccaagactgtgctggggacccagtgtgttgctgggtcccctcccagctgagctgtgactgctgagtactggaaggaggttgccagggtctctgctacctttgtctgcatccctcccttgctccctgctgggtggtccctcacccaggcctccaatgtggttggccctggggactcattacttctggtagctggctttctataaaaatgggtcaaacccaaatcaa

SEQ ID NO: 42024 - DNA, 1069 bp, Homo sapiens
gtggccaggaatgggatcacctggtcacactcccagctgaagcagaacgtggagccaccagagccaggaaaaggaagtgactgtttgaagtgggcccctatggctgcatcctgctcaccctttctgccatcctgtccaggtctacagagctcatccgccaggactttgatgtccccaccagccacctgattggagcacatggctactgtacacaggaacttgtcaatctgctcctgactgggaaagctgtgtccaaacgttttcaacgatgtggttgagctggattctggggatgggaacatcacacttctcagaggcattgctgcacgcagtgatattggcttcttatctctctttgagcattacaacatgtgccaggttggctgcttcctgaagaccccgaggttccccatctgggtggtttgcagtgagagccacttcagcatcctctttagcctgcagccggggctcctgcgtgactggaggactgagaggctctttgacttgtactactacgatggcctggccaaccagcaggagcagatccggctgaccattgacaccacccaaaccatctctgaggacacagacaacgaccttgtcccacccctcgagctctgcatcagaaccaagtggaagggggcatcagtgaactggaacggctcagaccccatcctgtgaccgttggatgtgggtaaaccctgtggtccaccactcatcacctcatcaccgaggatgacagctgaaccccaagcctctggggcaggtctcatgtaccccaacctgggtcagcatgactgcagaagcatccagagcctccctgccccttccatgaagggcccacccaagactgtgctggggacccagtgtgttgctgggtcccctcccagctgagctgtgactgctgagtactggaaggaggttgccagggtctctgctacctttgtctgcatccctcccttgctccctgctgggtggtccctcacccaggcctccaatgtggttggccctggggactcattacttctggtagctggctttctataaaaatgggtcaaacccaaatcaa

SEQ ID NO: 42025 - DNA, 2374 bp, Homo sapiens
atactgcgccggacagacccagttgcctggtgctgcggcccggcgtgggcctcgtgggcagagccagagccagagccatggacagcctcttcgtggaggaggtggccgcctccttggtcagggagttcctcagcagaaagggcttaaagaagacatgtgtgaccatggaccaggaacgcccacgctctgacctcagcataaacaacagaaatgatcttcgaaaggttttgcatcttgaatttctctataaggagaacaaggcaaaggaaaatcctctaaaaacaagccttgaactcatcaccagatactttctggatcactttggaaatacggctaacaatttcactcaagataccccaatccctgcactctcagttccaaagaaaaataacaaagtgccatcaagatgctcagagactacactggtaaatatatatgacctttcagatgaagatgcaggatggagaacatcattgtcagaaacaagcaaagccagacatgacaatcttgatggagatgtacttggtaattttgtatcatctaaaaggcccccgcacaaaagtaagcccatgcagacggtcccgggtgaaactcctgtgttgacttctgcatgggagaagatagacaagcttcactcggagccttccttggatgtgaagaggatgggagagaattccaggccaaagtctggtctgattgtgcgaggcatgatgtctgggcccatcgccagctccccacaggattcttttcacagacactatctgagacggtcctcaccgtcaagcagctccacccaaccccaagaagagagccggaaggtccctgagctctttgtctgcacccaacaggacattctggcttcgagcaacagctccccctccaggacctccctgggtcagcttagtgaactgaccgtagaaaggcagaaaaccactgccagcagccctccccatctgcccagcaaacggctgcccccatgggacagggccaggccgagggatccctccgaggacaccccagcagtggacggcagcacagacatggacaggatgcccttgaagctctacttgcctggtggtaattccaggatgacccaggagaggctggaaagagcgttcaaacggcagggcagccagcccgcacctgtcaggaaaaatcagttgctgccgtctgacaaggtggatggtgagctgggtgccctgcggctcgaggatgtggaggatgagttgataagggaagaggtcatcctgtcgccagtcccatcagtgctcaagttgcagacagcatcaaaaccaattgacctctcagtagcaaaggaaataaagacccttctgtttggttccagcttttgctgtttcaatgaagaatggaaacttcagagtttttcctttagtaacacagcctcattaaaatacggcatagtgcagaacaagggtggtccttgcggagtcctggcagctgtccaaggctgtgtcctacagaaactcctgtttgaaggagatagcaaagccgactgtgctcagggactgcagccttcagatgcccaccggacccgctgcctcgtcctggccctcgcagacattgtgtggcgggcagggggccgagagagagccgttgttgcactggcttcgagaacacagcagttcagtccaacagggaaatacaaagcagatggagtcttagaaacacttacgcttcacagtttgacctgctatgaggacctggtgacttttcttcaacaaagcattcatcagtttgaagtgggcccctatggctgcatcctgctcaccctttctgccatcctgtccaggtctacagagctcatccgccaggactttgatgtccccaccagccacctgattggagcacatggctactgtacacaggtcagggggcgctgtggggcccaggtggtccttccccctcctctgtccctcagagagggagaggtcctcctccctcctcttgccccagaaaaagacaagtctttcttgcctctgccaacactcttcaagcagctttcacgtgcccacctctgctgggtttcactgtcatgtcatggagacccagaaagagagctcagtttagcttctgtttctggacagctttatgtgcactgatgtatgtgctcagagctgcagaggatgcaaaagaggctgaactcagaccaaagtgctacacagcccggagcccaggacacagggagtgatgtctcaggcatgggccaggggaccctgggtccagctggggagatgatggccctggcctcttctatgtttgcacaaggtattgtctttatagccacccttccctttgcatctttacagaggggccctcaatggacctcacaggggcaaagaagaccctgagcaca

SEQ ID NO: 42026 - DNA, 1926 bp, Homo sapiens
ttgctgaagctcccggccaaataaagcccttccttctttaactcagtgtctgaggggttttgtctgcggcttgtcctgctacatttcttggttccctgactgggaagcaaggtgattaatggacggtcaaggcagccccttaggcggcttaggcctgccctgtgggggactctggccagcttgagcgacgcagatcctgagagcgctcccgggtaggcaactgccccggtggaatgccttgccagagcagtgcgtggcaggcccccgtggaggatcaatgtggtggctgatcaccaggaaggaattggcacttggagtccggacatctgaaacttggaaaaatcagttgctgccgtctgacaaggtggatggtgagctgggtgccctgcggctcgaggatgtggaggatgagttgataagggaagaggtcatcctgtcgccagtcccatcagtgctcaagttgcagacagcatcaaaaccaattgacctctcagtagcaaaggaaataaagacccttctgtttggttccagcttttgctgtttcaatgaagaatggaaacttcagagtttttcctttagtaacacagcctcattaaaatacggcatagtgcagaacaagggtggtccttgcggagtcctggcagctgtccaaggctgtgtcctacagaaactcctgtttgaaggagatagcaaagccgactgtgctcagggactgcagccttcagatgcccaccggacccgctgcctcgtcctggccctcgcagacattgtgtggcgggcagggggccgagagagagccgttgttgcactggcttcgagaacacagcagttcagtccaacagggaaatacaaagcagatggagtcttagaaacacttacgcttcacagtttgacctgctatgaggacctggtgacttttcttcaacaaagcattcatcagtttgaagtgggcccctatggctgcatcctgctcaccctttctgccatcctgtccaggtctacagagctcatccgccaggactttgatgtccccaccagccacctgattggagcacatggctactgtacacaggaacttgtcaatctgctcctgactgggaaagctgtgtccaaacgttttcaacgatgtggttgagctggattctggggatgggaacatcacacttctcagaggcattgctgcacgcagtgatattggcttcttatctctctttgagcattacaacatgtgccaggttggctgcttcctgaagaccccgaggttccccatctgggtggtttgcagtgagagccacttcagcatcctctttagcctgcagccggggctcctgcgtgactggaggactgagaggctctttgacttgtactactacgatggcctggccaaccagcaggagcagatccggctgaccattgacaccacccaaaccatctctgaggacacagacaacgaccttgtcccacccctcgagctctgcatcagaaccaagtggaagggggcatcagtgaactggaacggctcagaccccatcctgtgaccgttggatgtgggtaaaccctgtggtccaccactcatcacctcatcaccgaggatgacagctgaaccccaagcctctggggcaggtctcatgtaccccaacctgggtcagcatgactgcagaagcatccagagcctccctgccccttccatgaagggcccacccaagactgtgctggggacccagtgtgttgctgggtcccctcccagctgagctgtgactgctgagtactggaaggaggttgccagggtctctgctacctttgtctgcatccctcccttgctccctgctgggtggtccctcacccaggcctccaatgtggttggccctggggactcattacttctggtagctggctttctataaaaatgggtcaaacccaaatcaa

SEQ ID NO: 42027 - DNA, 1239 bp, Homo sapiens
ccctgccttatccacctccctgccagccgcctctctgatatcagtgactcgcccatggggtgcagccctcccctgttggggccacacaggatgctggaattctggggtctcaggcccagagctgccgtagggccacctgaaccctgacgactccagcggtaccggccagcctttcactcacatacagcttacgcttcacagtttgacctgctatgaggacctggtgacttttcttcaacaaagcattcatcagtttgaagtgggcccctatggctgcatcctgctcaccctttctgccatcctgtccaggtctacagagctcatccgccaggactttgatgtccccaccagccacctgattggagcacatggctactgtacacaggaacttgtcaatctgctcctgactgggaaagctgtgtccaaacgttttcaacgatgtggttgagctggattctggggatgggaacatcacacttctcagaggcattgctgcacgcagtgatattggcttcttatctctctttgagcattacaacatgtgccaggttggctgcttcctgaagaccccgaggttccccatctgggtggtttgcagtgagagccacttcagcatcctctttagcctgcagccggggctcctgcgtgactggaggactgagaggctctttgacttgtactactacgatggcctggccaaccagcaggagcagatccggctgaccattgacaccacccaaaccatctctgaggacacagacaacgaccttgtcccacccctcgagctctgcatcagaaccaagtggaagggggcatcagtgaactggaacggctcagaccccatcctgtgaccgttggatgtgggtaaaccctgtggtccaccactcatcacctcatcaccgaggatgacagctgaaccccaagcctctggggcaggtctcatgtaccccaacctgggtcagcatgactgcagaagcatccagagcctccctgccccttccatgaagggcccacccaagactgtgctggggacccagtgtgttgctgggtcccctcccagctgagctgtgactgctgagtactggaaggaggttgccagggtctctgctacctttgtctgcatccctcccttgctccctgctgggtggtccctcacccaggcctccaatgtggttggccctggggactcattacttctggtagctggctttctataaaaatgggtcaaacccaaatcaa

SEQ ID NO: 42028 - DNA, 273 bp, Homo sapiens
tgtttttttttgggggggtggtgggtggagggtatatattgcatggcatggtgaaaatagttaatagtgtattgtatatttcaaaatttcaaatgttcttgtcacaaaaatatttgaggtgatatgttaattagcttgatttaattactccatattgtgttaataactactttgtaccaatatatgcaactaaagtttgtcaatttacaaaaagaatttaaaaatcaaataaaatgggccaggtgcgatggctcatgcctataatcccagaat

SEQ ID NO: 42029 - DNA, 128 bp, Homo sapiens
ttccagttttaatgctctgattcaattgtgtatttaaaaaatagagtcaaagatcctttccaaaatgattttgggggactaatcaagacagttgtacaaagattgcttcaaaggaaagtatgactggc

SEQ ID NO: 42030 - DNA, 963 bp, Homo sapiens
taaaaaatattatttatggttgcagtaatgggtgtattattttaaatgaattaataattttgaagttttctttgtaatttcaaatatgataaatacagataaaatctcgaggtcttcagtattttgagtgtaaaagtgtcctcagataaaaaaggtcggaggatagctgaattacagtgttgtttaggtctgtactgtatggtagccactagccgcatgtatctgagtacttaaaatgtagctaagaaactcaatttttaattttaattaatttaaacttaatttctggctgatctcatcttgcagagggcagttcgctctccccctccgagagtgtaaaaaaaaaaaaaaagaattgccattctttttcctttttatactttataatgcaagtatattgattaaaaggtcaagggggaaaaggtgaagatggagtattccagacctttaattaccttttccccctttttattgccttcatttgtattcttcatttacctattactggtatagctttggggcattagaggataagtagtggtaaatcgggtgctgcagttgactgaagaccttgtactattagtttatagtgttgcttataggagaataccactatcacctaatgaagtgttttctaattttttttcactgctctcaaactaaattgctactaaattttatttttgacttgagaacatttttatgaactagatccattgccagcattcttttatgcaaagctgagaggtatgcctcttgtcagacttaattaccaagtttggtattttgtaacagctgttgagtgagtctggaatagtcttcagtaccatacaaacaccggttgattagaaagatagaaatggaacaagaagatatttaccaatattaaatgaaggtacaagcaaatattatttttggtactgtaataaaaagtaaaacagttcttgaaatttatttcaaggg

SEQ ID NO: 42031 - DNA, 207 bp, Homo sapiens
tctatcccattcctggcaaaatcttattggagacagaagaactggccagtgcatattcactgctgtgtcaccctggttctgggaaaagaggaagataagagagggagctgagcacagtagtgccaacttttttttttttttttttttttttgtatcaggtacatttgttgttatgcacattcaacctattcatctagatatttcaaa

SEQ ID NO: 42032 - DNA, 339 bp, Homo sapiens
ggggctgaaccacagaagagctggttgcctggggctggaattagaggacagtagacaagaattttccaagatagggaatatatgagagagagagagagagagagagagagagagagagagagagaggagagagagagagagtgtgtgtgtgtgtgtgtgtgtgtgtgtgtgtgtgtgtgtgtgtgtttggaggaatggagtggatattagaatgaggcttattgtctgggtcatcctacaaactgtgttgcttgtgcccaagatagttttagagagaatagtcatctcagaaatgtcagattgactatatcgaaactctgggacagtctgtctttcctt

SEQ ID NO: 42033 - DNA, 398 bp, Homo sapiens
tgcactggccttctcctctacctgaaacacttttctctccttcttcaattagccacgtctttcttaacctaaagtctcagcttgaatactactttgccaggaaagccttccttaagctcctaaactgggtttggtcttcctattatatattcatatcctgtattttatagcacctatatttatcatttaaattattgtataattatctgcttcatgtttgtctcccctattagaccataagcgccatgaggatggaaattatctgtctcactaactgcctgacaaagctcccaatacaaagtatatacttaataaatatttgttgactgggtaaattgtgcataaaggcaggttataacaatatgagagtttagattaggaagattattatggaaatt

SEQ ID NO: 42034 - DNA, 176 bp, Homo sapiens
acccgccaccatacctggctaatttttgtatttgtagttttgttttattttattttattttgttttgttttatttttaagtcttactctgtcacccaggctggagtgtagttgcagtgagccgagattgtgccactgcactccaacctgggcaacagagcaagactccatctcgga

SEQ ID NO: 42035 - DNA, 364 bp, Homo sapiens
attaaacttctggttttttttgtgtggttttttttttttgagacggagtcacactctgtcatcaagctggagtgcagtggtgcgatcttggctcactgcaacctccacctccaggtttcaagtgattcttctgcctcagcctcctgagtagctgggattacaggcacctggaccacacttaactaatctttctatttttagtagggacgggtttcaccatgttggccaggatggtctcgatctcttgaccttgttatctgtccgccttggcctcccaaagtgctggtattacaggcgtgagccaccgcaccaggcctaaatttctgctctcaaagtcattccttgtatgtctgaacccttgatt

SEQ ID NO: 42036 - DNA, 299 bp, Homo sapiens
gctaacagtttgagttgggtcatacaattgtatcatttcacatcagctactgactttgagtactgactttgaatgcttataaaatcttcctcaaatccaggtagtgtgcaggacatggtataacaagacaacggaaaattagcagagagagccttcattggaaacccagattgtatttttgccagtacaacaaatattatttttaaagtctctcactaataggattgttcaacataaatctattgagaaacaatgatgtcagagagttttaaagctatagtgaagtgtgttaaattttg

SEQ ID NO: 42037 - DNA, 401 bp, Homo sapiens
tggaagagctatggtaactgtcatagacccaggaaagacgccgtttactacgcagaggtgctgcggtgagtgacaggagactcagcagcattgtcatatcacagagcaaaccctgcctgctgggcttccaggccatgtgaaggtagagataaccgatgacctgcttgattgaatgtggagcccatggggctggtaggggtgccagggcttcagatctcttccagtgttctggggtctgcctgtcccaggagctggcagcaattccaacacattcctgagcacttattgctaaggtgaatccaagttcacgttcccagaacgggttccgagtcaaccacgccagaggtctgcgccagctgcacttggtctaggaggcctgggaccaccgtcagcccattctt

SEQ ID NO: 42038 - DNA, 428 bp, Homo sapiens
agacctgtgtcagattcctgacctccagaacagtcagagaatcaacgcctgctgttccaagctgctaaacttgtggtcatatgttatggcagccataggagctgaatgcagtcttaaaaaacggagaatggctgggtgcggtggctcatgcctgtaatcccagcactttgggaggcggaagcaggaagatcacttgagctcaggagttcaaggccagcctgggcaatacagtgagatctcgtctcactatacaaggctacatttacaagaaaatgaaactagccaggcatagtggtgtgcacctatactctcagctacttgggaggctgatatggaagaatcccttgagcccaggagttggaggctgcggtgagctacgattgcaccagtgcactccagcttgggtgacagagcgagaccctgtctcc

SEQ ID NO: 42039 - DNA, 457 bp, Homo sapiens
aattaagacaatagtatctctttatagaatctcccatagagtcaaaaaagactataagtgagagtgctttgtaaactatagagcattatataatttaattataagtatttctataaagattacagagtattttgatgcccattttattcttagcttagctcctataacccctctgaatcgtccattgccccacagttccttgcttgccttcaacaaactcaaataggacattttttaaatgatttgtcctcttaactctaagcgaactaaattatgcctgtgtattattgggctggggcaattgagttacctgaccatttccatgaagtcacagtgctaacctaatgcaatgtgacagctttttcctgtagcacattcttaaaatttgattattctgagtaagaaaatattcattgagaggctcaccaggattgcaccaggcctgtttagtatccat

SEQ ID NO: 42040 - DNA, 460 bp, Homo sapiens
gtagctgggattacaggagtgtgccaccatgcctggctaatttttgtatttttagtagagacggtgtttcaccatgttggccaggctggtctcgaatgcctgacctcaagttatccacttgccttagcctctcaaagtgctgggattacaggcatgagccaccacacccaggcaatttttaaagttgtgcaaccatcaccactatctaattctagaacacttctatcaccctataaagaaactccacgtcccttagcagtcactcctcatattcctgttttcatggattcctgtaactactaatatactttctgaatctatcagtttgcctattcttggtatttcatataaacgcaattgtaagtatgtagtttatcctggagaatgtttcatgtacacttgagaaaagcatatattattttctcaagtgtacaacaagttgttgttaagtatatgttct

SEQ ID NO: 42041 - DNA, 493 bp, Homo sapiens
catgcattagatgccctgaagagcttttgaaaaggaccaatccctgggccctatctcaggtgtgtctgagcatctgtagattttagaagctctgaggaggatttacatgcatttagggtggaaatcacttgtaagtaaatttttttaactgttccctgttaaaaaatatgaaccaatggaccaatggaccacttatggcttctgctaattctcttacatatgcccatggtaccttgttgcagtatcatttgtataataaaaagattggagccaaccagaaagtccatcaatggggggaaaattaaataaaatgtagttcattcagcaatggaatactatgcagctctgaaaaatgaatcaggaagctttctatgaacagatgtggaaagtctccaatgtatagcattaagtggaaaaagcaagacataatggtagtgtgcacgttctatattacaaaaaatgtgaataaaggcagtttatattcatgttttct

SEQ ID NO: 42042 - DNA, 475 bp, Homo sapiens
tctttgctttttcttttgattctttgtttcttgtcttgcctatttcctaccattcctttgcctttttttgtttaaagcattcagtaattaccagccagaaacagttttcattctcaacaaagtaactacatcagtaacaggtatactctttgtctctccataattgaagtttctattgtacaggctacttaaaaaaaaattttttttaagatttttcggttctgaaatttcaggacacctaatggctgttcttgaataacacaagtattaccgctcttggaaaggagagccaagagggctcattagctgcaaagaggggcaacaggaacacccttagcaagttcagtcaggttagctgctttaaagtactgccagaaaagtttcactatactatcatgtttttatgaaaggtaccaaatcagagttaagatatttgaagctgagaacccttttaaccacagaccaaatataaaac

SEQ ID NO: 42043 - DNA, 336 bp, Homo sapiens
cttccacctttgagtcaatcaagtcatgctgtaataaaaattctgaactttgcttcaggacagctcagagggaaaacacgagtcaagtaagatgcactatttagtggtcctcactaacagcagtttaaaaacagctcactcaagcactagcagactagtagcaaaattgctatccagggtgaattgtgttttgagtggttcctgtagaactgtactgtccaatatggtagccactagccacaaatgagtattgaccacttgcaatgtggctaaaccaaattgagatgcgctataaatgtaaaatacacacagacttttgaagacatagtacagaaa

SEQ ID NO: 42044 - DNA, 164 bp, Homo sapiens
aagactctgtctcaaaaacaaacaaacaaaaagaagaagaacccaacctgccattgctggtttgtgctttattacctctgctcatagaagccatgagccatggagcgtgggtggcctttttaagctggaaaattccaggagacagatgctagactccaaaaagg

SEQ ID NO: 42045 - DNA, 459 bp, Homo sapiens
gggacgcgcctctgagagccacgagggccctgaatgcacagcgcgggagtttcaggcccaggagtgaccgcctgcacttgcgcgctcattaactcttctctgcctgcctgggcccccggcgtgagtgggaatcacggcccacggagcctgggatgactcggccttgcgccccggcgtgcagcaggtctctgggcaggtctctgggcgcagcgaaccctggtctgccgggagctccttcttgaccttccttcctccacaagaagggagcgcctcccgacaggccacaggctacatcattttggattatgcaataaaatgcttggtttgtgcgcgtacaagggcaccagctaatgccccagggcagggcttactgtggccactgctgaaccaaataaaagcccacgtgatgtggaaactgcatggaataatacgttgtctggacaggcgtcacttacaaat

SEQ ID NO: 42046 - DNA, 464 bp, Homo sapiens
cccctaggtcgcggggcagccggggcggaaggggcttgttcattattttgagagtttgttgtgaacgtcataacctttcgtccttaaatattgccgatacttgacctacgcaagagacaatgtcatgtgattcagcctaatatctcaggaggatgcagcattcaaggttctatcttggaagcagagactgtgccctcaccagatgctgaacctgctgagcaccctgatcttccacttcaccttcatcagaactactgctgtgattgcacctgccatcttatgcagaaatgacctgaagacagactgaaacaacgtgttctacagcctgaaaatatctaccttgacttacagttttattaatgctggtgtgatcagactggacaaaaattagcatatgttattaactgatctaattcaagtgccaattcttaatagaaacacaaaacaataaaagcaattcagaa

SEQ ID NO: 42047 - DNA, 978 bp, Homo sapiens
cccctaggtcgcggggcagccggggcggaaggggcttgttcattattttgagagtttgttgtgaacgtcataacctttcgtccttaaatattgccgatacttgacctacgcaagagacaatgtcatgtgattcagcctaatatctcaggaggatgcagcattcaaggttctatcttggaagcagagactgtgccctcaccagatgctgaacctgctgagcaccctgatcttccacttcaccttcatcagaactactgctgtgattgcacctgccatcttatgcagaaatgacctgaagacagactgaaacaacgtgttctacagcctgaaaatatctaccttgacttacagttttattaatgctggtgtgatcagactggacaaaaattagcatatgttattaactgatctaattcaagtgccaattcttaatagaaacacaaaacaataaaagcaattcagaaaatatttactatttgatttcttcaagctccaaacaggcttgtgcttagctgtagaaacttgaatatatacaaatctacatggatagaattcttagtcttctttgggccaggtgtgttagccccttgggaaaggataaagttttggaatatatttttattcatgaacctgctctctttaagacttctgaggaaaagagctgctgggcagatgagtagaatatgttactactgttccgacatgtctacccatcaaaactagctgatacagtacactttaatgacccttctatagtcaaaactgacattgacattgacattaacagaaaagatttgggacaaagaactgtgttcatgcagcaaatcagcctcaaacttcaccacaagctgcacattttatgctactgtattctgcttaagcacttatttgtatttatgtaaactgaatgatcctttaatacttaaggactttattctgggtgagttagaatcacactgttttggcaggaaaactctt

SEQ ID NO: 42048 - DNA, 560 bp, Homo sapiens
  misc_feature (528)..(528): n is a, c, g, or t
ctttgtaagatcagatgcagagagcgcgcgttatcagattcattataggggcagtcagtgactgggccccccctgtaggtcgccggaatcgatgagattatatggctatacaggcgtatcacagttatacagcatacgcagtcagatcttgtgaccagacagtgtggcatctcagcatcagtgactctcttagctccctcatgttacaggaggatgcagcattcaaggttctatcttggaagcagagactgtgccctcaccagatgctgaacctgctgagcaccctgatcttccacttcaccttcatcagaactactgctgtgattgcacctgccatcttatgcagaaatgacctgaagacagactgaaacaacgtgttctacagcctgaaaatatctaccttgacttacagttttattaatgctggtgtgatcagactggacaaaaattagcatatgttattaactgatctaattcaagtgccaattcttaatagaaacacaaaacaataaaagcaattcagaaaanatcgatgctggccgaaactcgcttctacttta

SEQ ID NO: 42049 - DNA, 337 bp, Homo sapiens
ttgtctctacaccccaaaaaaaccaaacacaacttcaaaactggggctgtggctgagatgtcacatggcagataggatcacaaatttctgttgtatctggatggagatcagcaggaggatctatggactgctgtgattgcacctgccatcttatgcagaaatgacctgaagacagactgaaacaacgtgttctacagcctgaaaatatctaccttgacttacagttttattaatgctggtgtgatcagactggacaaaaattagcatatgttattaactgatctaattcaagtgccaattcttaatagaaacacaaaacaataaaagcaattcagaa

SEQ ID NO: 42050 - DNA, 262 bp, Homo sapiens
  misc_feature (37)..(38): n is a, c, g, or t
tataaatctatttatgtaaaaaaatgatacaacccannctcacaaataacaactgctgtgattgcacctgccatcttatgcagaaatgacctgaagacagactgaaacaacgtgttctacagcctgaaaatatctaccttgacttacagttttattaatgctggtgtgatcagactggacaaaaattagcatatgttattaactgatctaattcaagtgccaattcttaatagaaacacaaaacaataaaagcaattcagaa

SEQ ID NO: 42051 - DNA, 253 bp, Homo sapiens
tatatattgtatagaacatgtgaattaaaaataaactttatcactgctgtgattgcacctgccatcttatgcagaaatgacctgaagacagactgaaacaacgtgttctacagcctgaaaatatctaccttgacttacagttttattaatgctggtgtgatcagactggacaaaaattagcatatgttattaactgatctaattcaagtgccaattcttaatagaaacacaaaacaataaaagcaattcagaa

SEQ ID NO: 42052 - DNA, 298 bp, Homo sapiens
  misc_feature (258)..(261): n is a, c, g, or t
  misc_feature (275)..(275): n is a, c, g, or t
accagtgtctttctccccccacccccgatacagactgctgtgattgcacctgccatcttatgcagaaatgacctgaagacagactgaaacaacgtgttctacagcctgaaaatatctaccttgacttacagttttattaatgctggtgtgatcagactggacaaaaattagcatatgttattaactgatctaattcaagtgccaattcttaatagaaacacaaaacaataaaagcaattcagaagatgcggccgaaannnncccctctctccctntccccttccccccccctcccccc

SEQ ID NO: 42053 - DNA, 972 bp, Homo sapiens
ctttgtaagatcagatgcagagagcgcgcgttatcagattcattataggggcagtcagtgactgggccccccctgtaggtcgccggaatcgatgagattatatggctatacaggcgtatcacagttatacagcatacgcagtcagatcttgtgaccagacagtgtggcatctcagcatcagtgactctcttagctccctcatgttacaggaggatgcagcattcaaggttctatcttggaagcagagactgtgccctcaccagatgctgaacctgctgagcaccctgatcttccacttcaccttcatcagaactactggggctgtggctgagatgtcacatggcagataggatcacaaatttctgttgtatctggatggagatcagcaggaggatctatgggtgagaagaagcacagttacagatggattctagagcctgcttgctgacacaggcttgcaactgcggactttataagcttagtttttaatctgctatcagctagcataataccataaatgcataaaaaactaagtattcagtcttacgagaaatgctatcttgacctgaccctttctccaaataaattgacaaaatatctcatcgtctaggatgccagacagaaataccagttgcaatgttttgttgcataaagtttatcctaatttaaattagtggcatataaagtcatcatcttgcttgaacaaacatcttattaaattgagcatgtcttttatcccatgaaatgaaattaattttgagatagttatttttcagttggaaatttattgagttgatagaaaacaagttatatagtcttccaaagaatatgttacatccatttgcattttgtttttcttcagcaatgtttggtttttagaaaatcttacaagttaaatatactaatgtagaaattgaaagaaaataatcagagatagagcaataaatttgcaaataaagattattcttcaaa

SEQ ID NO: 42054 - DNA, 551 bp, Homo sapiens
cccctaggtcgcggggcagccggggcggaaggggcttgttcattattttgagagtttgttgtgaacgtcataacctttcgtccttaaatattgccgatacttgacctacgcaagagacaatgtcatgtgattcagcctaatatctcaggaggatgcagcattcaaggttctatcttggaagcagagactgtgccctcaccagatgctgaacctgctgagcaccctgatcttccacttcaccttcatcagaactactggggctgtggctgagatgtcacatggcagataggatcacaaatttctgttgtatctggatggagatcagcaggaggatctatggactgctgtgattgcacctgccatcttatgcagaaatgacctgaagacagactgaaacaacgtgttctacagcctgaaaatatctaccttgacttacagttttattaatgctggtgtgatcagactggacaaaaattagcatatgttattaactgatctaattcaagtgccaattcttaatagaaacacaaaacaataaaagcaattcagaa

SEQ ID NO: 42055 - DNA, 1065 bp, Homo sapiens
cccctaggtcgcggggcagccggggcggaaggggcttgttcattattttgagagtttgttgtgaacgtcataacctttcgtccttaaatattgccgatacttgacctacgcaagagacaatgtcatgtgattcagcctaatatctcaggaggatgcagcattcaaggttctatcttggaagcagagactgtgccctcaccagatgctgaacctgctgagcaccctgatcttccacttcaccttcatcagaactactggggctgtggctgagatgtcacatggcagataggatcacaaatttctgttgtatctggatggagatcagcaggaggatctatggactgctgtgattgcacctgccatcttatgcagaaatgacctgaagacagactgaaacaacgtgttctacagcctgaaaatatctaccttgacttacagttttattaatgctggtgtgatcagactggacaaaaattagcatatgttattaactgatctaattcaagtgccaattcttaatagaaacacaaaacaataaaagcaattcagaaaatatttactatttgatttcttcaagctccaaacaggcttgtgcttagctgtagaaacttgaatatatacaaatctacatggatagaattcttagtcttctttgggccaggtgtgttagccccttgggaaaggataaagttttggaatatatttttattcatgaacctgctctctttaagacttctgaggaaaagagctgctgggcagatgagtagaatatgttactactgttccgacatgtctacccatcaaaactagctgatacagtacactttaatgacccttctatagtcaaaactgacattgacattgacattaacagaaaagatttgggacaaagaactgtgttcatgcagcaaatcagcctcaaacttcaccacaagctgcacattttatgctactgtattctgcttaagcacttatttgtatttatgtaaactgaatgatcctttaatacttaaggactttattctgggtgagttagaatcacactgttttggcaggaaaactctt

SEQ ID NO: 42056 - DNA, 650 bp, Homo sapiens
ctttgtaagatcagatgcagagagcgcgcgttatcagattcattataggggcagtcagtgactgggccccccctgtaggtcgccggaatcgatgagattatatggctatacaggcgtatcacagttatacagcatacgcagtcagatcttgtgaccagacagtgtggcatctcagcatcagtgactctcttagctccctcatgttacaggaggatgcagcattcaaggttctatcttggaagcagagactgtgccctcaccagatgctgaacctgctgagcaccctgatcttccacttcaccttcatcagaactggtgctaagaattctgaatttattgaggaaataaatgtctgattgcaacaaaagaaaacttgtctggctttgggaaggaagaggcttaggaaaaaaattaaaggcgtctttactagaagttcaagactgctgtgattgcacctgccatcttatgcagaaatgacctgaagacagactgaaacaacgtgttctacagcctgaaaatatctaccttgacttacagttttattaatgctggtgtgatcagactggacaaaaattagcatatgttattaactgatctaattcaagtgccaattcttaatagaaacacaaaacaataaaagcaattcagaa

SEQ ID NO: 42057 - DNA, 527 bp, Homo sapiens
cccctaggtcgcggggcagccggggcggaaggggcttgttcattattttgagagtttgttgtgaacgtcataacctttcgtccttaaatattgccgatacttgacctacgcaagagacaatgtcatgtgattcagcctaatatctcaggaggatgcagcattcaaggttctatcttggaagcagagactgtgccctcaccagatgctgaacctgctgagcaccctgatcttccacttcaccttcatcagaactactgctgtgattgcacctgccatcttatgcagaaatgacctgaagacagactgaaacaacgtgttctacagcctgaaaatatctaccttgacttacagttttattaatgctggtgtgatcagactggacaaaaattagcatatgttattaactgatctaattcaagtgccaattcttaatagaaacacaaaacaataaaagcaattcagaaaaactgttacgcgtcaagttatttttttttattcacccccactaaccccataaacactcacca

SEQ ID NO: 42058 - DNA, 605 bp, Homo sapiens
  misc_feature (565)..(568): n is a, c, g, or t
  misc_feature (582)..(582): n is a, c, g, or t
cccctaggtcgcggggcagccggggcggaaggggcttgttcattattttgagagtttgttgtgaacgtcataacctttcgtccttaaatattgccgatacttgacctacgcaagagacaatgtcatgtgattcagcctaatatctcaggaggatgcagcattcaaggttctatcttggaagcagagactgtgccctcaccagatgctgaacctgctgagcaccctgatcttccacttcaccttcatcagaactactggggctgtggctgagatgtcacatggcagataggatcacaaatttctgttgtatctggatggagatcagcaggaggatctatggactgctgtgattgcacctgccatcttatgcagaaatgacctgaagacagactgaaacaacgtgttctacagcctgaaaatatctaccttgacttacagttttattaatgctggtgtgatcagactggacaaaaattagcatatgttattaactgatctaattcaagtgccaattcttaatagaaacacaaaacaataaaagcaattcagaagatgcggccgaaannnncccctctctccctntccccttccccccccctcccccc

SEQ ID NO: 42059 - DNA, 609 bp, Homo sapiens
  misc_feature (554)..(556): n is a, c, g, or t
cccctaggtcgcggggcagccggggcggaaggggcttgttcattattttgagagtttgttgtgaacgtcataacctttcgtccttaaatattgccgatacttgacctacgcaagagacaatgtcatgtgattcagcctaatatctcaggaggatgcagcattcaaggttctatcttggaagcagagactgtgccctcaccagatgctgaacctgctgagcaccctgatcttccacttcaccttcatcagaactactggggctgtggctgagatgtcacatggcagataggatcacaaatttctgttgtatctggatggagatcagcaggaggatctatggactgctgtgattgcacctgccatcttatgcagaaatgacctgaagacagactgaaacaacgtgttctacagcctgaaaatatctaccttgacttacagttttattaatgctggtgtgatcagactggacaaaaattagcatatgttattaactgatctaattcaagtgccaattcttaatagaaacacaaaacaataaaagcaattcagaaaannnagatgcggccagttgtctaaaagctataaaaaatttcttaaaaaatttattta

SEQ ID NO: 42060 - DNA, 603 bp, Homo sapiens
cccctaggtcgcggggcagccggggcggaaggggcttgttcattattttgagagtttgttgtgaacgtcataacctttcgtccttaaatattgccgatacttgacctacgcaagagacaatgtcatgtgattcagcctaatatctcaggaggatgcagcattcaaggttctatcttggaagcagagactgtgccctcaccagatgctgaacctgctgagcaccctgatcttccacttcaccttcatcagaactactggggctgtggctgagatgtcacatggcagataggatcacaaatttctgttgtatctggatggagatcagcaggaggatctatggactgctgtgattgcacctgccatcttatgcagaaatgacctgaagacagactgaaacaacgtgttctacagcctgaaaatatctaccttgacttacagttttattaatgctggtgtgatcagactggacaaaaattagcatatgttattaactgatctaattcaagtgccaattcttaatagaaacacaaaacaataaaagcaattcagaaggctgaaagcctccaactatactaacaaacgcgcggataacaaataacaaaa

SEQ ID NO: 42061 - DNA, 516 bp, Homo sapiens
cccctaggtcgcggggcagccggggcggaaggggcttgttcattattttgagagtttgttgtgaacgtcataacctttcgtccttaaatattgccgatacttgacctacgcaagagacaatgtcatgtgattcagcctaatatctcaggaggatgcagcattcaaggttctatcttggaagcagagactgtgccctcaccagatgctgaacctgctgagcaccctgatcttccacttcaccttcatcagaactactgctgtgattgcacctgccatcttatgcagaaatgacctgaagacagactgaaacaacgtgttctacagcctgaaaatatctaccttgacttacagttttattaatgctggtgtgatcagactggacaaaaattagcatatgttattaactgatctaattcaagtgccaattcttaatagaaacacaaaacaataaaagcaattcagaagatgcggccgaagtccatttttttgataaatagagcaccaaaacaaaagaat

SEQ ID NO: 42062 - DNA, 496 bp, Homo sapiens
cccctaggtcgcggggcagccggggcggaaggggcttgttcattattttgagagtttgttgtgaacgtcataacctttcgtccttaaatattgccgatacttgacctacgcaagagacaatgtcatgtgattcagcctaatatctcaggaggatgcagcattcaaggttctatcttggaagcagagactgtgccctcaccagatgctgaacctgctgagcaccctgatcttccacttcaccttcatcagaactactgctgtgattgcacctgccatcttatgcagaaatgacctgaagacagactgaaacaacgtgttctacagcctgaaaatatctaccttgacttacagttttattaatgctggtgtgatcagactggacaaaaattagcatatgttattaactgatctaattcaagtgccaattcttaatagaaacacaaaacaataaaagcaattcagaaaacatcgatgcgaccggccttaactctgatag

SEQ ID NO: 42063 - DNA, 497 bp, Homo sapiens
  misc_feature (485)..(485): n is a, c, g, or t
cccctaggtcgcggggcagccggggcggaaggggcttgttcattattttgagagtttgttgtgaacgtcataacctttcgtccttaaatattgccgatacttgacctacgcaagagacaatgtcatgtgattcagcctaatatctcaggaggatgcagcattcaaggttctatcttggaagcagagactgtgccctcaccagatgctgaacctgctgagcaccctgatcttccacttcaccttcatcagaactactgctgtgattgcacctgccatcttatgcagaaatgacctgaagacagactgaaacaacgtgttctacagcctgaaaatatctaccttgacttacagttttattaatgctggtgtgatcagactggacaaaaattagcatatgttattaactgatctaattcaagtgccaattcttaatagaaacacaaaacaataaaagcaattcagaaattcccgatgcggccgaaatnggtgcgaattct

SEQ ID NO: 42064 - DNA, 1101 bp, Homo sapiens
ctttgtaagatcagatgcagagagcgcgcgttatcagattcattataggggcagtcagtgactgggccccccctgtaggtcgccggaatcgatgagattatatggctatacaggcgtatcacagttatacagcatacgcagtcagatcttgtgaccagacagtgtggcatctcagcatcagtgactctcttagctccctcatgttacaggaggatgcagcattcaaggttctatcttggaagcagagactgtgccctcaccagatgctgaacctgctgagcaccctgatcttccacttcaccttcatcagaactgtacttcaaagaggacatcctctcctgaagaacagaagaacctgaaatgtttggagcctaagactgctgtgattgcacctgccatcttatgcagaaatgacctgaagacagactgaaacaacgtgttctacagcctgaaaatatctaccttgacttacagttttattaatgctggtgtgatcagactggacaaaaattagcatatgttattaactgatctaattcaagtgccaattcttaatagaaacacaaaacaataaaagcaattcagaaaatatttactatttgatttcttcaagctccaaacaggcttgtgcttagctgtagaaacttgaatatatacaaatctacatggatagaattcttagtcttctttgggccaggtgtgttagccccttgggaaaggataaagttttggaatatatttttattcatgaacctgctctctttaagacttctgaggaaaagagctgctgggcagatgagtagaatatgttactactgttccgacatgtctacccatcaaaactagctgatacagtacactttaatgacccttctatagtcaaaactgacattgacattgacattaacagaaaagatttgggacaaagaactgtgttcatgcagcaaatcagcctcaaacttcaccacaagctgcacattttatgctactgtattctgcttaagcacttatttgtatttatgtaaactgaatgatcctttaatacttaaggactttattctgggtgagttagaatcacactgttttggcaggaaaactctt

SEQ ID NO: 42065 - DNA, 674 bp, Homo sapiens
  misc_feature (619)..(621): n is a, c, g, or t
ctttgtaagatcagatgcagagagcgcgcgttatcagattcattataggggcagtcagtgactgggccccccctgtaggtcgccggaatcgatgagattatatggctatacaggcgtatcacagttatacagcatacgcagtcagatcttgtgaccagacagtgtggcatctcagcatcagtgactctcttagctccctcatgttacaggaggatgcagcattcaaggttctatcttggaagcagagactgtgccctcaccagatgctgaacctgctgagcaccctgatcttccacttcaccttcatcagaactagatggagttccaccgtgttagccaggatggtcttgatctcctgacctcgtgatccgcctgcctcggcctcccaaagtgctgggattacagactgctgtgattgcacctgccatcttatgcagaaatgacctgaagacagactgaaacaacgtgttctacagcctgaaaatatctaccttgacttacagttttattaatgctggtgtgatcagactggacaaaaattagcatatgttattaactgatctaattcaagtgccaattcttaatagaaacacaaaacaataaaagcaattcagaaaannnagatgcggccagttgtctaaaagctataaaaaatttcttaaaaaatttattta

SEQ ID NO: 42066 - DNA, 297 bp, Homo sapiens
ttatttaaagcacggtttcatgcataaattttaaaaacaaaagacttggggaccaagtaacatatgaaggcatcaattgttcagataacagatttaaaattaaaaaaatctattaattaaaaattaatagattaaaaatttaccttccctccttttgggcaaagtattaacaaacatgttaagaaagaatgggctgggtgcagtggctcacgcctgtaatcccaacactttgggaggccaaggcaggtggatcgcttgaagtcaggaattcaagatcagcctgaccaacatggtgaa

SEQ ID NO: 42067 - DNA, 372 bp, Homo sapiens
gctatgttagttatcatttgtcctcacagaaatcccataaaaggggtgtcattatttttgttgaacaaataggaaaccttttatttgtggagattaggtgactttcttaaggctctctagctggcatggtatggctgtgtccccacccaaatctcatcttgaattgtagttcccataatccccacctgtcatgggagggaccctgtgggaggtaaattaatcatgggggcagttaccctcatgctattttcatgatagtgaattctcacaagatctgatggttttataaggggcttttccctctttgcttggaacttctctttgctgccaccatgtttgtaagtttcctgaggcctcccagccatgctgaac

SEQ ID NO: 42068 - DNA, 392 bp, Homo sapiens
ttgttaaatgggatgatacccaccacattggtagtgaggattaaatgtgatcatgtatgtaaggagattaattgaacagttagcatatggttaggattcagtcattgtcagctattaagaccatcgtcagttttagttaatggccactccgtttttttttttcagttcctcaggaaaaaaaaccttaggttgttgttgactcctcacatccagtgcattagcaaattctgttggctccactttcaaaatatattccaagtctgaccactttatatgtcctccagtgttgccatgctggttcaagccataatctctttcctggattatttatttatttattattttgagacagaatcttgctctgtcacccaggctggagtgcagtgacgtga

SEQ ID NO: 42069 - DNA, 472 bp, Homo sapiens
caaatgtagttggttttatgataaggactgcccttatctataaaactgctaaccccaaacccttgcacaagctgtcagtcttttggttgtacaacaagaaggcctggacaatgagaaccattttttctgggttgttcccattaatgctttgttcctgaagtcaggaagtgccttgacagaaagtaattgcctttaaagttcttttgacattgtacaatgcccctggccagccagaaccccatgagatcaacaccaaagttgtggaagtggtctacttgatcctaaacaccctctaatttggcataaagatgatggagtcataagaatctttaaattaggatccctaatccccacattgttcaagggtcaactgtatatattgaccagtattcattgaactgtacattttaaactggcaaattttattgtgtgtaaattacacttcattaaatctgcttaaagagaaaaaaat

SEQ ID NO: 42070 - DNA, 478 bp, Homo sapiens
gctctacaataataaatacatcacagatgcccgtcaaaggcttaaataattttagtttacaaaaatggccaatagcgattcgctaactagtctttctagcccactattttcagtctgtcatatacattaaaaaatacctcaactgtaaattgaacctaaataacctcttctggttgaagatagggttcttattcaaagcctaggaaagccaaacgtatattaatccagaatcaaatcaggaggaaaaatagtgcagaatttgcacttgttgcaaaagcagcatggaagaagaaaaagtaaagatccacaggtacacctttagaaccctatgagcagcagggctgcttcattacagaggctgacttgaaacccaggaggtggaggttgcagtaagctaagatagcgccattgccctccagaccagcaacagagcaagactctgtctcaaaaaaaaaaaaaaaaaaaagtgtatgtaaaa

SEQ ID NO: 42071 - DNA, 391 bp, Homo sapiens
tcattctttggctaaaccttaaatgggaccatgtacttacttcatcccatgcaccaccatacacaggggcattagaatgtaatgagtttggctaagcgtggtggctcacacttgtaatccaagcactttgggaggccaaggtgggtggattgcttgagcccaggaatttaagactagcctaggcaacatggtcaaaccctgtcctacaaaaaatacaaaaaaatcagctgggtatggtagcacactctgtagttccagctactagggaggctaaagtgggaggatcacttgagcccaggaggttgaggctgcaatgagctgtgattgcgccactgcactccagcctgggcaacagagcaagacctgtctcaaaaaaaaaaaaatgtagtga

SEQ ID NO: 42072 - DNA, 386 bp, Homo sapiens
tcaccaatttcctttaccctgctgggctccggtgttccgtgccaggctgccggcactggcactgcccacctccaccctgcaacagtgcctgttttccttggctccacctaatggcttttagacaggagagaagaagaaccgagccgaggccaagggcatgacggggtcaactggggatttttgttgcaggtaacagaagccagcgctggctaacattagcaaatcagaataatcattattgttattgaaaggacatgggacaacacaaaagctagacagtcagccttgggtagattaggaaccaaggtgatctgaggatgtgggggtgcaagcaggatttgggggtactgccattagaatggctcagcacaaagcattgtacaccc

SEQ ID NO: 42073 - DNA, 282 bp, Homo sapiens
aggcagccgagcaaccactatgcactagaccagtgcacaccccctggcctggatcctgacatccgcagccccttcttccagtcaggatctcaaggaaacagggaacacaactctgacagcagaaagtggctcagctctgtgccagctcgaacccactgaccctctggaggcctgactctaggcagctgctcaaggcctgtagacagatgggccaccaggcaggagctgctgctgggatttgcttttgtggcctggtgagctaataaacaccaataacttcag

SEQ ID NO: 42074 - DNA, 234 bp, Homo sapiens
ctggggtccacacaggacaagaaaaaccaaagtttcagctggaggtagaactgagtctgttcagccaccttaactggctgagaaccaccaaaggttcttctggtacatttaggattccccactccctagtcccaggagaggaggacaggggatggaggcagagttcggtagggccagaggcagcccccagccctgcaccagcacctcctgcctcacaagcttcctgatagcatg

SEQ ID NO: 42075 - DNA, 1742 bp, Homo sapiens
  misc_feature (163)..(163): n is a, c, g, or t
  misc_feature (402)..(402): n is a, c, g, or t
  misc_feature (818)..(818): n is a, c, g, or t
gtctttttatcttttcctcttgttggagagcatagagtttttctatacaggtttactttttagtactttgttttatacctctggatagtaggtcacagagtacacggagcaggcttacacaaacacacacgtcaaatgaacaaatccagccacaccacctgtncagtctcttgaattcacttcctccaccactgcctggattcaggctctcacctggcttgttgaaggcatcctcaactagtctgtcagccttggtctttctcttgtctgtcatccacaccacgctaggttttgttttgctttgtttaagcctccttttgatcttgtcacagtccttgattaaatttttctgccttcttcttatctataggataaaggccatgctcttccaattccaacttnaacttctgccattgaattatgtgccagtcaaggaaaaccaaagacaaaacaacaagaaaacaacaacaaaatagcagacacggtccttgccttcatggagcctatagtctgtagtcacaacagtagtataattacaaagtagggtagtgctatgaaggggaagctgaggatgctgctatgagatattacggcatgatggggaatttcaaagacctttctgtgtaaattaaaattaggtcaagaccagaggatgttcaagaattagctaggtaaaaagctagggggagaatatttcagaatgagatactaccatgtgccaatgttctgcagcaaaaaagagcttggtggttttaggtactggaaggccagtgtgtcaggagaactgtgaatgagtgggagagtggagcaagaactanacagggcttagatttctcttaaaatgtagtgagcagccagtcgttggttttaagcagagtggtaatatggtctgctttacatattttaacttttattccagctgcatcagtcacctcgagtcattctgtttcccatacaccttgatgcctttgctcctgtctctttctcctcacctggggacaccttcaccttttttacttctgggaattagcacagcacagtagtcctagaatgaactctagaaccaaacgctttctagtggcgtggtcttagatatgttacttaaatctatctgtgcctcagtttcctttgcagaagtgggatataatatcaaggagatggcatgtgcctaacccacaataattcctacaaaagtgtttgctattattgtttttattactattattaagattcacctcaaatgttactgtgtaaccttctcccaccttttcaggtataattcattacttcctcttctgcagtcccacactgccatggttgcttttatcacactgttaagagagttgaatatgtacttttttgttgttatagattatgaattccttaagggcagcagtcatgtgacatcaagcatcgggatttacatttctcctctatcactgattaattgtacgaccttggataaattgtgcagcttctccatcttggtttcctcgcctgtaaaatgaggatagcattacccatcttaagagcttctgttttggttttgtaagaaacacatttgcaccatagctaatacttagtaaacacatatgcttttcttccctgcctctgtagatttctaacaactaagttagaaacaaagttgggcctggttatttactgattggaggctgaggtgttgaataaataaataatgagggttttatgaatgagtaaaacaacaacacaaaaaaaaggaa

SEQ ID NO: 42076 - DNA, 1151 bp, Homo sapiens
agacacctacctgaacgagatgatttggcaaagaaactagtttcagcagagttaaagttagatgacaccgagagaagaattaaggagctatcgaaaaaccttgaactgagtactaacagtttccaacgacagttgcttgctgaaaggaaaagggcatatgaggctcatgatgaaaataaagttcttcaaaaggaggtacagcgactatatcacaaattaaaggaaaaggagagagaactggatataaaaaatatatattctaatcgtctgccaaagtcctctccaaataaagagaaagaacttgcattaagaaaaaatgctgcatgccagagtgattttgcagacctgtgtacaaaaggagtacaaaccatggaagacttcaagccagaagaatatcctttaactccagaaacaattatgtgttacgaaaacaaatgggaagaaccaggacatcttactttggacttgcaatctcaaaagcaagacaggcatggagaagcagggattctaaacccaattatggaaagagaagaaaaatttgttacagatgaagaactccatgtcgtaaaacaggaggttgaaaagctggaggatgaatgggaaagagaagaacttgataaaaagcaaaaagaaaaggcatctttactggaaagagaagaaaagccagagtgggaaactggaaggtaccaactaggaatgtatccaattcagaatatggataaattgcaaggagaggaagaagaaagactgaagagagaaatgctacttgctaaactgaatgaaattgacagagaactccaagattctcgaaatctaaaataccctgttttgccattgttacctgattttgaatcaaaactacactccccagagagaagccccaaaacatacaggttctctgaatcctcagagagattatttaatgggcatcatttgcaagacatcagtttctcaactccaaaaggagaaggtcagaattcaggaaatgttagaagtccagcctcccctaatgagttcgcatttggtagctacgtgccttcgtttgcaaaaacatcagagaggtcaaatccatttagtcaaaaaagtagttttttggatttccaaagaaacagtatggaaaaacttagtaaagatggtgtagatttaattac

SEQ ID NO: 42077 - DNA, 323 bp, Homo sapiens
cgattttctgttgtattgccaatgcttacttaggtcagggcttggcatgtagtccttgcatatgagttagatgtgtggcttacaaggttaaccagcattttccagacaacctctacaaagcccacccccatgtaggtaaagggcttatcccacactgtcctgcaaaccccagtcacagcaccacataccacactatgctgactttcacgttttcctgctgtgatagtctctaggcttctgaggtcacaagccatacctcatccagtgtgcagcccccgtgactcaggaatgcctggtgcttgtgagctgtttgttgccatgaa

SEQ ID NO: 42078 - DNA, 102 bp, Homo sapiens
ggaaaatccttctccgccaggcaatgacttcatcgtttccttctcactaatttgaatactcttatgggagagccaaacaaaaaatgaaaatgatgaatgact

SEQ ID NO: 42079 - DNA, 1108 bp, Homo sapiens
agcggagggtagactgcgttgctagcagctgagtgaaggccgaaagggccaatggaaacgttagacgacgctcgggcctctgggtagagcgttggtgtccgctttcgtgaaatcgagttgcctaacccagagctttcccgagatggtcttcgttacaggtgtctgggaggcggcttaagctcacttcactaggtcattaagcatgtactttggtggttacatatatcttggaagtcaccggctttacattctgttttcctggccttcgaactggagcatcagtactaccgccgttggaatagcaacctagagactttgctattttgtgaagaaactctaactatccgcatgggcacagaattttgggtgctctggtgcaaatgtctcaggtgacttggcgtaactgagaatacagccttgggaccttcgttctggaggctgggaagtcaaagacaaggcactggcagattccatgactggaaaggagagaaggtctctgaggaagtgacattccagctgagacgtgaaggataagtagaaaccaagcagaagaattggaagaggaaagggaagagggaaaagcctgtgccaatgccctgagattggaatatgctttttgtgtttaagaaattaacagaaggagaagcacatctctggctgccctcagtacactaagagaatcagacctcagaggtggctgcattttattgttgggaataagaagactgcaattcaggaagacatatagtagtctataagtgattcaggactggaactcagttatcctaattccctctcggaggctctttccaccatgccatctgctcgtctggtgctttccatccatgaactctggaaaacaagcttgagataccaaaattgaaaagacagctcatcaaaaatgaatagttataattctataagtacaaaaatgaaatactcaaatctcttgccccccctcctgctaggagcataaatgttaacctgagttctctagctctgtacaaatccacagcaattaagactgcactgtgagggaaaatacttttctaaaaaagaatcctgatcaagttgaaacaaaaattttaaaacatgaaatggaaggaac

SEQ ID NO: 42080 - DNA, 679 bp, Homo sapiens
  misc_feature (673)..(674): n is a, c, g, or t
  misc_feature (676)..(677): n is a, c, g, or t
  misc_feature (679)..(679): n is a, c, g, or t
ggtgggtagagcagtgcacagtggggataatatgggagtaggtgtattaaacctggaagtgtaagcaactccttgtagacccaccctactgtgtataaaaggctggagaaattcttcatatgatctactctaggttatgtactgaggaccaccttatctgggtcaggtacactacacagagtgctacaatataattgtaaacataatttatcctcactgtgatggctagccacctgacccaaatcattattagactcaatactttggaactggaacaaaaatcagttgacctgatgtctgaaagacatgcccacctgctatttgacaagctatagacatatcctaccaattgatgggtagtagcactgaaactatgaaagtggatgaactcatccagaggagttgatgagtgagaaaagaagactggaaaaggaacacaaggaaatcaagaagcagcagctgagactgaaggaaaataacgtggtattacagaggccaaaaaatagagtatttcaagaagcaagtggttagtggagttaaaagctgctgatacaacctaaaaaagtaagtatccattttttaaaaaactttcatttaaaataccaccatattttattgaatctaagtacctgattgtaagacattaaagaaaaattaaacctgctaattaaannannan

SEQ ID NO: 42081 - DNA, 1079 bp, Homo sapiens
aacccggggctgcatgcgggtggcaccacctctttgaagcggtaccagagctcagctctcaccgtttgctccgaaccgagcccgcagtcggaccgtgccagtttggctcgatgccccaaaactaaccaccgaggtcccattcagctgtggcagttcctcctggagctgctccacgacggggcgcgtagcagctgcatccgttggactggcaacagccgcgagttccagctgtgcgaccccaaagaggtggctcggctgtggggcgagcgcaagagaaagccgggcatgaattacgagaagctgagccggggccttcgctactactatcgccgcgacatcgtgcgcaagagcggggggcgaaagtacacgtaccgcttcgggggccgcgtgcccagcctagcctatccggactgtgcgggaggcggacggggagcagagacacaataaaaattcccggtcaaacctcaaaaaaaaaaaaaaaaaaaaaaaaaaaaaaaaaaaggggaaaaaaaaaaaaaaaaaaaaaaaaaaaaaaaaaaaaaaaaaaaaaaaaaaaaaaccctggggggggggcccggtcccaaattccccctatagggagtcgtttaaaaattaacgggccggggtttaaaaacgtcggaacgggaaaaaccctggggtaaccaaactaaatcgcttggaagaaaatccccttttcgcaagttggcgtaatagcaaaaagcgcccccccaatcgcccttccaaaaattggcccaccctaaatggcaaagggaaaattgaaacgctaaatatttggtaaaaatccgggtaaaattttgggaaaataacctaatttttaaaccaataggccaaaatcggaaaaaccctttttaaataaaaaaaataaaccgaaatagggttagatggttgtccaagttggaaacaaaatcccattataaaaaacgggaactcaaacgtaaaagggcaaaaaaccgtatataagggaatggcccatacggaaacaatccccctaataaattttttggggtcaaggggcccccttaaatcgaaaccctaaggggacccccatttccttcggg

SEQ ID NO: 42082 - DNA, 1101 bp, Homo sapiens
gtctcttctagttcaatttagctccgcccaagggctaggttcaaccgcgtagccctcggccccgccgctccccggcccactcgaggccccgcccaacccttctcaaacccaatctcccgctgtactcctgcctcaaccaacccagtctccaccgggctctgcgaggcctcgcccaggtctgcactgcacaccgcccccaggcccggccctccccactatcgccaagccccgccccttcccactccgaccgagcgggcctctgtcctaggtggctcggctgtggggcgagcgcaagagaaagccgggcatgaattacgagaagctgagccggggccttcgctactactatcgccgcgacatcgtgcgcaagagcggggggcgaaagtacacgtaccgcttcgggggccgcgtgcccagcctagcctatccggactgtgcgggaggcggacggggagcagagacacaataaaaattcccggtcaaacctcaaaaaaaaaaaaaaaaaaaaaaaaaaaaaaaaaaaggggaaaaaaaaaaaaaaaaaaaaaaaaaaaaaaaaaaaaaaaaaaaaaaaaaaaaaaccctggggggggggcccggtcccaaattccccctatagggagtcgtttaaaaattaacgggccggggtttaaaaacgtcggaacgggaaaaaccctggggtaaccaaactaaatcgcttggaagaaaatccccttttcgcaagttggcgtaatagcaaaaagcgcccccccaatcgcccttccaaaaattggcccaccctaaatggcaaagggaaaattgaaacgctaaatatttggtaaaaatccgggtaaaattttgggaaaataacctaatttttaaaccaataggccaaaatcggaaaaaccctttttaaataaaaaaaataaaccgaaatagggttagatggttgtccaagttggaaacaaaatcccattataaaaaacgggaactcaaacgtaaaagggcaaaaaaccgtatataagggaatggcccatacggaaacaatccccctaataaattttttggggtcaaggggcccccttaaatcgaaaccctaaggggacccccatttccttcggg

SEQ ID NO: 42083 - DNA, 340 bp, Homo sapiens
gatccccttctcgggtcctgggtcccgagttgggaggacccggacctctagatcattgaagtggtgtgatctagggccgggaagactgagtgtgcccctcccttcatcccgcaggtcccattcagctgtggcagttcctcctggagctgctccacgacggggcgcgtagcagctgcatccgttggactggcaacagccgcgagttccagctgtgcgaccccaaagaggtggggcagctcccctgcccagccaaatccgccccgtctcttctagttcaatttagctccgcccaagggctaggttcaaccgcgtagccctcggccccgccgctccccggccc

SEQ ID NO: 42084 - DNA, 500 bp, Homo sapiens
ggaaacacccacagatgatcaataaatactaagggaactcagaggctggggggatcctccatatgctgaacgctggttccccggttccccttatttctttctctatactttgtctctgtgtctttttcttttccaaatctctcgtcccaccttacgagaaacacccacaggtgtgtaggggcaacccacccctacatttttctttctttcttatttccatttgtttcatagtttagtgatgttttatcttgagttacaaatccctttggtgcaaaggatgatgtcttatgctagctgcacatctcgtcggtcttatagctcaccaccacagagaggtgagccctccacaagcccctggtctgtgtccttgactctcccaaggccaccaccccacctttccccacactcagagccatcagcatcaccaccaccattgatcgtatgaagacatgcagaccacttttatactgcatgtgctttgttgcaggtacttttgtgaa

SEQ ID NO: 42085 - DNA, 976 bp, Homo sapiens
ggatatcagctttctccatttcatagggttgacatgatcctgataaaactttttaccgagagatacacaaggtgattcttcacgtggaacctaataaacaagaacagcaaaaataacctagaaaaaaacaatgaggaaggttgctggtcctatgagatgttacatgtcgagaacctccataagtgaatgtgtagtgttggcccaggaatagaacaatggaaaagtttaaaatccagaaatcgatccatgtacatttggaaatttagtgattgataaagatagcatttaaaatcagtggtaaaaatcacttctaacaagtggtattttgacaataagaccaccctgtggaaaaggataaaattggatccatcttgcatagtgtatatttaaattccaaatgaatcagaaacccagacataaaaagggaaacctgcagagcgcagcggcttgtacctggagtcccagctattccggaagctgatgtaaggagggtcacttgagcccaggagcttgagaccagcaggaccccatctcttcaaagacttttaaagtcccaaagacaatgtaagtaaattccttgatagaatttgtaagtaaattccttgatagaattgggaaaacttcgctctctgggaatcaagggagaaattgatgaagtgttgatattccatatatatgaaatcttaaggacaacctagtagaaaaatgggcaaaaaatatgaatagctcacaggaaaaagaaaagcaaatggctcaaacatatgaacaaaagattctccagctgatatactgtaccatcgcttacctagagactggcaaaaatccaggagtttgacaacatatactgttggttaggctgtaggggaaaaaggcattctcataaacattgctagcaggaatgaaaaacttagaattcctatggaaggaagttggcactatctagcgagattatatatgctgctttagcaatcctact

SEQ ID NO: 42086 - DNA, 1214 bp, Homo sapiens
gagctgagattatgccattgcactctagcctgggcgaccaagagtgaaactctgtcttacacacacacacacacaaaaagacactatcaagttacagaaatcaaggcagtgtggtattggagaagacttagacatatagatcaatggaacagaatgggacccacacatagatcctcacaaatatggccaattgattgttttaaattgcggtaaactacatgtaacataaatttaccatcgtaaccatttttaagcatacagttcagtatggtttaatatattcatattgttgtgcaactaatttccagaactttttcgtcttgcaaaacaaactcgatttccgttaaacaacaactgcccctttctcctttccccagctcctgggcaacccgcattctactttctctttctataagcttgactatgttaggtacctcatataagtaatcatatagtatttgtgactggcttatttcacttaatgtaatgtcctcaaggttcatccatttgtcagaaattctttcctttttaacactgaataatattctctcgtttgtgtatacaacatcttgtttatccattcattcatgcatggacacttgggttccttctaccttttggctattgtgaataatgctgctatgaacatgggtatacaaatatctgttcgattccctgctttcaattcttttgggtattgttgtactgtgaaatatatatttggtctttgttccaatttcctggcatacaactcctaagatccttggaatctccaaagtgatgtctttttgtgtgctaatgagttgccagatggctggcagctcctaggtagcttcaggatgggggctggtcaccagaaatgattagacggttgggacttttggccctagccccatcctttagagaggaaaaaggggctcaaggttaagttgatcaccagcggtcaatggtttaatcaattatgcctacctaacaaagcttctataaaaactgcaaatgacagggtgtgggaagtttctgaatagttgaactcatgaaagttcctggagggtggcatgcctgggaggatataaaagctccacgtctattttcatctcttaccctaggcatcttttcatcaataccctttgtaatattctttataataaactggtaaatgtaagttaaaagttaagtgtcttcctgagttatatgccactctagcaaattaatcg

SEQ ID NO: 42087 - DNA, 552 bp, Homo sapiens
ggggacctcatcagcgcccagtcctttcttgatttaccgcgttgcttcctccctcttctccctagtaattattattcagagcttcccagaataaagccggggccctgattttacctagacaaacagtgccacaggtttccccgacggaaagactgaacccagcagagagaagcgggtgagggtgggagttccagaagggaaggggcacaggtggggcctggatccagattatggatggatgcccctcccaggtagcacccaggcccagccctgcccctcccatgcatgggagtagcaggaggttgtgatagtggccctgacaacaggtagccggtcaatggtttaatcaattatgcctacctaacaaagcttctataaaaactgcaaatgacagggtgtgggaagtttctgaatagttgaactcatgaaagttcctggagggtggcatgcctgggaggatataaaagctccacgtctattttcatctcttaccctaggcatcttttcatcaataccctttgtaatattctttataataaactggtaaatgta

SEQ ID NO: 42088 - DNA, 415 bp, Homo sapiens
ggggacctcatcagcgcccagtcctttcttgatttaccgcgttgcttcctccctcttctccctagtaattattattcagagcttcccagaataaagccggggccctgattttacctagacaaacagtgccacaggtttccccgacggaaagactgaacccagcagagagaagcgggtgagggtgggagttccagaagggaaggggcacaggtggggcctggatccagattatggatggatgcccctcccaggtagcacccaggcccagccctgcccctcccatgcatgggagtagcaggaggttgtgatagtggccctgacaacaggtagccggccctcttttatgccattgaccatggagtgctgtagtctctgtcttccttctttctcctcaccctcccttgccccacacctt

SEQ ID NO: 42089 - DNA, 817 bp, Homo sapiens
agtctccaaggccgccatcttggccaggattaaaagacccggagatggaaactacaagagtggctgagtttggggtccctcaggttcctttttcaaaaaccagccaggcagaggttttaatgtctgcttattaactactgaataatattctctcgtttgtgtatacaacatcttgtttatccattcattcatgcatggacacttgggttccttctaccttttggctattgtgaataatgctgctatgaacatgggtatacaaatatctgttcgattccctgctttcaattcttttgggtattgttgtactgtgaaatatatatttggtctttgttccaatttcctggcatacaactcctaagatccttggaatctccaaagtgatgtctttttgtgtgctaatgagttgccagatggctggcagctcctaggtagcttcaggatgggggctggtcaccagaaatgattagacggttgggacttttggccctagccccatcctttagagaggaaaaaggggctcaaggttaagttgatcaccagcggtcaatggtttaatcaattatgcctacctaacaaagcttctataaaaactgcaaatgacagggtgtgggaagtttctgaatagttgaactcatgaaagttcctggagggtggcatgcctgggaggatataaaagctccacgtctattttcatctcttaccctaggcatcttttcatcaataccctttgtaatattctttataataaactggtaaatgtaagttaaaagttaagtgtcttcctgagttatatgccactctagcaaattaatcg

SEQ ID NO: 42090 - DNA, 1161 bp, Homo sapiens
gagctgagattatgccattgcactctagcctgggcgaccaagagtgaaactctgtcttacacacacacacacacaaaaagacactatcaagttacagaaatcaaggcagtgtggtattggagaagacttagacatatagatcaatggaacagaatgggacccacacatagatcctcacaaatatggccaattgattgttttaaattgcggtaaactacatgtaacataaatttaccatcgtaaccatttttaagcatacagttcagtatggtttaatatattcatattgttgtgcaactaatttccagaactttttcgtcttgcaaaacaaactcgatttccgttaaacaacaactgcccctttctcctttccccagctcctgggcaacccgcattctactttctctttctataagcttgactatgttaggtacctcatataagtaatcatatagtatttgtgactggcttatttcacttaatgtaatgtcctcaaggttcatccatttgtcagaaattctttcctttttaacactgaataatattctctcgtttgtgtatacaacatcttgtttatccattcattcatgcatggacacttgggttccttctaccttttggctattgtgaataatgctgctatgaacatgggtatacaaatatctgttcgattccctgctttcaattcttttgggtattgttgtactgtgaaatatatatttggtctttgttccaatttcctggcatacaactcctaagatccttggaatctccaaagtgatgtctttttgtgtgctaatgagttgccagatggctggcagctcctaggtagcttcaggatgggggctggtcaccagaaatgattagacggttgggacttttggccctagccccatcctttagagaggaaaaaggggctcaaggttaagttgatcaccagcggtcaatggtttaatcaattatgcctacctaacaaagcttctataaaaactgcaaatgacagggtgtgggaagtttctgaatagttgaactcatgaaagttcctggagggtggcatgcctgggaggatataaaagctccacgtctattttcatctcttaccctaggcatcttttcatcaataccctttgtaatattctttataataaactggtaaatgta

SEQ ID NO: 42091 - DNA, 317 bp, Homo sapiens
gtttactttgcacaggcatttttaaaaacattaaagaaaaaataactgtgacatgtcatctcattattgaataaaatctcttcttaaatgattcatagttcctgaaaacattaagctttgaaaagaaaaacaagttaacaattgcttctactccataactgtttgcttgacaactatacttctttatcccgcatcttatagttaatatgactctgtttaataaaagaaacatctatgaaagcattaggagaatccaataaccgaaactatcgtgtgcttataattttaatttttatcagtacattttgtatcccctg

SEQ ID NO: 42092 - DNA, 293 bp, Homo sapiens
ggctcacctggcctctgaattccttacttgtaactgccacagagcttcttgtaggggagatttgcctccattcatggaattaatctaaatgagacatctgaggacatatctctactaattagaaaacacagagacaatgttcttctaactggacaactctaagcttttggtttggctcagttctgtaattgttagtaaactgacaactatttgctccttagctactggttactcttggcaaaaagaagtaacaagagatttacagtcctcttggctgaattcatcacaaataa

SEQ ID NO: 42093 - DNA, 324 bp, Homo sapiens
tcaatatacactacaagaaatagtaaaggaagttctccaggcagaaggaaaatgatatcaaatggaagctggattcacagtaagaaatgaacagcactagaaatgctaaatatgtgagtaaatataaaattttaaaaaattattttaaaacatccttattaagtagttgactatttaaagcaaaccaataagattgtattgtggtgcttatatgtaaaaataaaatgtatttcaactataaataaaatttgtgggaggccattgttttggattgagctcctgcaccaagctccaacagaccagaccaaaccagaatggagttac

SEQ ID NO: 42094 - DNA, 421 bp, Homo sapiens
gactggttaggaggatgggttttcaagtttcaaccttggccagggtaattattagtgatgtggccatggccgaggtacttaacctccattacccctctgtaaaataagaatgataccacataccccataagactgatgtaaggattgaatgaaatgatgtccagcattgagcacagtgcctggcacacagaaaaggtgcaggaaatgatagaaactactccattcggaacacaagacactttggttaatgatggctctcttatcactgccccatcttgttcactctgactcttgtgacctggcacggcttcattcattcattcgttcacttctcaagttatttataccaataaagcctagttccaaaataaatttggggtggctgatgtcagcccctactggaattctctctcccagatgc

SEQ ID NO: 42095 - DNA, 355 bp, Homo sapiens
gaattttatttaaaatattttgatgaactagatttaaagatagattaaattaattcctacacatgatttaatttaatggataaaataagggactgagcattagcctgaactgtgtacttgcattagccctgatgttccccagagggaataatatgtgaagaatactgcataggctgaaaaacaagagttcccagcagaccaatattctttctttctgcaagctgtgagacacctggggaaagttctccacatttggtttttcagctactccacccatgactagaaggaagattttattttattattttattttattgtattttttaacagtaaaagaaaaattattgttatttta

SEQ ID NO: 42096 - DNA, 377 bp, Homo sapiens
ttttaaagagagaagcaacagaatcagatctgcagcctagaagagagcttaccctggggagaggctggacgtggtctggggctctcgctggcagaggcagacacaaccttcctctcaggaaaccatgaggatacaaaagtaggagggatcaaaagaaggaatcaaaagatatttaggatttccagttcaagatgatggcttgaagacatgtgtttttatctctgctccctcctgaaaccccactaaggcaacagtaaatgatatatatatcccaaggacaaagattaaaggtgaagagtcaatagcaataaactttcagaaacctagaagcaaaccatcacttggtggttgacaagcaagcccaaagattcaactgg

SEQ ID NO: 42097 - DNA, 352 bp, Homo sapiens
aaaagatctccttccgagttaccctccctaaaatacaataaaaaccccatacccactcacctaagcacaatatgagcaactgaacacataagactgaaacccactggggtccaacagactcaacctatctctttgtgtctcagagtataattggcagtaatgaccatcgaactctggtctccctgcccaaaaccatgcttacaacttcccagttgccacttctgccgaaatgcccacagaagtgaatagactagtgagacagatatgtgatctcaaactcaagttttccagcttacacactattgataaaatactgaggaaaatctaagcatttttaaaagtcaaaaataaa

SEQ ID NO: 42098 - DNA, 639 bp, Homo sapiens
tgcctctgcccagagatgtcccaaaggccctcagcagacggccgggccagggatgtggctgccacagctgagaccaagggctctggctggcccgtccccaccaggtggccctgccctccccaagttgggggttgtggcacttggggtcaggcctagccacgtaaggacacaggtaacaccctgaggatctggcattggcagcttcaggcctaactttcctggtcagggccccttaaggtggcccgggcacattggtttcatttcgatgagactttgtcagaggcctggtctggtcctggccctaccgccccagctgtccttcagcacagctcggggtggggactccaggatgctgggtctgccccttgggaggggaactctggaaggtcagggtgatccacaactgtgagctgaggttggatgcagctgggagcttgggacagagagagcccagggctcccctgctgtggggcacctgcccagcggggacatgagatgacagagacctccccggcgggggtactcaggtgctacgaacatggcagctcttgtttccggctgagccatggccagagcagggctcagtctgcccctgaacttgctgaatggaccgacgagctgagcctgaaagcccagaag

SEQ ID NO: 42099 - DNA, 385 bp, Homo sapiens
agccatacaaccctacatttttaccctgcatctgttccgtagggaaagagaattttactgattgccagctaatgtttattgcatactcactatgttccagagactaaagcctccattcttatgcatatctgacccgcataatggctctctaaggtggtattaccatcattttctacatgagagcactgagcccagagaggttaaataacttgcccacagttgcacagctagtgaatttggggtttgaacccaaatctgcttgactgcaaagcccatgttcttaactattctactggtttttaaataacaagagcctcatgatttcacagggtataaacaatgacatcaaaatagaagtgaaagaaggaaagtctctgggtctata

SEQ ID NO: 42100 - DNA, 128 bp, Homo sapiens
tctgctctccagttaaacaactgaagaatgaacgaatttagtgcatttgcacaagaagtgcattacaatgcaggggaggaagaagtcacttggggttggacaaatccttagaaaatgccaaaggaata

SEQ ID NO: 42101 - DNA, 344 bp, Homo sapiens
aagctgtcatgggaatttgtacataactgtacagagtacatgtgtacttaacataattccagaattaccagtttttataaccatgataaaagccctctccaggggcttttgcctctttggccaaagtatcagtggccactcttagcttcaagaaggctgaaagatggaataatcaaggtcttctcttactcatgggggatatgttccaagaccctcagtagacaccggagactatgggtactaccaaaccgtgtatgtactgtttggtatatatttttttctatacatacatagctatgataaaacttaatttataaatgaggcacagtagagattaataataa

SEQ ID NO: 42102 - DNA, 455 bp, Homo sapiens
aatttatatttctgttaattccataggccagtaaagaaaatttttaaagtgacctagaaaaattaaagggaggttatctgttgattaactcactggtgaccatgttaagatgcattttcaagtatatactgagatgaatgggaacatatttgaagaaaaataaacccagctgccgggcaaggtggctcacacctgtaatcccagcactttgggaggccgaggcaggcggatcaccagaggtcaggagttcgagatcaaccttgctaacatggtgaaaccccatttctactaaatatacaaaattagctgggcgtggtggtgtgtgcctgtaatcccagctacttgggaggctgaggcaggagaatcgcttgaacctgggaggtggaggttacagtgagtcaggatcacgccattgcactccagcctgggcaacagagtaagactcggtctcaaaa

SEQ ID NO: 42103 - DNA, 504 bp, Homo sapiens
cttccaaacttgggtgatctgcctgccttggcctctcaaaatacaggtgtgagccaccgcacccagccaggtttattcttttttgaaagtacagtactctgttaaaattcctgtgtaaactgggacttttcttttcactttcttgtgtttcaagaacagtaggtgttccagggcttttgtcctgctgggtacaagcaagtaggattttgagaaggtgtgaggaggaggtcagaaaaattggtggaaataggaaagagaaagaaatatggccccgattttggggagagaaagtctggggaaagagcaaaggcaattaaagaggattttgaggaagagacttctgtaaaatatgtcttagcaacactttttggagttgaaaatatttctttttagtgtgttattttttctaagaggtgcctcaagatggataatggaagatttggagtacgattgggttgacaatccaaggagattcggtgacatccagattaccctgaaataaaa

SEQ ID NO: 42104 - DNA, 254 bp, Homo sapiens
cccgtctccccatcaccccagtgcccttttctcccatatattttaaagtgataaggctcaatgtaaacttcctccttcccaaacgtttagggcagttcctgccaaagtgccccattctacaaagtgatttagtactttaaccttgctccagacactctgacatctctgtttagtctctggtgtaaaaaggttcgtctctcatatttcttgaggttggggaaaggaaatggtcacagagtttaggtgagggtggg

SEQ ID NO: 42105 - DNA, 857 bp, Homo sapiens
gtcaccttctctcttcctctagagcactaatgccatttcctcccatcagctcaatacatcagcttagtcctctttagttttgggtccaagcagtattttgagggtggggaccagggaaaggtagcaccatgaatcaatacctgtgcatctctctctgttgccctgttcccccagccagtgtctccccttatttgttctctacttgtatcaggtaaaaaggccttcgtgatggtctggccaggatcaaaaggcaggcttctccattcctacccactcccacacttcctggcttatgagtaatgatattaccttttttttttttttttttaaattgagacagggtctcactatgttgctcaggttggtctgagtaatgatattatcttgcatttatgtggtgctttactttttgttacacattcacagtaattaacctcatttgattttcaacatctctacaacagaggtttggcaaatattttttgagtggctgctaagtggcaatcattccacaaggtatttttacatttgttacttcacttaatcctttcaacaatcctgagaggtaagcatttgctttacttaacagaggaggagacggagactcaaggaacttaaatcttaaaaaaaaaaaaaacccaaaacacccaaaaacaattatttatgttttacagataagagactataaaaccaattaacaggtactttcaccacatcagcttgtaagatgaaatggtttatcatcctaatgttagtgaatgacagaggtgtgcagtcttacaaatgacacactttgtaagtcactgagcaatgtttttctgccataagggattttgagtccgagaaatcaggtcctc

SEQ ID NO: 42106 - DNA, 656 bp, Homo sapiens
ttgtaggcagagtctcactatggttacccaggttggtctggaaattcctgggctcaagcgatccaccacctcagcctcctaaagtgctgagatagattacaggtatgagccatggcgcctggcctacatttttaacctaagcttaaatttatactttctatcagtgtccaaggttaataagtatctcttgtctttccaaggtaatagcatgaagatccatagatctctggcacaaaccttccagaggaagaacctagctacagaacccacaagatgtctagtttgtaagtgacaactgtgattctctccgggccagtgcgtgtcttagcctaactgactgggctagggaagtatttcagtggttcctgaggccgaaaccatacaaatcgccgccctatcgccgggctctctcccttaccttcagtctctgcactatctcccttatgtcctccacagaaccctctgtcgcctgtaggaagatgtggtctcctcgtccatagaagattttgagtgtggaggagtctggagtccagccaatgacatccccgcagtagcagttgaacaccacctccttggtgcgtaagtccaggagcaccacaaactcattggaaattccaaaatgcagtcgatttccaccccctgggcgtagtcctggg

SEQ ID NO: 42107 - DNA, 331 bp, Homo sapiens
aaccacaatagaccctgaatagccaaagaaatcttgaccaaaaaagaagctggaggtatcacactccttgatttcaaagtataacacaattataattgcaacaacatgctactggcataaaaacagataagtcaatcaacagaacaggacagaaagcccagtaataaactcatgcatttatggtcaattgatttttgacaaagatgtcaagaatgcacaatggggaatggtgttgggaaaactgaatatccatatgcagaataataaaatttgatccttatctcactccatgtataaaaatcaactcaaaatggattaaagacacaaatat

SEQ ID NO: 42108 - DNA, 591 bp, Homo sapiens
gagcgcaggtgctggggccaggggcggacagaactgtgtgaaagcaccaaggacagggccagaggagccaggtcagagcccagccctaggtcgggaacacgtagggagcagagctggtggttcagggccctgttgtggcatcagagagatgtgagcgctaacctcagcaccctgctttccactccggggccttggggcgacttatttatctgccaaggcagtttcctgacttcagggaaggggccaggagagaattaagtaagaacaagcagcacctgacactcagaaaagtgtccctaaatgttcgccacctttattaatagtacaaattaatgggtgaccagcctccattgtgggatggagccggaagctgctctccaggcctgctctcacccagatacatggtatgtttcgaccacacaggagttcttttaaggatgaatgatgatgaccgccaacgtttaggtgtcagcagattttacagaagcctttggccatttgacttctcctggtctagtggagcctctagttttctggggcctgcctcttcctgtccatagacaaccgtagctggggtgcggccgccccctt

SEQ ID NO: 42109 - DNA, 3288 bp, Homo sapiens
gctggccaggagcgcggggacagttcggggctgcgccggagcgccggcccgccttcccgggggttccgttatcatgtcgctgaggcagcgcctggcccagctggttggccgtctgcaggacccgcagaaagtggcccgtttccagcggctgtgcggggtggaagcgccgccgcgccgctcagcagaccggagggaggatgagaaagcggaggcgcctctcgccggagaccctcgactgcgagggcggcagccaggggcgcctggaggcccccagcctcccgggagcgaccgcaatcagtgcccggccaagccggacggcggcggcgcccccaacggcgtgcggaacgggctggcggccgagctgggcccggcctcgccgcggcgcgcgggcgctctgcgccgcaactcgctgacgggcgaggagggccagctggcccgcgtgagcaactggccgctctactgcctgttctgcttcggcacggagctgggcaacgaactcttctacatcctgttcttccccttctggatctggaacctggaccctctggtgggccggaggctcgtggtcatctgggtgctggtcatgtacctgggccagtgcaccaaggacatcatccgctggccgaggcccgcctcgccgcccgtggtcaagttggaggtcttctacaactctgagtacagcatgccctccacccatgccatgtccggcaccgccatccccatttctatggtcctcctcacctatggccgctggcagtaccctcttatatatggactgattcttattccctgctggtgttctctagtttgcctaagtagaatttacatgggaatgcactctattctggatattattgctggattcctatataccattttaatcttagctgtcttctatccatttgtggacctgattgacaacttcaaccaaactcacaaatatgctccattcatcatcatcgggcttcatttagctttggggatcttttctttcactcttgacacctggagcacatcccgaggagacacagccgagatactaggaagtggtgctggaattgcatgtggatctcatgttacttataacatgggtctagtattagatccttctctagatacattacctttagctgggccccccattactgtgactctgtttggaaaagccatattgcggatcctcatagggatggtatttgtactaataatcagagatgtaatgaaaaagatcaccattcctttagcctgcaaaatcttcaatataccgtgtgatgatattcgaaaagcaagacagcacatggaagttgaacttccttatcggtatattacctatggaatggttggtttctccatcacattttttgttccttacatatttttctttattggtatctcttgatggagaagtattgtttatgataagaaaggagggtatcagttactgatacccaaaaatatattccaggtaaagccaggtcagaattaggcttttgcaggaatttaacttaaataattatttaagtaaattcataagagtcagtgcattttatcattgcacatccagatactgttttaggtgagctgagctatttcgttactgagaaaatgataagtatccatttagaatgttcatgtaatgtttggagagttttgtattatggattcaacttatatataatatatataaggtacataatatgcaattatatatctgatatatattatatataaaataatatacctaagtgtttttttaaactatgggagtgtattataaaatcaataataatatgcaaacagttgtgcctgtgtatttgaactacatacaggtatgttgttattaacagatatatttaacatttatttactatgggagccatttcctaattgaattgcgtaattactagaccagaatgcatatgctactatacattgatttactgcctgtttttacactgccattacctttcatgttatccatgatgttgaacatgggaggcatttttaatggaccaaatttttagaaaaattagtttttggatttttttttaagttctgtatactgttttgaatgaactttatttgcagctattctggatgtcagtttaataattcaggtactgaattttattgcttgctaattgtgcctttccgttgctaaattaagaaatgctatgtgtactgtgatgtaaaaataagacattaactttatcttaagttacatataatcaagcaaatattttaaaaaatgtatgtcagggtgacaggcataaaagtaaattacccttaactctttagcctttatttagaaagaaatgtggaatgggctaaactttctcaccaatttattagaaagctaaatggataaatacttccctttttgtagatatttttctgtgcattgtaagttataggagcaggacatattttttgtacattgtcttgattgtttatactgcaggtaggtatttccagtgaatggaaacgttgaaatttatagatgggacaatgcacatacttcatatgtaaacaaagcatttttctaaataatttggaaaggattggatttagcaccgttaacttttaatacccatttattggctatttaaggtaaattataaaacctaaaattagtatcagtattttagatcctattattttttcaactttctattattttcacagtggaaaatttgcgtatagtattaaactattcttttttctgtctacctttatattttgaagtgtggttgtacttacgttaatagtaagtgtatttgtagaaagtttttcataaagaagagattaactttccatataaataaataccaggtatgaaattactgattttagtgcaatatctgtatgattatccagaactatcacttcagatgtttctattttgggcaccataactatttgagctcatatttttataattctgattgagaatttaggggcatggtaatttttaccaaaactgaagctggtaattttaagtaaagcaactaaatttaccctttacttattagttaaaaggaaaccaaggcatgtaggaaaatattggtacgttggaaaatgtgaaaagagctttactttcaaaatgtatgtttaatgaattgaattttagggaccgtttcccataatttgggcctatgctatcctgttgatttttatgtctagcttaaaaggtatttgaaaatgttccatttgtgttttattattttctgtcctatgacagttctatgctaaatgtattttaaaataaaagccaaattgaagattaaa

SEQ ID NO: 42110 - DNA, 3622 bp, Homo sapiens
gctggccaggagcgcggggacagttcggggctgcgccggagcgccggcccgccttcccgggggttccgttatcatgtcgctgaggcagcgcctggcccagctggttggccgtctgcaggacccgcagaaagtggcccgtttccagcggctgtgcggggtggaagcgccgccgcgccgctcagcagaccggagggaggatgagaaagcggaggcgcctctcgccggagaccctcgactgcgagggcggcagccaggggcgcctggaggcccccagcctcccgggagcgaccgcaatcagtgcccggccaagccggacggcggcggcgcccccaacggcgtgcggaacgggctggcggccgagctgggcccggcctcgccgcggcgcgcgggcgctctgcgccgcaactcgctgacgggcgaggagggccagctggcccgcgtgagcaactggccgctctactgcctgttctgcttcggcacggagctgggcaacgaactcttctacatcctgttcttccccttctggatctggaacctggaccctctggtgggccggaggctcgtggtcatctgggtgctggtcatgtacctgggccagtgcaccaaggacatcatccgctggccgaggcccgcctcgccgcccgtggtcaagttggaggtcttctacaactctgagtacagcatgccctccacccatgccatgtccggcaccgccatccccatttctatggtcctcctcacctatggccgctggcagtaccctcttatatatggactgattcttattccctgctggtgttctctagtttgcctaagtagaatttacatgggaatgcactctattctggatattattgctggattcctatataccattttaatcttagctgtcttctatccatttgtggacctgattgacaacttcaaccaaactcacaaatatgctccattcatcatcatcgggcttcatttagctttggggatcttttctttcactcttgacacctggagcacatcccgaggagacacagccgagatactaggaagtggtgctggaattgcatgtggatctcatgttacttataacatgggtctagtattagatccttctctagatacattacctttagctgggccccccattactgtgactctgtttggaaaagccatattgcggatcctcatagggatggtatttgtactaataatcagagatgtaatgaaaaagatcaccattcctttagcctgcaaaatcttcaatataccgtgtgatgatattcgaaaagcaagacagcacatggaagttgaacttccttatcggtatattacctatggaatggttggtttctccatcacattttttgttccttacatatttttctttattggtatctcttgatggagaagtattgtttatgataagaaaggagggtatcagttactgatacccaaaaatatattccaggtaaagccaggtcagaattaggcttttgcaggaatttaacttaaataattatttaagtaaattcataagagtcagtgcattttatcattgcacatccagatactgttttaggtgagctgagctatttcgttactgagaaaatgataagtatccatttagaatgttcatgtaatgtttggagagttttgtattatggattcaacttatatataatatatataaggtacataatatgcaattatatatctgatatatattatatataaaataatatacctaagtgtttttttaaactatgggagtgtattataaaatcaataataatatgcaaacagttgtgcctgtgtatttgaactacatacaggtatgttgttattaacagatatatttaacatttatttactatgggagccatttcctaattgaattgcgtaattactagaccagaatgcatatgctactatacattgatttactgcctgtttttacactgccattacctttcatgttatccatgatgttgaacatgggaggcatttttaatggaccaaatttttagaaaaattagtttttggatttttttttaagttctgtatactgttttgaatgaactttatttgcagctattctggatgtcagtttaataattcaggtactgaattttattgcttgctaattgtgcctttccgttgctaaattaagaaatgctatgtgtactgtgatgtaaaaataagacattaactttatcttaagttacatataatcaagcaaatattttaaaaaatgtatgtcagggtgacaggcataaaagtaaattacccttaactctttagcctttatttagaaagaaatgtggaatgggctaaactttctcaccaatttattagaaagctaaatggataaatacttccctttttgtagatatttttctgtgcattgtaagttataggagcaggacatattttttgtacattgtcttgattgtttatactgcaggtaggtatttccagtgaatggaaacgttgaaatttatagatgggacaatgcacatacttcatatgtaaacaaagcatttttctaaataatttggaaaggattggatttagcaccgttaacttttaatacccatttattggctatttaaggtaaattataaaacctaaaattagtatcagtattttagatcctattattttttcaactttctattattttcacagtggaaaatttgcgtatagtattaaactattcttttttctgtctacctttatattttgaagtgtggttgtacttacgttaatagtaagtgtatttgtagaaagtttttcataaagaagagattaactttccatataaataaataccaggtatgaaattactgattttagtgcaatatctgtatgattatccagaactatcacttcagatgtttctattttgggcaccataactatttgagctcatatttttataattctgattgagaatttaggggcatggtaatttttaccaaaactgaagctggtaattttaagtaaagcaactaaatttaccctttacttattagttaaaaggaaaccaaggcatgtaggaaaatattggtacgttggaaaatgtgaaaagagctttactttcaaaatgtatgtttaatgaattgaattttagggaccgtttcccataatttgggcctatgctatcctgttgatttttatgtctagcttaaaaggtatttgaaaatgttccatttgtgttttattattttctgtcctatgacagttctatgctaaatgtattttaaaataaaagccaaattgaagattaaaaaaaaaaaaaaaaaaaaaaaaaaaaaaaaaaaaaaaggggaaaaaaaaaaaaaaaaaaaaaaaaaaaattttggggggggggggggcgaaaaaattttaaaaacaccgttggggggggcaggggccccaagtggtattataaaaaacacggctcaagcgggggctcccacagagagacccggggcaaacacaacggtggggggggtttctcccccccaataaaaaagcgccggggggaacacaccaccggtgtttgaaaaaccaccacgagggaggcgcgagggagaacagaggggctatcaacgggggggcacccagggcgcgcgctataatg

SEQ ID NO: 42111 - DNA, 2911 bp, Homo sapiens
cttgcagcaatggcttggattagatccacttgcattctcttttttaccttgctttttgcccacatagcagctgtaccgattaagcatcttcctgaagaaaatgtacatgatgcagattttggtgaacagaaggatatttcagaaatcaatttagctgcaggcttggacctctttcaaggggacatcctcttgcagaaatccagaaatggcctgagagacccaaacaccaggtggacgttccccattccttacatcttggctgataatttggggctgaatgctaaaggagccattctgtatgcctttgagatgttccgtctcaagtcctgtgtggatttcaagccctatgaaggagagagctcatatatcatatttcaacagtttgatgggtgctggtctgaggttggtgaccaacatgtgggacagaacatttccattggccaaggatgtgcctataaggccatcatagaacacgagatcctgcatgctttgggattttaccacgagcagtcaaggacggaccgggatgattatgtgaacatctggtgggaccaaattctttcaggttaccagcacaactttgacacctatgatgatagcttaatcacagacctcaatacaccctatgattatgagtctttgatgcactaccagcctttctcatttaacaagaatgcaagtgttcccaccatcacagccaagatccctgagtttaactccattatcggacagcgcctggatttcagtgccattgatttagagaggctgaaccgaatgtacaattgcaccacaactcacactcttttggaccactgtacttttgagaaggcaaacatctgtggaatgattcagggcaccagagatgacactgactgggcccatcaggacagtgctcaggctggagaagtggatcacaccttgttgggacaatgcacaggtgccggctacttcatgcagttcagcaccagctcggggtccgcggaagaggcagccctactggagtctcggattctttacccaaagaggaagcagcagtgcctgcaatttttctataaaatgacgggaagtccttcagacagactcgttgtctgggtcaggagggatgacagcacaggcaatgttcgcaagttggtgaaggtgcagacttttcaaggagatgatgaccacaattggaaaattgcccatgtggtgctcaaagaggaacagaagtttcgctaccttttccagggcacaaaaggcgaccctcagaactcaactgggggaatttacctagatgacatcactctgacagaaaccccctgccccacaggggtctggacagtccggaatttctcccaagtccttgagaacaccagcaaaggggacaagcttcagagccctcgattctacaattcggagggatatggttttggggtaactttatacccaaatagcagagaaagctctggttacttgagacttgcttttcatgtgtgcagtggggagaacgatgctatcctggagtggccggtagaaaacagacaggtgataattaccatccttgaccaggagcctgatgtccggaacaggatgtcctcaagcatggtgttcactacctcgaagtcgcacacatctccagcgataaatgacactgtcatctgggacaggccgtccagggtgggaacctatcatacagactgtaattgttttagaagcatcgacttgggctggagtggtttcatttcccaccaaatgctgaaaaggaggagtttcctgaaaaatgatgacctcatcatatttgtggactttgaagatatcacccacctcagccagactgaagttcccactaaaggcaaaagactgagcccccaaggcctcattctccaaggccaggagcagcaggtctccgaagaaggttcgggaaaggccatgttagaggaagccctacctgtcagcctgagccaggggcagcccagccgacagaagcggtcggtggagaacacaggccccctggaggaccataactggccacagtacttcagagacccatgtgacccaaacccttgccaaaatgacggcatctgtgtgaacgtgaaggggatggcgagctgcaggtgcatctctggacatgctttcttctacacgggggagcgctgtcaggccgtgcaggtgcacggcagtgtcctgggcatggtgatcggaggcacggctggcgtgatcttcttgaccttctccatcatcgccatcctttcccaaaggccaaggaagtgacctgcctgctggcattggccagaccacagcagcacctcctccatgcaggccttaactttcccatgttcaatgcagtttggggcagcttttttatcagccttgctttggataggacctccaaggactaaggcctccagccccatgtgtgacccttgtcatctctctgccccacataattctgttactttgctatgtgctcctaatgtatctagtgtgtcctgtgacaacactcatcacacttcattgtaaatcacttgttttattgactgtctttcctatagactgtaagctccatgagggcaggcacatgttgttctcattgaccgtgctggccccagtgcctagatgcatggctggcacattgttggcactcaacaatggttgaatgaataaaacaataaatgaatgaataactaagatatagaaactctcatttatattgcagattgaatatatatgatgaaattcttatgttgaatatgttagaatcaaatactcatttttcattagatacagtagtgtcatcactcttttaagatcttgttaaagatttcaaataaaggtacttctgggcagccaggctgcacagcatttgctttcctctgagattctaagagaaggcctttaataaatttaataaatattgagttagcaccttctt

SEQ ID NO: 42112 - DNA, 488 bp, Homo sapiens
aataaggctaagaagtgcaggatcccaggagaaaggtaggtaggggtgtgtgtatgtgcgtgtgtgtgtgtgtgcacgcgcaagttggtatcacatactcagcagatgatgtagttatgagcagggagtttggaatcagagaccttgttttgacccctagctgtttctcccatttctgtgagaccctggactagttaatatgtgtcggtatgagtttctctacctgtgaaatggagctaatgcgtggtttctcagtggaggatctgttgacattggggctggataattcattgctgaggggctaccctgcgcattttaggatgttttgcagtatatctctagcctctacgcactagattccggtagcatcttccctgctgtctccctgtgacaaccaaaaatgtctctggacattgccaaatatcccctgggagtcaaaattgtttcagagccgctggcctatactacttctctctccctcccttcct

SEQ ID NO: 42113 - DNA, 181 bp, Homo sapiens
ccatccctcagcccagtgataatggactgattcaacaaatgaaatcagccaaactagtccatggattctctttctggccagtcagttcaataaggaagtgaaagccaaaaagaatggaggcatctaatttctaactggttaaataagtcattgttaagaaattttacattatgaaggtata

SEQ ID NO: 42114 - DNA, 791 bp, Homo sapiens
gaggcaggagaatcacttgaacctgggaggcggaggttgcagtgagccaagatcacgccactgcactccagcctgggcaacagagtgagactccgtctcaaaaaataaataaaatttttttaaaaaggtcaaaatgctataaaatttaacatctactatttaaatttataaaggagatgcagtgataattatgcatatgcgttttttgacttgttagctacattcttttttactatacttgctttctttattaagttctacattttgtcctacattaatatgaatcatttgaagtactttattctaatttaaatttgaaaatactattttctgaaaaaatgtattttattttggaagctcttcatttttaaaaatttgtggtttatattctgagcaaattaaaagtagctgttttggccatttaaaaatgttaaaagaatatgagtgcattaagagatataatgaccactataactattacttgacctgtttttatattcactacctaacatttatttaatgcctgctaaatacaaggcagtataattgagccagtttgtgtgatagaatatatatttgattctttaaatttttgtttttttattataacagtgtgctcagtttaaactgtgaaacaaagacaagaacagctgccatcattttaagataactgaagttagaaatgtgataatggttgttttaaaatctttacctctgcaattacctataaggccttttaagatcctgtaatgatctgcctacccacaccacttcttaaacctctctggcct

SEQ ID NO: 42115 - DNA, 469 bp, Homo sapiens
agataaactgtttccacctgtgacaaatgagtcatccaccttccgtgtggtctggactttgtccctgttacaatattcctgtctcttgtttctggtttttggcgtcccacgtgttgtccctgtaacagtcctgtctcttgtttctggggtcacccctgtggcgagctgactgtgccacgttcctgaggctggtgaggatgctgtgggcaccttaatcacggctgtgaacaaactggctagagctaggtgccatggagctttgcagtggacagtaagttgtggtacccattctttgatcagtgacggagccaggtgccttattaagtctcggggatttctggaagcacagagcaggcaagcaccttctacactgaaaggaatccttctcacactcatgttggcaacgtgaagtcctgcctttggaaatccctgatttcctaagacactaccctaacattttaaaggactt

SEQ ID NO: 42116 - DNA, 727 bp, Homo sapiens
agctccctggcttccattccactcatgactagctttacctctttgaccccactgtattattgtctagcccagttcagctgaatctttcaacacaaaatatacagggaaccccttcctggggaacttcctttgttattgaggtcttcgctgatggcttcttccatttgatactcagtctcagtcacagtaggattacggaatcttttgccagagtatcaatctacatgggtgctacacattactgaaaaaaattaggaacatggtgctagttaattcaagtcttcatgtaaaacttcttctatcatagtggacattaaaaaaaatctctctgcaaagtgcattgaccctacctctagtagatgaatgttgaacaagtagcctatctaggaagcaagtgactagcatccatgggcatcccacaggttgtagtccagccccgatcttggtggttgggattgatgttgctgccaagtccctccgtttcatgttcaggctctgcctatgttcctggtgtctggtacctgatttttcaggatgctgacatttacttcttgcccacaacaccatataccctaagtcttgccaacatctttgaatgtcttctgctggtctgtctctcctccgttgttcttttactatgtcccaagtgcatgctttgttcagtatctgcctaagtctcaggatactgattttagctttttactaggtcctgacattcccgtagttt

SEQ ID NO: 42117 - DNA, 316 bp, Homo sapiens
aaattactaggatctgatatgaaagagtagacactactaccaaccttacagaaatgggcaatctgaatagacctataactagtgaacagattaaaccaggaatcagaaaattgcccacaaagaatagtccaggcacagacagttttaccactgtgttctaccaaacaatcaaataaattatagcaattattctcaaactctttcaagaaataggagggagtacttcccagtattgccctgataacaaaactgctcaaagatattacaagaaaactgcagaccaatatgtcttatgaaatacctgcaaaaatcctca

SEQ ID NO: 42118 - DNA, 441 bp, Homo sapiens
accacaaccattcaatggagaaagaagagtaccttcaacaaatcatactagaacatttgtataatgacatgtaaaaaaaaatgaagtgggactccatataaaataattaactcatatataataattaactcatggatcaaggaccctcaatgtaaggggtaagattgcaaaattcttagaagcaaacatagaagtagatctgcatttcctcagatttgacaatggattgttagatttgacaccaaaagcactagtaacaaaatttaaaaatagattagattctgcaaaaatgtaaagcttttttgcattaaaaaacattttcagccaggtgcagtgctcatgcctgtaatcccagaactttgggaggccacagcataaggcttgcttgagcccaggaatttgagaccagcatgggcaatatagtgagaccttgtctctaga

SEQ ID NO: 42119 - DNA, 253 bp, Homo sapiens
tctgaatctcgttgacccttcagtaaaatggaaatagtagtactgactcaaccactgtcttatcagatacacatagcaatcctataaggtgagtcttattaaaggaaacagaggctcaagagaggttaatagtttgcttaaggtcacacagcaagtagcattgtcagggttaaaccaattctttgtaactctcaagttgggtgttattagtaatagcctgattagagtaatatacaaacagactattgagagt

SEQ ID NO: 42120 - DNA, 287 bp, Homo sapiens
ccgggtgggggtccaggaacaggcccaacaagccaaagcccaggagaccggggtcttgggcacagacccctgggccatctcttgccaaggccctggaaatagggatcctggacacagaccccccacaaaaccaaggacaggggtacagagattctaggtacaactcctagaactagatggggatggagatggggtcggggacacagcccccgtatcaaaccaaggcctccaggacgcgattccagacacaatccctacctctccctgcctaagggggtctcagcaca

SEQ ID NO: 42121 - DNA, 674 bp, Homo sapiens
cggtatcatttgttgaaaagattatcttttccccacttaaatgacttggcactttgctgaaaatcaattgaccatatatgtgtggatctatttctggacttgctattctgttccattcatctaatggtctattttcatatcaataccatactgtcttgattactgtagctttataataattcttgaaatcatgtagtctaagtccttcaactgtgttgttctttttcaaagttattttagcaactctgggttccttgcatttccatataaactttagaatcaggttatcaaattctacaagtaggcatgctgaggtctgattccgattgctttgaatctgtagatcattttgggaaaagtcgccatcctaagatactgagtcttctgattcaagagcatgttataacttgccatttatttaggtcttttaaaatttctctcagcagtgttttgtagattacagtgtacaggcctcgcgcattttatctctgagcatttcataattttcatgcttgattactgttttttgtttttttttttttgagatggtagtcttgctctgtcacccaggctagagtgcagtggcatgatctcggctcactgcaagctctgcctcctgggttcaagcaattctcctgcctcagcctccccagtaactgggattacaggcgcct

SEQ ID NO: 42122 - DNA, 2215 bp, Homo sapiens
cgcccgcgcgggccctgacgcgggcccgggcgccgcgccgctgcggctgcaggcggcgacggctacaccatgggccggctgctgcgggccgcccggctgccgccgctgctttcgccgctgctgcttctgctggttgggggagcgttcctgggtgcctgtgtggctgggtctgatgagcctggcccagagggcctcacctccacctccctgctagacctcctgctgcccactggcttggagccactggactcagaggagcctagtgagaccatgggcctgggagctgggctgggagcccctggctcaggcttccccagcgaagagaatgaagagtctcggattctgcagccaccacagtacttctgggaagaggaggaagagctgaatgactcaagtctggacctgggacccactgcagattatgtttttcctgacttaactgagaaggcaggttccattgaagacaccagccaggctcaagagctgccaaacctcccctctcccttgcccaagatgaatctggttgagcctccctggcatatgcctcccagagaggaggaagaagaggaagaggaagaggaggagagggagaaggaagaggtagagaaacaagaggaggaggaagaggaggagctgctccctgtgaatggatcccaagaagaagccaagcctcaggtccgtgacttttctctcaccagcagcagccagaccccaggggccaccaaaagcaggcatgaagactccggggaccaggcctcatcaggtgtggaggtggagagcagcatggggcccagcttgctgctgccttcagtcaccccaactacagtgactccgggggaccaggactccaccagccaagaggcagaggccacagtgctgccagctgcagggcttggggtagagttcgaggctcctcaggaagcaagcgaggaagccactgcaggagcagctggtttgtctggccagcacgaggaggtgccggccttgccttcattccctcaaaccacagctcccagtggggccgagcacccagatgaagatccccttggctctagaacctcagcctcttccccactggcccctggagacatggaactgacaccttcctctgctaccttgggacaagaagatctcaaccagcagctcctagaagggcaggcagctgaagctcaatccaggataccctgggattctacgcaggtgatctgcaaggactggagcaatctggctgggaaaaactacatcattctgaacatgacagagaacatagactgtgaggtgttccggcagcaccgggggccacagctcctggccctggtggaagaggtgctgccccgccatggcagtggccaccatggggcctggcacatctctctgagcaagcccagcgagaaggagcagcaccttctcatgacactggtgggcgagcagggggtggtgcccactcaagatgtcctttccatgctgggtgacatccgcaggagcctggaggagattggcatccagaactattccacaaccagcagctgccaggcgcgggccagccaggtgcgcagcgactacggcacgctcttcgtggtgctggtggtcattggggccatctgcatcatcatcattgcgcttggcctgctctacaactgctggcagcgccggctgcccaagctcaagcacgtgtcgcacggcgaggagctgcgcttcgtggagaacggctgccacgacaaccccacgctggacgtggccagcgacagccagtcggagatgcaggagaagcaccccagcctgaacggcggcggggccctcaacggcccggggagctggggggcgctcatggggggcaagcgggaccccgaggactcggacgtgttcgaggaggacacgcacctgtgagcgcagccgaggcgcaggccgagtgggccgccaggaccaagcgaggtggaccccgaaacggacggcccggagcccgcaccagccccgcgcctacccgggccgcccccgcggcctggccctcggcgcgggctccttcccgcttcccccgacttcacacggcggcttcggaccaactccctcactcccgcccgaggggcaggcctcaaagcccgccttggccccgctttcccgcccctgaaccccggccccgcgggcggcgggcgcgcttcctgcgccccgggactcaattaaacccgcccggagaccacgccgggcccagcgcgtctgc

SEQ ID NO: 42123 - DNA, 1856 bp, Homo sapiens
cgcccgcgcgggccctgacgcgggcccgggcgccgcgccgctgcggctgcaggcggcgacggctacaccatgggccggctgctgcgggccgcccggctgccgccgctgctttcgccgctgctgcttctgctggttgggggagcgttcctgggtgcctgtgtggctgggtctgatgagcctggcccagagggcctcacctccacctccctgctagacctcctgctgcccactggcttggagccactggactcagaggagcctagtgagaccatgggcctgggagctgggctgggagcccctggctcaggcttccccagcgaagagaatgaagagtctcggattctgcagccaccacagtacttctgggaagaggaggaagagctgaatgactcaagtctggacctgggacccactgcagattatgtttttcctgacttaactgagaaggcaggttccattgaagacaccagccaggctcaagagctgccaaacctcccctctcccttgcccaagatgaatctggttgagcctccctggcatatgcctcccagagaggaggaagaagaggaagaggaagaggaggagagggagaaggaagaggtagagaaacaagaggaggaggaagaggaggagctgctccctgtgaatggatcccaagaagaagccaagcctcaggtccgtgacttttctctcaccagcagcagccagaccccaggggccaccaaaagcaggcatgaagactccggggaccaggcctcatcaggtgtggaggtggagagcagcatggggcccagcttgctgctgccttcagtcaccccaactacagtgactccgggggaccaggactccaccagccaagaggcagaggccacagtgctgccagctgcagggcttggggtagagttcgaggctcctcaggaagcaagcgaggaagccactgcaggagcagctggtttgtctggccagcacgaggaggtgccggccttgccttcattccctcaaaccacagctcccagtggggccgagcacccagatgaagatccccttggctctagaacctcagcctcttccccactggcccctggagacatggaactgacaccttcctctgctaccttgggacaagaagatctcaaccagcagctcctagaagggcaggcagctgaagctcaatccaggataccctgggattctacgcaggtgatctgcaaggactggagcaatctggctgggaaaaactacatcattctgaacatgacagagaacatagactgtgaggtgttccggcagcaccgggggccacagctcctggccctggtggaagaggtgctgccccgccatggcagtggccaccatggggcctggcacatctctctgagcaagcccagcgagaaggagcagcaccttctcatgacactggtgggcgagcagggggtggtgcccactcaagatgtcctttccatgctgggtgacatccgcaggagcctggaggagattggcatccagaactattccacaaccagcagctgccaggcgcgggccagccaggtgcgcagcgactacggcacgctcttcgtggtgctggtggtcattggggccatctgcatcatcatcattgcgcttggcctgctctacaactgctggcagcgccggctgcccaagctcaagcacgtggtgagtgtggggacaggtggggctgggggccagttgagaggagagtgcccatcgataggtgtcctcatctgcaaggggaggcagtgactctcctgggcgcacagggtcccgtgggtgaagcagctggtcagcctagcactgctgactgctctgcagggcaccagccccaggacaggtgccag

SEQ ID NO: 42124 - DNA, 1391 bp, Homo sapiens
cggacgcgtgggcatgctgctctccacctccacacctgatgaggccacagtgctgccagctgcagggcttggggtagagttcgaggctcctcaggaagcaagcgaggaagccactgcaggagcagctggtttgtctggccagcacgaggaggtgccggccttgccttcattccctcaaaccacagctcccagtggggccgagcacccagatgaagatccccttggctctagaacctcagcctcttccccactggcccctggagacatggaactgacaccttcctctgctaccttgggacaagaagatctcaaccagcagctcctagaagggcaggcagctgaagctcaatccaggataccctgggattctacgcaggtgatctgcaaggactggagcaatctggctgggaaaaactacatcattctgaacatgacagagaacatagactgtgaggtgttccggcagcaccgggggccacagctcctggccctggtggaagaggtgctgccccgccatggcagtggccaccatggggcctggcacatctctctgagcaagcccagcgagaaggagcagcaccttctcatgacactggtgggcgagcagggggtggtgcccactcaagatgtcctttccatgctgggtgacatccgcaggagcctggaggagattggcatccagaactattccacaaccagcagctgccaggcgcgggccagccaggtgcgcagcgactacggcacgctcttcgtggtgctggtggtcattggggccatctgcatcatcatcattgcgcttggcctgctctacaactgctggcagcgccggctgcccaagctcaagcacgtgtcgcacggcgaggagctgcgcttcgtggagaacggctgccacgacaaccccacgctggacgtggccagcgacagccagtcggagatgcaggagaagcaccccagcctgaacggcggcggggccctcaacggcccggggagctggggggcgctcatggggggcaagcgggaccccgaggactcggacgtgttcgaggaggacacgcacctgtgagcgcagccgaggcgcaggccgagtgggccgccaggaccaagcgaggtggaccccgaaacggacggcccggagcccgcaccagccccgcgcctacccgggccgcccccgcggcctggccctcggcgcgggctccttcccgcttcccccgacttcacacggcggcttcggaccaactccctcactcccgcccgaggggcaggcctcaaagcccgccttggccccgctttcccgcccctgaaccccggccccgcgggcggcgggcgcgcttcctgcgccccgggactcaattaaacccgcccggagaccacgccgggcccagcgcgtctgc

SEQ ID NO: 42125 - DNA, 1273 bp, Homo sapiens
atatgggctatgcgacgggcgtagcacgaggaggtgccggccttgccttcattccctcaaaccacagctcccagtggggccgagcacccagatgaagatccccttggctctagaacctcagcctcttccccactggcccctggagacatggaactgacaccttcctctgctaccttgggacaagaagatctcaaccagcagctcctagaagggcaggcagctgaagctcaatccaggataccctgggattctacgcaggtgatctgcaaggactggagcaatctggctgggaaaaactacatcattctgaacatgacagagaacatagactgtgaggtgttccggcagcaccgggggccacagctcctggccctggtggaagaggtgctgccccgccatggcagtggccaccatggggcctggcacatctctctgagcaagcccagcgagaaggagcagcaccttctcatgacactggtgggcgagcagggggtggtgcccactcaagatgtcctttccatgctgggtgacatccgcaggagcctggaggagattggcatccagaactattccacaaccagcagctgccaggcgcgggccagccaggtgcgcagcgactacggcacgctcttcgtggtgctggtggtcattggggccatctgcatcatcatcattgcgcttggcctgctctacaactgctggcagcgccggctgcccaagctcaagcacgtgtcgcacggcgaggagctgcgcttcgtggagaacggctgccacgacaaccccacgctggacgtggccagcgacagccagtcggagatgcaggagaagcaccccagcctgaacggcggcggggccctcaacggcccggggagctggggggcgctcatggggggcaagcgggaccccgaggactcggacgtgttcgaggaggacacgcacctgtgagcgcagccgaggcgcaggccgagtgggccgccaggaccaagcgaggtggaccccgaaacggacggcccggagcccgcaccagccccgcgcctacccgggccgcccccgcggcctggccctcggcgcgggctccttcccgcttcccccgacttcacacggcggcttcggaccaactccctcactcccgcccgaggggcaggcctcaaagcccgccttggccccgctttcccgcccctgaaccccggccccgcgggcggcgggcgcgcttcctgcgccccgggactcaattaaacccgcccggagaccacgccgggcccagcgcgtctgc

SEQ ID NO: 42126 - DNA, 1562 bp, Homo sapiens
cgcccgcgcgggccctgacgcgggcccgggcgccgcgccgctgcggctgcaggcggcgacggctacaccatgggccggctgctgcgggccgcccggctgccgccgctgctttcgccgctgctgcttctgctggttgggggagcgttcctgggtgcctgtgtggctgggtctgatgagcctggcccagagggcctcacctccacctccctgctagacctcctgctgcccactggcttggagccactggactcagaggagcctagtgagaccatgggcctgggagctgggctgggagcccctggctcaggcttccccagcgaagagaatgaagagtctcggattctgcagccaccacagtacttctgggaagaggaggaagagctgaatgactcaagtctggacctgggacccactgcaggtagctcttcttacctacagagcattgacaccttcctctgctaccttgggacaagaagatctcaaccagcagctcctagaagggcaggcagctgaagctcaatccaggataccctgggattctacgcaggtgatctgcaaggactggagcaatctggctgggaaaaactacatcattctgaacatgacagagaacatagactgtgaggtgttccggcagcaccgggggccacagctcctggccctggtggaagaggtgctgccccgccatggcagtggccaccatggggcctggcacatctctctgagcaagcccagcgagaaggagcagcaccttctcatgacactggtgggcgagcagggggtggtgcccactcaagatgtcctttccatgctgggtgacatccgcaggagcctggaggagattggcatccagaactattccacaaccagcagctgccaggcgcgggccagccaggtgcgcagcgactacggcacgctcttcgtggtgctggtggtcattggggccatctgcatcatcatcattgcgcttggcctgctctacaactgctggcagcgccggctgcccaagctcaagcacgtgtcgcacggcgaggagctgcgcttcgtggagaacggctgccacgacaaccccacgctggacgtggccagcgacagccagtcggagatgcaggagaagcaccccagcctgaacggcggcggggccctcaacggcccggggagctggggggcgctcatggggggcaagcgggaccccgaggactcggacgtgttcgaggaggacacgcacctgtgagcgcagccgaggcgcaggccgagtgggccgccaggaccaagcgaggtggaccccgaaacggacggcccggagcccgcaccagccccgcgcctacccgggccgcccccgcggcctggccctcggcgcgggctccttcccgcttcccccgacttcacacggcggcttcggaccaactccctcactcccgcccgaggggcaggcctcaaagcccgccttggccccgctttcccgcccctgaaccccggccccgcgggcggcgggcgcgcttcctgcgccccgggactcaattaaacccgcccggagaccacgccgggcccagcgcgtctgc

SEQ ID NO: 42127 - DNA, 1150 bp, Homo sapiens
cactgcaggagcacctcctcgtgctggccagacaaaccagctgctcctgcagtggcttcctcgcttgcttcctgaggagcctcgaactctaccccaagccctgcagctggcagcactgtggcctctgcagcacgaggaggtgccggccttgccttcattccctcaaaccacagctcccagtggggccgagcacccagatgaagatccccttggctctagaacctcagcctcttccccaagctcctggccctggtggaagaggtgctgccccgccatggcagtggccaccatggggcctggcacatctctctgagcaagcccagcgagaaggagcagcaccttctcatgacactggtgggcgagcagggggtggtgcccactcaagatgtcctttccatgctgggtgacatccgcaggagcctggaggagattggcatccagaactattccacaaccagcagctgccaggcgcgggccagccaggtgcgcagcgactacggcacgctcttcgtggtgctggtggtcattggggccatctgcatcatcatcattgcgcttggcctgctctacaactgctggcagcgccggctgcccaagctcaagcacgtgtcgcacggcgaggagctgcgcttcgtggagaacggctgccacgacaaccccacgctggacgtggccagcgacagccagtcggagatgcaggagaagcaccccagcctgaacggcggcggggccctcaacggcccggggagctggggggcgctcatggggggcaagcgggaccccgaggactcggacgtgttcgaggaggacacgcacctgtgagcgcagccgaggcgcaggccgagtgggccgccaggaccaagcgaggtggaccccgaaacggacggcccggagcccgcaccagccccgcgcctacccgggccgcccccgcggcctggccctcggcgcgggctccttcccgcttcccccgacttcacacggcggcttcggaccaactccctcactcccgcccgaggggcaggcctcaaagcccgccttggccccgctttcccgcccctgaaccccggccccgcgggcggcgggcgcgcttcctgcgccccgggactcaattaaacccgcccggagaccacgccgggcccagcgcgtctgc

SEQ ID NO: 42128 - DNA, 949 bp, Homo sapiens
gcgcgtgcgtgctggcgtgcgttcactttcagcctggtgtggggcttgtaaacatataacataaaaatggcttccaaaagagctctggtcatcctggctaaaggagcagaggaaatggagacggtcatccctgtaggactgcatccaaccccgcaggctccactccgggtggtgcccactcaagatgtcctttccatgctgggtgacatccgcaggagcctggaggagattggcatccagaactattccacaaccagcagctgccaggcgcgggccagccaggtgcgcagcgactacggcacgctcttcgtggtgctggtggtcattggggccatctgcatcatcatcattgcgcttggcctgctctacaactgctggcagcgccggctgcccaagctcaagcacgtgtcgcacggcgaggagctgcgcttcgtggagaacggctgccacgacaaccccacgctggacgtggccagcgacagccagtcggagatgcaggagaagcaccccagcctgaacggcggcggggccctcaacggcccggggagctggggggcgctcatggggggcaagcgggaccccgaggactcggacgtgttcgaggaggacacgcacctgtgagcgcagccgaggcgcaggccgagtgggccgccaggaccaagcgaggtggaccccgaaacggacggcccggagcccgcaccagccccgcgcctacccgggccgcccccgcggcctggccctcggcgcgggctccttcccgcttcccccgacttcacacggcggcttcggaccaactccctcactcccgcccgaggggcaggcctcaaagcccgccttggccccgctttcccgcccctgaaccccggccccgcgggcggcgggcgcgcttcctgcgccccgggactcaattaaacccgcccggagaccacgccgggcccagcgcgtctgc

SEQ ID NO: 42129 - DNA, 905 bp, Homo sapiens
ccagaggcaggccctgcgttggtggtgcccaaggatcaaggagaggctccagcagcctagaggcctccccaggaggaagcgagcagagccctagcgatgctccctgcccacctcgcaagtggagtcttcttagggggctgttgggggatcgatgacgtcagggaggccacggggctttgtagtgccaacgactagtaggtttattttgagaaaggagttgagctgcagcaacagaaaagaaggatctggcacctgtggagggtgccgcgggaaccccctgggtggggttgcacagacggccgcgggcctggcgctgtccgggggctggctcgctcgcccatggcctctccccaccccgcctcagtcgcacggcgaggagctgcgcttcgtggagaacggctgccacgacaaccccacgctggacgtggccagcgacagccagtcggagatgcaggagaagcaccccagcctgaacggcggcggggccctcaacggcccggggagctggggggcgctcatggggggcaagcgggaccccgaggactcggacgtgttcgaggaggacacgcacctgtgagcgcagccgaggcgcaggccgagtgggccgccaggaccaagcgaggtggaccccgaaacggacggcccggagcccgcaccagccccgcgcctacccgggccgcccccgcggcctggccctcggcgcgggctccttcccgcttcccccgacttcacacggcggcttcggaccaactccctcactcccgcccgaggggcaggcctcaaagcccgccttggccccgctttcccgcccctgaaccccggccccgcgggcggcgggcgcgcttcctgcgccccgggactcaattaaacccgcccggagaccacgccgggcccagcgcgtctgc

SEQ ID NO: 42130 - DNA, 1070 bp, Homo sapiens
aggggagctgagcggcgtccgcccccgccgagccgagcggagcgcgagcgaagccggcgcgcctgcagctgggagctgggagctgggagcgcgccgggcgcagggccgggccggccgcgggagggtagtgtcagcgcccgcgtccagctcttcggccgcagacccgggctgtctggaggccgcgcggccacctgctgcgtcgccccggctttgggctggggctagacgcgcaccgcggcgggagcagccccggctcgccgcaccccgcggaaggtgcccttctctgcgcgtctcgccgagcccgggccacgctcctgtcccagcgagcttgacatgatttccacaagggtgatggacattaagcttcgggaggctgcagaaggccttggggaggacagcacaggaaagaaaaaatctaaattcaaaacttttaagaagttttttgggaagaagaagagaaaagaatcgccgtcgtccacaggaagtagcacctggaaacaaagtcagacgaggaatgaggtcattgccatcgaatccgggccagtgggctacgactccgaggatgagctggaggagtcgaggggcacgctgggcagccgggccctttctcacgacagtattttcattcctgagtccggacaggacgctactcggcctgtgcgggtgttttcccaagaaaatgtgtgtgatcggattaaagctctgcagttaaaaatacagtgtaatgtgaaaatggggccaccacctcctccaggggggcttcctgccaagcggggagaggatgccggcatgagctctgaggacgacgggctgcccaggagccccccagagatgtctctgctgcacgacgtgggtcctggtaccaccataaaggtctctgtcgtgtctccagaccacgtgagcgacagcaccgtctctgcccggatctcagacaacagcctggcaccagtggcttgacttcagttatcctgcagaatcctcctcctgcctggacaactctgcagctaagcacaagctccaggtcaagccccgcaaccagcggtcgagtaagatgaggcggctctcatcgg

SEQ ID NO: 42131 - DNA, 934 bp, Homo sapiens
aggggagctgagcggcgtccgcccccgccgagccgagcggagcgcgagcgaagccggcgcgcctgcagctgggagctgggagctgggagcgcgccgggcgcagggccgggccggccgcgggagggtagtgtcagcgcccgcgtccagctcttcggccgcagacccgggctgtctggaggccgcgcggccacctgctgcgtcgccccggctttgggctggggctagacgcgcaccgcggcgggagcagccccggctcgccgcaccccgcggaaggtgcccttctctgcgcgtctcgccgagcccgggccacgctcctgtcccagcgagcttgacatgatttccacaagggtgatggacattaagcttcgggaggctgcagaaggccttggggaggacagcacaggaaagaaaaaatctaaattcaaaacttttaagaagttttttgggaagaagaagagaaaagaatcgccgtcgtccacaggaagtagcacctggaaacaaagtcagacgaggaatgaggtcattgccatcgaatccgggccagtgggctacgactccgaggatgagctggattaaaaatacagtgtaatgtgaaaatggggccaccacctcctccaggggggcttcctgccaagcggggagaggatgccggcatgagctctgaggacgacgggctgcccaggagccccccagagatgtctctgctgcacgacgtgggtcctggtaccaccataaaggtctctgtcgtgtctccagaccacgtgagcgacagcaccgtctctgcccggatctcagacaacagcctggcaccagtggcttgacttcagttatcctgcagaatcctcctcctgcctggacaactctgcagctaagcacaagctccaggtcaagccccgcaaccagcggtcgagtaagatgaggcggctctcatcgg

SEQ ID NO: 42132 - DNA, 922 bp, Homo sapiens
aggggagctgagcggcgtccgcccccgccgagccgagcggagcgcgagcgaagccggcgcgcctgcagctgggagctgggagctgggagcgcgccgggcgcagggccgggccggccgcgggagggtagtgtcagcgcccgcgtccagctcttcggccgcagacccgggctgtctggaggccgcgcggccacctgctgcgtcgccccggctttgggctggggctagacgcgcaccgcggcgggagcagccccggctcgccgcaccccgcggaaggtgcccttctctgcgcgtctcgccgagcccgggccacgctcctgtcccaggttttaactccatgattgtgtgctatgagtatatggctgcatgtctcaagaaattcactggctttaaaatgtgggcttagctactgccagtatgatttgatgaaagcggatagaggtctcagatccacccccggattccaccgtcaggcccaaggacggacccctggccattgactgatgccaagtgggtgcctggcagcagccttccttcccatccctgcttctggacgcctcagccaagtcactgattttctgcatactccatgtaatgaatctggtatgctgagataaggacacctgtgactgagatgatttctttggcgtccgtgcaagataaaagcgagcttgacatgatttccacaagggtgatggacattaagcttcgggaggctgcagaaggccttggggaggacagcacaggaagaaaaattctaattcacacttttacaagtttttggcacaagaagaaaaaaatccgtcgccacggaagtcgcctgcgacaagccacggcgaagaggtcttcctcaatccggccggggcacccggatatgagacaaagcacgggcgagctccaccaaacccacgacacgccgccagta

SEQ ID NO: 42133 - DNA, 978 bp, Homo sapiens
gtcgacaggctatccacaggctgtgggatgggagaaactgtggagccatccagctgtgtggccaggaaggatggctagcctctcccctgccagactactcactgcagggacagggcaggcatttgccagaagtcactgattttctgcatactccatgtaatgaatctggtatgctgagataaggacacctgtgactgagatgatttctttggcgtccgtgcaagataaaagcgagcttgacatgatttccacaagggtgatggacattaagcttcgggaggctgcagaaggccttggggaggacagcacaggaaagaaaaaatctaaattcaaaacttttaagaagttttttgggaagaagaagagaaaagaatcgccgtcgtccacaggaagtagcacctggaaacaaagtcagacgaggaatgaggtcattgccatcgaatccgggccagtgggctacgactccgaggatgagctggaggagtcgaggggcacgctgggcagccgggccctttctcacgacagtattttcattcctgagtccggacaggacgctactcggcctgtgcgggtgttttcccaagaaaatgtgtgtgatcggattaaagctctgcagttaaaaatacagtgtaatgtgaaaatggggccaccacctcctccaggggggcttcctgccaagcggggagaggatgccggcatgagctctgaggacgacgggctgcccaggagccccccagagatgtctctgctgcacgacgtgggtcctggtaccaccataaaggtctctgtcgtgtctccagaccacgtgagcgacagcaccgtctctgcccggatctcagacaacagcctggcaccagtggcttgacttcagttatcctgcagaatcctcctcctgcctggacaactctgcagctaagcacaagctccaggtcaagccccgcaaccagcggtcgagtaagatgaggcggctctcatcgg

SEQ ID NO: 42134 - DNA, 394 bp, Homo sapiens
atcacatgtacatgacagctcccccaggacacaccaaatgagctgcagtgggatctcgactcattcttagatgaacaaagaagagatggcagtggaagagctggtggcagatgcacgttcagttcagttctctgcaccacaccaagatactgaaggcatttccagcatgaatgaattagagcaggaggatttgttgataaatatcattgatgaaaataagagcacatgttctttattccaatctagttaaaaatacagtgtaatgtgaaaatggggccaccacctcctccaggggggcttcctgccaagcggggagaggatgccggcatgagctctgaggacgacgggctgcccaggagccccccagagatgtctctgctgcacgacgtgggtc

SEQ ID NO: 42135 - DNA, 271 bp, Homo sapiens
ttgccctgagggggacagttagggaggcccacgtgaggagtgaacatgtggctggagatgaggacccagagtgatccccccaggtgatgcttaggaacagggaaagcccagatctgagaagggaggcacatcctgaggggtctttggaaccagtgtgtctacactgtgggctcaagtttttaacacacttgtcctagggccctgccaccttcctccctgaaactggtcagggtgccactcccaggacccaggtgcacactatttccacccc

SEQ ID NO: 42136 - DNA, 429 bp, Homo sapiens
tctcttgttgcccaggctggagtgcaatggtgcgatcttggctcactgcaacctccacctcccaggttcaagcgattctcctgctcatgcctgtaatctcagcacactttgggagggtgaggtggggggatcacttgaagtcaggagttcgagaccagcctgggcaataataacaataaaaaagccattttagattccaatccactgaaagaaaactgacccttagttaatgtcatgcttattggatccatgaagtctttgaaaatttaaactacaaggacactgctctctgtggtggtggagagaataccaaggatttaaaggtctttaagaaagagaatgtagaaagcgtacccattggaaacagcaagatgatgataatcgtactgacagtaataataagctgaaatatatagagcttactatgta

SEQ ID NO: 42137 - DNA, 390 bp, Homo sapiens
tagaggcagggtcttgtgatgttgctcaggctggatggagttcagtggctatttacaagcacagtcatagcacgctgcagccttaaactcctggcctcaagagatcttccctcctcagccacctgagtagccaaaaccataagtgcatgccaccatgtaccacttcctaccaagaatttttcaaaaaactagggaggcatttactactacaggccatggaattttaagattgacttatgttacttggatccttgaaagcggggagtgaccaatgatggagatttgggagagtggggaggcaggggagtggagtcatttagatgacacctggaaagcacaggagtaacacctttttcaactttgttgatagtaaacaaagaacgtacttat

SEQ ID NO: 42138 - DNA, 280 bp, Homo sapiens
acgaattcttagaacagagaagtagtactgattttatatgacatagtattgatcttagttatatttttttttcaaaaaaagtcagtgaatcacacaaaataaccttcaaatcacatgtgacttttgtagtatgttcagaaagggtcatctcaatcatgaagagaaacatttcattaaaaatatttaaggactgactcagttttcttaagagcctttcttaattatttgatattcctgtcattctctttggaagcacctctaatgttaccactctttccat

SEQ ID NO: 42139 - DNA, 417 bp, Homo sapiens
tgggacttcaggtgcatgccaccatggcaggctaattaaaaaaaagtttaatggaaattggggtccctctatgttgtccaggctagtcttgaactcctggcctcaagcaatcctcctgcctcggcctcacaaagtgctgagattacaggcatgaaccactgtaccaggcctaattgattttttaattatcaattccacaagcttaaactgaactatctttaactgaaggtgctcatttgtcttgatggctacattcagttaaaatgtgctgactggaattttcttttaatccagccacgtttaggaacctactagataatacaaactgagagattcaagagattaagtagtggcatataatttcatagttgcttcttttttgcatgtacaattggaaaactcagcctgcttttacat

SEQ ID NO: 42140 - DNA, 484 bp, Homo sapiens
caatataattgtaaacataatttatcctcactgtgatggctagccacctgacccaaatcattattagactcaatactttggaactggaacaaaaatcagttgacctgatgtctgaaagacatgcccacctgctatttgacaagctatagacatatcctaccaattgatgggtagtagcactgaaactatgaaagtggatgaactcatccagaggagttgatgagtgagaaaagaagactggaaaaggaacacaaggaaatcaagaagcagcagctgagactgaaggaaaataacgtggtattacagaggccaaaaaatagagtatttcaagaagcaagtggttagtggagttaaaagctgctgatacaacctaaaaaagtaagtatccattttttaaaaaactttcatttaaaataccaccatattttattgaatctaagtacctgattgtaagacattaaagaaaaattaaacctgctaatta

SEQ ID NO: 42141 - DNA, 264 bp, Homo sapiens
aactcacaccttctgctcacttctcaacctagaagagtccacttttgctgactctctctttcttctatcatctcatggaaactgctaaacactttacctggtgttccaatccctggcctcagagatctttggcctgaggacattacggaactttcctttcctttccctttcccttctcttccctttttctttctcagagtctcactctgtcacccaggagggcgtgcagtggcatgaactcggctcactgcaacctctgcctcc

SEQ ID NO: 42142 - DNA, 438 bp, Homo sapiens
gcctcaaacaagaggactttttaccgcagtttcttctacccagtatatcatgtctgctttcaacaaaaacttacaagacatgctaaaaggcaaaaatcaaagttgcatgaggcataacaagaatcagaaccattgccagactcatttatggcagcgatttttggaataatcagactggaaattttaaataagtatgattaatatactaaaggctctaatggaaaaagtgaacaacatgcaagaaaggtgggtaacataagcagacaatagaaactctaagaaagaacccaaaagaaatactagaaataagcaatactataacagaaatgaagaatgcccttggacttattgatagagtggaaaggacaatagataacctgggaaagattcaatgagcttgaagatatgtcagtagaaagttccaaaacttaaactgca

SEQ ID NO: 42143 - DNA, 197 bp, Homo sapiens
gatcgcaccattgtactccagcctgggcaacagagcgaaactctatctcaaaacaaaccaaccaaccaggattgaagtttctattttcctgttttcacatacacattttcttcagccatattatatgtgtatgtatagcctacattggctaaatctgaggaacaccacaaacatcagataaatctctcatgttgtgt

SEQ ID NO: 42144 - DNA, 407 bp, Homo sapiens
aacatcaaccaatcaatcagatttgcatctaagcttgtgtgacatacaagcctaaggcctgggttagttgtagataaaccttttcatcattgccaaaagcaaacaccatttctattttttaacatctacaaaatgttgaacatttttaacatgttggatctgttgttttggggatatatatgtggatataataagcatttaagaagtttagtctacagccgggtgcggtggctcacacctgtaatcccggcactttgggaggccgaggcgggcggatcaccaggtcaagagatcgagaccatcctggccaacatggtgaaaccccgtctctactaaaaatacaaaaattagctgggcgtggtggcacgggtctatagtcccagctactcaggaggctgagactgcac

SEQ ID NO: 42145 - DNA, 451 bp, Homo sapiens
ctggcttgctttgcagggcttccacaagaatgggctgggagcgtaactgagtaactgagtcatgattaggggttaattaagaggagaaatgggctagctgtttcctaagataagggaggggaagtttttttaaaaactgtaactgctcagaacagtatgtgctaaggcagactttctgtgctgggagacagaacacttctgcagtgatgtagcagaatccttaaaggatcctgccaatgactctttttttctggtgtcacatccaatctttgctgcagccaacacttcctggagatgaaacacaacttcaatacagagatagcaagttcacactctggcagtcatgcaaggatgagtgatgcgggccttttctaagtgagtatgaacgggtgggacctacggtaaattcaatgcagtataatccgtctacggggcagtgggcacccagcaa

SEQ ID NO: 42146 - DNA, 426 bp, Homo sapiens
aacaaccacacttttcatagcattgcaacatctctgtcttttcttacgccctgaatcatctcaaatcatcgcgagtggatattgatgcttctacttcccttgtttatagaaaaatcccaggcaaatgggttgatagaataaaggactggaaggattactggaaagccctcaattataggtatgggattgaaaggctgtgtagcccatggacacctaagaataagactaagtgtctttgagggtgtccgtgtatttccaacaatttttcctcttctgaaaactgcttccctgtccatccctcccaccctcttctagggcctgagggtgggctctcagtggccctgttgctatcctgtggccccaccctcttggccaacagtgattggacatcagatccgagctgagccaatcagcttcactaacttc

SEQ ID NO: 42147 - DNA, 490 bp, Homo sapiens
gatgaggggtgcacctggctacacctcactcccttgtccagaagaggagaaagtaccagtgtcagctgcatgtccaccaggcacgctccgagcacgttgcaaggcatccacggtgagggccactcctaagtgggccctcttctgtctggtgagctgctctgttccagtgtctgcaacagtgccaggcacttggtaggtgctcaataaatgctcatggaccacatgaatcacctcatgtgatattcacaaccacccatgggttaagtacaatcaccatccgcattacagtagagggtactgaggctcagagagcgagggccatcacgctgggattttaatctaggcagtggcttctgattcttctctaaccactgcgcggcattcgacaggagggagagcggaaggagggtaccagcgcaaggcggctgtaggagtgtggattcgcttcccatggctgccacagcaaatgaccacagactgattgtggctt

SEQ ID NO: 42148 - DNA, 553 bp, Homo sapiens
tgcaaacacatcgtctttgtgcagctgcaggaaggggagcacgtcttccagcccagggagccggaccccagcatctgtgtggtgcaggacgggcggctggaggtctgcatccaggacactgacggcaccgaggtggtggtgaaagaggttctggcgggagacagcgtccacagcctgctcagcatcctggacatcatcaccggccatgctgcaccttacaaaacggtctccgtccgcgcggccatcccgtccaccatcctccggcttccagctgcggcttttcatggagtttttgagaaatatccggaaactctggtgagggtggtgcagatcatcatggtgcggctgcagagggtgacctttctggctctgcacaactacctcggcctgaccacagagctcttcaacgctgagagccaggccatccctctcgtgtctgtagccagtgtggctgccgggaaggccaagaagcaggtgttctatggcgaagaagagcggcttaaaaagccaccgcggctccaggagtcctgtgactcaggtactgtcctgcacc

SEQ ID NO: 42149 - DNA, 448 bp, Homo sapiens
agatctataatgggaaaatgctccaggctcagaagagttcatgcttagttctatcttttaaagaaagagtaataccagtgttatttattatatggatgtaatacaatccatgaactgtactcatttattttattaagtcagaataaattttaacaccaaaatcaaatacagatagttgaaaaaagaaaacttctgctgggtgcggtggctcacgcctgtaatcccaacactttgggaggccgaggcaggtggatcatgaggtcagaagttcgagatggtgaaaccccatctctactaaaaatacaaaaattagccgggtgtggtggcacacacctgtagtcccagctacttgggaggttgaggcatgaggcaggagaattgcttgtacccaggaggtagaggttgcggtgagccaagatcgtgccatccagcctgggtgacaagagcg

SEQ ID NO: 42150 - DNA, 411 bp, Homo sapiens
acattttagcaaactaaagcagaacaaagatgagttttattgcatttatttctactacgtgatttaacacatcactttttgcacacatggtgctttttatttcaacactatttaaaatgtattaatcatcagtcatcacaggagccactgaaaagctaattttatatggaattttaacaacaagataaaaacatgtgcataatgaactatcaagtcccaggcacaaacatggtttcacttagcccttataaaaattctgggaggggttgttattctctccatttcacagatgagaaactggagcacagagaggttgatttatctctgcaaaaaagctcagggccaatgttgtgggtccaacaatcattctggaagacaaacgttgttcgtgttaccttccaagctaagaga

SEQ ID NO: 42151 - DNA, 479 bp, Homo sapiens
aagaaaatcagtttcagattactagtaattatttaggtactaattaaaaaataatgaatctcagttactaaatacacaaataagggagttatatgaaactgtgcaatagtcattctatggatagtcatatttaaaataaaatgaaaagagactaaaatatgcatttgtgcttttaactctgaaaacctgaatacctattcaactgttgattctgagtatttacagaactttatttcttctttggacatgctttggcagtttttacctaatgtatacacatttttgccttgttcttaataattaaaaatctgagaaaaagatattcaaaaagtggttttttgtgcgtactcatgataaacagtaatataaaaagttacagaggtcgggcccagtggctcacgcctgtaatcccagcactttgggaggccaaggtgggtggatcacttgaagtcaggagttttagaccagcctggccaaca

SEQ ID NO: 42152 - DNA, 3161 bp, Homo sapiens
cacccatcacccgagcagtgtacactgtacccaatgtgcagtcttttatccctcgcccacttcccacccttccccctgagtccccaaagtccactgtatcattcttatgccttcgcatgctcatagctgagctcccacttatatgtgagaatatacatttggtttttcatccctgagttacttcacttagaataatgaaatccccatacacctaggttcagggctcctccccaggaaacttctgaggtttggggagtcccaggagagaagttaggaaactctggcctccatcccctccctgtagcagccaaagttcttagggatttagaggcgattttcttttgtcctttctaagaattgacatcattggtctcatctagacttgcttcaagccctactgatgaacctttgacagagtcttccccccagtctgactcttctccatttttccagaaaagggattagataggaaagtcacatacccagggcctgcagcctgtgacttcagaactggaagtctaaaccctacagccccttcttcttctgagccacctactattgttgcagaattgtgtgactgagtcttgtctccttaaaacgaccgtaaactcttgagtgcaaggattgtattagtcagagtaaagctatgctgctataaaaaatagtccctacatgcaaaggttcaatacagtagatgtttatttcctgcttacaaggcagtcttcagcatgtgtatgtccatgtggtcattcagggatccaggctccttgtgttttctggctccacctcaccctagttcctaatcatcatccatatccacctgatggaatagaaaatagcgtgaggtgtgttcccaggaggctttgcatgggttagacctggaaggcaaacacatcacgtctgcttatgttccatctggaaaaacatttgagttgccacagcaaattgctagtgagaatgagagatggagttccctgtgtctccaagaagggtatgactttggcagagcagctcttctgttccctgacttctctttctcctgccagaacccagcaccgagagggaccatcagaggatgttccatgagaacttggtgagggttgtggagaggttggctggtgcttctccgtcttcatacagatgtccagacaggggaccagaagtctcaggtctgagctctacctggaagcccctcacgtctgtagccatcaaacctccagataagacgagccctgaagcattttggttgcatcagaaaacagatggaaggccagtcttcacagatgcatatacttcatcctggcttccacccacagaggttgcatctgtgcagaaattcatcccagagcaccaggcaggtgggtgtcaactcctgctgagatttcgctgtatcaggaaactcatgcatctggtgcagatgtcccggagtggctctgacagtccagggctgggcagtggagacactgatgacagccttgagcagagtggttttagtagaaatggcagagacaaaagccaggctagaggagtttaaggaaggaacagaggtaagtaagctagaaatgaacttttccagtcacttggaaaaaataagaccaaagatgattatgcatatcacaactgatacacacatagcccagggccaggttccctcctctctggaacccctgattcctgctggtgctgttttatctccccaggtagccactgtgtctttatctccctccagagaagcaacgcgctccagactctgatgcactggaggcaggagacagctgcaggtggtggtgtgctctggaagagtagaaacagagacccctcatagataccctgtcttcagaatagacctaggctcttcaccccaccacccctgccaccacccccacccaagccactgcagtgtcttgcccagacaaggggcatagccaactaactgatccctcagatcttgccctggtccccctaagataactctttatatggcagctttctccatcttagcactttgggaggccgagacaggtggactgcctgagctcaggagttcaagaccagcctgggcaacatggtgaagtccagtctgtattaaaactataaaaaattagctgggcatggtggcgcacacctctaatcccaactactgtggaggctgaggcatgagaatcacttgaacctgggaggcagaggatgcagtgagccgagatggtgccacttcactccagcctggacaacagagcaagactctgtctaaaacaacaacaacaaaaaaaaaaaaaaaaaacaaacaaaagaaggaagaaagaaagaagggagggaaggagggaaagaaaaaggaaggaaagaaagagaaagagaaaacactataacagagatgatgaaggcatttgatgggaccatcagtagactggacatagatgaggaaaaaatcagcctgaaggtatgttaatagaaccttcccaaactgtaatgcaaagaaaaaaatggggaaaaaaacagattatacaagaactgtgggatattttcaaaaggtatatgcacaattgaaacaccacaaggagaagaaagggagaacagagcagaaaaatcgtgaaagttataatggctcccaattttccaaaagtaaaggcagaccccaagccacggatccagtaagcttagagaacaccaaataggatacatacttaaaaaaaaaatcaacacctacatatatcatattcaaactgtagaaaaccaaagacaaacacaaaatcttgaaagaagccatagaaaaaaacccagcttacttatacaggaaacgaataagaattacagccttcttgtcagaacacgcaagcaagaagagaaaagggtgaaatatgtaaagtgttgaaagagaaaactggctgggcaagtggctcatgcctgtaatcccagcactttggaaggccgaggtgggtggatcacgaggtcaggatttcaagaccatcctggctaacacggtgaaaccccgtctctactaaaaatacaaaaaaattagccaggcgtggtggcagacgcctgtagtcccagctactcgggaggctgaggcaggagaatggcctgaacccgggaggtggagcttgcagtgagccgagatcgcgccattgcactccagtttgggcgacagagcaagactctgcctc

SEQ ID NO: 42153 - DNA, 2198 bp, Homo sapiens
aggccttccttttccttgtttcccccctgaacctttcctcctttttcctcccttggcccaaggaaacccccaagccacccgaaggaggggaccaattcaagaaggaattgttccattggaagaacctttggtgagggttgtggagaggttggctggtgcttctccgtcttcatacagatgtccagacaggggaccagaagtctcaggtctgagctctacctggaagcccctcacgtctgtagccatcaaacctccagataagacgagccctgaagcattttggttgcatcagaaaacagatggaaggccagtcttcacagatgcatatacttcatcctggcttccacccacagaggttgcatctgtgcagaaattcatcccagagcaccaggcaggtgggtgtcaactcctgctgagatttcgctgtatcaggaaactcatgcatctggtgcagatgtcccggagtggctctgacagtccagggctgggcagtggagacactgatgacagccttgagcagagtggttttagtagaaatggcagagacaaaagccaggctagaggagtttaaggaaggaacagaggtaagtaagctagaaatgaacttttccagtcacttggaaaaaataagaccaaagatgattatgcatatcacaactgatacacacatagcccagggccaggttccctcctctctggaacccctgattcctgctggtgctgttttatctccccaggtagccactgtgtctttatctccctccagagaagcaacgcgctccagactctgatgcactggaggcaggagacagctgcaggtggtggtgtgctctggaagagtagaaacagagacccctcatagataccctgtcttcagaatagacctaggctcttcaccccaccacccctgccaccacccccacccaagccactgcagtgtcttgcccagacaaggggcatagccaactaactgatccctcagatcttgccctggtccccctaagataactctttatatggcagctttctccatcttagcactttgggaggccgagacaggtggactgcctgagctcaggagttcaagaccagcctgggcaacatggtgaagtccagtctgtattaaaactataaaaaattagctgggcatggtggcgcacacctctaatcccaactactgtggaggctgaggcatgagaatcacttgaacctgggaggcagaggatgcagtgagccgagatggtgccacttcactccagcctggacaacagagcaagactctgtctaaaacaacaacaacaaaaaaaaaaaaaaaaaacaaacaaaagaaggaagaaagaaagaagggagggaaggagggaaagaaaaaggaaggaaagaaagagaaagagaaaacactataacagagatgatgaaggcatttgatgggaccatcagtagactggacatagatgaggaaaaaatcagcctgaaggtatgttaatagaaccttcccaaactgtaatgcaaagaaaaaaatggggaaaaaaacagattatacaagaactgtgggatattttcaaaaggtatatgcacaattgaaacaccacaaggagaagaaagggagaacagagcagaaaaatcgtgaaagttataatggctcccaattttccaaaagtaaaggcagaccccaagccacggatccagtaagcttagagaacaccaaataggatacatacttaaaaaaaaaatcaacacctacatatatcatattcaaactgtagaaaaccaaagacaaacacaaaatcttgaaagaagccatagaaaaaaacccagcttacttatacaggaaacgaataagaattacagccttcttgtcagaacacgcaagcaagaagagaaaagggtgaaatatgtaaagtgttgaaagagaaaactggctgggcaagtggctcatgcctgtaatcccagcactttggaaggccgaggtgggtggatcacgaggtcaggatttcaagaccatcctggctaacacggtgaaaccccgtctctactaaaaatacaaaaaaattagccaggcgtggtggcagacgcctgtagtcccagctactcgggaggctgaggcaggagaatggcctgaacccgggaggtggagcttgcagtgagccgagatcgcgccattgcactccagtttgggcgacagagcaagactctgcctc

SEQ ID NO: 42154 - DNA, 1619 bp, Homo sapiens
agcagggctcccgcgggcgtcactccggccatcgtccccacctccacctgggccgcccggcaggcaggcgacggaggcccgggagccatgggtgactggggcttcctggagaagttgctggaccaggtccaggagcactcgaccgtggtgggtaagatctggctgacggtgctcttcatcttccgcatcctcatcctgggcctggccggcgagtcagtgtggggtgacgagcagtcagatttcgagtgtaacacggcccagccaggctgcaccaacgtctgctatgaccaggccttccccatctcccacatccgctactgggtgctgcagttcctcttcgtcagcacacccaccctggtctacctgggccatgtcatttacctgtctcggcgagaagagcggctgcggcagaaggagggggagctgcgggcactgccggccaaggacccacaggtggagcgggcgctggcggccgtagagcgtcagatggccaagatctcggtggcagaagatggtcgcctgcgcatccgcggagcactgatgggcacctatgtcgccagtgtgctctgcaagagtgtgctagaggcaggcttcctctatggccagtggcgcctgtacggctggaccatggagcccgtgtttgtgtgccagcgagcaccctgcccctacctcgtggactgctttgtctctcgccccacggagaagaccatcttcatcatcttcatgttggtggttggactcatctccctggtgcttaacctgctggagttggtgcacctgctgtgtcgctgcctcagccgggggatgagggcacggcaaggccaagacgcacccccgacccagggcacctcctcagacccttacacggaccaggtcttcttctacctccccgtgggccaggggccctcatccccaccatgccccacctacaatgggctctcatccagtgagcagaactgggccaacctgaccacagaggagaggctggcgtcttccaggccccctctcttcctggacccaccccctcagaatggccaaaaacccccaagtcgtcccagcagctctgcttctaagaagcagtatgtatagaggcctgtggcttatgtcacccaacagaggggtcctgagaagtctggctgcctgggatgccccctgccccctcctggaaggctctgcagagatgactgggctggggaagcagatgcttgctggccatggagcctcattgcaagttgttcttgaacacctgaggccttcctggtgcccaccaggcactacggcttcctctccagaatgtggctttgcctgagcacagacagagtcagcatggaatgctcttggccaagggtactgggggccctctggccttttgcagctgatccagaggaacccagagccaacttaccccaacctcaccctatggaacagtcacctgtgcgcaggttgtcctcaaaccctctcctcacaggaaaaggcggattgaggctgctgggtcagccttgatcgcacagacagagcttgtgccggatttggccctgtcaaggggactggtgccttgttttcatcactccttcctagttctactgttcaagcttctgaaataaacaggacttgatcac

SEQ ID NO: 42155 - DNA, 1798 bp, Homo sapiens
agcagggctcccgcgggcgtcactccggccatcgtccccacctccacctgggccgcccggcaggcaggcgacggaggcccgggagccatgggtgactggggcttcctggagaagttgctggaccaggtccaggagcactcgaccgtggtgggtaagatctggctgacggtgctcttcatcttccgcatcctcatcctgggcctggccggcgagtcagtgtggggtgacgagcagtcagatttcgagtgtaacacggcccagccaggctgcaccaacgtctgctatgaccaggccttccccatctcccacatccgctactgggtgctgcagttcctcttcgtcagcacacccaccctggtctacctgggccatgtcatttacctgtctcggcgagaagagcggctgcggcagaaggagggggagctgcgggcactgccggccaaggacccacaggtggagcgggcgctggcggccgtagagcgtcagatggccaagatctcggtggcagaagatggtcgcctgcgcatccgcggagcactgatgggcacctatgtcgccagtgtgctctgcaagagtgtgctagaggcaggcttcctctatggccagtggcgcctgtacggctggaccatggagcccgtgtttgtgtgccagcgagcaccctgcccctacctcgtggactgctttgtctctcgccccacggagaagaccatcttcatcatcttcatgttggtggttggactcatctccctggtgcttaacctgctggagttggtgcacctgctgtgtcgctgcctcagccgggggatgagggcacggcaaggccaagacgcacccccgacccagggcacctcctcagacccttacacggaccaggtcttcttctacctccccgtgggccaggggccctcatccccaccatgccccacctacaatgggctctcatccagtgagcagaactgggccaacctgaccacagaggagaggctggcgtcttccaggccccctctcttcctggacccaccccctcagaatggccaaaaacccccaagtcgtcccagcagctctgcttctaagaagcagtatgtatagaggcctgtggcttatgtcacccaacagaggggtcctgagaagtctggctgcctgggatgccccctgccccctcctggaaggctctgcagagatgactgggctggggaagcagatgcttgctggccatggagcctcattgcaagttgttcttgaacacctgaggccttcctggtgcccaccaggcactacggcttcctctccagaatgtggctttgcctgagcacagacagagtcagcatggaatgctcttggccaagggtactgggggccctctggccttttgcagctgatccagaggaacccagagccaacttaccccaacctcaccctatggaacagtcacctgtgcgcaggttgtcctcaaaccctctcctcacaggaaaaggcggattgaggctgctgggtcagccttgatcgcacagacagagcttgtgccggatttggccctgtcaaggggactggtgccttgttttcatcactccttcctagttctactgttcaagcttctgaaataaacaggacttgatcacaagtaggtgtgtattgatgctatcatgatgtgctgggggttgggggatagagttattttgcccaggcttcctttacttcttggtcctgtataatctctttggtctctataacccccgattccagccaacaccttgaaccctcaaactcataccttctgcctccaacagccctgatttct

SEQ ID NO: 42156 - DNA, 1714 bp, Homo sapiens
agcagggctcccgcgggcgtcactccggccatcgtccccacctccacctgggccgcccggcaggcaggcggtagaacgggcgtggcagacctccctgcaggcttgttgctgggcgaacgagaaggatgccatgctgacacactgacgtgctctgtctccttgcagacggaggcccgggagccatgggtgactggggcttcctggagaagttgctggaccaggtccaggagcactcgaccgtggtgggtaagatctggctgacggtgctcttcatcttccgcatcctcatcctgggcctggccggcgagtcagtgtggggtgacgagcagtcagatttcgagtgtaacacggcccagccaggctgcaccaacgtctgctatgaccaggccttccccatctcccacatccgctactgggtgctgcagttcctcttcgtcagcacacccaccctggtctacctgggccatgtcatttacctgtctcggcgagaagagcggctgcggcagaaggagggggagctgcgggcactgccggccaaggacccacaggtggagcgggcgctggcggccgtagagcgtcagatggccaagatctcggtggcagaagatggtcgcctgcgcatccgcggagcactgatgggcacctatgtcgccagtgtgctctgcaagagtgtgctagaggcaggcttcctctatggccagtggcgcctgtacggctggaccatggagcccgtgtttgtgtgccagcgagcaccctgcccctacctcgtggactgctttgtctctcgccccacggagaagaccatcttcatcatcttcatgttggtggttggactcatctccctggtgcttaacctgctggagttggtgcacctgctgtgtcgctgcctcagccgggggatgagggcacggcaaggccaagacgcacccccgacccagggcacctcctcagacccttacacggaccaggtcttcttctacctccccgtgggccaggggccctcatccccaccatgccccacctacaatgggctctcatccagtgagcagaactgggccaacctgaccacagaggagaggctggcgtcttccaggccccctctcttcctggacccaccccctcagaatggccaaaaacccccaagtcgtcccagcagctctgcttctaagaagcagtatgtatagaggcctgtggcttatgtcacccaacagaggggtcctgagaagtctggctgcctgggatgccccctgccccctcctggaaggctctgcagagatgactgggctggggaagcagatgcttgctggccatggagcctcattgcaagttgttcttgaacacctgaggccttcctggtgcccaccaggcactacggcttcctctccagaatgtggctttgcctgagcacagacagagtcagcatggaatgctcttggccaagggtactgggggccctctggccttttgcagctgatccagaggaacccagagccaacttaccccaacctcaccctatggaacagtcacctgtgcgcaggttgtcctcaaaccctctcctcacaggaaaaggcggattgaggctgctgggtcagccttgatcgcacagacagagcttgtgccggatttggccctgtcaaggggactggtgccttgttttcatcactccttcctagttctactgttcaagcttctgaaataaacaggacttgatcac

SEQ ID NO: 42157 - DNA, 1020 bp, Homo sapiens
taatattataattaagtaatctaaggaccattgcactccagcctgggcaacaagagcgaaactcccctacctcgtggactgctttgtctctcgccccacggagaagaccatcttcatcatcttcatgttggtggttggactcatctccctggtgcttaacctgctggagttggtgcacctgctgtgtcgctgcctcagccgggggatgagggcacggcaaggccaagacgcacccccgacccagggcacctcctcagacccttacacggaccaggtcttcttctacctccccgtgggccaggggccctcatccccaccatgccccacctacaatgggctctcatccagtgagcagaactgggccaacctgaccacagaggagaggctggcgtcttccaggccccctctcttcctggacccaccccctcagaatggccaaaaacccccaagtcgtcccagcagctctgcttctaagaagcagtatgtatagaggcctgtggcttatgtcacccaacagaggggtcctgagaagtctggctgcctgggatgccccctgccccctcctggaaggctctgcagagatgactgggctggggaagcagatgcttgctggccatggagcctcattgcaagttgttcttgaacacctgaggccttcctggtgcccaccaggcactacggcttcctctccagaatgtggctttgcctgagcacagacagagtcagcatggaatgctcttggccaagggtactgggggccctctggccttttgcagctgatccagaggaacccagagccaacttaccccaacctcaccctatggaacagtcacctgtgcgcaggttgtcctcaaaccctctcctcacaggaaaaggcggattgaggctgctgggtcagccttgatcgcacagacagagcttgtgccggatttggccctgtcaaggggactggtgccttgttttcatcactccttcctagttctactgttcaagcttctgaaataaacaggacttgatcac

SEQ ID NO: 42158 - DNA, 247 bp, Homo sapiens
ctagaatagaatgttgttcatcatctatttggaaggaggcaggaagcctttacctccagctttgggggattcttattatcatcctatccacttttcctacttgtaaaagtttctttctgcagatctccaaagggcgagagtggtaactcaatctctcactcctttagatctttttgttcaactcaagaaatagttctgaatgccagtattaggcttcttcaatgaggggagcaggccagtgactcac

SEQ ID NO: 42159 - DNA, 445 bp, Homo sapiens
ttttttttaagaagtcttgctctgtcgcccaggctggagtacaatggctcgatctcggctcactgcaacctccaccttctgggttcaagcaatcctcctgtctcagcctcctgagtagctgggattacaggcacgtgccaccaggcttggctaatttttttttttgtgtgtgtgtatttttagtaaagatgaggtttcaccatgttggccaagctggtcttgaactcctgaccttgtgaaatgcctgcctcagcctcccaaagtgctgcgattacaggcatgagccactgtgcccagcctcaaagattcttatgagtcctcacagatgtcagaggaagataccatgacctatacttgcaaactcccagaagacttaaagctattgttttgcaaatggtgtgtgtatttttagtaaagatgaggtttcaccatgttggccaagctg

SEQ ID NO: 42160 - DNA, 6757 bp, Homo sapiens
gtcatttaaaagtgtgtggtggctgcggcggcggctgcgcgcgtggggcccggggcgcggggcgaggccgtggggacgtgcgagcggggccgcggtggggctcgggggcgcgtccacgtggccagagggcggccacccggagccagcggagggacaggcctgtccccaggcgcggctgccggccatgccctctgtctgcctcctcctgctgctcttccttgccgtggggggggccctgggcaacaggcccttccgtgccttcgtggtgacagacaccacgcttacccacctggctgtgcaccgggtgactggggaggtgttcgtgggcgcagtgaaccgagtctttaagctggcccccaacctgactgagctgcgggcccatgtcacggggcccgtcgaggacaacgctcgctgctacccgccccccagcatgcgcgtgtgtgcccaccgcctggcccccgtggacaacatcaacaagctgctgctcatagactatgcggcccgccgcctggtggcctgcggcagcatctggcagggcatctgccagttcctgcgtctggacgacctcttcaagctgggtgagccgcaccaccgcaaggagcactacctgtcgggggcccaggagcccgactccatggctggtgtcattgtggagcagggccaggggcccagcaagctgtttgtgggcactgctgtcgacggcaagtcggagtacttccccaccttgagctcccgcaagctcatcagtgatgaagacagcgcggacatgttcagtctcgtgtaccaggatgagtttgtgtcctcccagatcaagatcccctcagacacgctgtccttgtaccctgcccttgacatctactacatctacggcttcgtcagcgcctccttcgtgtacttcctgacgctgcagctggacacccagcagacgctgttggacacagcgggcgagaaatttttcacgtccaagatcgtgcgcatgtgcgcgggagactcagagttctactcatacgtggaattccccatcggctgctcctggcgcggcgtggagtaccgcttggtgcagagcgcccacctggccaagcctggcctgctgctggcccaggccctgggcgtgccggctgatgaggacgtcctcttcaccatcttctctcagggccagaagaaccgggccagcccaccccggcagaccatcctctgcctcttcaccctcagcaacatcaatgcccacatccggcgccgcatccagtcctgctatcgtggggagggcactctggctctgccctggctgctgaacaaggagctgccctgcatcaacacccccatgcagatcaacggcaacttctgtgggctggtgttgaaccagcctctgggaggcctgcatgtgatcgaggggctgcccctgctggccgacagcaccgacggcatggccagcgtggccgcctacacctaccgccagcactctgtggtcttcattggcacgcgcagcggcagcttgaagaaggtgcgggtcgatggcttccaggatgcccacctgtatgagacagtccccgtggtggatggcagccccatcctccgagacctgctcttcagcccggaccaccggcacatctatctcctgagtgagaagcaggtgagccagctcccggtggagacctgtgagcagtaccagagctgcgcagcctgcctgggctccggggacccgcactgtggttggtgtgtgctgcgacacaggtgctgccgcgaaggggcctgtctgggcgcctctgccccacacggctttgctgaggagctgagcaagtgtgtccaggtgcgggtccggcccaacaatgtgtcagtgacgtcacctggggtgcagctgaccgtcaccctgcacaacgtgccagacctcagtgcgggcgtgagctgcgccttcgaggcggcggcggagaacgaggcggtcctgctgccctccggtgaactgctctgcccctcaccctccctccaggagctccgagctcttaccagggggcatggggccacccgcactgtgcggctgcagcttctctccaaggagacaggcgtgaggtttgccggtgctgactttgtcttctacaactgcagcgtcctccagtcgtgcatgtcctgtgttggcagcccttacccctgccactggtgtaagtaccgccacacgtgtaccagccgcccccacgagtgctccttccaggagggcagggtccacagccctgagggctgccctgagatcctgcccagtggggacctcctgatccccgttggggtcatgcagcctcttaccttgcgggctaagaacctacctcagccgcagtcgggccagaagaactatgagtgcgtggtgcgggtgcaggggcggcagcagcgggtgcctgccgtgcgcttcaacagcagcagtgtgcagtgccagaacgcctcgtactcctatgaaggtgatgagcatggtgacaccgagctggacttctccgtggtctgggatggagacttccccatagacaagcctcccagcttccgagccctcctgtacaagtgctgggcgcagcggcccagctgtggcctctgcctcaaggctgatccccgcttcaactgtggctggtgcatctcagagcacaggtgccagctgcggacccactgcccggccccgaagaccaactggatgcacctgagccagaagggcacccggtgcagccacccccgcatcacgcagatccaccctctcgtggggcccaaggaaggaggcacccgggtcaccatcgtgggtgagaacctgggcctcttgtcccgagaggtgggcctgcgggtggctggcgtgcgttgcaactccattccggccgagtacatcagtgctgagaggatcgtgtgtgagatggaggagtcgctggtgcccagcccgccgccggggcccgtggagctgtgtgtgggtgactgttcagccgacttccgcacgcagtcggagcaggtctacagctttgtgaccccaacgtttgaccaagtgagtcccagccgtggcccggcgtccgggggcacacggcttaccatctcaggcagctctctggatgctggcagcagggtcacagtgactgtgagggacagcgagtgccagtttgtaaggagagatgccaaggcgatcgtgtgcatctcacctctctccaccctgggccccagccaggcccccatcacacttgccattgaccgggctaacatctccagccccgggctcatctacacctacactcaggaccccaccgtcacccgccttgagcccacctggagcatcatcaatggaagcactgccatcactgtgagtgggacccacctgctgacggtccaggagccccgggtccgtgccaagtaccgcggcattgagaccaccaatacatgccaagtgatcaacgacactgccatgctgtgtaaggcccccggcatctttcttgggcggccccagcctcgggcgcaaggcgagcaccctgatgagtttggcttcctgctggaccacgtgcaaacggcccgctccctcaaccgctcctcctttacctactaccctgatcccagctttgagccgctggggccctctggcgtgctggacgtcaaaccgggctcccacgtggtgctgaagggcaagaacctgattcccgcggcagccggcagctcccgcctcaactacactgtgctgataggaggccagccgtgttcgctcactgtctcggacacacaactcctgtgcgactcacccagccagactggccggcagcctgtcatggtgctggtgggtggcctggagttctggctgggcaccctgcacatctcggcagagcgggcgctgaccctaccggccatgatggggctggcggcggggggtgggctcctgctgctggccatcacagccgtgctggtggcgtacaagcgcaagactcaggacgcggaccgtaccctcaagcgtctgcagctgcagatggacaacctggagtcccgtgtggccctggagtgcaaggaagcttttgcagagctgcagacggacatcaatgagctgactaaccacatggacgaggtgcagatccccttcctggactaccggacttacgccgtgcgcgtgctcttcccgggcatcgaggcccacccggtgctcaaggagctggatacgccacccaacgtggagaaggccctgcgcctcttcgggcagctgctgcacagccgcgcgttcgtgcttaccttcatccacacgctggaggcccagagcagcttctccatgcgcgaccgcggcaccgtggcctcgctcaccatggtggccctgcagagccggctcgactatgccacggggctgctcaagcaactgctggccgacctcatcgagaagaacctcgagagcaagaaccaccccaagctgctgctacgcaggacagagtcagtggctgagaagatgcttaccaactggttcacgttcctgctgcataagtttctgaaggagtgtgctggggagcctctcttcctgctttactgtgccatcaagcagcagatggagaagggccccattgatgccatcacgggcgaggcacgatactccctgagcgaggacaagctcatccgtcagcagatcgactacaagacactgacccttcactgcgtgtgtccggagaacgagggcagcgcccaggtcccagtgaaggttctcaactgtgacagcatcacccaggccaaagataagctgctggacactgtgtacaagggcattccgtactcccagcgtcccaaagctgaggacatggacctggagtggcgccagggccgcatgactcgcatcatcctccaggatgaggatgtcaccaccaagatcgagtgtgactggaagaggctcaactcactggcccactaccaggtgacagacggttccttggtggcattggtgcccaaacaagtgtctgcctataacatggccaactccttcaccttcacccgctccctcagccgctacgagagcttgctccgcacggccagcagccctgatagcctccgctcacgggcacccatgattacgcctgaccaggagacaggcaccaaattgtggcacctggtgaaaaaccacgaccatgccgaccatcgcgagggggaccgtggcagcaagatggtctccgagatctacctgacacggctgctggccaccaagggcacactgcagaagttcgtggatgacctctttgagacagtgttcagcacagcccaccggggctcggccctgcccctggccatcaagtacatgttcgacttcctggatgagcaggcggaccagcgccagatcagcgaccccgatgtgcgccacacctggaagagcaactgcctgccgctgcgcttctgggtgaatgtgatcaagaacccgcagttcgtgttcgacatccacaagaacagcatcacggatgcctgcctgtcggtggtagcccagaccttcatggactcctgctctacatccgagcaccgcctggggaaggactcgccctccaacaaactgctctacgccaaggacatccccaactacaagagctgggtggagaggtattatcgagacattgcaaagatggcatccatcagcgaccaggacatggatgcctacctggtggagcagtcccgcctccacgccagcgacttcagcgtcctgagtgcgctcaacgagctgtatttctatgtcaccaagtaccgccaggagattctcacggctctggaccgagatgcctcttgtcggaagcataagttgcggcagaaactggaacagatcatcagcctcgtgtccagcgacagctaaggtggtggaatcggtgaggagggggcttctcagtcctgtgccgtcctcccatccaggggagtggctggctcaagcctgggtccccgggctgagccctggattgggtatcgtggggcaggtcaccctggccacgatgcccccggcacacccaggcccccttcattagtgccttgctttgggccctgcagggggaggggtgacagggcgagcccccaccccagcagcagcaatacccccaccctcctgccctgtgcccaggtgttgggacagtcccaccctccctgctatttatatccctctgcctatttattgaatcgaacttcgcctctgtctccatctgtaaatatgtgtccccccaccggatgtcgccaccctcactcacctgcctcttcttgagctgtcctgggccctgccacccgtctgggctcctttgtgtagcattatcagcctcggtctggcctctggcacctcacccttgccatggctgaccccacccattccaaggcggggtcacggtaccagcagcacttggggtgaggcctccaaagcttcctcagaattgtggctgtgccacgctggaccacagggtccccctcaagcatctcggggccctattctctctgagcacctggagggctggactcaggcttgtgccagggcctgacttgggcctgggggccctagaacactcctcctcctgagcctactgccaaacgtcctcagtgttgtctgcacctgctccgactccttcagccgccccattcagcgcccgctccgtccagtgcccgccctgtggggccaaggcggccgtgccttactactctgtgtcttctgcctcctctgaggaatctggccctgtctgacagtcccagaccccccgttctctcctctttagttgcatgagtttttctttgttcatggaatgttttttcctgattaaatgttggggaaatgcca

SEQ ID NO: 42161 - DNA, 5894 bp, Homo sapiens
cccagtgccccgcttctgcttccttccgttcccagctcgttcctccttgctccgtctcccggttgccccttgtcttgagccaacaagagtcttgtgggcccaggcttcgctcctcgctccctgctgtccctcctctgtctccctccgcagccaccaatttcctggagcaccctagggcgagcagtcagtcctggctggaggggaccgggttctagatcccgctctcttctgggacacaggaactgccggcctccatcttgcgcctgggagctttgactctcacgggttcctcctctgtttcaccagcccatgcagatcaacggcaacttctgtgggctggtgttgaaccagcctctgggaggcctgcatgtgatcgaggggctgcccctgctggccgacagcaccgacggcatggccagcgtggccgcctacacctaccgccagcactctgtggtcttcattggcacgcgcagcggcagcttgaagaaggtgcgggtcgatggcttccaggatgcccacctgtatgagacagtccccgtggtggatggcagccccatcctccgagacctgctcttcagcccggaccaccggcacatctatctcctgagtgagaagcaggtgagccagctcccggtggagacctgtgagcagtaccagagctgcgcagcctgcctgggctccggggacccgcactgtggttggtgtgtgctgcgacacaggtgctgccgcgaaggggcctgtctgggcgcctctgccccacacggctttgctgaggagctgagcaagtgtgtccaggtgcgggtccggcccaacaatgtgtcagtgacgtcacctggggtgcagctgaccgtcaccctgcacaacgtgccagacctcagtgcgggcgtgagctgcgccttcgaggcggcggcggagaacgaggcggtcctgctgccctccggtgaactgctctgcccctcaccctccctccaggagctccgagctcttaccagggggcatggggccacccgcactgtgcggctgcagcttctctccaaggagacaggcgtgaggtttgccggtgctgactttgtcttctacaactgcagcgtcctccagtcgtgcatgtcctgtgttggcagcccttacccctgccactggtgtaagtaccgccacacgtgtaccagccgcccccacgagtgctccttccaggagggcagggtccacagccctgaggtgaggcgggcgccgcatgtgaggggctgggctctgtggtgcgggcggggccaccggcttctatgcgttctcggtttctttgagccttctccaggttgggcctggagaagggtggccctgtgtgcagctgacaggtgctttccccgcagggctgccctgagatcctgcccagtggggacctcctgatccccgttggggtcatgcagcctcttaccttgcgggctaagaacctacctcagccgcagtcgggccagaagaactatgagtgcgtggtgcgggtgcaggggcggcagcagcgggtgcctgccgtgcgcttcaacagcagcagtgtgcagtgccagaacgcctcgtactcctatgaaggtgatgagcatggtgacaccgagctggacttctccgtggtctgggatggagacttccccatagacaagcctcccagcttccgagccctcctgtacaagtgctgggcgcagcggcccagctgtggcctctgcctcaaggctgatccccgcttcaactgtggctggtgcatctcagagcacaggtgccagctgcggacccactgcccggccccgaagaccaactggatgcacctgagccagaagggcacccggtgcagccacccccgcatcacgcagatccaccctctcgtggggcccaaggaaggaggcacccgggtcaccatcgtgggtgagaacctgggcctcttgtcccgagaggtgggcctgcgggtggctggcgtgcgttgcaactccattccggccgagtacatcagtgctgagaggatcgtgtgtgagatggaggagtcgctggtgcccagcccgccgccggggcccgtggagctgtgtgtgggtgactgttcagccgacttccgcacgcagtcggagcaggtctacagctttgtgaccccaacgtttgaccaagtgagtcccagccgtggcccggcgtccgggggcacacggcttaccatctcaggcagctctctggatgctggcagcagggtcacagtgactgtgagggacagcgagtgccagtttgtaaggagagatgccaaggcgatcgtgtgcatctcacctctctccaccctgggccccagccaggcccccatcacacttgccattgaccgggctaacatctccagccccgggctcatctacacctacactcaggaccccaccgtcacccgccttgagcccacctggagcatcatcaatggaagcactgccatcactgtgagtgggacccacctgctgacggtccaggagccccgggtccgtgccaagtaccgcggcattgagaccaccaatacatgccaagtgatcaacgacactgccatgctgtgtaaggcccccggcatctttcttgggcggccccagcctcgggcgcaaggcgagcaccctgatgagtttggcttcctgctggaccacgtgcaaacggcccgctccctcaaccgctcctcctttacctactaccctgatcccagctttgagccgctggggccctctggcgtgctggacgtcaaaccgggctcccacgtggtgctgaagggcaagaacctgattcccgcggcagccggcagctcccgcctcaactacactgtgctgataggaggccagccgtgttcgctcactgtctcggacacacaactcctgtgcgactcacccagccagactggccggcagcctgtcatggtgctggtgggtggcctggagttctggctgggcaccctgcacatctcggcagagcgggcgctgaccctaccggccatgatggggctggcggcggggggtgggctcctgctgctggccatcacagccgtgctggtggcgtacaagcgcaagactcaggacgcggaccgtaccctcaagcgtctgcagctgcagatggacaacctggagtcccgtgtggccctggagtgcaaggaagcttttgcagagctgcagacggacatcaatgagctgactaaccacatggacgaggtgcagatccccttcctggactaccggacttacgccgtgcgcgtgctcttcccgggcatcgaggcccacccggtgctcaaggagctggatacgccacccaacgtggagaaggccctgcgcctcttcgggcagctgctgcacagccgcgcgttcgtgcttaccttcatccacacgctggaggcccagagcagcttctccatgcgcgaccgcggcaccgtggcctcgctcaccatggtggccctgcagagccggctcgactatgccacggggctgctcaagcaactgctggccgacctcatcgagaagaacctcgagagcaagaaccaccccaagctgctgctacgcaggacagagtcagtggctgagaagatgcttaccaactggttcacgttcctgctgcataagtttctgaaggagtgtgctggggagcctctcttcctgctttactgtgccatcaagcagcagatggagaagggccccattgatgccatcacgggcgaggcacgatactccctgagcgaggacaagctcatccgtcagcagatcgactacaagacactgacccttcactgcgtgtgtccggagaacgagggcagcgcccaggtcccagtgaaggttctcaactgtgacagcatcacccaggccaaagataagctgctggacactgtgtacaagggcattccgtactcccagcgtcccaaagctgaggacatggacctggagtggcgccagggccgcatgactcgcatcatcctccaggatgaggatgtcaccaccaagatcgagtgtgactggaagaggctcaactcactggcccactaccaggtgacagacggttccttggtggcattggtgcccaaacaagtgtctgcctataacatggccaactccttcaccttcacccgctccctcagccgctacgagagcttgctccgcacggccagcagccctgatagcctccgctcacgggcacccatgattacgcctgaccaggagacaggcaccaaattgtggcacctggtgaaaaaccacgaccatgccgaccatcgcgagggggaccgtggcagcaagatggtctccgagatctacctgacacggctgctggccaccaagggcacactgcagaagttcgtggatgacctctttgagacagtgttcagcacagcccaccggggctcggccctgcccctggccatcaagtacatgttcgacttcctggatgagcaggcggaccagcgccagatcagcgaccccgatgtgcgccacacctggaagagcaactgcctgccgctgcgcttctgggtgaatgtgatcaagaacccgcagttcgtgttcgacatccacaagaacagcatcacggatgcctgcctgtcggtggtagcccagaccttcatggactcctgctctacatccgagcaccgcctggggaaggactcgccctccaacaaactgctctacgccaaggacatccccaactacaagagctgggtggagaggtattatcgagacattgcaaagatggcatccatcagcgaccaggacatggatgcctacctggtggagcagtcccgcctccacgccagcgacttcagcgtcctgagtgcgctcaacgagctgtatttctatgtcaccaagtaccgccaggagattctcacggctctggaccgagatgcctcttgtcggaagcataagttgcggcagaaactggaacagatcatcagcctcgtgtccagcgacagctaaggtggtggaatcggtgaggagggggcttctcagtcctgtgccgtcctcccatccaggggagtggctggctcaagcctgggtccccgggctgagccctggattgggtatcgtggggcaggtcaccctggccacgatgcccccggcacacccaggcccccttcattagtgccttgctttgggccctgcagggggaggggtgacagggcgagcccccaccccagcagcagcaatacccccaccctcctgccctgtgcccaggtgttgggacagtcccaccctccctgctatttatatccctctgcctatttattgaatcgaacttcgcctctgtctccatctgtaaatatgtgtccccccaccggatgtcgccaccctcactcacctgcctcttcttgagctgtcctgggccctgccacccgtctgggctcctttgtgtagcattatcagcctcggtctggcctctggcacctcacccttgccatggctgaccccacccattccaaggcggggtcacggtaccagcagcacttggggtgaggcctccaaagcttcctcagaattgtggctgtgccacgctggaccacagggtccccctcaagcatctcggggccctattctctctgagcacctggagggctggactcaggcttgtgccagggcctgacttgggcctgggggccctagaacactcctcctcctgagcctactgccaaacgtcctcagtgttgtctgcacctgctccgactccttcagccgccccattcagcgcccgctccgtccagtgcccgccctgtggggccaaggcggccgtgccttactactctgtgtcttctgcctcctctgaggaatctggccctgtctgacagtcccagaccccccgttctctcctctttagttgcatgagtttttctttgttcatggaatgttttttcctgattaaatgttggggaaatgcca

SEQ ID NO: 42162 - DNA, 4402 bp, Homo sapiens
cacccaggcgcacttctctcaaagccatactggtggggatttttgttgttttaacagggtcttgctctgtcacccaggctcccagaagtgcgcctgggtgcgcacccaggcgcacttctccgtggtctgggatggagacttccccatagacaagcctcccagcttccgagccctcctgtacaagtgctgggcgcagcggcccagctgtggcctctgcctcaaggctgatccccgcttcaactgtggctggtgcatctcagagcacaggtgccagctgcggacccactgcccggccccgaagaccaactggatgcacctgagccagaagggcacccggtgcagccacccccgcatcacgcagatccaccctctcgtggggcccaaggaaggaggcacccgggtcaccatcgtgggtgagaacctgggcctcttgtcccgagaggtgggcctgcgggtggctggcgtgcgttgcaactccattccggccgagtacatcagtgctgagaggatcgtgtgtgagatggaggagtcgctggtgcccagcccgccgccggggcccgtggagctgtgtgtgggtgactgttcagccgacttccgcacgcagtcggagcaggtctacagctttgtgaccccaacgtttgaccaagtgagtcccagccgtggcccggcgtccgggggcacacggcttaccatctcaggcagctctctggatgctggcagcagggtcacagtgactgtgagggacagcgagtgccagtttgtaaggagagatgccaaggcgatcgtgtgcatctcacctctctccaccctgggccccagccaggcccccatcacacttgccattgaccgggctaacatctccagccccgggctcatctacacctacactcaggaccccaccgtcacccgccttgagcccacctggagcatcatcaatggaagcactgccatcactgtgagtgggacccacctgctgacggtccaggagccccgggtccgtgccaagtaccgcggcattgagaccaccaatacatgccaagtgatcaacgacactgccatgctgtgtaaggcccccggcatctttcttgggcggccccagcctcgggcgcaaggcgagcaccctgatgagtttggcttcctgctggaccacgtgcaaacggcccgctccctcaaccgctcctcctttacctactaccctgatcccagctttgagccgctggggccctctggcgtgctggacgtcaaaccgggctcccacgtggtgctgaagggcaagaacctgattcccgcggcagccggcagctcccgcctcaactacactgtgctgataggaggccagccgtgttcgctcactgtctcggacacacaactcctgtgcgactcacccagccagactggccggcagcctgtcatggtgctggtgggtggcctggagttctggctgggcaccctgcacatctcggcagagcgggcgctgaccctaccggccatgatggggctggcggcggggggtgggctcctgctgctggccatcacagccgtgctggtggcgtacaagcgcaagactcaggacgcggaccgtaccctcaagcgtctgcagctgcagatggacaacctggagtcccgtgtggccctggagtgcaaggaagcttttgcagagctgcagacggacatcaatgagctgactaaccacatggacgaggtgcagatccccttcctggactaccggacttacgccgtgcgcgtgctcttcccgggcatcgaggcccacccggtgctcaaggagctggatacgccacccaacgtggagaaggccctgcgcctcttcgggcagctgctgcacagccgcgcgttcgtgcttaccttcatccacacgctggaggcccagagcagcttctccatgcgcgaccgcggcaccgtggcctcgctcaccatggtggccctgcagagccggctcgactatgccacggggctgctcaagcaactgctggccgacctcatcgagaagaacctcgagagcaagaaccaccccaagctgctgctacgcaggacagagtcagtggctgagaagatgcttaccaactggttcacgttcctgctgcataagtttctgaaggagtgtgctggggagcctctcttcctgctttactgtgccatcaagcagcagatggagaagggccccattgatgccatcacgggcgaggcacgatactccctgagcgaggacaagctcatccgtcagcagatcgactacaagacactgacccttcactgcgtgtgtccggagaacgagggcagcgcccaggtcccagtgaaggttctcaactgtgacagcatcacccaggccaaagataagctgctggacactgtgtacaagggcattccgtactcccagcgtcccaaagctgaggacatggacctggagtggcgccagggccgcatgactcgcatcatcctccaggatgaggatgtcaccaccaagatcgagtgtgactggaagaggctcaactcactggcccactaccaggtgacagacggttccttggtggcattggtgcccaaacaagtgtctgcctataacatggccaactccttcaccttcacccgctccctcagccgctacgagagcttgctccgcacggccagcagccctgatagcctccgctcacgggcacccatgattacgcctgaccaggagacaggcaccaaattgtggcacctggtgaaaaaccacgaccatgccgaccatcgcgagggggaccgtggcagcaagatggtctccgagatctacctgacacggctgctggccaccaagggcacactgcagaagttcgtggatgacctctttgagacagtgttcagcacagcccaccggggctcggccctgcccctggccatcaagtacatgttcgacttcctggatgagcaggcggaccagcgccagatcagcgaccccgatgtgcgccacacctggaagagcaactgcctgccgctgcgcttctgggtgaatgtgatcaagaacccgcagttcgtgttcgacatccacaagaacagcatcacggatgcctgcctgtcggtggtagcccagaccttcatggactcctgctctacatccgagcaccgcctggggaaggactcgccctccaacaaactgctctacgccaaggacatccccaactacaagagctgggtggagaggtattatcgagacattgcaaagatggcatccatcagcgaccaggacatggatgcctacctggtggagcagtcccgcctccacgccagcgacttcagcgtcctgagtgcgctcaacgagctgtatttctatgtcaccaagtaccgccaggagattctcacggctctggaccgagatgcctcttgtcggaagcataagttgcggcagaaactggaacagatcatcagcctcgtgtccagcgacagctaaggtggtggaatcggtgaggagggggcttctcagtcctgtgccgtcctcccatccaggggagtggctggctcaagcctgggtccccgggctgagccctggattgggtatcgtggggcaggtcaccctggccacgatgcccccggcacacccaggcccccttcattagtgccttgctttgggccctgcagggggaggggtgacagggcgagcccccaccccagcagcagcaatacccccaccctcctgccctgtgcccaggtgttgggacagtcccaccctccctgctatttatatccctctgcctatttattgaatcgaacttcgcctctgtctccatctgtaaatatgtgtccccccaccggatgtcgccaccctcactcacctgcctcttcttgagctgtcctgggccctgccacccgtctgggctcctttgtgtagcattatcagcctcggtctggcctctggcacctcacccttgccatggctgaccccacccattccaaggcggggtcacggtaccagcagcacttggggtgaggcctccaaagcttcctcagaattgtggctgtgccacgctggaccacagggtccccctcaagcatctcggggccctattctctctgagcacctggagggctggactcaggcttgtgccagggcctgacttgggcctgggggccctagaacactcctcctcctgagcctactgccaaacgtcctcagtgttgtctgcacctgctccgactccttcagccgccccattcagcgcccgctccgtccagtgcccgccctgtggggccaaggcggccgtgccttactactctgtgtcttctgcctcctctgaggaatctggccctgtctgacagtcccagaccccccgttctctcctctttagttgcatgagtttttctttgttcatggaatgttttttcctgattaaatgttggggaaatgcca

SEQ ID NO: 42163 - DNA, 3404 bp, Homo sapiens
cgggccagtacggatgtggctggaagattaagacatgccaagtgatcaacgacactgccatgctgtgtaaggcccccggcatctttcttgggcggccccagcctcgggcgcaaggcgagcaccctgatgagtttggcttcctgctggaccacgtgcaaacggcccgctccctcaaccgctcctcctttacctactaccctgatcccagctttgagccgctggggccctctggcgtgctggacgtcaaaccgggctcccacgtggtgctgaagggcaagaacctgattcccgcggcagccggcagctcccgcctcaactacactgtgctgataggaggccagccgtgttcgctcactgtctcggacacacaactcctgtgcgactcacccagccagactggccggcagcctgtcatggtgctggtgggtggcctggagttctggctgggcaccctgcacatctcggcagagcgggcgctgaccctaccggccatgatggggctggcggcggggggtgggctcctgctgctggccatcacagccgtgctggtggcgtacaagcgcaagactcaggacgcggaccgtaccctcaagcgtctgcagctgcagatggacaacctggagtcccgtgtggccctggagtgcaaggaagcttttgcagagctgcagacggacatcaatgagctgactaaccacatggacgaggtgcagatccccttcctggactaccggacttacgccgtgcgcgtgctcttcccgggcatcgaggcccacccggtgctcaaggagctggatacgccacccaacgtggagaaggccctgcgcctcttcgggcagctgctgcacagccgcgcgttcgtgcttaccttcatccacacgctggaggcccagagcagcttctccatgcgcgaccgcggcaccgtggcctcgctcaccatggtggccctgcagagccggctcgactatgccacggggctgctcaagcaactgctggccgacctcatcgagaagaacctcgagagcaagaaccaccccaagctgctgctacgcaggacagagtcagtggctgagaagatgcttaccaactggttcacgttcctgctgcataagtttctgaaggagtgtgctggggagcctctcttcctgctttactgtgccatcaagcagcagatggagaagggccccattgatgccatcacgggcgaggcacgatactccctgagcgaggacaagctcatccgtcagcagatcgactacaagacactgacccttcactgcgtgtgtccggagaacgagggcagcgcccaggtcccagtgaaggttctcaactgtgacagcatcacccaggccaaagataagctgctggacactgtgtacaagggcattccgtactcccagcgtcccaaagctgaggacatggacctggagtggcgccagggccgcatgactcgcatcatcctccaggatgaggatgtcaccaccaagatcgagtgtgactggaagaggctcaactcactggcccactaccaggtgacagacggttccttggtggcattggtgcccaaacaagtgtctgcctataacatggccaactccttcaccttcacccgctccctcagccgctacgagagcttgctccgcacggccagcagccctgatagcctccgctcacgggcacccatgattacgcctgaccaggagacaggcaccaaattgtggcacctggtgaaaaaccacgaccatgccgaccatcgcgagggggaccgtggcagcaagatggtctccgagatctacctgacacggctgctggccaccaagggcacactgcagaagttcgtggatgacctctttgagacagtgttcagcacagcccaccggggctcggccctgcccctggccatcaagtacatgttcgacttcctggatgagcaggcggaccagcgccagatcagcgaccccgatgtgcgccacacctggaagagcaactgcctgccgctgcgcttctgggtgaatgtgatcaagaacccgcagttcgtgttcgacatccacaagaacagcatcacggatgcctgcctgtcggtggtagcccagaccttcatggactcctgctctacatccgagcaccgcctggggaaggactcgccctccaacaaactgctctacgccaaggacatccccaactacaagagctgggtggagaggtattatcgagacattgcaaagatggcatccatcagcgaccaggacatggatgcctacctggtggagcagtcccgcctccacgccagcgacttcagcgtcctgagtgcgctcaacgagctgtatttctatgtcaccaagtaccgccaggagattctcacggctctggaccgagatgcctcttgtcggaagcataagttgcggcagaaactggaacagatcatcagcctcgtgtccagcgacagctaaggtggtggaatcggtgaggagggggcttctcagtcctgtgccgtcctcccatccaggggagtggctggctcaagcctgggtccccgggctgagccctggattgggtatcgtggggcaggtcaccctggccacgatgcccccggcacacccaggcccccttcattagtgccttgctttgggccctgcagggggaggggtgacagggcgagcccccaccccagcagcagcaatacccccaccctcctgccctgtgcccaggtgttgggacagtcccaccctccctgctatttatatccctctgcctatttattgaatcgaacttcgcctctgtctccatctgtaaatatgtgtccccccaccggatgtcgccaccctcactcacctgcctcttcttgagctgtcctgggccctgccacccgtctgggctcctttgtgtagcattatcagcctcggtctggcctctggcacctcacccttgccatggctgaccccacccattccaaggcggggtcacggtaccagcagcacttggggtgaggcctccaaagcttcctcagaattgtggctgtgccacgctggaccacagggtccccctcaagcatctcggggccctattctctctgagcacctggagggctggactcaggcttgtgccagggcctgacttgggcctgggggccctagaacactcctcctcctgagcctactgccaaacgtcctcagtgttgtctgcacctgctccgactccttcagccgccccattcagcgcccgctccgtccagtgcccgccctgtggggccaaggcggccgtgccttactactctgtgtcttctgcctcctctgaggaatctggccctgtctgacagtcccagaccccccgttctctcctctttagttgcatgagtttttctttgttcatggaatgttttttcctgattaaatgttggggaaatgcca

SEQ ID NO: 42164 - DNA, 2477 bp, Homo sapiens
caccttggttctgccggtcgatctaaggatccccgctgagatgacagtcggccaagcaactgctggccgacctcatcgagaagaacctcgagagcaagaaccaccccaagctgctgctacgcaggacagagtcagtggctgagaagatgcttaccaactggttcacgttcctgctgcataagtttctgaaggagtgtgctggggagcctctcttcctgctttactgtgccatcaagcagcagatggagaagggccccattgatgccatcacgggcgaggcacgatactccctgagcgaggacaagctcatccgtcagcagatcgactacaagacactgacccttcactgcgtgtgtccggagaacgagggcagcgcccaggtcccagtgaaggttctcaactgtgacagcatcacccaggccaaagataagctgctggacactgtgtacaagggcattccgtactcccagcgtcccaaagctgaggacatggacctggagtggcgccagggccgcatgactcgcatcatcctccaggatgaggatgtcaccaccaagatcgagtgtgactggaagaggctcaactcactggcccactaccaggtgacagacggttccttggtggcattggtgcccaaacaagtgtctgcctataacatggccaactccttcaccttcacccgctccctcagccgctacgagagcttgctccgcacggccagcagccctgatagcctccgctcacgggcacccatgattacgcctgaccaggagacaggcaccaaattgtggcacctggtgaaaaaccacgaccatgccgaccatcgcgagggggaccgtggcagcaagatggtctccgagatctacctgacacggctgctggccaccaagggcacactgcagaagttcgtggatgacctctttgagacagtgttcagcacagcccaccggggctcggccctgcccctggccatcaagtacatgttcgacttcctggatgagcaggcggaccagcgccagatcagcgaccccgatgtgcgccacacctggaagagcaactgcctgccgctgcgcttctgggtgaatgtgatcaagaacccgcagttcgtgttcgacatccacaagaacagcatcacggatgcctgcctgtcggtggtagcccagaccttcatggactcctgctctacatccgagcaccgcctggggaaggactcgccctccaacaaactgctctacgccaaggacatccccaactacaagagctgggtggagaggtattatcgagacattgcaaagatggcatccatcagcgaccaggacatggatgcctacctggtggagcagtcccgcctccacgccagcgacttcagcgtcctgagtgcgctcaacgagctgtatttctatgtcaccaagtaccgccaggagattctcacggctctggaccgagatgcctcttgtcggaagcataagttgcggcagaaactggaacagatcatcagcctcgtgtccagcgacagctaaggtggtggaatcggtgaggagggggcttctcagtcctgtgccgtcctcccatccaggggagtggctggctcaagcctgggtccccgggctgagccctggattgggtatcgtggggcaggtcaccctggccacgatgcccccggcacacccaggcccccttcattagtgccttgctttgggccctgcagggggaggggtgacagggcgagcccccaccccagcagcagcaatacccccaccctcctgccctgtgcccaggtgttgggacagtcccaccctccctgctatttatatccctctgcctatttattgaatcgaacttcgcctctgtctccatctgtaaatatgtgtccccccaccggatgtcgccaccctcactcacctgcctcttcttgagctgtcctgggccctgccacccgtctgggctcctttgtgtagcattatcagcctcggtctggcctctggcacctcacccttgccatggctgaccccacccattccaaggcggggtcacggtaccagcagcacttggggtgaggcctccaaagcttcctcagaattgtggctgtgccacgctggaccacagggtccccctcaagcatctcggggccctattctctctgagcacctggagggctggactcaggcttgtgccagggcctgacttgggcctgggggccctagaacactcctcctcctgagcctactgccaaacgtcctcagtgttgtctgcacctgctccgactccttcagccgccccattcagcgcccgctccgtccagtgcccgccctgtggggccaaggcggccgtgccttactactctgtgtcttctgcctcctctgaggaatctggccctgtctgacagtcccagaccccccgttctctcctctttagttgcatgagtttttctttgttcatggaatgttttttcctgattaaatgttggggaaatgcca

SEQ ID NO: 42165 - DNA, 2450 bp, Homo sapiens
cttccgcctctcctgctgcttgatggcacagtaaagcaggaagagaggctcccaagccccacccctgccaggcccgagcccccttctcttgccctaggacagagtcagtggctgagaagatgcttaccaactggttcacgttcctgctgcataagtttctgaaggagtgtgctggggagcctctcttcctgctttactgtgccatcaagcagcagatggagaagggccccattgatgccatcacgggcgaggcacgatactccctgagcgaggacaagctcatccgtcagcagatcgactacaagacactgacccttcactgcgtgtgtccggagaacgagggcagcgcccaggtcccagtgaaggttctcaactgtgacagcatcacccaggccaaagataagctgctggacactgtgtacaagggcattccgtactcccagcgtcccaaagctgaggacatggacctggagtggcgccagggccgcatgactcgcatcatcctccaggatgaggatgtcaccaccaagatcgagtgtgactggaagaggctcaactcactggcccactaccaggtgacagacggttccttggtggcattggtgcccaaacaagtgtctgcctataacatggccaactccttcaccttcacccgctccctcagccgctacgagagcttgctccgcacggccagcagccctgatagcctccgctcacgggcacccatgattacgcctgaccaggagacaggcaccaaattgtggcacctggtgaaaaaccacgaccatgccgaccatcgcgagggggaccgtggcagcaagatggtctccgagatctacctgacacggctgctggccaccaagggcacactgcagaagttcgtggatgacctctttgagacagtgttcagcacagcccaccggggctcggccctgcccctggccatcaagtacatgttcgacttcctggatgagcaggcggaccagcgccagatcagcgaccccgatgtgcgccacacctggaagagcaactgcctgccgctgcgcttctgggtgaatgtgatcaagaacccgcagttcgtgttcgacatccacaagaacagcatcacggatgcctgcctgtcggtggtagcccagaccttcatggactcctgctctacatccgagcaccgcctggggaaggactcgccctccaacaaactgctctacgccaaggacatccccaactacaagagctgggtggagaggtattatcgagacattgcaaagatggcatccatcagcgaccaggacatggatgcctacctggtggagcagtcccgcctccacgccagcgacttcagcgtcctgagtgcgctcaacgagctgtatttctatgtcaccaagtaccgccaggagattctcacggctctggaccgagatgcctcttgtcggaagcataagttgcggcagaaactggaacagatcatcagcctcgtgtccagcgacagctaaggtggtggaatcggtgaggagggggcttctcagtcctgtgccgtcctcccatccaggggagtggctggctcaagcctgggtccccgggctgagccctggattgggtatcgtggggcaggtcaccctggccacgatgcccccggcacacccaggcccccttcattagtgccttgctttgggccctgcagggggaggggtgacagggcgagcccccaccccagcagcagcaatacccccaccctcctgccctgtgcccaggtgttgggacagtcccaccctccctgctatttatatccctctgcctatttattgaatcgaacttcgcctctgtctccatctgtaaatatgtgtccccccaccggatgtcgccaccctcactcacctgcctcttcttgagctgtcctgggccctgccacccgtctgggctcctttgtgtagcattatcagcctcggtctggcctctggcacctcacccttgccatggctgaccccacccattccaaggcggggtcacggtaccagcagcacttggggtgaggcctccaaagcttcctcagaattgtggctgtgccacgctggaccacagggtccccctcaagcatctcggggccctattctctctgagcacctggagggctggactcaggcttgtgccagggcctgacttgggcctgggggccctagaacactcctcctcctgagcctactgccaaacgtcctcagtgttgtctgcacctgctccgactccttcagccgccccattcagcgcccgctccgtccagtgcccgccctgtggggccaaggcggccgtgccttactactctgtgtcttctgcctcctctgaggaatctggccctgtctgacagtcccagaccccccgttctctcctctttagttgcatgagtttttctttgttcatggaatgttttttcctgattaaatgttggggaaatgcca

SEQ ID NO: 42166 - DNA, 4574 bp, Homo sapiens
cccagtgccccgcttctgcttccttccgttcccagctcgttcctccttgctccgtctcccggttgccccttgtcttgagccaacaagagtcttgtgggcccaggcttcgctcctcgctccctgctgtccctcctctgtctccctccgcagccaccaatttcctggagcaccctagggcgagcagtcagtcctggctggaggggaccgggttctagatcccgctctcttctgggacacaggaactgccggcctccatcttgcgcctgggagctttgactctcacgggttcctcctctgtttcaccagcccatgcagatcaacggcaacttctgtgggctggtgttgaaccagcctctgggaggcctgcatgtgatcgaggggctgcccctgctggccgacagcaccgacggcatggccagcgtggccgcctacacctaccgccagcactctgtggtcttcattggcacgcgcagcggcagcttgaagaaggtgcgggtcgatggcttccaggatgcccacctgtatgagacagtccccgtggtggatggcagccccatcctccgagacctgctcttcagcccggaccaccggcacatctatctcctgagtgagaagcaggtgagccagctcccggtggagacctgtgagcagtaccagagctgcgcagcctgcctgggctccggggacccgcactgtggttggtgtgtgctgcgacacaggtgctgccgcgaaggggcctgtctgggcgcctctgccccacacggctttgctgaggagctgagcaagtgtgtccaggtgcgggtccggcccaacaatgtgtcagtgacgtcacctggggtgcagctgaccgtcaccctgcacaacgtgccagacctcagtgcgggcgtgagctgcgccttcgaggcggcggcggagaacgaggcggtcctgctgccctccggtgaactgctctgcccctcaccctccctccaggagctccgagctcttaccagggggcatggggccacccgcactgtgcggctgcagcttctctccaaggagacaggcgtgaggtttgccggtgctgactttgtcttctacaactgcagcgtcctccagtcgtgcatgtcctgtgttggcagcccttacccctgccactggtgtaagtaccgccacacgtgtaccagccgcccccacgagtgctccttccaggagggcagggtccacagccctgaggtgaggcgggcgccgcatgtgaggggctgggctctgtggtgcgggcggggccaccggcttctatgcgttctcggtttctttgagccttctccaggttgggcctggagaagggtggccctgtgtgcagctgacaggtgctttccccgcagggctgccctgagatcctgcccagtggggacctcctgatccccgttggggtcatgcagcctcttaccttgcgggctaagaacctacctcagccgcagtcgggccagaagaactatgagtgcgtggtgcgggtgcaggggcggcagcagcgggtgcctgccgtgcgcttcaacagcagcagtgtgcagtgccagaacgcctcgtactcctatgaaggtgatgagcatggtgacaccgagctggacttctccgtggtctgggatggagacttccccatagacaagcctcccagcttccgagccctcctgtacaagtgctgggcgcagcggcccagctgtggcctctgcctcaaggctgatccccgcttcaactgtggctggtgcatctcagagcacaggtgccagctgcggacccactgcccggccccgaagaccaactggatgcacctgagccagaagggcacccggtgcagccacccccgcatcacgcagatccaccctctcgtggggcccaaggaaggaggcacccgggtcaccatcgtgggtgagaacctgggcctcttgtcccgagaggtgggcctgcgggtggctggcgtgcgttgcaactccattccggccgagtacatcagtgctgagaggatcgtgtgtgagatggaggagtcgctggtgcccagcccgccgccggggcccgtggagctgtgtgtgggtgactgttcagccgacttccgcacgcagtcggagcaggtctacagctttgtgaccccaacgtttgaccaagtgagtcccagccgtggcccggcgtccgggggcacacggcttaccatctcaggcagctctctggatgctggcagcagggtcacagtgactgtgagggacagcgagtgccagtttgtaaggagagatgccaaggcgatcgtgtgcatctcacctctctccaccctgggccccagccaggcccccatcacacttgccattgaccgggctaacatctccagccccgggctcatctacacctacactcaggaccccaccgtcacccgccttgagcccacctggagcatcatcaatggaagcactgccatcactgtgagtgggacccacctgctgacggtccaggagccccgggtccgtgccaagtaccgcggcattgagaccaccaatacatgccaagtgatcaacgacactgccatgctgtgtaaggcccccggcatctttcttgggcggccccagcctcgggcgcaaggcgagcaccctgatgagtttggcttcctgctggaccacgtgcaaacggcccgctccctcaaccgctcctcctttacctactaccctgatcccagctttgagccgctggggccctctggcgtgctggacgtcaaaccgggctcccacgtggtgctgaagggcaagaacctgattcccgcggcagccggcagctcccgcctcaactacactgtgctgataggaggccagccgtgttcgctcactgtctcggacacacaactcctgtgcgactcacccagccagactggccggcagcctgtcatggtgctggtgggtggcctggagttctggctgggcaccctgcacatctcggcagagcgggcgctgaccctaccggccatgatggggctggcggcggggggtgggctcctgctgctggccatcacagccgtgctggtggcgtacaagcgcaagactcaggacgcggaccgtaccctcaagcgtctgcagctgcagatggacaacctggagtcccgtgtggccctggagtgcaaggaagcttttgcagagctgcagacggacatcaatgagctgactaaccacatggacgaggtgcagatccccttcctggactaccggacttacgccgtgcgcgtgctcttcccgggcatcgaggcccacccggtgctcaaggagctggatacgccacccaacgtggagaaggccctgcgcctcttcgggcagctgctgcacagccgcgcgttcgtgcttaccttcatccacacgctggaggcccagagcagcttctccatgcgcgaccgcggcaccgtggcctcgctcaccatggtggccctgcagagccggctcgactatgccacggggctgctcaagcaactgctggccgacctcatcgagaagaacctcgagagcaagaaccaccccaagctgctgctacgcaggacagagtcagtggctgagaagatgcttaccaactggttcacgttcctgctgcataagtttctgaaggagtgtgctggggagcctctcttcctgctttactgtgccatcaagcagcagatggagaagggccccattgatgccatcacgggcgaggcacgatactccctgagcgaggacaagctcatccgtcagcagatcgactacaagacactgacccttcactgcgtgtgtccggagaacgagggcagcgcccaggtcccagtgaaggttctcaactgtgacagcatcacccaggccaaagataagctgctggacactgtgtacaagggcattccgtactcccagcgtcccaaagctgaggacatggacctggagtggcgccagggccgcatgactcgcatcatcctccaggatgaggatgtcaccaccaagatcgagtgtgactggaagaggctcaactcactggcccactaccaggtgacagacggttccttggtggcattggtgcccaaacaagtgtctgcctataacatggccaactccttcaccttcacccgctccctcagccgctacgagagcttgctccgcacggccagcagccctgatagcctccgctcacgggcacccatgattacgcctgaccaggagacaggcaccaaattgtggcacctggtgaaaaaccacgaccatgccgaccatcgcgagggggaccgtggcagcaagatggtctccgagatctacctgacacggctgctggccaccaagggcacactgcagaagttcgtggatgacctctttgagacagtgttcagcacagcccaccggggctcggccctgcccctggccatcaagtacatgttcgacttcctggatgagcaggcggaccagcgccagatcagcgaccccgatgtgcgccacacctggaagagcaactggtatcaccccgtgctgggctgccagcagcctgtctggagactggtgggcggaagacgctggtggctctgctgagacccagggcctggagtagcatcc

SEQ ID NO: 42167 - DNA, 2556 bp, Homo sapiens
cccagtgccccgcttctgcttccttccgttcccagctcgttcctccttgctccgtctcccggttgccccttgtcttgagccaacaagagtcttgtgggcccaggcttcgctcctcgctccctgctgtccctcctctgtctccctccgcagccaccaatttcctggagcaccctagggcgagcagtcagtcctggctggaggggaccgggttctagatcccgctctcttctgggacacaggaactgccggcctccatcttgcgcctgggagctttgactctcacgggttcctcctctgtttcaccagcccatgcagatcaacggcaacttctgtgggctggtgttgaaccagcctctgggaggcctgcatgtgatcgaggggctgcccctgctggccgacagcaccgacggcatggccagcgtggccgcctacacctaccgccagcactctgtggtcttcattggcacgcgcagcggcagcttgaagaaggtgcgggtcgatggcttccaggatgcccacctgtatgagacagtccccgtggtggatggcagccccatcctccgagacctgctcttcagcccggaccaccggcacatctatctcctgagtgagaagcaggtgagccagctcccggtggagacctgtgagcagtaccagagctgcgcagcctgcctgggctccggggacccgcactgtggttggtgtgtgctgcgacacaggtgctgccgcgaaggggcctgtctgggcgcctctgccccacacggctttgctgaggagctgagcaagtgtgtccaggtgcgggtccggcccaacaatgtgtcagtgacgtcacctggggtgcagctgaccgtcaccctgcacaacgtgccagacctcagtgcgggcgtgagctgcgccttcgaggcggcggcggagaacgaggcggtcctgctgccctccggtgaactgctctgcccctcaccctccctccaggagctccgagctcttaccagggggcatggggccacccgcactgtgcggctgcagcttctctccaaggagacaggcgtgaggtttgccggtgctgactttgtcttctacaactgcagcgtcctccagtcgtgcatgtcctgtgttggcagcccttacccctgccactggtgtaagtaccgccacacgtgtaccagccgcccccacgagtgctccttccaggagggcagggtccacagccctgaggtgaggcgggcgccgcatgtgaggggctgggctctgtggtgcgggcggggccaccggcttctatgcgttctcggtttctttgagccttctccaggttgggcctggagaagggtggccctgtgtgcagctgacaggtgctttccccgcagggctgccctgagatcctgcccagtggggacctcctgatccccgttggggtcatgcagcctcttaccttgcgggctaagaacctacctcagccgcagtcgggccagaagaactatgagtgcgtggtgcgggtgcaggggcggcagcagcgggtgcctgccgtgcgcttcaacagcagcagtgtgcagtgccagaacgcctcgtactcctatgaaggtgatgagcatggtgacaccgagctggacttctccgtggtctgggatggagacttccccatagacaagcctcccagcttccgagccctcctgtacaagtgctgggcgcagcggcccagctgtggcctctgcctcaaggctgatccccgcttcaactgtggctggtgcatctcagagcacaggtgccagctgcggacccactgcccggccccgaagaccaactggatgcacctgagccagaagggcacccggtgcagccacccccgcatcacgcagatccaccctctcgtggggcccaaggaaggaggcacccgggtcaccatcgtgggtgagaacctgggcctcttgtcccgagaggtgggcctgcgggtggctggcgtgcgttgcaactccattccggccgagtacatcagtgctgagaggatcgtgtgtgagatggaggagtcgctggtgcccagcccgccgccggggcccgtggagctgtgtgtgggtgactgttcagccgacttccgcacgcagtcggagcaggtctacagctttgtgaccccaacgtttgaccaagtgagtcccagccgtggcccggcgtccgggggcacacggcttaccatctcaggcagctctctggatgctggcagcagggtcacagtgactgtgagggacagcgagtgccagtttgtaaggagagatgccaaggcgatcgtgtgcatctcacctctctccaccctgggccccagccaggcccccatcacacttgccattgaccgggctaacatctccagccccgggctcatctacacctacactcaggaccccaccgtcacccgccttgagcccacctggagcatcatcaatggaagcactgccatcactgtgagtgggacccacctgctgacggtccaggagccccgggtccgtgccaagtaccgcggcattgagaccaccaatgtgagtaccagctgccccgccccaccccgaccct

SEQ ID NO: 42168 - DNA, 3956 bp, Homo sapiens
ggctctgtgggtgcccgggccgtatgtggcctggccggccctgacgctctctgagccctaggatcgtgtgtgagatggaggagtcgctggtgcccagcccgccgccggggcccgtggagctgtgtgtgggtgactgttcagccgacttccgcacgcagtcggagcaggtctacagctttgtgaccccaacgtttgaccaagtgagtcccagccgtggcccggcgtccgggggcacacggcttaccatctcaggcagctctctggatgctggcagcagggtcacagtgactgtgagggacagcgagtgccagtttgtaaggagagatgccaaggcgatcgtgtgcatctcacctctctccaccctgggccccagccaggcccccatcacacttgccattgaccgggctaacatctccagccccgggctcatctacacctacactcaggaccccaccgtcacccgccttgagcccacctggagcatcatcaatggaagcactgccatcactgtgagtgggacccacctgctgacggtccaggagccccgggtccgtgccaagtaccgcggcattgagaccaccaatacatgccaagtgatcaacgacactgccatgctgtgtaaggcccccggcatctttcttgggcggccccagcctcgggcgcaaggcgagcaccctgatgagtttggcttcctgctggaccacgtgcaaacggcccgctccctcaaccgctcctcctttacctactaccctgatcccagctttgagccgctggggccctctggcgtgctggacgtcaaaccgggctcccacgtggtgctgaagggcaagaacctgattcccgcggcagccggcagctcccgcctcaactacactgtgctgataggaggccagccgtgttcgctcactgtctcggacacacaactcctgtgcgactcacccagccagactggccggcagcctgtcatggtgctggtgggtggcctggagttctggctgggcaccctgcacatctcggcagagcgggcgctgaccctaccggccatgatggggctggcggcggggggtgggctcctgctgctggccatcacagccgtgctggtggcgtacaagcgcaagactcaggacgcggaccgtaccctcaagcgtctgcagctgcagatggacaacctggagtcccgtgtggccctggagtgcaaggaagcttttgcagagctgcagacggacatcaatgagctgactaaccacatggacgaggtgcagatccccttcctggactaccggacttacgccgtgcgcgtgctcttcccgggcatcgaggcccacccggtgctcaaggagctggatacgccacccaacgtggagaaggccctgcgcctcttcgggcagctgctgcacagccgcgcgttcgtgcttaccttcatccacacgctggaggcccagagcagcttctccatgcgcgaccgcggcaccgtggcctcgctcaccatggtggccctgcagagccggctcgactatgccacggggctgctcaagcaactgctggccgacctcatcgagaagaacctcgagagcaagaaccaccccaagctgctgctacgcaggacagagtcagtggctgagaagatgcttaccaactggttcacgttcctgctgcataagtttctgaaggagtgtgctggggagcctctcttcctgctttactgtgccatcaagcagcagatggagaagggccccattgatgccatcacgggcgaggcacgatactccctgagcgaggacaagctcatccgtcagcagatcgactacaagacactgacccttcactgcgtgtgtccggagaacgagggcagcgcccaggtcccagtgaaggttctcaactgtgacagcatcacccaggccaaagataagctgctggacactgtgtacaagggcattccgtactcccagcgtcccaaagctgaggacatggacctggagtggcgccagggccgcatgactcgcatcatcctccaggatgaggatgtcaccaccaagatcgagtgtgactggaagaggctcaactcactggcccactaccaggtgacagacggttccttggtggcattggtgcccaaacaagtgtctgcctataacatggccaactccttcaccttcacccgctccctcagccgctacgagagcttgctccgcacggccagcagccctgatagcctccgctcacgggcacccatgattacgcctgaccaggagacaggcaccaaattgtggcacctggtgaaaaaccacgaccatgccgaccatcgcgagggggaccgtggcagcaagatggtctccgagatctacctgacacggctgctggccaccaagggcacactgcagaagttcgtggatgacctctttgagacagtgttcagcacagcccaccggggctcggccctgcccctggccatcaagtacatgttcgacttcctggatgagcaggcggaccagcgccagatcagcgaccccgatgtgcgccacacctggaagagcaactgcctgccgctgcgcttctgggtgaatgtgatcaagaacccgcagttcgtgttcgacatccacaagaacagcatcacggatgcctgcctgtcggtggtagcccagaccttcatggactcctgctctacatccgagcaccgcctggggaaggactcgccctccaacaaactgctctacgccaaggacatccccaactacaagagctgggtggagaggtattatcgagacattgcaaagatggcatccatcagcgaccaggacatggatgcctacctggtggagcagtcccgcctccacgccagcgacttcagcgtcctgagtgcgctcaacgagctgtatttctatgtcaccaagtaccgccaggagattctcacggctctggaccgagatgcctcttgtcggaagcataagttgcggcagaaactggaacagatcatcagcctcgtgtccagcgacagctaaggtggtggaatcggtgaggagggggcttctcagtcctgtgccgtcctcccatccaggggagtggctggctcaagcctgggtccccgggctgagccctggattgggtatcgtggggcaggtcaccctggccacgatgcccccggcacacccaggcccccttcattagtgccttgctttgggccctgcagggggaggggtgacagggcgagcccccaccccagcagcagcaatacccccaccctcctgccctgtgcccaggtgttgggacagtcccaccctccctgctatttatatccctctgcctatttattgaatcgaacttcgcctctgtctccatctgtaaatatgtgtccccccaccggatgtcgccaccctcactcacctgcctcttcttgagctgtcctgggccctgccacccgtctgggctcctttgtgtagcattatcagcctcggtctggcctctggcacctcacccttgccatggctgaccccacccattccaaggcggggtcacggtaccagcagcacttggggtgaggcctccaaagcttcctcagaattgtggctgtgccacgctggaccacagggtccccctcaagcatctcggggccctattctctctgagcacctggagggctggactcaggcttgtgccagggcctgacttgggcctgggggccctagaacactcctcctcctgagcctactgccaaacgtcctcagtgttgtctgcacctgctccgactccttcagccgccccattcagcgcccgctccgtccagtgcccgccctgtggggccaaggcggccgtgccttactactctgtgtcttctgcctcctctgaggaatctggccctgtctgacagtcccagaccccccgttctctcctctttagttgcatgagtttttctttgttcatggaatgttttttcctgattaaatgttggggaaatgcca

SEQ ID NO: 42169 - DNA, 4468 bp, Homo sapiens
cccagtgccccgcttctgcttccttccgttcccagctcgttcctccttgctccgtctcccggttgccccttgtcttgagccaacaagagtcttgtgggcccaggcttcgctcctcgctccctgctgtccctcctctgtctccctccgcagccaccaatttcctggagcaccctagggcgagcagtcagtcctggctggaggggaccgggttctagatcccgctctcttctgggacacaggaactgccggcctccatcttgcgcctgggagctttgactctcacgggttcctcctctgtttcaccagcccatgcagatcaacggcaacttctgtgggctggtgttgaaccagcctctgggaggcctgcatgtgatcgaggggctgcccctgctggccgacagcaccgacggcatggccagcgtggccgcctacacctaccgccagcactctgtggtcttcattggcacgcgcagcggcagcttgaagaaggtgcgggtcgatggcttccaggatgcccacctgtatgagacagtccccgtggtggatggcagccccatcctccgagacctgctcttcagcccggaccaccggcacatctatctcctgagtgagaagcaggtgagccagctcccggtggagacctgtgagcagtaccagagctgcgcagcctgcctgggctccggggacccgcactgtggttggtgtgtgctgcgacacaggtgctgccgcgaaggggcctgtctgggcgcctctgccccacacggctttgctgaggagctgagcaagtgtgtccaggtgcgggtccggcccaacaatgtgtcagtgacgtcacctggggtgcagctgaccgtcaccctgcacaacgtgccagacctcagtgcgggcgtgagctgcgccttcgaggcggcggcggagaacgaggcggtcctgctgccctccggtgaactgctctgcccctcaccctccctccaggagctccgagctcttaccagggggcatggggccacccgcactgtgcggctgcagcttctctccaaggagacaggcgtgaggtttgccggtgctgactttgtcttctacaactgcagcgtcctccagtcgtgcatgtcctgtgttggcagcccttacccctgccactggtgtaagtaccgccacacgtgtaccacctcgggcgcaaggcgagcaccctgatgagtttggcttcctgctggaccacgtgcaaacggcccgctccctcaaccgctcctcctttacctactaccctgatcccagctttgagccgctggggccctctggcgtgctggacgtcaaaccgggctcccacgtggtgctgaagggcaagaacctgattcccgcggcagccggcagctcccgcctcaactacactgtgctgataggaggccagccgtgttcgctcactgtctcggacacacaactcctgtgcgactcacccagccagactggccggcagcctgtcatggtgctggtgggtggcctggagttctggctgggcaccctgcacatctcggcagagcgggcgctgaccctaccggccatgatggggctggcggcggggggtgggctcctgctgctggccatcacagccgtgctggtggcgtacaagcgcaagactcaggacgcggaccgtaccctcaagcgtctgcagctgcagatggacaacctggagtcccgtgtggccctggagtgcaaggaagcttttgcagagctgcagacggacatcaatgagctgactaaccacatggacgaggtgcagatccccttcctggactaccggacttacgccgtgcgcgtgctcttcccgggcatcgaggcccacccggtgctcaaggagctggatacgccacccaacgtggagaaggccctgcgcctcttcgggcagctgctgcacagccgcgcgttcgtgcttaccttcatccacacgctggaggcccagagcagcttctccatgcgcgaccgcggcaccgtggcctcgctcaccatggtggccctgcagagccggctcgactatgccacggggctgctcaagcaactgctggccgacctcatcgagaagaacctcgagagcaagaaccaccccaagctgctgctacgcaggacagagtcagtggctgagaagatgcttaccaactggttcacgttcctgctgcataagtttctgaaggagtgtgctggggagcctctcttcctgctttactgtgccatcaagcagcagatggagaagggccccattgatgccatcacgggcgaggcacgatactccctgagcgaggacaagctcatccgtcagcagatcgactacaagacactgacccttcactgcgtgtgtccggagaacgagggcagcgcccaggtcccagtgaaggttctcaactgtgacagcatcacccaggccaaagataagctgctggacactgtgtacaagggcattccgtactcccagcgtcccaaagctgaggacatggacctggagtggcgccagggccgcatgactcgcatcatcctccaggatgaggatgtcaccaccaagatcgagtgtgactggaagaggctcaactcactggcccactaccaggtgacagacggttccttggtggcattggtgcccaaacaagtgtctgcctataacatggccaactccttcaccttcacccgctccctcagccgctacgagagcttgctccgcacggccagcagccctgatagcctccgctcacgggcacccatgattacgcctgaccaggagacaggcaccaaattgtggcacctggtgaaaaaccacgaccatgccgaccatcgcgagggggaccgtggcagcaagatggtctccgagatctacctgacacggctgctggccaccaagggcacactgcagaagttcgtggatgacctctttgagacagtgttcagcacagcccaccggggctcggccctgcccctggccatcaagtacatgttcgacttcctggatgagcaggcggaccagcgccagatcagcgaccccgatgtgcgccacacctggaagagcaactgcctgccgctgcgcttctgggtgaatgtgatcaagaacccgcagttcgtgttcgacatccacaagaacagcatcacggatgcctgcctgtcggtggtagcccagaccttcatggactcctgctctacatccgagcaccgcctggggaaggactcgccctccaacaaactgctctacgccaaggacatccccaactacaagagctgggtggagaggtattatcgagacattgcaaagatggcatccatcagcgaccaggacatggatgcctacctggtggagcagtcccgcctccacgccagcgacttcagcgtcctgagtgcgctcaacgagctgtatttctatgtcaccaagtaccgccaggagattctcacggctctggaccgagatgcctcttgtcggaagcataagttgcggcagaaactggaacagatcatcagcctcgtgtccagcgacagctaaggtggtggaatcggtgaggagggggcttctcagtcctgtgccgtcctcccatccaggggagtggctggctcaagcctgggtccccgggctgagccctggattgggtatcgtggggcaggtcaccctggccacgatgcccccggcacacccaggcccccttcattagtgccttgctttgggccctgcagggggaggggtgacagggcgagcccccaccccagcagcagcaatacccccaccctcctgccctgtgcccaggtgttgggacagtcccaccctccctgctatttatatccctctgcctatttattgaatcgaacttcgcctctgtctccatctgtaaatatgtgtccccccaccggatgtcgccaccctcactcacctgcctcttcttgagctgtcctgggccctgccacccgtctgggctcctttgtgtagcattatcagcctcggtctggcctctggcacctcacccttgccatggctgaccccacccattccaaggcggggtcacggtaccagcagcacttggggtgaggcctccaaagcttcctcagaattgtggctgtgccacgctggaccacagggtccccctcaagcatctcggggccctattctctctgagcacctggagggctggactcaggcttgtgccagggcctgacttgggcctgggggccctagaacactcctcctcctgagcctactgccaaacgtcctcagtgttgtctgcacctgctccgactccttcagccgccccattcagcgcccgctccgtccagtgcccgccctgtggggccaaggcggccgtgccttactactctgtgtcttctgcctcctctgaggaatctggccctgtctgacagtcccagaccccccgttctctcctctttagttgcatgagtttttctttgttcatggaatgttttttcctgattaaatgttggggaaatgcca

SEQ ID NO: 42170 - DNA, 2807 bp, Homo sapiens
taactctagcggatcttagtacttgttctcgtgttggcctggagtacaaggaagcttttgcagagctgcagacggacatcaatgagctgactaaccacatggacgaggtgcagatccccttcctggactaccggacttacgccgtgcgcgtgctcttcccgggcatcgaggcccacccggtgctcaaggagctggatacgccacccaacgtggagaaggccctgcgcctcttcgggcagctgctgcacagccgcgcgttcgtgcttaccttcatccacacgctggaggcccagagcagcttctccatgcgcgaccgcggcaccgtggcctcgctcaccatggtggccctgcagagccggctcgactatgccacggggctgctcaagcaactgctggccgacctcatcgagaagaacctcgagagcaagaaccaccccaagctgctgctacgcaggacagagtcagtggctgagaagatgcttaccaactggttcacgttcctgctgcataagtttctgaaggagtgtgctggggagcctctcttcctgctttactgtgccatcaagcagcagatggagaagggccccattgatgccatcacgggcgaggcacgatactccctgagcgaggacaagctcatccgtcagcagatcgactacaagacactgacccttcactgcgtgtgtccggagaacgagggcagcgcccaggtcccagtgaaggttctcaactgtgacagcatcacccaggccaaagataagctgctggacactgtgtacaagggcattccgtactcccagcgtcccaaagctgaggacatggacctggagtggcgccagggccgcatgactcgcatcatcctccaggatgaggatgtcaccaccaagatcgagtgtgactggaagaggctcaactcactggcccactaccaggtgacagacggttccttggtggcattggtgcccaaacaagtgtctgcctataacatggccaactccttcaccttcacccgctccctcagccgctacgagagcttgctccgcacggccagcagccctgatagcctccgctcacgggcacccatgattacgcctgaccaggagacaggcaccaaattgtggcacctggtgaaaaaccacgaccatgccgaccatcgcgagggggaccgtggcagcaagatggtctccgagatctacctgacacggctgctggccaccaagggcacactgcagaagttcgtggatgacctctttgagacagtgttcagcacagcccaccggggctcggccctgcccctggccatcaagtacatgttcgacttcctggatgagcaggcggaccagcgccagatcagcgaccccgatgtgcgccacacctggaagagcaactgcctgccgctgcgcttctgggtgaatgtgatcaagaacccgcagttcgtgttcgacatccacaagaacagcatcacggatgcctgcctgtcggtggtagcccagaccttcatggactcctgctctacatccgagcaccgcctggggaaggactcgccctccaacaaactgctctacgccaaggacatccccaactacaagagctgggtggagaggtattatcgagacattgcaaagatggcatccatcagcgaccaggacatggatgcctacctggtggagcagtcccgcctccacgccagcgacttcagcgtcctgagtgcgctcaacgagctgtatttctatgtcaccaagtaccgccaggagattctcacggctctggaccgagatgcctcttgtcggaagcataagttgcggcagaaactggaacagatcatcagcctcgtgtccagcgacagctaaggtggtggaatcggtgaggagggggcttctcagtcctgtgccgtcctcccatccaggggagtggctggctcaagcctgggtccccgggctgagccctggattgggtatcgtggggcaggtcaccctggccacgatgcccccggcacacccaggcccccttcattagtgccttgctttgggccctgcagggggaggggtgacagggcgagcccccaccccagcagcagcaatacccccaccctcctgccctgtgcccaggtgttgggacagtcccaccctccctgctatttatatccctctgcctatttattgaatcgaacttcgcctctgtctccatctgtaaatatgtgtccccccaccggatgtcgccaccctcactcacctgcctcttcttgagctgtcctgggccctgccacccgtctgggctcctttgtgtagcattatcagcctcggtctggcctctggcacctcacccttgccatggctgaccccacccattccaaggcggggtcacggtaccagcagcacttggggtgaggcctccaaagcttcctcagaattgtggctgtgccacgctggaccacagggtccccctcaagcatctcggggccctattctctctgagcacctggagggctggactcaggcttgtgccagggcctgacttgggcctgggggccctagaacactcctcctcctgagcctactgccaaacgtcctcagtgttgtctgcacctgctccgactccttcagccgccccattcagcgcccgctccgtccagtgcccgccctgtggggccaaggcggccgtgccttactactctgtgtcttctgcctcctctgaggaatctggccctgtctgacagtcccagaccccccgttctctcctctttagttgcatgagtttttctttgttcatggaatgttttttcctgattaaatgttggggaaatgcca

SEQ ID NO: 42171 - DNA, 1675 bp, Homo sapiens
ttgcaccaggtagagatgctggtggtcggtcgcaggtggtgagagcggtgacaggagaagctgcggagggggttgagccctattgagaacagaagttcagcagagacttagaggaaaggccgttcaccctaaatgtgttgctctcaccacctctggacaagatgtgagccggccggacaggaaagagatgtgcacatgggaggggccccttggggctaactagggagcctcaggcgcacgtccctctgttgtccacagcctgccgctgcgcttctgggtgaatgtgatcaagaacccgcagttcgtgttcgacatccacaagaacagcatcacggatgcctgcctgtcggtggtagcccagaccttcatggactcctgctctacatccgagcaccgcctggggaaggactcgccctccaacaaactgctctacgccaaggacatccccaactacaagagctgggtggagaggtattatcgagacattgcaaagatggcatccatcagcgaccaggacatggatgcctacctggtggagcagtcccgcctccacgccagcgacttcagcgtcctgagtgcgctcaacgagctgtatttctatgtcaccaagtaccgccaggagattctcacggctctggaccgagatgcctcttgtcggaagcataagttgcggcagaaactggaacagatcatcagcctcgtgtccagcgacagctaaggtggtggaatcggtgaggagggggcttctcagtcctgtgccgtcctcccatccaggggagtggctggctcaagcctgggtccccgggctgagccctggattgggtatcgtggggcaggtcaccctggccacgatgcccccggcacacccaggcccccttcattagtgccttgctttgggccctgcagggggaggggtgacagggcgagcccccaccccagcagcagcaatacccccaccctcctgccctgtgcccaggtgttgggacagtcccaccctccctgctatttatatccctctgcctatttattgaatcgaacttcgcctctgtctccatctgtaaatatgtgtccccccaccggatgtcgccaccctcactcacctgcctcttcttgagctgtcctgggccctgccacccgtctgggctcctttgtgtagcattatcagcctcggtctggcctctggcacctcacccttgccatggctgaccccacccattccaaggcggggtcacggtaccagcagcacttggggtgaggcctccaaagcttcctcagaattgtggctgtgccacgctggaccacagggtccccctcaagcatctcggggccctattctctctgagcacctggagggctggactcaggcttgtgccagggcctgacttgggcctgggggccctagaacactcctcctcctgagcctactgccaaacgtcctcagtgttgtctgcacctgctccgactccttcagccgccccattcagcgcccgctccgtccagtgcccgccctgtggggccaaggcggccgtgccttactactctgtgtcttctgcctcctctgaggaatctggccctgtctgacagtcccagaccccccgttctctcctctttagttgcatgagtttttctttgttcatggaatgttttttcctgattaaatgttggggaaatgcca

SEQ ID NO: 42172 - DNA, 2852 bp, Homo sapiens
cccagtgccccgcttctgcttccttccgttcccagctcgttcctccttgctccgtctcccggttgccccttgtcttgagccaacaagagtcttgtgggcccaggcttcgctcctcgctccctgctgtccctcctctgtctccctccgcagccaccaatttcctggagcaccctagggcgagcagtcagtcctggctggaggggaccgggttctagatcccgctctcttctgggacacaggaactgccggcctccatcttgcgcctgggagctttgactctcacgggttcctcctctgtttcaccagcccatgcagatcaacggcaacttctgtgggctggtgttgaaccagcctctgggaggcctgcatgtgatcgaggggctgcccctgctggccgacagcaccgacggcatggccagcgtggccgcctacacctaccgccagcactctgtggtcttcattggcacgcgcagcggcagcttgaagaaggtgcgggtcgatggcttccaggatgcccacctgtatgagacagtccccgtggtggatggcagccccatcctccgagacctgctcttcagcccggaccaccggcacatctatctcctgagtgagaagcaggtgagccagctcccggtggagacctgtgagcagtaccagagctgcgcagcctgcctgggctccggggacccgcactgtggttggtgtgtgctgcgacacaggtgctgccgcgaaggggcctgtctgggcgcctctgccccacacggctttgctgaggagctgagcaagtgtgtccaggtgcgggtccggcccaacaatgtgtcagtgacgtcacctggggtgcagctgaccgtcaccctgcacaacgtgccagacctcagtgcgggcgtgagctgcgccttcgaggcggcggcggagaacgaggcggtcctgctgccctccggtgaactgctctgcccctcaccctccctccaggagctccgagctcttaccagggggcatggggccacccgcactgtgcggctgcagcttctctccaaggagacaggcgtgaggtttgccggtgctgactttgtcttctacaactgcagcgtcctccagtcgtgcatgtcctgtgttggcagcccttacccctgccactggtgtaagtaccgccacacgtgtaccagccgcccccacgagtgctccttccaggagggcagggtccacagccctgaggtgaggcgggcgccgcatgtgaggggctgggctctgtggtgcgggcggggccaccggcttctatgcgttctcggtttctttgagccttctccaggttgggcctggagaagggtggccctgtgtgcagctgacaggtgctttccccgcagggctgccctgagatcctgcccagtggggacctcctgatccccgttggggtcatgcagcctcttaccttgcgggctaagaacctacctcagccgcagtcgggccagaagaactatgagtgcgtggtgcgggtgcaggggcggcagcagcgggtgcctgccgtgcgcttcaacagcagcagtgtgcagtgccagaacgcctcgtactcctatgaaggtgatgagcatggtgacaccgagctggacttctccgtggtctgggatggagacttccccatagacaagcctcccagcttccgagccctcctgtacaagtgctgggcgcagcggcccagctgtggcctctgcctcaaggctgatccccgcttcaactgtggctggtgcatctcagagcacaggtgccagctgcggacccactgcccggccccgaagaccaactggatgcacctgagccagaagggcacccggtgcagccacccccgcatcacgcagatccaccctctcgtggggcccaaggaaggaggcacccgggtcaccatcgtgggtgagaacctgggcctcttgtcccgagaggtgggcctgcgggtggctggcgtgcgttgcaactccattccggccgagtacatcagtgctgagaggatcgtgtgtgagatggaggagtcgctggtgcccagcccgccgccggggcccgtggagctgtgtgtgggtgactgttcagccgacttccgcacgcagtcggagcaggtctacagctttgtgaccccaacgtttgaccaagtgagtcccagccgtggcccggcgtccgggggcacacggcttaccatctcaggcagctctctggatgctggcagcagggtcacagtgactgtgagggacagcgagtgccagtttgtaaggagagatgccaaggcgatcgtgtgcatctcacctctctccaccctgggccccagccaggcccccatcacacttgccattgaccgggctaacatctccagccccgggctcatctacacctacactcaggaccccaccgtcacccgccttgagcccacctggagcatcatcaatggaagcactgccatcactgtgagtgggacccacctgctgacggtccaggagccccgggtccgtgccaagtaccgcggcattgagaccaccaatacatgccaagtgatcaacgacactgccatgctgtgtaaggcccccggcatctttcttgggcggccccagcctcgggcgcaaggcgagcaccctgatgagtttggcttcctgctggaccacgtgcaaacggcccgctccctcaaccgtccgtccagtgcccgccctgtggggccaaggcggccgtgccttactactctgtgtcttctgcctcctctgaggaatctggccctgtctgacagtcccagaccccccgttctctcctctttagttgcatgagtttttctttgttcatggaatgttttttcctgattaaatgttggggaaatgcca

SEQ ID NO: 42173 - DNA, 498 bp, Homo sapiens
gtgatgtcgcctgagtgacatactcagggtcccaacaggtattatcgagacattgcaaagatggcatccatcagcgaccaggacatggatgcctacctggtggagcagtcccgcctccacgccagcgacttcagcgtcctgagtgcgctcaacgagctgtatttctatgtcaccaagtaccgccaggaggtgtgtgtcatccccacagactcccagttacttggtcctgaaggtgcagccagtgacaaaggcaggagggttggtgggggttggggattgttcacggtctctcccctgaccagggcctggggccggcacaggtgatgctctctgggatcacaggtagatgctggaatttgagggacccaggagataagccactggctgggtacaaagtggccactgggcaaaagttaaagggcctgagcactggaagggatgggtcaggctttgtgatgagaaatagccagaggcaggaggacatagaggtgtggactt

SEQ ID NO: 42174 - DNA, 517 bp, Homo sapiens
gcacccccctctttttctggctcctctaggggcaccaggcagctgtcagggccctggcatgcaaggctgtgcccaagggaagcggacatcatggagctaattaaaccaacgtggacccaagtgcctggaattcaggaggctgtcctctcccacccaccccaacagagccccgcagacgctggagtgagttagtttgaccttctggattgatgcagttaatgagatggttgtgtaatgctttgtttaacagaactggtttctgggcccggcccaaagctaggctggactctggctggcttccatgccccagccctgcttgctcccttgaggctccctctggccagtgccctctaggggccggggctgatatgtttattgctaactactccgaactcgtctgcctcctctgaggaacccggggacaattcctctgacctttccctgcaagctccatctctgtgaaacttggtctcacaagctagcctttcttgcttggagaatctgtgtttgaagtcag

SEQ ID NO: 42175 - DNA, 334 bp, Homo sapiens
ccctggttccaggcctttaagaagtggcaccaacgcctggcagccaggagcccaaggagaggagctgccagtagcccaagaccctggagcaagccaggccccaagggccccgagagtggacaggaagccgccggagcaccgcggggttgggggcttggggcagagcatggggcccagctgcagctgtgacttgttctcatagaataaaaaacagaactgaacttagccttcccagggaaggaaccatgccccacacatccagggagtgatgacagaggggacagcttgaagagctctgaaggacaataaaacccactcctcagtcctaaaagct

SEQ ID NO: 42176 - DNA, 334 bp, Homo sapiens
tgatccacctgcctcggcctcccaaagtgctgggattacaggagtgagccaccatgcccggccccagatctgttttttgaagttcacatcaggtaattctggaactcacaacttgactgacactggacctgaatttagaaattggaaatgtttgatgatcaagtgttgccgatctaaaccttattgaattcattcagttctgcagttcttattggcaagtacctctgctttccattttacattagccagatggcaagatgaacttactctattatacttacaagccagccagtgatattcaaagactagcatccatccatccagatatcacatt

SEQ ID NO: 42177 - DNA, 374 bp, Homo sapiens
cccttcagaaacccagaatcagctcccttttctcccttcccttcttcttaaaatgaatgacttcttttctcctgtgcaaaatgaaggccctgcggctgggcacagtggctcacgcctgtaatcccagcactttgggaggccaaggcgggcgaatcacaaggtcaggagcttgcgaccagcctggccaatgtggtgaaaccccgtctctactgaaaatacaaaaattagcctggcgtggtggtgcacgcttgtaatcccagctactcgggaggctgaggcaggagaattgcttgaacccaggaagcagaggttgcagtgtgctgagtttgcaccactgcactccagcctgggtgacagagtaagactccatctca

SEQ ID NO: 42178 - DNA, 402 bp, Homo sapiens
gacatatgaatccctgaataaaatattttgagcaaaatggcactgtaacagaagtaataattcagtttatttttttacagttttatgtcgggattcatatataattacccacctaataaaaggagctattaggttgtaaagatcctatcccttccatgctcttttaaaattatgacctactcaagcttgaaatcaaaggcagagctgaaaggaataattcagctgaaactctctcattgggttttcaagtcacctaactgataaatatgcaaactagctcccttttggcgattcagctgcataaacagggattaactccaaatgcagctgaaaattcagaaactaaaatgctgcatacaaaatgttcttaattttagctagttccaagctgtagataaacat

SEQ ID NO: 42179 - DNA, 560 bp, Homo sapiens
aaccctatgtttccttcactagctccaggtctcttctttggcctcttgaacctggtgccatccctactgaagttaacagaggtctggcccaacctaagggcatcattttttaaagtcccatggaaaaaactcccagcagagttcagcatctgggaacggttggcaggccccacaggaaccacagcttctgcctttatgatgctgagaaacacttcactgttgacttcccccatctaagggggccagagctaaattttgggcagctgtgtttatcctgggggtccacatatttgcatcattctttcttctcatcgtgatgttctaccttgttggtactgttctcttccttctttgtgtgagttcctgttgtgagcttccccttgttcactgaggtaatgtagccaaacaaggttaaaaagcccccagtaagccgggtgcggtggctcatgcccgtaatctcagcactttgggaggccgaggcgggcagatcacctgaggtcgagagtttaagaccagcctgaccaacatggagaaaccccgtctctactaaaaatacaaaa

SEQ ID NO: 42180 - DNA, 377 bp, Homo sapiens
attctagcaagttgatgttattggtatctggtgttaaggcagtgccgaatggagggcaggaaacacatttttaaatatttatggatttatgtatttttctcataaagacagggtctccctatgattcccaggctctccttgaacgcctaggctcaagtgatcctcccacctcagcctcccaaagtgctgggattacaggtgtgagccaccagattatatttatttctattcgctgtatttaattcttaaccccatgtttattttacataacttccctatttctcaaaaagaatttaaggcctattctcaaaataatgtaagtttatgggtattaaatattaaaatagtattagtccaattttaaaagcggcaaaaaa

SEQ ID NO: 42181 - DNA, 792 bp, Homo sapiens
tgcctcagccttccaaagtgttgggattataggcgggatagccattgcacctggccctgttagtgtcttctatttgttgagctcttgatcgttcacaaagccccttcataactgttaccccagaaaaattccacccattttgcagatgagaaaactggagctttgagggcactttctcagggtcacaagctagtacgaggcaaagctgagtctcaaaagccttttcccctgactccagagctcccacccactgatgaagcttttcccctgacagagctggggcttgaggtgtgaccctggatgaacctcttctctctctccccgttgtactcatcagttctgccagtaaaaattctcctctatgacctggaaagcggggttgtggcctttctttaggtagtgagttggtgttttgggtttgctttttatttttgaatcagtgacaaataacctttctggctggttgaatggcttcaggttctggaattcttgctttgttctaaatgtcaatagtatagcagaaatattaataataaataatacaatataaataataatagcaaaaacacacaggcagttcaaaaacagagaattaaaatgttatgctaaaaaatatttatttccccactgcttaatttgactggctttgaaaagaaaagtaggctgggcaaggtggctcatgcctgtaacacagcactttgggaggccaaagctggaatattgcttgagcccaggagtttgaggctgcagtgagctatgattgcaccactgtactccagcctgggtgacaga

SEQ ID NO: 42182 - DNA, 493 bp, Homo sapiens
tgcgcagggaacactctgaatcacactgtgatagccacaggacaagtctcagggcaaatggtgtggcacgccacacagacactgatcgtctaacgtgtaagcagccggcaggcacagaacagcccgtgagcctgctcagggagtcccagccggcttgtcctctcagctgctctgaccattcaaggcagatatgacaacatttccgaggcagaattttgttaccgtctatttggcataggcaactggaaatcctccaaaatccagttgccaggcatggaaccagttaggtggcaagcatcagaaccattgggagccatccctggaagtgccagctatgggctttcctggattctccaaccatgtcctcacaagcgtgaagcctgcctctaaaatatttcagccaatccgtatatcttgaaattgagtattatgaattttaccctttttaaaaatagccatcatgctaaagagcaagccatcaatttcaccactt

SEQ ID NO: 42183 - DNA, 2202 bp, Homo sapiens
  misc_feature (174)..(174): n is a, c, g, or t
agagcaaggaagggcaggggacctgggaaggaagttctggaaggcagtggggtttgagattggacccagggtcaagatagaacatgaaggtgggatgaggacatgaacagaacatggccaagaaggatctgggggagcagccaggacgaggcggagctgatccgagaggacatncagggggctctgcacaattaccgctcgggccgcggggagcgcagggcggcggcgctcagggccacgcaggaggagttgcagcgcgaccgctcgcccgccgctgagaccccgcccctgcagcgccgcccgtcagtccgcgcagtgatcagcaccgtagagcggggcgcgggccgcggacgaccccaggcgaagcccattcccgaggcagaggaggcgcagaggcctgagccggtggggacctcgagcaacgctgactcggcctccccggacctgggtccccggggtcctgacctggcggttctgcaggcggagcgggaagtggacatcctgaaccacgtgttcgacgacgtagagagctttgtatcgaggctgcagaagtcggcggaggcggccagggtgctggagcaccgggaacgcggccgcaggagccggcgccgggcggctggggagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatatgtgccctacaacatcctgacaccctaccccggaccccggctgcaccacagccaaagccctgcccgcagcctgaacagcactcctcctccaccaccagccccagccccggccccacctccagctctggctcggccccgctgggacaggccccgctgggacagctgcgatagcctcaacggcttggaccccagcgagaaggagaaattctcccagatgctcatcgtcaacgaggaactgcaggcgcgcctggcccagggccgctcgggaccgagccgcgcagtcccagggccccgcgccccggaaccgcagctcagcccgggctcggacgcctccgaggtccgcgcctggctgcaggccaagggctttagctccgggaccgtggacgcgctgggtgtgctgaccggggcgcagcttttctcgctgcagaaggaggagctgcgggcggtgagccccgaggagggggcacgtgtgtacagccaggtcaccgtgcagcgctcgctgctggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcagacccccgagagggtgcagtggagccctgagcattgtaatatgcggcccagcctataaacagcctccgtgcttagca

SEQ ID NO: 42184 - DNA, 2143 bp, Homo sapiens
  misc_feature (586)..(586): n is a, c, g, or t
ggcacgaggccagaacacccctatcttctaggattgacactggctgtcaaactcatccttcaaggtgattcctggcctgccctcctcctccaggcagcctgtcctcctcctccaggcagcctgtcctgaccctcagcagcctctcctggccttggcagagcccctcgtgtcctcccttgcagcacgcatgggaagaaaggccatcgtcctcgccattgctaacaccagccttgcgtttcctctttgccagcacctggtgacgttctgcctgggtgaggacgatggcgtgcataccgtggaggatgcctccaggaagttggccgtcatggatagccagggccgagtctgggcacaggagatgctgctgcgagtgtctcccgaccatgtcacgctgctcgacccggcctccaaggaggagctggagtcgtacccactgggcgccatcgtgcgctgtgacgcggtgatgccacccggcaggagccgctcgttgctgctgctcgtgtgccaggaacccgagcgcgcgcagcccgacgtgcacttcttccagggcctgcgcctcggggcggagctgatccgagaggacatncagggggctctgcacaattaccgctcgggccgcggggagcgcagggcggcggcgctcagggccacgcaggaggagttgcagcgcgaccgctcgcccgccgctgagaccccgcccctgcagcgccgcccgtcagtccgcgcagtgatcagcaccgtagagcggggcgcgggccgcggacgaccccaggcgaagcccattcccgaggcagaggaggcgcagaggcctgagccggtggggacctcgagcaacgctgactcggcctccccggacctgggtccccggggtcctgacctggcggttctgcaggcggagcgggaagtggacatcctgaaccacgtgttcgacgacgtagagagctttgtatcgaggctgcagaagtcggcggaggcggccagggtgctggagcaccgggaacgcggccgcaggagccggcgccgggcggctggggagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcaggtgacccaagcgacacagcagggccgaggctgggaagtccgggggcgcggccggtccgcctggccccgcctgacccgactgtcttacttcctacagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcagacccccgagagggtgcagtggagccctgagcattgtaatatgcggcccagcctataaacagcctccgtgcttagca

SEQ ID NO: 42185 - DNA, 1676 bp, Homo sapiens
aaaaaaaaaaaaaaaaaaaaaaaaaaatcgcggccgcaggagccggcgccgggcggctggggagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatatgtgccctacaacatcctgacaccctaccccggaccccggctgcaccacagccaaagccctgcccgcagcctgaacagcactcctcctccaccaccagccccagccccggccccacctccagctctggctcggccccgctgggacaggccccgctgggacagctgcgatagcctcaacggcttggaccccagcgagaaggagaaattctcccagatgctcatcgtcaacgaggaactgcaggcgcgcctggcccagggccgctcgggaccgagccgcgcagtcccagggccccgcgccccggaaccgcagctcagcccgggctcggacgcctccgaggtccgcgcctggctgcaggccaagggctttagctccgggaccgtggacgcgctgggtgtgctgaccggggcgcagcttttctcgctgcagaaggaggagctgcgggcggtgagccccgaggagggggcacgtgtgtacagccaggtcaccgtgcagcgctcgctgctggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcagacccccgagagggtgcagtggagccctgagcattgtaatatgcggcccagcctataaacagcctccgtgcttagcaaaaggtgtgccaactgctgtcctctacccggcta

SEQ ID NO: 42186 - DNA, 1289 bp, Homo sapiens
gagcaaatagagggcagactggagggaagcaacgtgggaggagacgaaaacaaagcagtgaggctggaggagacaaaggggggtctgggtgagggcccgagcagagggtctcagcagggacagcgtgctgggagctgccggccccacacagggggtgccgcggccctgaagaccccccctctcccctgcacagtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatatgtgccctacaacatcctgacaccctaccccggaccccggctgcaccacagccaaagccctgcccgcagcctgaacagcactcctcctccaccaccagccccagccccggccccacctccagctctggctcggccccgctgggacaggccccgctgggacagctgcgatagcctcaacggcttggaccccagcgagaaggagaaattctcccagatgctcatcgtcaacgaggaactgcaggcgcgcctggcccagggccgctcgggaccgagccgcgcagtcccagggccccgcgccccggaaccgcagctcagcccgggctcggacgcctccgaggtccgcgcctggctgcaggccaagggctttagctccgggaccgtggacgcgctgggtgtgctgaccggggcgcagcttttctcgctgcagaaggaggagctgcgggcggtgagccccgaggagggggcacgtgtgtacagccaggtcaccgtgcagcgctcgctgctggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcagacccccgagagggtgcagtggagccctgagcattgtaatatgcggcccagcctataaacagcctccgtgcttagca

SEQ ID NO: 42187 - DNA, 1242 bp, Homo sapiens
cttgtttcaaatttctattaacagtattaacccggcccctgctgtgcccccagcttggctctaaccccagctcacaccagcaccctgcagcccagagcaatggggctggctgcctccttatctccaaccctcccgcttctcctcagtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatatgtgccctacaacatcctgacaccctaccccggaccccggctgcaccacagccaaagccctgcccgcagcctgaacagcactcctcctccaccaccagccccagccccggccccacctccagctctggctcggccccgctgggacaggccccgctgggacagctgcgatagcctcaacggcttggaccccagcgagaaggagaaattctcccagatgctcatcgtcaacgaggaactgcaggcgcgcctggcccagggccgctcgggaccgagccgcgcagtcccagggccccgcgccccggaaccgcagctcagcccgggctcggacgcctccgaggtccgcgcctggctgcaggccaagggctttagctccgggaccgtggacgcgctgggtgtgctgaccggggcgcagcttttctcgctgcagaaggaggagctgcgggcggtgagccccgaggagggggcacgtgtgtacagccaggtcaccgtgcagcgctcgctgctggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcagacccccgagagggtgcagtggagccctgagcattgtaatatgcggcccagcctataaacagcctccgtgcttagca

SEQ ID NO: 42188 - DNA, 563 bp, Homo sapiens
ccaccaaggtaagtcgcgaccgcaagtgaagtcggaccgtggacgcgctgggtgtgctgaccggggcgcagcttttctcgctgcagaaggaggagctgcgggcggtgagccccgaggagggggcacgtgtgtacagccaggtcaccgtgcagcgctcgctgctggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcagacccccgagagggtgcagtggagccctgagcattgtaatatgcggcccagcctataaacagcctccgtgcttagca

SEQ ID NO: 42189 - DNA, 899 bp, Homo sapiens
aaaaaaaaaaaaaaaaaaaaaaaaaaatcgcggccgcaggagccggcgccgggcggctggggagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatatgtgccctacaacatcctgacaccctaccccggaccccggctgcaccacagccaaagccctgcccgcagcctgaacagcactcctcctccaccaccagccccagcccggtgttcctcgttgacgatgagcatctgggagaatttctccttctcgctggggt

SEQ ID NO: 42190 - DNA, 719 bp, Homo sapiens
aaaaaaaaaaaaaaaaaaaaaaaaaaatcgcggccgcaggagccggcgccgggcggctggggagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcagcaaagcgccccccaggtcgctgtcaatgggtgagtgtccgccccagggcagggcaagggggtcaaggaggggtgcgtcccgggggctcccgatgctgactccgccccctttttttctgtgtttttccttctgtcttcctggctcttctcaggtgggtgagatggtgatggggcgggccggggctgggagagagggaggagca

SEQ ID NO: 42191 - DNA, 1830 bp, Homo sapiens
gatctcttccaaatgtccccgctctccccaggctctcccctcccgccacttgccagggctgacctcaccgccatcttaaccgggtgtccacctctctctgcctgcctggtgctggccccgcgtccccatcgccgcgcccgtctgctcccctcagagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcaggtgacccaagcgacacagcagggccgaggctgggaagtccgggggcgcggccggtccgcctggccccgcctgacccgactgtcttacttcctacagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatatgtgccctacaacatcctgacaccctaccccggaccccggctgcaccacagccaaagccctgcccgcagcctgaacagcactcctcctccaccaccagccccagccccggccccacctccagctctggctcggccccgctgggacaggccccgctgggacagctgcgatagcctcaacggcttggaccccagcgagaaggagaaattctcccagatgctcatcgtcaacgaggaactgcaggcgcgcctggcccagggccgctcgggaccgagccgcgcagtcccagggccccgcgccccggaaccgcagctcagcccgggctcggacgcctccgaggtccgcgcctggctgcaggccaagggctttagctccgggaccgtggacgcgctgggtgtgctgaccggggcgcagcttttctcgctgcagaaggaggagctgcgggcggtgagccccgaggagggggcacgtgtgtacagccaggtcaccgtgcagcgctcgctgctggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcagacccccgagagggtgcagtggagccctgagcattgtaatatgcggcccagcctataaacagcctccgtgcttagca

SEQ ID NO: 42192 - DNA, 1642 bp, Homo sapiens
aaaaaaaaaaaaaaaaaaaaaaaaaaatcgcggccgcaggagccggcgccgggcggctggggagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatatgtgccctacaacatcctgacaccctaccccggaccccggctgcaccacagccaaagccctgcccgcagcctgaacagcactcctcctccaccaccagccccagccccggccccacctccagctctggctcggccccgctgggacaggccccgctgggacagctgcgatagcctcaacggcttggaccccagcgagaaggagaaattctcccagatgctcatcgtcaacgaggaactgcaggcgcgcctggcccagggccgctcgggaccgagccgcgcagtcccagggccccgcgccccggaaccgcagctcagcccgggctcggacgcctccgaggtccgcgcctggctgcaggccaagggctttagctccgggaccgtggacgcgctgggtgtgctgaccggggcgcagcttttctcgctgcagaaggaggagctgcgggcggtgagccccgaggagggggcacgtgtgtacagccaggtcaccgtgcagcgctcgctgctggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcagacccccgagagggtgcagtggagccctgagcattgtaatatgcggcccagcctataaacagcctccgtgcttagca

SEQ ID NO: 42193 - DNA, 1868 bp, Homo sapiens
aaaaaaaaaaaaaaaaaaaaaaaaaaatcgcggccgcaggagccggcgccgggcggctggggagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatatgtgccctacaacatcctgacaccctaccccggaccccggctgcaccacagccaaagccctgcccgcagcctgaacagcactcctcctccaccaccagccccagccccggccccacctccagctctggctcggccccgctgggacaggccccgctgggacagctgcgatagcctcaacggcttggaccccagcgagaaggagaaattctcccagatgctcatcgtcaacgaggaactgcaggcgcgcctggcccagggccgctcgggaccgagccgcgcagtcccagggccccgcgccccggaaccgcagctcagcccgggctcggacgcctccgaggtccgcgcctggctgcaggccaagggctttagctccgggaccgtggacgcgctgggtgtgctgaccggggcgcagcttttctcgctgcagaaggaggagctgcgggcggtgagccccgaggagggggcacgtgtgtacagccaggtcaccgtgcagcgctcgctgctggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcagacccccgagagggtgcagtggagccctgagcattgtaatatgcggcccagcctataaacagcctccgtgcttagcaaaaaaaaaaaaaaaaaaaaaaaaaaaaaaaaaaaaaaaaaaaaaaaaaaaaaacatacaaaaaataaaagaatagtcaacaaacaaaataagaaactatagataatataaaaatgaaaataaaaaagagatggggtggggcccttgtctttactctctccctctggagtgggcacactatattatttcgccctccccctctttttttgtatgagagggctctttta

SEQ ID NO: 42194 - DNA, 1557 bp, Homo sapiens
aaaaaaaaaaaaaaaaaaaaaaaaaaatcgcggccgcaggagccggcgccgggcggctggggagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcagcaaagcgccccccaggtcgctgtcaatgggcccgcaacagcagtgagctgtcggtcaagcagcgggacgtactggaggtcctggatgacagtcgtaagtggtggaaggttcgggacccagcggggcaggagggatatgtgccctacaacatcctgacaccctaccccggaccccggctgcaccacagccaaagccctgcccgcagcctgaacagcactcctcctccaccaccagccccagccccggccccacctccagctctggctcggccccgctgggacaggccccgctgggacagctgcgatagcctcaacggcttggaccccagcgagaaggagaaattctcccagatgctcatcgtcaacgaggaactgcaggcgcgcctggcccagggccgctcgggaccgagccgcgcagtcccagggccccgcgccccggaaccgcagctcagcccgggctcggacgcctccgaggtccgcgcctggctgcaggccaagggctttagctccgggaccgtggacgcgctgggtgtgctgaccggggcgcagcttttctcgctgcagaaggaggagctgcgggcggtgagccccgaggagggggcacgtgtgtacagccaggtcaccgtgcagcgctcgctgctggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcagacccccgagagggtgcagtggagccctgagcattgtaatatgcggcccagcctataaacagcctccgtgcttagca

SEQ ID NO: 42195 - DNA, 1392 bp, Homo sapiens
aaaaaaaaaaaaaaaaaaaaaaaaaaatcgcggccgcaggagccggcgccgggcggctggggagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatatgtgccctacaacatcctgacaccctaccccggaccccggctgcaccacagccaaagccctgcccgcagcctgaacagcactcctcctccaccaccagccccagccccggccccacctccagctctggctcggccccgctgggacaggccccgctgggacagctgcgatagcctcaacggcttggaccccagcgagaaggagaaattctcccagatgctcatcgtcaacgaggaactgcaggcgcgcctggcccagggccgctcgggaccgagccgcgcagtcccagggccccgcgccccggaaccgcagctcagcccgggctcggacgcctccgaggtccgcgcctggctgcaggccaagggctttagctccgggaccgtggacgcgctgggtgtgctgaccggggcgcagcttttctcgctgcagaaggaggagctgcgggcggtgagccccgaggagggggcacgtgtgtacagccaggtcaccgtgcagcgctcgctgctggaggacaaagagaaagtgtcagagctggaggcagtgatggagaagcaaaagaagaaggtggaaggcgaggtggacatcccagctggctagtttgtttccgggtgataagcaatcatctgtgagttttgtttgtccccgaagtatgtagt

SEQ ID NO: 42196 - DNA, 438 bp, Homo sapiens
aaaaaaaaaaaaaaaaaaaaaaaaaaatcgcggccgcaggagccggcgccgggcggctggggagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtcccacggaggagggacccccacgagagagcatccacccacagagagagcgtg

SEQ ID NO: 42197 - DNA, 438 bp, Homo sapiens
atcaagagaaaggtggagggcctaaaaactaaaaaaaaaaaaaaaaaaagaaagtaaatgctgtttagtgtgttgtagatactgagaaataagatgtctttgcaaatgtatttaggagggaagcactggagcgagacttagacaaggtacctagaatataaacaaaagaattttatatttcaggtctttaaatggagttcgtagctgatttcttttttcttttttagacagagtcttgctctgtcacccaggctggagtgccgtggtacattcttggctcactgcaacctccgcctcctggattcaagcaattctcttcccccagctacttgggaggctgaggcaggagaatggcgtgaacccgggaggcagagcttgcagtgagcccagatagcgccactgcagtccagcctggatgaaagagcgagctccgtctca

SEQ ID NO: 42198 - DNA, 455 bp, Homo sapiens
ataacttgacacagagatgactgtgaactgcataaatacatcccactaaacccaaacaaaatgtggacccaattcgacttccccctagctatatctcaaaagcactttcaagtccaatgtcatcaaacccaaacagaaatgtgacagcagggaagtcagaatgagaaagaaaaacattaaaggattgcttaaaatcttcttccaattttaccagttatgatcccatgaaggcccagctacgtatactgctagggctcctccagggccctggaaagtgctgggtgggccctggcaatatattcaaaaacggcaaggaatgcgttgtacaagtcaggggccctggggctggagcttcattagcttcacaataaatctgcctctgtggtccctattattattcattatttatctcagtctgtacatgtctggtctctccaaataaatttcaaatcctt

SEQ ID NO: 42199 - DNA, 1390 bp, Homo sapiens
tgttttgattgtgtaaagagtagagtgctgatttgtgtgttacagagggtggtctgtacaagtcataaagctcgacatggccttgcttcctgctaggtgttaggacacccatgatggtggagtctcttggcattctgtgtaattagataaggctgtttatagcattggtccatgagaacttccttgtttctatttaaaatgaaaatcattgtataagtaaaacttcttaaatgtagatagaaatagaattttaactgaaattttatgaagccattggccgcagggatgtgtgtcatggaggagggctccatacttttttggtatacttatctcaaacttaattcatttgcatactgctttttctctaagtgccaactgtcctagtatattttctaagtcaacttttactttcactttatcctaagcaagaatatctttggcatcacagactcagtaagcccgtttttttctaatgcacatacaaataaataaaatgcacaacttttaacataaatggctgcctccaatttgggaaatactgttctggccagaggccgttgctctgataatgtcatgtggttagtgcattttaggaagacctcctttccctttggttgactcctgcaggacataagatatcagtgacgttatcctttgttgagccatcctggtttgagtcaggatgagtgttgagagtttttggggagttgcccctgtgtcctatattattttatcctcttaaattctgatggtctttggctccactgactccaggtaagttggggtgacagtgcagcatatttctattttctagttgtttctggccagacatggggaaggtcaagacatcttgttcatgcaaacggattgatggccattcctaatctgattttattagtgtattttaggaagtaaagtaagattcttgagcccagctgaacttcccctattgaattttctaacaaaaagagagtttgcgtatgggtttataattgagcctgctcttgtagaaatgttttatcagaattgaaatcctctctgatccccaaattctagagacaaagttgttttctgaatttgagaaatctgttcagttcacaaggaaaggtgacaatgtgtcatttggatgttgtcccacacgtgaggcctcgttgggtgcttgtggtgggagggaccctccaggcaggctttgtatggagggttttcatgtctggacacatttctgttccgagaagcactgctgcgtttttgggagcgtggaccctggccagagcctgtggccagctctgcctgccctccctttcttggcctgctcttttgagtatgtagtggggctttgtgtggcatcctgccaggttaaagctgcatggtgcttaggatagagctggtg

SEQ ID NO: 42200 - DNA, 629 bp, Homo sapiens
  misc_feature (15)..(15): n is a, c, g, or t
  misc_feature (32)..(32): n is a, c, g, or t
  misc_feature (37)..(37): n is a, c, g, or t
  misc_feature (40)..(40): n is a, c, g, or t
aatggatggcccccnacctccggcccacgggnccccnganccgcccccggcctggcctccagttaaactccctctggccacatacctaaattaatcctgcactacgacagtatcctgcttttgtataactagaaatttcagttaataatgccctgaattgacttcctcatagctcttaaaacttctggttatatgtgtcaagatgaatattttgataaaagaataagtaaagcatcatgttcaggaaagtaagtgttgcagaagaaatgagcaatgatatggtctgatgtcctctacatttgatatatactatatatcaatttgatatatagtatgtatctgattgtagttaactccaggagattttccccttatcttagagtttgaaccatatagtgaccatgtattatcgaagaaaaatgaagggtatttccccttacaaaaagaaaaaggagtaaagatcataagcaggaagttcatggacacactaacaaaaataaatgaaatagtaattataatcataattgtttatacattacaatgtgtttcaccattttcaatatttaagtttttcccacactttgaatgttttctgaatttattttgaatcttttattactaaaaaaaaa

SEQ ID NO: 42201 - DNA, 804 bp, Homo sapiens
ttccaatggcttttgatggcagctggtattcttctcaccctcaggtatacctcagactgagtttcctttgagtcaggaaatactgagcccacattgacattcacattcacattcacaggaaatctcagtgcccacattcaactgagccatgtaatgggcaccccgcttttggactgactgggaattgattgtcctaactctgaccactggtctctgatctgcctggtcttgcttcagttaaactccctctggccacatacctaaattaatcctgcactacgacagtatcctgcttttgtataactagaaatttcagttaataatgccctgaattgacttcctcatagctcttaaaacttctggttatatgtgtcaagatgaatattttgataaaagaataagtaaagcatcatgttcaggaaagtaagtgttgcagaagaaatgagcaatgatatggtctgatgtcctctacatttgatatatactatatatcaatttgatatatagtatgtatctgattgtagttaactccaggagattttccccttatcttagagtttgaaccatatagtgaccatgtattatcgaagaaaaatgaagggtatttccccttacaaaaagaaaaaggagtaaagatcataagcaggaagttcatggacacactaacaaaaataaatgaaatagtaattataatcataattgtttatacattacaatgtgtttcaccattttcaatatttaagtttttcccacactttgaatgttttctgaatttattttgaatcttttattactaaaaaaaaa

SEQ ID NO: 42202 - DNA, 496 bp, Homo sapiens
agctatttgatggcagtttgggttaagtgatttctgagactttcccatagattctttgaatttaaatgagaagcctgataaaaattccaagttaaagatacccaggaaatctacaacagatcaagcttgtttttttgtttgtttgtttgttagtttgtttttgagatggagtcccgctctgtcacccaggctgaagtgcagtggtgcaatcttggctcactgcaaccgccacctcccgggttcaagcgatcctcttgcctcagcctcctgactagctggaattacaggcacatgctaccacacctggctaatttttgtatttttcagtagagacgggatttcaccatgttggtcaggctggtctcgaactccagacctcatgatccgcccgcctttgcctcccaaagtgttgggattacaggcgtgagccactgcgccaggctgatcaagcttgttttttagatacaatatgtgaatttagcctaagccatacgtt

SEQ ID NO: 42203 - DNA, 1198 bp, Homo sapiens
agggtggagtgcaggcttggaaagcaggagagctcagcctacgtctttaatcctcctgcccaccccttggattctgtctccactgggactcaagagaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagttacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtgaa

SEQ ID NO: 42204 - DNA, 1182 bp, Homo sapiens
caacccagcctacctgctgtagctgccgccactgccgtctccgccgccactgggcccccagagccccagccccagagcctaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagttacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtgaa

SEQ ID NO: 42205 - DNA, 420 bp, Homo sapiens
gctcggtacccgtggacatttccacgagtcaccccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtgaa

SEQ ID NO: 42206 - DNA, 1281 bp, Homo sapiens
  misc_feature (4)..(4): n is a, c, g, or t
  misc_feature (6)..(6): n is a, c, g, or t
  misc_feature (8)..(8): n is a, c, g, or t
  misc_feature (12)..(12): n is a, c, g, or t
cccncncntccntgctccacacctggtcaggggagagaggggaggaaagccaagggaagggacctaactgaaaacaaacaagctgggagaagcaggaatctgcgctcgggttccgcagatgcagaggttgaggtggctgcgggactggaagtcatcgggcagaggtctcacagcagccaaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagttacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtgaa

SEQ ID NO: 42207 - DNA, 1809 bp, Homo sapiens
caacccagcctacctgctgtagctgccgccactgccgtctccgccgccactgggcccccagagccccagccccagagcctaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagttacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtgaaaaaacaaaaaacacaaaaaaaaaaaaaaaaaaaaaaaaaaaaaaaaaaaaaaaaaaacagaaaaaaaacaacaaccaacgaccaacaagcaagaaaaaccacacaagcaagacgacgtgggtggggggcggaggccgcccacccagaagcaggaaataacacacaggaggggcgggggcggccgccaccaaagtaataaaaagcacgaccgctccgttggtacaaacacagtgcgcccggagagagggaggggcggtgggcccaccacaaaaaaaagagcggggggggggaaggacgggtgtgacaaaccaccacaggggtgaggatgcgagcagagttttggcttacaaaaccggcgcgcgccccctttccccccgcccggcggcgggggtcgtaaaaacgaagcaaagaaagaaaaacaaacagaagagcaaaaaaagaagaagtgaacaaacgaacaacccacagcaaacagtaaaccaaagacgggaacgaacaacaaacgaagaaacaacagacggacacaaaaaagagaagacgacaacaggagtgtaaagaaacagaaacgaaagaaaacaaagagaaccgaaaaggagagaaggaaggagacaggaaagaacagcacgc

SEQ ID NO: 42208 - DNA, 410 bp, Homo sapiens
aacccacctctgagaagtagtagctaaggctaagatcacaggccttggattaggcataccttacattagcctcccatctctgccatagatgcatataaatcatttactacaattatggcacattgtgagaactcagcaagtggtagcttttcactaggatctctgggtacatagcagatttaagttgactaaggcaaacactcatcttccagttgttcatagtcagattgtcatgccttgataagttcatgtcctgactgggcctgggagatgctggccatcctgctcatacagcaccagggcttctgccatggagttgtgccaattccctcttcttgcctcctacagaaaatctatctttccatttatttagcctctgctctgttcctttcagctcagtaccactaggt

SEQ ID NO: 42209 - DNA, 404 bp, Homo sapiens
taaagttacagataacagaattatatggtctaacatgcagctcacttaggcagtcctacctttccaaatgttttcttcaatgccatattcccagggaaaattgctgctgggtagttgaaactaggtgcctcactggacttcttcctattatttgggcaacttgtaaaagcttacaaactttctagaaagtagccctgaaaacagttccttcgttatgtttttagcaataccacagaatacatggttctatgttatagcttagaattgctactactcttacaaaattggaacatagaaaagatggacaaaaacctagtataatgtatcattatttccatttcaagatggcgttttgaactcatctcttttccttcccaaaatcctagtgaaattatcataggaat

SEQ ID NO: 42210 - DNA, 172 bp, Homo sapiens
attcatcagcaaaaccagacctgaaccaaagtgaccctattcatattctttgattatctgtcctactgggacatatatggtttgctacagaaatattaatgtatttaattataggatactgccctagatagttcatatatgtggtatatgcaccatactgcttttctaaatt

SEQ ID NO: 42211 - DNA, 404 bp, Homo sapiens
ggatggtctcgatctcttgacttcgtgatctgcctgcctcggcctcctaaagtgctgggattacaggcgtaagcaaccgtgcccggctgtccatctcttttcagatgaagagctcaggttctgaggagtgacttgtcaaaagctgttctacctctcagagccagcccttgtcctcctgctagccagagcaaggtaccacctggaagagatgttcagttacatgggatccagggccagagggaaaatatcagtgcttcctgaggttcgggtccagccacccttcttccaccatttctactgagccttcagttgtaccccttcagtccacttggcgaggcatcacgccctctgggcaggctcagtggggaactatgggagcaggtgctgtgtgccacctctggagg

SEQ ID NO: 42212 - DNA, 411 bp, Homo sapiens
tgcgatggacagacaccctctccgaacactccccgctccctgggctgcattgagagggcctgcagtcagtctccaaagcgctttgtgcgctgggaatgttgaaagaaggcaagatgatggagaagcttctgcgtgaagcgcgttcgtgcgcgcgactttcccaaatctacttctgtgcacctgcttttcttccctgtgcgagtgtgtcactctgacccatttaatctgttggattaaaaatccctggaaaaggttcagctgccctcggaccctcgagttcagcccacagccgggctccactggacctgtcgagttgggggaccagcgccacgttgggacgcggctgcctgggacgctgagtctcgacgtggcgcgcagatggcccggacagaccagggctgttctcaattg

SEQ ID NO: 42213 - DNA, 649 bp, Homo sapiens
gttttgtttgaggcaatgtcttactctgtcacccagactggagtgcagtggtgctactacagttcactgcagtctcaatctctcaagctcaagcgagcctcctgccttagcctcctgagtagctgggaccacaggcacatgccaccacaggcacatgccaccacacccaggtcatttttaaaaatttttggtagagatgaagcctcactgtattgcctaggctaatctcgaactcctgtgctcaagcaatcctcccaccttggcctcccaaagtgctgggattacaggtgtgagccactgcaccgggcccaaagtacattttttacacctgattggattttgttctagttggcctatccactatgtggtatgagtatacttcctgggtaatgagaatggcaaacacttgtgattacctagttgtcaagatgattactaattctaacctagcattctaatctagagttcgtttctagattagaattagtaatcaagtcacagtgaaagaaaaaaagagtttctgggaaggcagaaggaaaaattggtaaattcacttttactgtttacatattgacttgtttttcttaatgttaactgcagaatttgtttcgtcatccaaggtgcaaataaaagtcctgagagtttaatt

SEQ ID NO: 42214 - DNA, 429 bp, Homo sapiens
agtcagccttgctgtggtggcccacaaggagtggagatgacagagggccttggggacagggcaaaagctcatgtgatagggatgctgtctctgcaaccacatggattttaatagttacccatggctggcttcagctttttttgtgaatggcagccaaaaagtgtggtgaaaatggagggatagttcagtggagacagaggggagactgttgaatttgtggagtttttagttcttcctaaacagagagcaacagacaagagttacagacaaattaattcttttcgttaatttaccctcaactactggccaagaaggggtgtaactcagaatgttttcttcttttgtgccctgagtagcagacccagagtctggagacccagattctaggcctggcttggccaacgacaagcagggtgaccttgggttaaa

SEQ ID NO: 42215 - DNA, 334 bp, Homo sapiens
agtagagatggggtttcatcgtgtcagccaggatggtctcgatcacctgacttcatgatctgcctgacttagcctcccaaagttctgggattacaggggtgagccaccgtgcccagccaaggccagccaatttttgtattttttgtagagacggggtcttgccatgttgcccgggctggtctggaactcctgggctcaagcgattcatctgcctctgcctcctaaagtactgggattacaggcataagccatctagcccagcccagagataggatatttaaagaggtcattaaggttaaatgaggtcatcagggcgggccctaatccaatatac

SEQ ID NO: 42216 - DNA, 537 bp, Homo sapiens
gttatattcatgcagattctgaggttcagggtatcaaagtatgatgagactatcatcccatactaaaaataaaaaagacaaaatcgaatggattgttaagcatagcaaaggaagtacagtctcttggagcagaccgctaatttatatagagtctcacggaagtgtgaagttcagtgactggcgaagttgcagaggcttaagagcttcaacatcatccgcagaggtgtgggtacacagatgaggctattggtaattggttgtcactatagtgtatttattgaggtgagtctgtgattggctggctttcagaagtaagcagctaatgctgattgtaaacaacttgtaaaagctcttcaccaaagcaaattgttgttgctggcttgaccaggttccaaactggttctgagtgccacttattgatatggctatagggcaaccaggcctttccaagggggtgggaatttattttcttccccattcagctttactggtagtaaagctggcactgtccttttatcatcttcaggctccttgtgc

SEQ ID NO: 42217 - DNA, 463 bp, Homo sapiens
gactctctaaacacagggggagttcacacacacacacacacacacacacacacacacacacacacactgatagagccctacacacacacacaaccacaaggctgctggagggatctgacagcacctggcactgtgggcacagagcagaggcttggtaaggaccagcatccctatatgatgagtagggctcttcttgaagccttagctttggtgaccaggactccgcaggggagagattgaggccaagtattcccacctcctaaaaagagtctagattaattggggccacatatctttgattaaagatccaagggcttttgaacgatgagactaggccaggcatagtgggtttatgtgtctaatcccagcactttgagaggctgaggtgggtggatcacctgaggtaggaagttcgagaccagcctgaccaacatggagatacctgcgtgctgctgactaaaaa

SEQ ID NO: 42218 - DNA, 141 bp, Homo sapiens
gggggtgtccaacctgtatagcccatgggttgtgtctagaattaagtggagggcagctatctggagttaacttgcaagcatattggtgccctccatgaccacctctggcttaggacttggccctgttatgagctgtgcccc

SEQ ID NO: 42219 - DNA, 422 bp, Homo sapiens
caggagaactgcttgaacctgggaggtggaggttgcagtgagccgagatcacgccactgcactccagcctggacaacagagtgagactccgtttaaaaaaattctgtgctctctctctgtctctgtctccctttgtgtctctgtctcgctctcactttcactctcccatccaggttctgaaagcaggtgggctgaggtggagggagcggagggtggaccctctgaggcccccaggggccggcagggctgggcggggtggggagtgggggctgccacagaccacggttctgcagaggccaaaatagcactaaagggaagtgggcagttttcatatgaacaacgattgccaagagctggcttcggggaagttctcggggctgggctggaggagctacagtgtctgaatcccgcctggaaggacg

SEQ ID NO: 42220 - DNA, 380 bp, Homo sapiens
ctacaatcatttatatctgcttgtaaaacctttttttaaaaaacttgcttactagacacagcacatgttcattttagaaaatgtagaaaaatcagataagcagccgggcatgatgactcatgcctgtaatctcagcactttgggaggccaaggcaggcagatcacctgaggtcaggagttcgagaccagcctggccaacatggtgaaaccccatctctactaaaaatacaaaaattatctgggtgtggtggtgcgtacctgtagtctcagttacctgggaggctgaggtgggagaatcacttgaacccaggaggtggaggttccagtgagccgagatcatgccactgtactccaacctacgtgacagagtgagaccctgt

SEQ ID NO: 42221 - DNA, 374 bp, Homo sapiens
gaactcctggcttcaagtaatcctcccaccttggcctcccaaagcactaggattacaggtgtgcactgccatgcctggcagaattaaaatatttatataaatgaaggaggaggtactatataaaacattagtttcattaaagtgcccttttgtttgcagccattcaaaataaaatgctatacaaaggtgtttcaaggactccacagtgtgctttctgtaaacaagattatatacaatagttcagtataggattttattgccttaggataactgctgagaatgacagcaacagaataaaaataactatgggtgacaagatgtttttggacatttctcattattagaattagaaacttagtagattagtcaaattt

SEQ ID NO: 42222 - DNA, 462 bp, Homo sapiens
gttgagccctggagactgtcaggtcgtacgactgcaattcttctcagattcactctcttcctcattgttcttgttctgtaaatgactaagagagaccagagaccagacctccccacttccaatcactggttttgttgtagatgaactgcctcctttgctgtccggtacctaatgtggaccagacggtgctcaagaccctatcactagtacaacctcagtgtggaatgttaaatatgccttgcctggaagaaaaagaccaacttgactaatcagatcatcataactatgcatgaagtcttccacagaaagatgatgaaattttgttacacttccctaacctttgtctaaataagcattcccaaacatctacactttggaacactgacttctgttctttgagatgggtgcttcccaggtggcccatcctcaaactttttgcttgaataaactctctaaactaga

SEQ ID NO: 42223 - DNA, 281 bp, Homo sapiens
tggattttcactgggggaaacagtctctaccctccggggtctgactcagtgcggggagataggtgagcagacatagaatcaacacagagcactaagtgctgtggaagatagaatggacacttatctttttgtctgaccagcaacccccatccttcttctaagaacagctcccctgagtatttctcctttcctgcttccagtctgtggctccgacaggagctgctgtgtccttgcacccctggccctggaacaggcttggactcctgacccaggttgggcca

SEQ ID NO: 42224 - DNA, 468 bp, Homo sapiens
agtctccactggacaggtaagattggcagcagtttattaatgacactcataatctcagtgagagaaacactgcataccattcagggccacatggaggttgcatttgggagcagagcgaaccagtaggagttgtgggaggaaggctttctagtaaccagggagtggggtgcctgtgtttcccgtaagaccatgtgattggtttctttaaataattttacaggctggcaggcagctgaagactgttaggttgatagccgagtggagtacatgtagaccagctgatgggcactagcagagtggggagcccatctcactaagtagggggtatatctggtgagagcaggggagctcttggttagaactttggggccccatgaggctcaaagacatcaaggcagcacatgaatttttaggtatacaagaagttaggacttcaacttatctttttgaatgacccaattcaaccca

SEQ ID NO: 42225 - DNA, 561 bp, Homo sapiens
ttttttgagatggagtcttgctctgtcgcccaggctggagtgcagtgacacgatctccgctcactgcaagctccgcctcccgggttcacgccattctcctgcctcagcctcccgagtagctgggactacaggcactgccacgacgcccggctaattttttgtatttttagtagagacggggtttcaccatgttagccaggatggtcttgatctcctgaactcgtgatccgcccgcctcggcctcccaaagtgctgggattacaagcgtgagccatcgcaccgggccttgccaatattcttgatttcaaaattccttaccattttcaggacattcatcaatcatttgtcctaattattgaaacctagtaaaattctgctattatttttcctactccttattatagtttcttgtattatgtaccttattgtatactatttataattatataaattttagagtttagatagactccaatcagtcattaaagttctgtctgctatgtaataattcctaatttctttatacaacgctcaaaactcagttctcgtaatttcataccc

SEQ ID NO: 42226 - DNA, 1056 bp, Homo sapiens
gtaaatgaatagttaggctcttcagtgtaataatcatggtaaatattctcaatgtgcgaaaatacaaacaaaagactttctctcccagcaaatttagacccacatgaaaatttaagcacaatcattttaaacgaatttaccctggagcttagtggttcgagctcaaggttgaggagcagtctggggacatcagctcttaatatttttcaagttttggagcaagtggtttctaggttctgagtgaagtgaaacagaatctctaggggcatgtggtaaagataatcccatactatgtactgcgtagagttaaagagaagaggcgagagcatgaagataaaccagtacaatcagtcgttcacataccactaactacaatgatactcccgtttgcttcctgtgaagtagttactaataatcactgatgtcgctttttaatttcatacatcctttaactatcttcatataggtattgaaagagtcaacataaaagccacatccattttctaattttgaacaatagttagagaaacctaatatcttctcatatttttgtcttgcttctgtctcatgagttcccaaaatagatatattatctgaatgaagagttcatgggcaaatgtcacacttttcttggtttggctaattatatttctgcttttgcttagaataagattaattttcctattctgctaataaaccacgtgatggcaaaatgccttattctgagaaaagaagcctttggtattttaaagaattgggaagctatttcagataagctatcatatgcatgaagattaatttattcatatgaaatgttcaataaccagaaaagactgttttaaataaaaccatttcacaattaagtttttttttggttatggacagtgatttcttctaagaaacaaagcgtctgtctatatgaagaataactaaaataatggttagcaaatattgattggatccagccaagtgagcagcatttttgagtttacagatgtggtaactttgaactatatttacgtgcttataatgaaaccttacagttggagtaatagc

SEQ ID NO: 42227 - DNA, 587 bp, Homo sapiens
ttaccaaggggcagactggataattgagtaatttaaatacttgggactttgttaaagaagctgttgggggaaggtgagcctgggtgagtggtggagggtgatgtgcagcatctgctgggccttcctgcctcttggtatgactgctcagctcaggagttgggtgctttagggcccctaccatgcagtgcggtgaagccccgcccctgcagtggtttgtgcttgtctgcacgtaggagggaacaagccggctgcagtaccttcggtggcctctgagactcacctcccccacttctgtccatagacaaagctcctggggagccctaagcctctttcctcatgccagcaagcagtcttggaagcaggctggggctgcagtgggagagatgccaagaccagttattcaagggcagtgaggttgccagtcctagcattacacactgtggaccagcacagctgctggctgaatactgcagtcaagattctctgaagggagtcatatcccttccaaacatcttcagtttacttgcagtgagctgagatcgcgccagtgcactccagcctgggcaacagagcgagactccatctca

SEQ ID NO: 42228 - DNA, 349 bp, Homo sapiens
  misc_feature (61)..(61): n is a, c, g, or t
cttactctgtattcaggctggatgatcatggctcactgcagcctccatctcccaggcgcanaattcctcccacctcagcctgggaaacagagtccctgtttaaaaaaaaaaataataataaataaataaaagtggctcatgcctgtaatcctagcactttgggagaccaaggtaagaggatcacttaagcccaagagttcaagactggcctgggtgacatagcaaaacctcgtctcaataaagtgtaagaatatataaaaaaacaaaacaggctaggcctgtagctcacatctgtaattacagcacttggcgaggctgaggtgggcagatggcttgagcccagaagttc

SEQ ID NO: 42229 - DNA, 410 bp, Homo sapiens
tgctagcttatactgcagcttccagctgctttaagtagactgtgagcaagtgattctcattcttgtagattctgccttctcatttctgttctgcctgctgtgctgttgtcctccctaggttattcatacagttaagatattgtattcagttgctgctgagtgtgctcagagatagcttcaaatatgaatttttatctgggagaattccagttctcctcccatttgctcctatgtgtttcttttcttccttttgttctccagagccagttgtacaagtttaaactactgaagtgatcaaactgtagtaccaattatcagcagtatttattcagaggcttttttttttaaaagaaacagagtctcattctgttgcccaggatggaatgcagtggtacaatctttagctcact

SEQ ID NO: 42230 - DNA, 386 bp, Homo sapiens
ggccattatgtgcttactctgtgttaaataccttgataagtacagtgtcctcattatctcatgtgaacttcagggcaacctcgtgagatagtgacagtacactaaccttatagtaacattttatttgatattatttagaagtttttaagttaccactgatgctctaagtcggtctatatctggggaatttcctttgtagcttatattctcagccagtgtcaggcaatgtattcctttaagtgtctcaggccttcctcctgagtccttggtggctgagagtcctggatctggaggcatacctcttgagattagatttcaagtgtgaaacacttactaacaatgtgaccttgagcaaattatttaaccttcctgtaagatgaagatga

SEQ ID NO: 42231 - DNA, 732 bp, Homo sapiens
cttgggttccagcatcctttatcattctgcaaacagattgtcagattttaggctgtcttcccgccaaactcccagctcctctcctcatccattatttttctttttttctaagcttcttatctcccccacggcacaatttcgctttatccaataaggaattgtttttgttactatctcatcccaggaatcactgaatctggagagtgaagggagtgctctgtatgatccagaaaagtctgacttgtaatatggagtcgcagagcatgaactggtcaaggctgatcagctaaatggagtagcccattcctccctgcctgcctcctgcccctcctcttgcctgccccttgcccctccttctgcctgcccagctgctccccaccttgaagccatggaagacatgcaagttttatgcccggaggaagtttatagttctgtttattcttcaggcttccatgtatgggtaaatggggaagcctctagcacttgagactaaacctaaattattttaaggatagattgattgctgtaatataatggtgagtctttctgttcacatttcagccactccttgaccactctcttgtttggcctattagagctgcttaagtgagtccaggctcccttagacaggaagcagaagaaagccaggacagagtgcaggagaaacacccatatagattcttatgattgtaacatctaggatctgtttcatgatactcagagtttaatata

SEQ ID NO: 42232 - DNA, 302 bp, Homo sapiens
tttatctgaacagttcattctttgccttactgtgtaacatccaccatagatagctgcctatgagaatgaatggaaaccatctgtatgtataatgtattcattaactcagtatagtgtaagtagatgcactaatcttttcccaatagatattcttttatttctttgataaggacttgttaagcatttgctatgtactgtgtactcttctgaatgctttagatatgctattaaacaagaataaggatcctgtcgtcatgtagcttatagtctaacagtggaaaaataaattataaagaagtaaa

SEQ ID NO: 42233 - DNA, 142 bp, Homo sapiens
tgctggtgtgagccactgcacccggcttaggatgcatttttcaatattttagtgtttgaataacgggctaacttgagaaaaaaataatttgaatcacacatcacacctgtaatcccagcactttgggaggccgaggcaggtg

SEQ ID NO: 42234 - DNA, 501 bp, Homo sapiens
ctggcaggttggatgactgaggcttagcaaggcaaatccaaggctgtgagaccggattccaggtgcagtgctcttgccgttgcaataaatattcaggtggaggtatttaatgtgggttggagggggtcccatcgctgtggcccctctgctcagctccttctggtgtggagacaagaagggcctctgcaccatgaagaaactcagcatttttttagttcttttttaatttttcagattctgaggcaacgtgatggttacggttcaaaacaaagagagatgactcagcttcctgtggagaagctgcagccttttgcaaatgatctttcagttttaatgcttctctcttcttatccatggaggcagcttgtccaagctgcttgttttcttttttcttttcttttttctcttatttatttatttattgagacagggtctccctctattgcccaggctgcagtgcagtggcatgagcataacttactgcagccttgaattcctggg

SEQ ID NO: 42235 - DNA, 416 bp, Homo sapiens
agaatattaaatgcaatgacggaaaaaggatggaagaacgaaatgaccacggtaatgaacatcagtggcctgctacccctatgtggaaggctgcccgtgacctctgaggtacaccctcgtacccctacctgtgaaaactggactcatggggatgctcaaaaccctaaaaccctcctcactgtacagcaggcatcttcccgggtgccgctcgcattctctaggggctgattttgcatggctctctccactcatctattctgctcgaaccgggtgatgaggaaggtggctctgacctcctctcccactcttcagtggatctatccctgcacccagctggcacagcagatatttgttccttgactttactctggtttggggttttcacccttttttttcaataaatgactcagaagtga

SEQ ID NO: 42236 - DNA, 588 bp, Homo sapiens
ggttttagaaagcagttcaggtgcaaaaaaataaagttcacagttcaaagaaggcctacagtgactacctgctacttggaacatactttgtttctccacaaagctgaaaataatgttgcaatgggaaagaaaacacatcattctggaggatatccaagggggattcaagtgaaaaatggaaccaagaacttactttgcaaagcttcaaggtgacctccttctcaccgtagggcataaaagccaatcagatatatgcatagttacagttcaagcagtacctatactgacaggtcccatatttccaaatggatttcacatttatataacatagtgatggttctatcctattaggctatctaaaaagtctaaaaagaatgagcatgtgccaaatataaatctggttcaacagaatcaaaaaattccttctagggtgcccctgctcttaataaatgactgtgaactatttcattaaaatcactcaggattctggaccaggatttccattgattatgtggtcttacacggttacttaatttgtctaggtctcagtttatctttttttttttaaaggattttatatttgggtaa

SEQ ID NO: 42237 - DNA, 377 bp, Homo sapiens
taaaataaaagggactgcaaatgcccatgacttagatgtgttagagtccagcttctgtttccccccatttggtcctgattttccgaagtgaaggggagacaggactgagtggcatggtggtgagcaacccgtgtgcttagcccagcggctctctggtttgtcattgtggtatccctctctggaccacagtttcctcatctggaaaatgaagatctaaggctaggtgattttaaagtccctttcagctctaaaatattattttacagttgtaggatttatggaggagaacggcattccgctctatcccttgctttagccttttgaatgaaagtgagatgtctcatcagctcagatagagccagctcaagcccagtgtc

SEQ ID NO: 42238 - DNA, 474 bp, Homo sapiens
gacaaagagcagggcactgattgtagcaactagtatatggatcttgcagctactctgtactctaattagccgagacaccctattgacaaggatggccagtgtcttagtgccactggggtgtaatcagtgggaaggcctgaatccctggtcggattttccacaaaacttagtgctcacatggaaccttcccgtggcccagaaacagctataagattgggattaagctgggcatggcagctcatttctgtaatcccactttgggaggccaagttgggtggataatttgagcccaggagttcaagaccagcctgggcaacatagcaaaatcccacttctaccacaaaaacaaaagttagctgcatgtggtggtacgtgcctgtaatcccagctacttcagaggctgaagcaaagagtcgcttgagcctgggagacagaggttacagtgagccaagatcgcaccactgaacgccagcc

SEQ ID NO: 42239 - DNA, 812 bp, Homo sapiens
gacagctttcatcaaacttggctttatccaaactttcagtggtttcccattttgttcatgattaagtccaaatattttagccagtgaaaggccctgtaatttaacccacacctttctaatcttatttctcatcatttttcctattcagtgagattaatgtgtttccctgatccatgcctttgtttgctcctgctgacttgttcttttaattctttctgcctatcagtacccatcatttttgctccagttccgatcccactgctcccagctcccctccacctccaaaaaaaaaacttttattttttgtctgcttgatatttttaccaaattattttttgaattgtatgtatccctcattatagcataatatttttaatgatacagatttaatagtacaaactatgttggagcagtttctgcataaggtatgttttaatttactctaggaatatgaagcacgaacggggaggacctgtaaaccaccacctcagtcttcaagacgcaagaattttgaatttgagccgctttctaccactgccttgattcttgaggatcgaccatcaaatcttcctgccaaatctgtggaagaagctttacgtcaccgacaagaatacgatgagatggtggctgaggctaaaaaacgaggtataaaatttaactccaaatggtataattttctgattttaataagaagatggatggtaaaattcatcaagtctgtcttcaagatgatactgaattcttttttttatttcttttttcgtttcttttttgagtctgggcaacaagagcgaaactccatctcaaaaata

SEQ ID NO: 42240 - DNA, 5252 bp, Homo sapiens
aacgttgcggcggctgtcgccgcggccccagcacccagagctgttctctggccaagcctgcgcctgtagtccttctttgcctcctggggcggccgccacccacccccagatggtgggtccggaggatgccggagcctgctcgggaagaaaccccaagttgctcccggtgcctgcgccggaccccgtgggccaggacaggaaggtaatccgggccacgggcggctttggcggaggcgtcggcgctgtggagccgccggaggaggctgacgaggaggaggagacgccgcctcggcagctccttcagcgttacctcgcggcggccggggagcagctggagccggggctctgctactgtccgctccccgctggccaggccggcgccccgccgccctcggcagccccacgatcggacgcctgcctgctgggctcgggctccaaacaccgcggcgcggaggtggctgatggccgcgcgccgcggcacgaaggcatgaccaacggcgactcgggttttctgccgggccgggactgtcgcgatctggaagaggctcgcgggctggcgcgcgccggcggccgggagtcgcgccgccgccgcccctacggccgccttcgcctggaggggcctggcgacgaggacgcggacggcgcgggaagcccgtccgattgggcctctccgcttgaggacccgctgcggagctgctgcctggtggccgcggacgcccaggagcccgagggcgcgggcagcgactcgggggacagccccgccagcagctgcagcagtagcgaggactcagagcagcggggagtcggcgccgggggtcccgaggagggcgcgccccctgccacctcggccgagaggactaatgggggtgcggagccgcgcctgggcttttctgacattcacttcaactctcgcaacacgttccaggtgagccgcggtcagagcgcccgcgatcacctgcccccggcggggccgccggtgcccttgcccgccgcggagcagggtcctgcgggggcttcggcccgggctcgacggagtggcggcttcgcggacttcttcaccagaaacctttttccaaaaaggacaaaggaactcaaatcagttgtccatagtgctcctggttggaaattatttggtaaagtccctcctagagagaatcttcagaaaacatccaaaatcattcagcaggaatatgaagcacgaacggggaggacctgtaaaccaccacctcagtcttcaagacgcaagaattttgaatttgagccgctttctaccactgccttgattcttgaggatcgaccatcaaatcttcctgccaaatctgtggaagaagctttacgtcaccgacaagaatacgatgagatggtggctgaggctaaaaaacgagaaattaaggaagcacataaaagaaaaagaatcatgaaagaacgatttaagcaggaagaaaatattgcaagtgcaatggtaatttggatcaatgaaatactgcccaattgggaagtaatgcgtagtacaagaagagttcgagaattgtggtggcagggattgccccctagtgtccgtgggaaagtttggagtctagctgtaggaaatgaactaaatatcactcctgaactttatgaaatcttcctctcaagagcaaaagaacggtggaaaagtttcagtgaaacaagttcagagaatgatacagaaggtgtatctgttgctgatcgagaggccagtctggaattaattaagttggacatatcccgtacatttccatctctctacatctttcagaagggtggtccatatcatgatgtcttgcatagtattttaggggcatacacatgctacaggcctgatgttggttatgtccaagggatgtccttcattgcagcagtactcattctcaatttggaagaggcagatgcctttatcgcatttgccaatctcctgaataagccatgccagttggccttttttcgtgtggatcacagcatgatgttgaaatattttgcaacatttgaagtattctttgaagaaaatctttccaaattatttcttcacttcaaatcttacagtcttacaccagatatatacttgatagactggatcttcacactatatagcaaatcactaccacttgatctggcctgtcgagtctgggatgtattttgcagagatggggaagaatttttatttaggactggattaggaatcctccgattatatgaagatattctcctgcagatggactttattcatatagcacagtttctaactaaattgccagaagatatcacatcggaaaagctgttcagttgtattgcagccattcagatgcagaatagcaccaaaaaatggactcaggtctttgcatctgtaatgaaggatattaaagaaggagacaagaacagtagtcctgctttgaaaagctagtcttcaaaattgacagactaactgacatagaaaaagtggtttttggataaaggttttttgtttcctatgtaaaaggcgtggaagaaaatgttggagatacctaaaagaatcaagaggtggaaaactgctgattttacattttatggctgaagtaaatgaaataagtaacttattgacagtattaataaactattattttgtaggtagagtcatttttcaaaggaaaaagtttaagtggtgagtttatattccacaatttggagtaaacaaaatgcaataaatttttaaaatagctttgaagatacttcaaatttttacatcttttcttttgtaacagttaccacaaagatattctggaggctagagtaggattgttaaatactactgttaacctccaaagtactatagtacagacattgtttccagttctgaccttttgaagatattatagaccagtaatgaacagatttggttgtaaattatttaagtcactgaagatgtcatttatcttcattcacaagttggggcaaattcgagttacctaggaactggaaatgttggtgggagattgtttattgtttgtttagatgtttttccatagtatggtgtccatttgttttttaagggaaattttttgtcttccttaaggaattcctatcactcagagaattttagccattctggttctagtctaacaaattattcatctaataatttgacattaagaaaactataaataactggtagaaggaaagtgctttgcacttcagtggattgaagacttgactttgagagtaagtccaaaaacatatatgatgtttctcagtgataagagtaaaaagtaatgaatcctgagagttcttaaacagcatgctacttggcaagacttcatattttttagttacaattcttccactgtttaactccagtttgaaatttgaaatctaatatgtagctaaatctgtgacttgtaaaactctatgcataatttttcctaatcagtggaaataagaataaaagaaaaaggtaaagttaattttttttctaagtctacatcctatctcttgattcagttgcctgaagaagctgggtaaggagattagtcttgttattgattcttttatgtgtcagtgccatcttaatctcttcacatggtacactaaatgctgcctataacccatcctcatcttctttactcatcattgctttcttcaaggaaggtcttgatactgccctcgtctacctcactatccgctagtctagatagtgactctttggaaaattggtagcctctgaatgagttatccaacttctgcttcctcacattggccactttgcataggttcgggaacttagcaggttttaaatcatcatgcccatggaggtgaaatactttgaggaatgggaacatctcttcactgtgtttttggatcagccttctctcaaccgccaagaaatgcatgatttccctgccaactctaggaagtagtgctgcatgattgaatcattatttgatgaattctttcattgtaacatagggagtcattttcaaaaaggtagatatgaacttaaattaaattgacttatgaatgctttgcctgtgggcccaacagtgtcatgaccctccaattgaaacatagcatgaattatttttatgtcgagttcttgaactgctaatcaggtgtgtgtttccttgaagtccagagcaggatccaggtcagatgaaggaggtggtatgcctggcttaactgctgaaaatagagcattgaaactcttcacaatgtgctgcattgggtttctgcttggctttctcactgaaaagtaaattggggaaaatgctgcttttactattttgcattttatagcaacattaacagtcttttcccagtcaggtgctgtccagggaacatgtttcccttgggaggtctgaacagagtgacctggcttgatgtatttcctgagctctagtaccatatcatagaattagttaaatgtagtcaacagcaatgtcagaacaattgacattgtctttccaagagtgaatgcattggctttcggaactgctactagagacatacatgaggcagcgaacacatctttaggtgggggcaaggctatatctgattgacagagatctctgatctctaatgacatattgctattgtcctattatgtttaaatttgaacctaaatcacttgagtgttatgagtgatggctatataacatgctgtttggttagatttacagtgtgtttttatgttgcagtttagtttgaaacaacacttaagcacactatttctgttagtgtatatagttttcaaactaacaagcctgcgatccttgttagtgtagtgactgcctctttaggagtatggggccctagggtgtccatatatttttaccccatgggtcattctagtctaaggactactagtagaaccctcaaaaggtaattgctattatagggacttacttattggagactggtaatataataaaatattgaaggagtggccatggtcttagcaggttttagaatgaccttttaactccagtaactacttccttggtattggtatccttgatagagggaatataacatctggcagtaatctcattcaggttatactacctgactaaatttaatcatactttcatgtatttgtttcctcagttggacctaagttactgtatttgtttttcttatttttttattattgtacagtttctttacctttcaagtataaatgtgtatataaaatgtaaatacaaagaattcactaaaaaccactcataacaattactgtgtaaataaaactggtaagcagagta

SEQ ID NO: 42241 - DNA, 5198 bp, Homo sapiens
aacgttgcggcggctgtcgccgcggccccagcacccagagctgttctctggccaagcctgcgcctgtagtccttctttgcctcctggggcggccgccacccacccccagatggtgggtccggaggatgccggagcctgctcgggaagaaaccccaagttgctcccggtgcctgcgccggaccccgtgggccaggacaggaaggtaatccgggccacgggcggctttggcggaggcgtcggcgctgtggagccgccggaggaggctgacgaggaggaggagacgccgcctcggcagctccttcagcgttacctcgcggcggccggggagcagctggagccggggctctgctactgtccgctccccgctggccaggccggcgccccgccgccctcggcagccccacgatcggacgcctgcctgctgggctcgggctccaaacaccgcggcgcggaggtggctgatggccgcgcgccgcggcacgaaggcatgaccaacggcgactcgggttttctgccgggccgggactgtcgcgatctggaagaggctcgcgggctggcgcgcgccggcggccgggagtcgcgccgccgccgcccctacggccgccttcgcctggaggggcctggcgacgaggacgcggacggcgcgggaagcccgtccgattgggcctctccgcttgaggacccgctgcggagctgctgcctggtggccgcggacgcccaggagcccgagggcgcgggcagcgactcgggggacagccccgccagcagctgcagcagtagcgaggactcagagcagcggggagtcggcgccgggggtcccgaggagggcgcgccccctgccacctcggccgagaggactaatgggggtgcggagccgcgcctgggcttttctgacattcacttcaactctcgcaacacgttccaggtgagccgcggtcagagcgcccgcgatcacctgcccccggcggggccgccggtgcccttgcccgccgcggagcagggtcctgcgggggcttcggcccgggctcgacggagtggcggcttcgcggacttcttcaccagaaacctttttccaaaaaggacaaaggaactcaaatcagttgtccatagtgctcctggttggaaattatttggtaaagtccctcctagagagaatcttcagaaaacatccaaaatcattcagcaggaatatgaagcacgaacggggaggacctgtaaaccaccacctcagtcttcaagacgcaagaattttgaatttgagccgctttctaccactgccttgattcttgaggatcgaccatcaaatcttcctgccaaatctgtggaagaagctttacgtcaccgacaagaatacgatgagatggtggctgaggctaaaaaacgagaaattaaggaagcacataaaagaaaaagaatcatgaaagaacgatttaagcaggaagaaaatattgcaagtgcaatggtaatttggatcaatgaaatactgcccaattgggaagtaatgcgtagtacaagaagagttcgagaattgtggtggcagggattgccccctagtgtccgtgggaaagtttggagtctagctgtaggaaatgaactaaatatcactcctgaactttatgaaatcttcctctcaagagcaaaagaacggtggaaaagtttcagtgaaacaagttcagagaatgatacagaaggtgtatctgttgctgatcgagaggccagtctggaattaattaagttggacatatcccgtacatttccatctctctacatctttcagaagggtggtccatatcatgatgtcttgcatagtattttaggggcatacacatgctacaggcctgatgttggttatgtccaagggatgtccttcattgcagcagtactcattctcaatttggaagaggcagatgcctttatcgcatttgccaatctcctgaataagccatgccagttggccttttttcgtgtggatcacagcatgatgttgaaatattttgcaacatttgaagtattctttgaagaaaatctttccaaattatttcttcacttcaaatcttacagtcttacaccagatatatacttgatagactggatcttcacactatatagcaaatcactaccacttgatctggcctgtcgagtctgggatgtattttgcagagatggggaagaatttttatttaggactggattaggaatcctccgattatatgaagatattctcctgcagatggactttattcatatagcacagtttctaactaaattgccagaagatatcacatcggaaaagctgttcagttgtattgcagccattcagatgcagaatagcaccaaaaaatggactcaggtctttgcatctgtaatgaaggatattaaagaaggagacaagaacagtagtcctgctttgaaaagctagtcttcaaaattgacagactaactgacatagaaaaagtggtttttggataaaggttttttgtttcctatgtaaaaggcgtggaagaaaatgttggagatacctaaaagaatcaagaggtggaaaactgctgattttacattttatggctgaagtaaatgaaataagtaacttattgacagtattaataaactattattttgtaggtagagtcatttttcaaaggaaaaagtttaagtggtgagtttatattccacaatttggagtaaacaaaatgcaataaatttttaaaatagctttgaagatacttcaaatttttacatcttttcttttgtaacagttaccacaaagatattctggaggctagagtaggattgttaaatactactgttaacctccaaagtactatagtacagacattgtttccagttctgaccttttgaagatattatagaccagtaatgaacagatttggttgtaaattatttaagtcactgaagatgtcatttatcttcattcacaagttggggcaaattcgagttacctaggaactggaaatgttggtgggagattgtttattgtttgtttagatgtttttccatagtatggtgtccatttgttttttaagggaaattttttgtcttccttaaggaattcctatcactcagagaattttagccattctggttctagtctaacaaattattcatctaataatttgacattaagaaaactataaataactggtagaaggaaagtgctttgcacttcagtggattgaagacttgactttgagagtaagtccaaaaacatatatgatgtttctcagtgataagagtaaaaagtaatgaatcctgagagttcttaaacagcatgctacttggcaagacttcatattttttagttacaattcttccactgtttaactccagtttgaaatttgaaatctaatatgtagctaaatctgtgacttgtaaaactctatgcataatttttcctaatcagtggaaataagaataaaagaaaaaggtaaagttaattttttttctaagtctacatcctatctcttgattcagttgcctgaagaagctgggtaaggagattagtcttgttattgattcttttatgtgtcagtgccatcttaatctcttcacatggtacactaaatgctgcctataacccatcctcatcttctttactcatcattgctttcttcaaggaaggtcttgatactgccctcgtctacctcactatccgctagtctagatagtgactctttggatttgcataggttcgggaacttagcaggttttaaatcatcatgcccatggaggtgaaatactttgaggaatgggaacatctcttcactgtgtttttggatcagccttctctcaaccgccaagaaatgcatgatttccctgccaactctaggaagtagtgctgcatgattgaatcattatttgatgaattctttcattgtaacatagggagtcattttcaaaaaggtagatatgaacttaaattaaattgacttatgaatgctttgcctgtgggcccaacagtgtcatgaccctccaattgaaacatagcatgaattatttttatgtcgagttcttgaactgctaatcaggtgtgtgtttccttgaagtccagagcaggatccaggtcagatgaaggaggtggtatgcctggcttaactgctgaaaatagagcattgaaactcttcacaatgtgctgcattgggtttctgcttggctttctcactgaaaagtaaattggggaaaatgctgcttttactattttgcattttatagcaacattaacagtcttttcccagtcaggtgctgtccagggaacatgtttcccttgggaggtctgaacagagtgacctggcttgatgtatttcctgagctctagtaccatatcatagaattagttaaatgtagtcaacagcaatgtcagaacaattgacattgtctttccaagagtgaatgcattggctttcggaactgctactagagacatacatgaggcagcgaacacatctttaggtgggggcaaggctatatctgattgacagagatctctgatctctaatgacatattgctattgtcctattatgtttaaatttgaacctaaatcacttgagtgttatgagtgatggctatataacatgctgtttggttagatttacagtgtgtttttatgttgcagtttagtttgaaacaacacttaagcacactatttctgttagtgtatatagttttcaaactaacaagcctgcgatccttgttagtgtagtgactgcctctttaggagtatggggccctagggtgtccatatatttttaccccatgggtcattctagtctaaggactactagtagaaccctcaaaaggtaattgctattatagggacttacttattggagactggtaatataataaaatattgaaggagtggccatggtcttagcaggttttagaatgaccttttaactccagtaactacttccttggtattggtatccttgatagagggaatataacatctggcagtaatctcattcaggttatactacctgactaaatttaatcatactttcatgtatttgtttcctcagttggacctaagttactgtatttgtttttcttatttttttattattgtacagtttctttacctttcaagtataaatgtgtatataaaatgtaaatacaaagaattcactaaaaaccactcataacaattactgtgtaaataaaactggtaagcagagta

SEQ ID NO: 42242 - DNA, 5217 bp, Homo sapiens
aacgttgcggcggctgtcgccgcggccccagcacccagagctgttctctggccaagcctgcgcctgtagtccttctttgcctcctggggcggccgccacccacccccagatggtgggtccggaggatgccggagcctgctcgggaagaaaccccaagttgctcccggtgcctgcgccggaccccgtgggccaggacaggaaggtaatccgggccacgggcggctttggcggaggcgtcggcgctgtggagccgccggaggaggctgacgaggaggaggaggctgacgaggaggaggagacgccgcctcggcagctccttcagcgttacctcgcggcggccggggagcagctggagccggggctctgctactgtccgctccccgctggccaggccggcgccccgccgccctcggcagccccacgatcggacgcctgcctgctgggctcgggctccaaacaccgcggcgcggaggtggctgatggccgcgcgccgcggcacgaaggcatgaccaacggcgactcgggttttctgccgggccgggactgtcgcgatctggaagaggctcgcgggctggcgcgcgccggcggccgggagtcgcgccgccgccgcccctacggccgccttcgcctggaggggcctggcgacgaggacgcggacggcgcgggaagcccgtccgattgggcctctccgcttgaggacccgctgcggagctgctgcctggtggccgcggacgcccaggagcccgagggcgcgggcagcgactcgggggacagccccgccagcagctgcagcagtagcgaggactcagagcagcggggagtcggcgccgggggtcccgaggagggcgcgccccctgccacctcggccgagaggactaatgggggtgcggagccgcgcctgggcttttctgacattcacttcaactctcgcaacacgttccaggtgagccgcggtcagagcgcccgcgatcacctgcccccggcggggccgccggtgcccttgcccgccgcggagcagggtcctgcgggggcttcggcccgggctcgacggagtggcggcttcgcggacttcttcaccagaaacctttttccaaaaaggacaaaggaactcaaatcagttgtccatagtgctcctggttggaaattatttggtaaagtccctcctagagagaatcttcagaaaacatccaaaatcattcagcaggaatatgaagcacgaacggggaggacctgtaaaccaccacctcagtcttcaagacgcaagaattttgaatttgagccgctttctaccactgccttgattcttgaggatcgaccatcaaatcttcctgccaaatctgtggaagaagctttacgtcaccgacaagaatacgatgagatggtggctgaggctaaaaaacgagaaattaaggaagcacataaaagaaaaagaatcatgaaagaacgatttaagcaggaagaaaatattgcaagtgcaatggtaatttggatcaatgaaatactgcccaattgggaagtaatgcgtagtacaagaagagttcgagaattgtggtggcagggattgccccctagtgtccgtgggaaagtttggagtctagctgtaggaaatgaactaaatatcactcctgaactttatgaaatcttcctctcaagagcaaaagaacggtggaaaagtttcagtgaaacaagttcagagaatgatacagaaggtgtatctgttgctgatcgagaggccagtctggaattaattaagttggacatatcccgtacatttccatctctctacatctttcagaagggtggtccatatcatgatgtcttgcatagtattttaggggcatacacatgctacaggcctgatgttggttatgtccaagggatgtccttcattgcagcagtactcattctcaatttggaagaggcagatgcctttatcgcatttgccaatctcctgaataagccatgccagttggccttttttcgtgtggatcacagcatgatgttgaaatattttgcaacatttgaagtattctttgaagaaaatctttccaaattagatcttcacactatatagcaaatcactaccacttgatctggcctgtcgagtctgggatgtattttgcagagatggggaagaatttttatttaggactggattaggaatcctccgattatatgaagatattctcctgcagatggactttattcatatagcacagtttctaactaaattgccagaagatatcacatcggaaaagctgttcagttgtattgcagccattcagatgcagaatagcaccaaaaaatggactcaggtctttgcatctgtaatgaaggatattaaagaaggagacaagaacagtagtcctgctttgaaaagctagtcttcaaaattgacagactaactgacatagaaaaagtggtttttggataaaggttttttgtttcctatgtaaaaggcgtggaagaaaatgttggagatacctaaaagaatcaagaggtggaaaactgctgattttacattttatggctgaagtaaatgaaataagtaacttattgacagtattaataaactattattttgtaggtagagtcatttttcaaaggaaaaagtttaagtggtgagtttatattccacaatttggagtaaacaaaatgcaataaatttttaaaatagctttgaagatacttcaaatttttacatcttttcttttgtaacagttaccacaaagatattctggaggctagagtaggattgttaaatactactgttaacctccaaagtactatagtacagacattgtttccagttctgaccttttgaagatattatagaccagtaatgaacagatttggttgtaaattatttaagtcactgaagatgtcatttatcttcattcacaagttggggcaaattcgagttacctaggaactggaaatgttggtgggagattgtttattgtttgtttagatgtttttccatagtatggtgtccatttgttttttaagggaaattttttgtcttccttaaggaattcctatcactcagagaattttagccattctggttctagtctaacaaattattcatctaataatttgacattaagaaaactataaataactggtagaaggaaagtgctttgcacttcagtggattgaagacttgactttgagagtaagtccaaaaacatatatgatgtttctcagtgataagagtaaaaagtaatgaatcctgagagttcttaaacagcatgctacttggcaagacttcatattttttagttacaattcttccactgtttaactccagtttgaaatttgaaatctaatatgtagctaaatctgtgacttgtaaaactctatgcataatttttcctaatcagtggaaataagaataaaagaaaaaggtaaagttaattttttttctaagtctacatcctatctcttgattcagttgcctgaagaagctgggtaaggagattagtcttgttattgattcttttatgtgtcagtgccatcttaatctcttcacatggtacactaaatgctgcctataacccatcctcatcttctttactcatcattgctttcttcaaggaaggtcttgatactgccctcgtctacctcactatccgctagtctagatagtgactctttggaaaattggtagcctctgaatgagttatccaacttctgcttcctcacattggccactttgcataggttcgggaacttagcaggttttaaatcatcatgcccatggaggtgaaatactttgaggaatgggaacatctcttcactgtgtttttggatcagccttctctcaaccgccaagaaatgcatgatttccctgccaactctaggaagtagtgctgcatgattgaatcattatttgatgaattctttcattgtaacatagggagtcattttcaaaaaggtagatatgaacttaaattaaattgacttatgaatgctttgcctgtgggcccaacagtgtcatgaccctccaattgaaacatagcatgaattatttttatgtcgagttcttgaactgctaatcaggtgtgtgtttccttgaagtccagagcaggatccaggtcagatgaaggaggtggtatgcctggcttaactgctgaaaatagagcattgaaactcttcacaatgtgctgcattgggtttctgcttggctttctcactgaaaagtaaattggggaaaatgctgcttttactattttgcattttatagcaacattaacagtcttttcccagtcaggtgctgtccagggaacatgtttcccttgggaggtctgaacagagtgacctggcttgatgtatttcctgagctctagtaccatatcatagaattagttaaatgtagtcaacagcaatgtcagaacaattgacattgtctttccaagagtgaatgcattggctttcggaactgctactagagacatacatgaggcagcgaacacatctttaggtgggggcaaggctatatctgattgacagagatctctgatctctaatgacatattgctattgtcctattatgtttaaatttgaacctaaatcacttgagtgttatgagtgatggctatataacatgctgtttggttagatttacagtgtgtttttatgttgcagtttagtttgaaacaacacttaagcacactatttctgttagtgtatatagttttcaaactaacaagcctgcgatccttgttagtgtagtgactgcctctttaggagtatggggccctagggtgtccatatatttttaccccatgggtcattctagtctaaggactactagtagaaccctcaaaaggtaattgctattatagggacttacttattggagactggtaatataataaaatattgaaggagtggccatggtcttagcaggttttagaatgaccttttaactccagtaactacttccttggtattggtatccttgatagagggaatataacatctggcagtaatctcattcaggttatactacctgactaaatttaatcatactttcatgtatttgtttcctcagttggacctaagttactgtatttgtttttcttatttttttattattgtacagtttctttacctttcaagtataaatgtgtatataaaatgtaaatacaaagaattcactaaaaaccactcataacaattactgtgtaaataaaactggtaagcagagta

SEQ ID NO: 42243 - DNA, 2937 bp, Homo sapiens
tttgaggattaatctttattttatataattttcaggtctttgcatctgtaatgaaggatattaaagaaggagacaagaacagtagtcctgctttgaaaagctagtcttcaaaattgacagactaactgacatagaaaaagtggtttttggataaaggttttttgtttcctatgtaaaaggcgtggaagaaaatgttggagatacctaaaagaatcaagaggtggaaaactgctgattttacattttatggctgaagtaaatgaaataagtaacttattgacagtattaataaactattattttgtaggtagagtcatttttcaaaggaaaaagtttaagtggtgagtttatattccacaatttggagtaaacaaaatgcaataaatttttaaaatagctttgaagatacttcaaatttttacatcttttcttttgtaacagttaccacaaagatattctggaggctagagtaggattgttaaatactactgttaacctccaaagtactatagtacagacattgtttccagttctgaccttttgaagatattatagaccagtaatgaacagatttggttgtaaattatttaagtcactgaagatgtcatttatcttcattcacaagttggggcaaattcgagttacctaggaactggaaatgttggtgggagattgtttattgtttgtttagatgtttttccatagtatggtgtccatttgttttttaagggaaattttttgtcttccttaaggaattcctatcactcagagaattttagccattctggttctagtctaacaaattattcatctaataatttgacattaagaaaactataaataactggtagaaggaaagtgctttgcacttcagtggattgaagacttgactttgagagtaagtccaaaaacatatatgatgtttctcagtgataagagtaaaaagtaatgaatcctgagagttcttaaacagcatgctacttggcaagacttcatattttttagttacaattcttccactgtttaactccagtttgaaatttgaaatctaatatgtagctaaatctgtgacttgtaaaactctatgcataatttttcctaatcagtggaaataagaataaaagaaaaaggtaaagttaattttttttctaagtctacatcctatctcttgattcagttgcctgaagaagctgggtaaggagattagtcttgttattgattcttttatgtgtcagtgccatcttaatctcttcacatggtacactaaatgctgcctataacccatcctcatcttctttactcatcattgctttcttcaaggaaggtcttgatactgccctcgtctacctcactatccgctagtctagatagtgactctttggaaaattggtagcctctgaatgagttatccaacttctgcttcctcacattggccactttgcataggttcgggaacttagcaggttttaaatcatcatgcccatggaggtgaaatactttgaggaatgggaacatctcttcactgtgtttttggatcagccttctctcaaccgccaagaaatgcatgatttccctgccaactctaggaagtagtgctgcatgattgaatcattatttgatgaattctttcattgtaacatagggagtcattttcaaaaaggtagatatgaacttaaattaaattgacttatgaatgctttgcctgtgggcccaacagtgtcatgaccctccaattgaaacatagcatgaattatttttatgtcgagttcttgaactgctaatcaggtgtgtgtttccttgaagtccagagcaggatccaggtcagatgaaggaggtggtatgcctggcttaactgctgaaaatagagcattgaaactcttcacaatgtgctgcattgggtttctgcttggctttctcactgaaaagtaaattggggaaaatgctgcttttactattttgcattttatagcaacattaacagtcttttcccagtcaggtgctgtccagggaacatgtttcccttgggaggtctgaacagagtgacctggcttgatgtatttcctgagctctagtaccatatcatagaattagttaaatgtagtcaacagcaatgtcagaacaattgacattgtctttccaagagtgaatgcattggctttcggaactgctactagagacatacatgaggcagcgaacacatctttaggtgggggcaaggctatatctgattgacagagatctctgatctctaatgacatattgctattgtcctattatgtttaaatttgaacctaaatcacttgagtgttatgagtgatggctatataacatgctgtttggttagatttacagtgtgtttttatgttgcagtttagtttgaaacaacacttaagcacactatttctgttagtgtatatagttttcaaactaacaagcctgcgatccttgttagtgtagtgactgcctctttaggagtatggggccctagggtgtccatatatttttaccccatgggtcattctagtctaaggactactagtagaaccctcaaaaggtaattgctattatagggacttacttattggagactggtaatataataaaatattgaaggagtggccatggtcttagcaggttttagaatgaccttttaactccagtaactacttccttggtattggtatccttgatagagggaatataacatctggcagtaatctcattcaggttatactacctgactaaatttaatcatactttcatgtatttgtttcctcagttggacctaagttactgtatttgtttttcttatttttttattattgtacagtttctttacctttcaagtataaatgtgtatataaaatgtaaatacaaagaattcactaaaaaccactcataacaattactgtgtaaataaaactggtaagcagagta

SEQ ID NO: 42244 - DNA, 2740 bp, Homo sapiens
aacgttgcggcggctgtcgccgcggccccagcacccagagctgttctctggccaagcctgcgcctgtagtccttctttgcctcctggggcggccgccacccacccccagatggtgggtccggaggatgccggagcctgctcgggaagaaaccccaagttgctcccggtgcctgcgccggaccccgtgggccaggacaggaaggtaatccgggccacgggcggctttggcggaggcgtcggcgctgtggagccgccggaggaggctgacgaggaggaggaggctgacgaggaggaggagacgccgcctcggcagctccttcagcgttacctcgcggcggccggggagcagctggagccggggctctgctactgtccgctccccgctggccaggccggcgccccgccgccctcggcagccccacgatcggacgcctgcctgctgggctcgggctccaaacaccgcggcgcggaggtggctgatggccgcgcgccgcggcacgaaggcatgaccaacggcgactcgggttttctgccgggccgggactgtcgcgatctggaagaggctcgcgggctggcgcgcgccggcggccgggagtcgcgccgccgccgcccctacggccgccttcgcctggaggggcctggcgacgaggacgcggacggcgcgggaagcccgtccgattgggcctctccgcttgaggacccgctgcggagctgctgcctggtggccgcggacgcccaggagcccgagggcgcgggcagcgactcgggggacagccccgccagcagctgcagcagtagcgaggactcagagcagcggggagtcggcgccgggggtcccgaggagggcgcgccccctgccacctcggccgagaggactaatgggggtgcggagccgcgcctgggcttttctgacattcacttcaactctcgcaacacgttccaggtgagccgcggtcagagcgcccgcgatcacctgcccccggcggggccgccggtgcccttgcccgccgcggagcagggtcctgcgggggcttcggcccgggctcgacggagtggcggcttcgcggacttcttcaccagaaacctttttccaaaaaggacaaaggaactcaaatcagttgtccatagtgctcctggttggaaattatttggtaaagtccctcctagagagaatcttcagaaaacatccaaaatcattcagcaggaatatgaagcacgaacggggaggacctgtaaaccaccacctcagtcttcaagacgcaagaattttgaatttgagccgctttctaccactgccttgattcttgaggatcgaccatcaaatcttcctgccaaatctgtggaagaagctttacgtcaccgacaagaatacgatgagatggtggctgaggctaaaaaacgagaaattaaggaagcacataaaagaaaaagaatcatgaaagaacgatttaagcaggaagaaaatattgcaagtgcaatggtaatttggatcaatgaaatactgcccaattgggaagtaatgcgtagtacaagaagagttcgagaattgtggtggcagggattgccccctagtgtccgtgggaaagtttggagtctagctgtaggaaatgaactaaatatcactcctgaactttatgaaatcttcctctcaagagcaaaagaacggtggaaaagtttcagtgaaacaagttcagagaatgatacagaaggtgtatctgttgctgatcgagaggccagtctggaattaattaagttggacatatcccgtacatttccatctctctacatctttcagaagggtggtccatatcatgatgtcttgcatagtattttaggggcatacacatgctacaggcctgatgttggttatgtccaagggatgtccttcattgcagcagtactcattctcaatttggaagaggcagatgcctttatcgcatttgccaatctcctgaataagccatgccagttggccttttttcgtgtggatcacagcatgatgttgaaatattttgcaacatttgaagtattctttgaagaaaatctttccaaattatttcttcacttcaaatcttacagtcttacaccagatatatacttgatagactggatcttcacactatatagcaaatcactaccacttgatctggcctgtcgagtctgggatgtattttgcagagatggggaagaatttttatttaggactggattaggaatcctccgattatatgaagatattctcctgcagatggactttattcatatagcacagtttctaactaaattgccagaagatatcacatcggaaaagctgttcagttgtattgcagccattcagatgcagaatagcaccaaaaaatggactcaggtctttgcatctgtaatgaaggatattaaagaaggagacaagaacagtagtcctgctttgaaaagctagtcttcaaaattgacagactaactgacatagaaaaagtggtttttggataaaggttttttgtttcctatgtaaaaggcgtggaagaaaatgttggagatacctaaaagaatcaagaggtggaaaactgctgattttacattttatggctgaagtaaatgaaataagtaacttattgacagtattaataaactattattttgtaggtagagtcatttttcaaaggaaaaagtttaagtggtgagtttatattccacaatttggagtaaacaaaatgcaataaatttttaaaatagctttgaagat

SEQ ID NO: 42245 - DNA, 252 bp, Homo sapiens
cacacacaccacatattaacaacctggattctgattctgttctaaaatgcacagttcttttcagcctttcacttccttaatgtatgaaatgaggttagtttagaaattctttgcatctgggtgtaaaaacaaataagttagtaagttgaaagttaatcttttaaaaattgtcttgacttaagtaatttttttttccagaaatcttcctgccaaatctgtggaagaagctttacgtcaccgacaagaatacga

SEQ ID NO: 42246 - DNA, 242 bp, Homo sapiens
cctgtaaaccacgcaccttcgagtcttcaagacgcaagaattttgaatttgagccgctttctaccactgccttgattcttgaggatcgaccatcaaacctttttccaaaaaggacaaaggaactcaaatcagttgtccatagtgctcctggttggaaattatttggtaaagtccctcctagagagaatcttcagaaaacatccaaaatcattcagcaggtaagtactgacatagccatgtag

SEQ ID NO: 42247 - DNA, 5573 bp, Homo sapiens
aacgttgcggcggctgtcgccgcggccccagcacccagagctgttctctggccaagcctgcgcctgtagtccttctttgcctcctggggcggccgccacccacccccagatggtgggtccggaggatgccggagcctgctcgggaagaaaccccaagttgctcccggtgcctgcgccggaccccgtgggccaggacaggaaggtaatccgggccacgggcggctttggcggaggcgtcggcgctgtggagccgccggaggaggctgacgaggaggaggagacgccgcctcggcagctccttcagcgttacctcgcggcggccggggagcagctggagccggggctctgctactgtccgctccccgctggccaggccggcgccccgccgccctcggcagccccacgatcggacgcctgcctgctgggctcgggctccaaacaccgcggcgcggaggtggctgatggccgcgcgccgcggcacgaaggcatgaccaacggcgactcgggttttctgccgggccgggactgtcgcgatctggaagaggctcgcgggctggcgcgcgccggcggccgggagtcgcgccgccgccgcccctacggccgccttcgcctggaggggcctggcgacgaggacgcggacggcgcgggaagcccgtccgattgggcctctccgcttgaggacccgctgcggagctgctgcctggtggccgcggacgcccaggagcccgagggcgcgggcagcgactcgggggacagccccgccagcagctgcagcagtagcgaggactcagagcagcggggagtcggcgccgggggtcccgaggagggcgcgccccctgccacctcggccgagaggactaatgggggtgcggagccgcgcctgggcttttctgacattcacttcaactctcgcaacacgttccaggtgagccgcggtcagagcgcccgcgatcacctgcccccggcggggccgccggtgcccttgcccgccgcggagcagggtcctgcgggggcttcggcccgggctcgacggagtggcggcttcgcggacttcttcaccagaaacctttttccaaaaaggacaaaggaactcaaatcagttgtccatagtgctcctggttggaaattatttggtaaagtccctcctagagagaatcttcagaaaacatccaaaatcattcagcaggaatatgaagcacgaacggggaggacctgtaaaccaccacctcagtcttcaagacgcaagaattttgaatttgagccgctttctaccactgccttgattcttgaggatcgaccatcaaatcttcctgccaaatctgtggaagaagctttacgtcaccgacaagaatacgatgagatggtggctgaggctaaaaaacgagaaattaaggaagcacataaaagaaaaagaatcatgaaagaacgatttaagcaggaagaaaatattgcaagtgcaatggtaatttggatcaatgaaatactgcccaattgggaagtaatgcgtagtacaagaagagttcgagaattgtggtggcagggattgccccctagtgtccgtgggaaagtttggagtctagctgtaggaaatgaactaaatatcactcctgaactttatgaaatcttcctctcaagagcaaaagaacggtggaaaagtttcagtgaaacaagttcagagaatgatacagaaggtgtatctgttgctgatcgagaggccagtctggaattaattaagttggacatatcccgtacatttccatctctctacatctttcagaagggtggtccatatcatgatgtcttgcatagtattttaggggcatacacatgctacaggcctgatgttggttatgtccaagggatgtccttcattgcagcagtactcattctcaatttggaagaggcagatgcctttatcgcatttgccaatctcctgaataagccatgccagttggccttttttcgtgtggatcacagcatgatgttgaaatattttgcaacatttgaagtattctttgaagaaaatctttccaaattatttcttcacttcaaatcttacagtcttacaccagatatatacttgatagactggatcttcacactatatagcaaatcactaccacttgatctggcctgtcgagtctgggatgtattttgcagagatggggaagaatttttatttaggactggattaggaatcctccgattatatgaagatattctcctgcagatggactttattcatatagcacagtttctaactaaattgccagaagatatcacatcggaaaagctgttcagttgtattgcagccattcagatgcagaatagcaccaaaaaatggactcaggtctttgcatctgtaatgaaggatattaaagaaggagacaagaacagtagtcctgctttgaaaagctagtcttcaaaattgacagactaactgacatagaaaaagtggtttttggataaaggttttttgtttcctatgtaaaaggcgtggaagaaaatgttggagatacctaaaagaatcaagaggtggaaaactgctgattttacattttatggctgaagtaaatgaaataagtaacttattgacagtattaataaactattattttgtaggtagagtcatttttcaaaggaaaaagtttaagtggtgagtttatattccacaatttggagtaaacaaaatgcaataaatttttaaaatagctttgaagatacttcaaatttttacatcttttcttttgtaacagttaccacaaagatattctggaggctagagtaggattgttaaatactactgttaacctccaaagtactatagtacagacattgtttccagttctgaccttttgaagatattatagaccagtaatgaacagatttggttgtaaattatttaagtcactgaagatgtcatttatcttcattcacaagttggggcaaattcgagttacctaggaactggaaatgttggtgggagattgtttattgtttgtttagatgtttttccatagtatggtgtccatttgttttttaagggaaattttttgtcttccttaaggaattcctatcactcagagaattttagccattctggttctagtctaacaaattattcatctaataatttgacattaagaaaactataaataactggtagaaggaaagtgctttgcacttcagtggattgaagacttgactttgagagtaagtccaaaaacatatatgatgtttctcagtgataagagtaaaaagtaatgaatcctgagagttcttaaacagcatgctacttggcaagacttcatattttttagttacaattcttccactgtttaactccagtttgaaatttgaaatctaatatgtagctaaatctgtgacttgtaaaactctatgcataatttttcctaatcagtggaaataagaataaaagaaaaaggtaaagttaattttttttctaagtctacatcctatctcttgattcagttgcctgaagaagctgggtaaggagattagtcttgttattgattcttttatgtgtcagtgccatcttaatctcttcacatggtacactaaatgctgcctataacccatcctcatcttctttactcatcattgctttcttcaaggaaggtcttgatactgccctcgtctacctcactatccgctagtctagatagtgactctttggaaaattggtagcctctgaatgagttatccaacttctgcttcctcacattggccactttgcataggttcgggaacttagcaggttttaaatcatcatgcccatggaggtgaaatactttgaggaatgggaacatctcttcactgtgtttttggatcagccttctctcaaccgccaagaaatgcatgatttccctgccaactctaggaagtagtgctgcatgattgaatcattatttgatgaattctttcattgtaacatagggagtcattttcaaaaaggtagatatgaacttaaattaaattgacttatgaatgctttgcctgtgggcccaacagtgtcatgaccctccaattgaaacatagcatgaattatttttatgtcgagttcttgaactgctaatcaggtgtgtgtttccttgaagtccagagcaggatccaggtcagatgaaggaggtggtatgcctggcttaactgctgaaaatagagcattgaaactcttcacaatgtgctgcattgggtttctgcttggctttctcactgaaaagtaaattggggaaaatgctgcttttactattttgcattttatagcaacattaacagtcttttcccagtcaggtgctgtccagggaacatgtttcccttgggaggtctgaacagagtgacctggcttgatgtatttcctgagctctagtaccatatcatagaattagttaaatgtagtcaacagcaatgtcagaacaattgacattgtctttccaagagtgaatgcattggctttcggaactgctactagagacatacatgaggcagcgaacacatctttaggtgggggcaaggctatatctgattgacagagatctctgatctctaatgacatattgctattgtcctattatgtttaaatttgaacctaaatcacttgagtgttatgagtgatggctatataacatgctgtttggttagatttacagtgtgtttttatgttgcagtttagtttgaaacaacacttaagcacactatttctgttagtgtatatagttttcaaactaacaagcctgcgatccttgttagtgtagtgactgcctctttaggagtatggggccctagggtgtccatatatttttaccccatgggtcattctagtctaaggactactagtagaaccctcaaaaggtaattgctattatagggacttacttattggagactggtaatataataaaatattgaaggagtggccatggtcttagcaggttttagaatgaccttttaactccagtaactacttccttggtattggtatccttgatagagggaatataacatctggcagtaatctcattcaggttatactacctgactaaatttaatcatactttcatgtatttgtttcctcagttggacctaagttactgtatttgtttttcttatttttttattattgtacagtttctttacctttcaagtataaatgtgtatataaaatgtaaatacaaagaattcactaaaaaccactcataacaattactgtgtaaataaaactggtaagcagagtaattacttgaaatgagtcttcattactttggggatatctgttttatttaactgcatctcaaggaaacaaaggaaataatctttgtttttgtttgccaaatttgtcttccaaggaatgcactaagccttcagtctttttagactgacagtactggcagctaaaatattgtactgtatcttctcttgagcccagtatgtaggaaatatgtgataattcacatggtcagtatatggcagtttttgttgttgttgttacagtatattttcaattaaaaaaaaacttttcctaaaatactcaaataatgtgaaatttaatatggtgt

SEQ ID NO: 42248 - DNA, 4081 bp, Homo sapiens
aacgttgcggcggctgtcgccgcggccccagcacccagagctgttctctggccaagcctgcgcctgtagtccttctttgcctcctggggcggccgccacccacccccagatggtgggtccggaggatgccggagcctgctcgggaagaaaccccaagttgctcccggtgcctgcgccggaccccgtgggccaggacaggaaggtaatccgggccacgggcggctttggcggaggcgtcggcgctgtggagccgccggaggaggctgacgaggaggaggagacgccgcctcggcagctccttcagcgttacctcgcggcggccggggagcagctggagccggggctctgctactgtccgctccccgctggccaggccggcgccccgccgccctcggcagccccacgatcggacgcctgcctgctgggctcgggctccaaacaccgcggcgcggaggtggctgatggccgcgcgccgcggcacgaaggcatgaccaacggcgactcgggttttctgccgggccgggactgtcgcgatctggaagaggctcgcgggctggcgcgcgccggcggccgggagtcgcgccgccgccgcccctacggccgccttcgcctggaggggcctggcgacgaggacgcggacggcgcgggaagcccgtccgattgggcctctccgcttgaggacccgctgcggagctgctgcctggtggccgcggacgcccaggagcccgagggcgcgggcagcgactcgggggacagccccgccagcagctgcagcagtagcgaggactcagagcagcggggagtcggcgccgggggtcccgaggagggcgcgccccctgccacctcggccgagaggactaatgggggtgcggagccgcgcctgggcttttctgacattcacttcaactctcgcaacacgttccaggtgagccgcggtcagagcgcccgcgatcacctgcccccggcggggccgccggtgcccttgcccgccgcggagcagggtcctgcgggggcttcggcccgggctcgacggagtggcggcttcgcggacttcttcaccagaaacctttttccaaaaaggacaaaggaactcaaatcagttgtccatagtgctcctggttggaaattatttggtaaagtccctcctagagagaatcttcagaaaacatccaaaatcattcagcaggaatatgaagcacgaacggggaggacctgtaaaccaccacctcagtcttcaagacgcaagaattttgaatttgagccgctttctaccactgccttgattcttgaggatcgaccatcaaatcttcctgccaaatctgtggaagaagctttacgtcaccgacaagaatacgatgagatggtggctgaggctaaaaaacgagaaattaaggaagcacataaaagaaaaagaatcatgaaagaacgatttaagcaggaagaaaatattgcaagtgcaatggtaatttggatcaatgaaatactgcccaattgggaagtaatgcgtagtacaagaagagttcgagaattgtggtggcagggattgccccctagtgtccgtgggaaagtttggagtctagctgtaggaaatgaactaaatatcactcctgaactttatgaaatcttcctctcaagagcaaaagaacggtggaaaagtttcagtgaaacaagttcagagaatgatacagaaggtgtatctgttgctgatcgagaggccagtctggaattaattaagttggacatatcccgtacatttccatctctctacatctttcagaagggtggtccatatcatgatgtcttgcatagtattttaggggcatacacatgctacaggcctgatgttggttatgtccaagggatgtccttcattgcagcagtactcattctcaatttggaagaggcagatgcctttatcgcatttgccaatctcctgaataagccatgccagttggccttttttcgtgtggatcacagcatgatgttgaaatattttgcaacatttgaagtattctttgaagaaaatctttccaaattatttcttcacttcaaatcttacagtcttacaccagatatatacttgatagactggatcttcacactatatagcaaatcactaccacttgatctggcctgtcgagtctgggatgtattttgcagagatggggaagaatttttatttaggactggattaggaatcctccgattatatgaagatattctcctgcagatggactttattcatatagcacagtttctaactaaattgccagaagatatcacatcggaaaagctgttcagttgtattgcagccattcagatgcagaatagcaccaaaaaatggactcaggtctttgcatctgtaatgaaggatattaaagaaggagacaagaacagtagtcctgctttgaaaagctagtcttcaaaattgacagactaactgacatagaaaaagtggtttttggataaaggttttttgtttcctatgtaaaaggcgtggaagaaaatgttggagatacctaaaagaatcaagaggtggaaaactgctgattttacattttatggctgaagtaaatgaaataagtaacttattgacagtattaataaactattattttgtaggtagagtcatttttcaaaggaaaaagtttaagtggtgagtttatattccacaatttggagtaaacaaaatgcaataaatttttaaaatagctttgaagatacttcaaatttttacatcttttcttttgtaacagttaccacaaagatattctggaggctagagtaggattgttaaatactactgttaacctccaaagtactatagtacagacattgtttccagttctgaccttttgaagatattatagaccagtaatgaacagatttggttgtaaattatttaagtcactgaagatgtcatttatcttcattcacaagttggggcaaattcgagttacctaggaactggaaatgttggtgggagattgtttattgtttgtttagatgtttttccatagtatggtgtccatttgttttttaagggaaattttttgtcttccttaaggaattcctatcactcagagaattttagccattctggttctagtctaacaaattattcatctaataatttgacattaagaaaactataaataactggtagaaggaaagtgctttgcacttcagtggattgaagacttgactttgagagtaagtccaaaaacatatatgatgtttctcagtgataagagtaaaaagtaatgaatcctgagagttcttaaacagcatgctacttggcaagacttcatattttttagttacaattcttccactgtttaactccagtttgaaatttgaaatctaatatgtagctaaatctgtgacttgtaaaactctatgcataatttttcctaatcagtggaaataagaataaaagaaaaaggtaaagttaattttttttctaagtctacatcctatctcttgattcagttgcctgaagaagctgggtaaggagattagtcttgttattgattcttttatgtgtcagtgccatcttaatctcttcacatggtacactaaatgctgcctataacccatcctcatcttctttactcatcattgctttcttcaaggaaggtcttgatactgccctcgtctacctcactatccgctagtctagatagtgactctttggaaaattggtagcctctgaatgagttatccaacttctgcttcctcacattggccactttgcataggttcgggaacttagcaggttttagaatgaccttttaactccagtaactacttccttggtattggtatccttgatagagggaatataacatctggcagtaatctcattcaggttatactacctgactaaatttaatcatactttcatgtatttgtttcctcagttggacctaagttactgtatttgtttttcttatttttttattattgtacagtttctttacctttcaagtataaatgtgtatataaaatgtaaatacaaagaattcactaaaaaccactcataacaattactgtgtaaataaaactggtaagcagagta

SEQ ID NO: 42249 - DNA, 3404 bp, Homo sapiens
ctgtgtgatcattctgtatttataaaattggacttgttagagccaagtgatcatttaaattgtatctgcttggtaaatgcaggtgtatctgttgctgatcgagaggccagtctggaattaattaagttggacatatcccgtacatttccatctctctacatctttcagaagggtggtccatatcatgatgtcttgcatagtattttaggggcatacacatgctacaggcctgatgttggttatgatcttcacactatatagcaaatcactaccacttgatctggcctgtcgagtctgggatgtattttgcagagatggggaagaatttttatttaggactggattaggaatcctccgattatatgaagatattctcctgcagatggactttattcatatagcacagtttctaactaaattgccagaagatatcacatcggaaaagctgttcagttgtattgcagccattcagatgcagaatagcaccaaaaaatggactcaggtctttgcatctgtaatgaaggatattaaagaaggagacaagaacagtagtcctgctttgaaaagctagtcttcaaaattgacagactaactgacatagaaaaagtggtttttggataaaggttttttgtttcctatgtaaaaggcgtggaagaaaatgttggagatacctaaaagaatcaagaggtggaaaactgctgattttacattttatggctgaagtaaatgaaataagtaacttattgacagtattaataaactattattttgtaggtagagtcatttttcaaaggaaaaagtttaagtggtgagtttatattccacaatttggagtaaacaaaatgcaataaatttttaaaatagctttgaagatacttcaaatttttacatcttttcttttgtaacagttaccacaaagatattctggaggctagagtaggattgttaaatactactgttaacctccaaagtactatagtacagacattgtttccagttctgaccttttgaagatattatagaccagtaatgaacagatttggttgtaaattatttaagtcactgaagatgtcatttatcttcattcacaagttggggcaaattcgagttacctaggaactggaaatgttggtgggagattgtttattgtttgtttagatgtttttccatagtatggtgtccatttgttttttaagggaaattttttgtcttccttaaggaattcctatcactcagagaattttagccattctggttctagtctaacaaattattcatctaataatttgacattaagaaaactataaataactggtagaaggaaagtgctttgcacttcagtggattgaagacttgactttgagagtaagtccaaaaacatatatgatgtttctcagtgataagagtaaaaagtaatgaatcctgagagttcttaaacagcatgctacttggcaagacttcatattttttagttacaattcttccactgtttaactccagtttgaaatttgaaatctaatatgtagctaaatctgtgacttgtaaaactctatgcataatttttcctaatcagtggaaataagaataaaagaaaaaggtaaagttaattttttttctaagtctacatcctatctcttgattcagttgcctgaagaagctgggtaaggagattagtcttgttattgattcttttatgtgtcagtgccatcttaatctcttcacatggtacactaaatgctgcctataacccatcctcatcttctttactcatcattgctttcttcaaggaaggtcttgatactgccctcgtctacctcactatccgctagtctagatagtgactctttggaaaattggtagcctctgaatgagttatccaacttctgcttcctcacattggccactttgcataggttcgggaacttagcaggttttaaatcatcatgcccatggaggtgaaatactttgaggaatgggaacatctcttcactgtgtttttggatcagccttctctcaaccgccaagaaatgcatgatttccctgccaactctaggaagtagtgctgcatgattgaatcattatttgatgaattctttcattgtaacatagggagtcattttcaaaaaggtagatatgaacttaaattaaattgacttatgaatgctttgcctgtgggcccaacagtgtcatgaccctccaattgaaacatagcatgaattatttttatgtcgagttcttgaactgctaatcaggtgtgtgtttccttgaagtccagagcaggatccaggtcagatgaaggaggtggtatgcctggcttaactgctgaaaatagagcattgaaactcttcacaatgtgctgcattgggtttctgcttggctttctcactgaaaagtaaattggggaaaatgctgcttttactattttgcattttatagcaacattaacagtcttttcccagtcaggtgctgtccagggaacatgtttcccttgggaggtctgaacagagtgacctggcttgatgtatttcctgagctctagtaccatatcatagaattagttaaatgtagtcaacagcaatgtcagaacaattgacattgtctttccaagagtgaatgcattggctttcggaactgctactagagacatacatgaggcagcgaacacatctttaggtgggggcaaggctatatctgattgacagagatctctgatctctaatgacatattgctattgtcctattatgtttaaatttgaacctaaatcacttgagtgttatgagtgatggctatataacatgctgtttggttagatttacagtgtgtttttatgttgcagtttagtttgaaacaacacttaagcacactatttctgttagtgtatatagttttcaaactaacaagcctgcgatccttgttagtgtagtgactgcctctttaggagtatggggccctagggtgtccatatatttttaccccatgggtcattctagtctaaggactactagtagaaccctcaaaaggtaattgctattatagggacttacttattggagactggtaatataataaaatattgaaggagtggccatggtcttagcaggttttagaatgaccttttaactccagtaactacttccttggtattggtatccttgatagagggaatataacatctggcagtaatctcattcaggttatactacctgactaaatttaatcatactttcatgtatttgtttcctcagttggacctaagttactgtatttgtttttcttatttttttattattgtacagtttctttacctttcaagtataaatgtgtatataaaatgtaaatacaaagaattcactaaaaaccactcataacaattactgtgtaaataaaactggtaagcagagta

SEQ ID NO: 42250 - DNA, 840 bp, Homo sapiens
tagtctctacaatattgtcagactgatctctgcaaaactcaaaagtcaaattactcttctactttaaacttccagtagctcccggattcatttaagggtagaatctaaatcctttggcatagcacttaagaccatttccaagggagtggctctaccatggagccctagagactctacatgtgtctacatgggatgcacaggcaaagcttggactgccatatgacctaaatctgggtggaatgccctgtgatcctcctaggaacatggcaagggaggaaatcttcagagaaggcttcgcgaggttgttttctcatctgcctctatcttgtggggatgctgccatgaggcggttttctgatataactcccaggttccagaggaacatgagacttccaacttaacccctaggcttccgtagggcagaactgcagctctatagccatttagctgcagtctggaattgactggccagcaatagggtgtatcacaactcttgctgaagccatctgaccccttttgtttcagtgccatccttttggtgtgtgggataaggactcatagggctgacacctttagcttctcttttcttcactatgtatataagtaataatctggctgaatctaaaattagttcattatttctttaccagctgaatctgtaagtgttagacttggacggtcctttgtgtttggcacctttcataatctgattcaatcaaagcctttaaccctgatctatttactagtctaaacaactatctcattacaaaattaacatatgatattgtgaaagtctgcttctttatctgactatccattttctgctctatacaaatacag

SEQ ID NO: 42251 - DNA, 195 bp, Homo sapiens
caaaataaaactgcaattgtcaacattagaacatcattaaaaagtttacctgtcatcatctgcctgcttcttttaatgaattatttcacatgacagaagaattttaaagtagaaatatgtagggactgtacagaaaatccaggatttagtaaacatgtgatttcagtacagggcttttcttgaactttttactcc

SEQ ID NO: 42252 - DNA, 880 bp, Homo sapiens
tatattaataaatttttttaaatgtattaatatctgctcttactgagagagttttcagcctgctgaatagtcagttttacagtactagctaaaccttcttttctttttttttttgagatggagtctcactctgtcttccaggctggagtgcagtggtgtgatcttggctcactgcagcctccgcctcccgagttcaaacaattctcctgcctcagcctccctagcagctgggattacaggcgcgtgccaccacgcccagctaatttttgtacttttagtagagatggtgtttcaccatgttggccaggctgctcttgaactcctgaccttggtgatccacccgccttggcctcccaaagtgctgggattacaggcatgagccaccgtgtccagccttgcaaaccttcttaatagaggcaggcagagagctgagaaaaactatggtaagaatgagtcattgagttcctttctgcttgttatctgttgagcaaattgatatcacatgaatagaaaagctagcttggaagtagaatgatcttttttattttttgacacattcccagtaccatcagtgtctttatggctgttccaggctacattaatgttcaattctatattctctataaatcataactcacctttgtctcatttttaccagttttattttcttgtcattggagaatttctggtattgtggtaatagagtaaatgaattcttaagtgttgaaggtttaacactacaaaggtatgtcaagtcaggttgtttctcaggttcttttttgggaggttatacttcatggtagaggataaggctcaaacgggaaattgtgacattttaataaattttaattttaataaaattttagtaaatttcagctct

SEQ ID NO: 42253 - DNA, 592 bp, Homo sapiens
tgtcaatcaagtcactctgccactcacaatcccccagtgactccctacatctctcagagtaaaagccagagtcattatttattctggcttcagtgccctatatactctgacttctgttatctccgctatctcaccttctactttcccccttcacttcattccagtgcatgaaatctatctagttcacctagattttctcctatgttatctttcagaagttttacagttttgtgttttgcatttaggtctatgatccattttgagtaaatttttttcaaaagatataaggtctgtatctagattattttttgcatatgaatgtccagttattccagcactgtttattgaaaaggccattgtttctcattccagccataatgttttctttgttgtttcttgaaaatagcagacaggttctgtctctctcccctcactagagtgtaagctcagtgagaacaaagatttccatttgttttattcactgcttgtccccagtgcctaccacagtgtctggaacatagtgaatgtttactaaatattacatgaatgaacgaatatgtgttgaggacccggccgaggttgagtcagctct

SEQ ID NO: 42254 - DNA, 808 bp, Homo sapiens
aatgagagctaagctacgggtcagcccactgaggctggcagagatcaagctacctgcccaggtccacactacaggtggactgagactcacacctcaagtgccctggagtccccataaatctcattaaggatgctggctcatctgctttggggtgattcaggctttgagggtcatagcaagcaacaaacccaggccaggctagatcagcacagaacaagattatagagtccttcccagaattgtggggcctgagactgctgtggcacttctctaagcctctgcagggaacccttctctggccccagccctctcttcctcagaattctttagttggggggtcctggcctttcagatcccatttctccggatggaggattaaaaatacctatgtcatcaaatacaagacatctttgggagtgagatgcgctatcattttgtgaattaccatggaattcattaatttgatgacactctggatttaaacagtcagggtgacctccaggttgataaactgtgaaaaatggtaatactatagtaataagaataagtgatatttattacaattaaaaagaaaaaaagaaaacgctgggaaatctctgcactacccttccttacgtgcaatgacgggggcaatcttaatcagttcaatcaatgcaagtggaaataactgaagaatgagtggttgaatacttagatttcattttgcttcaaaccgatcatctttacaagtgtttcttaattcaaggctaaaagctggggatatgggacttctgtatgaaaaacagtctttagcatcagagcacctcta

SEQ ID NO: 42255 - DNA, 388 bp, Homo sapiens
attttagtagagatggggtttcaccatattggccaggctggtctctaactcctgactttgtggcctacctgcctcggcctcccaaagtgctgggagtgagcctctgcgcccagctgaaagtggttctttttttagcctgcctgttctcattgcttttttttctgttatagatctttcttaaaaaatggaagtagaagacttctttcctttgtactcagtgaggtttctcagtggtgcagatctaccctgggggaaaagaggcaagtgagaggcttgtggaccttgataagctgctggatctagcataccccgagtggtacagcctcgggtactgcctgcttcccagagcctgtggtccccatctctcagggggcacattattcatgcc

SEQ ID NO: 42256 - DNA, 792 bp, Homo sapiens
agaaagaaaataagttccagattctagtccacttagagatatgtttcttggtaaaaattaaagctgcactgtggccaagtgcagtggctcaagcctgtaatcccagcactttggaaggctgaggtgggagaattgcttgcgcccaggagttcaagaccagtctggacaacgttgtgagaccccatctcaatttttttttttaaaaaaagctgcattgtgagtttgatccctctgaccccaaacactcctcccaaacaggtccctctctcaccctgccaccacaggtgtctttctggatctcacctctataccctcccctgcccaaggataaaaatctccacaacttagcagggcatgtgtagccttgcatgctccataggctggcctcatctcttcctgttccccacaacagtcacactaaatcacagtcttgtccttctctgtaagctcacacctcctggctgaccatcctgctactcctcctggaatactctttccctcttctctgctcttgaagttctgccttgggacttggcaaggcatcagcctccacccctagatggtgttccctgagcctggcccaaagctgagagctagggggtgtccttgctctgggcttccatgttgtacggcgcttacctagtatgagaggttaacactgttaacctctccacgggttaatcctgtatccttagcacctgtcccatagcaaacactccataagtatctgttgccaaaactgaatgaagtttcgtacccaaggtcctgatacaccacactcagaaaattgag

SEQ ID NO: 42257 - DNA, 406 bp, Homo sapiens
aataaagacttttatcatgcaggccactttatttaactgttacttaaagctcaaaatattctgagtgagataaaaggacccaggagaatactatgcaagccattaaatagaataaaatagaattataagtgctgccgtgcaaagatatctaagatgaccaggcgtgttggctcacgtctgtaatcccagcactttgggaggctgaggtgaaaggatcacttgagtccaggagtttgagaccaacctggccaacatggtgaaactctgtctctactaaaaatacaaaaattagctgggtgtggtggcgcatgcctgtagtcccagctacttgggaggtcaaggctgcaatgagccatgattatgtcactgcactccagtctgagtgacagagcaagactctgtcacc

SEQ ID NO: 42258 - DNA, 760 bp, Homo sapiens
aaactgagatgtaaggaggttaagtgacttgtccaaggtcacacgggaagaggctgagccaagattcaaagtctgacttcacagtactggttctgctctatcatgggaagtgtctcctcactgcacacacttccaggttcagacaaaccggaaaggaaacccaccatgcaggactgtccatgtgatggctcttcccgtggctccatttctaagcgcctccgaggacctcatcgtggcccaggaccgcaagccaaggccaccccagtgtccttaccatcctgggaatgggaggagtcaggcccagccttgtcctgtctgcccccctggaagccttccctgagcactggcctcttatttacccgtctttgtctctggcttgttggtatctgtcccttgtctgattagggaacgcctgaggtcaggatctttgcctccccaatcagattgtcaggcaggagtgggggtagtgcagatgctgggtcatttctacatgtgagaccaaatagtggtcctgtttaagttgatccccttgaaagaaaattctggaaaagctcctcagatgcacagatacacagaatcagaccttgggcaaagtgtgtagttgtgcttttgaagctgtgcaaccttggacaaactacttgacttctctgtgcctcagtttccttatttgtgaaatgaggggtagtcatgataccttccccatgaggttgatgggaggattgagttaatatttataaagcatttcagacagtgccagaga

SEQ ID NO: 42259 - DNA, 436 bp, Homo sapiens
gcaagtaatcaatggtatttatttaagtgctcttggtaaagataatgtgaatagagaaatctgcttatttctagcataaaattgcttattaagcaaaataatagagcactgcaaattaactagtaaaaaattgaaatctttaactttcacaccttcatttgatatttactgaatactttggggactagattatatgtaatttagttcaacttttgtttaaaataggaaaatgaactttgaaaataagtacttttaaaaatattttagaatgcaagatagttttcatggaaactttcatggaatcatattctttatattttagaatcaaggtatgttcctacttggtacttgatcaaggaaatacctaaatcaagaaccattccaaatggctgtttattaagtgtgatggtttactaatgtcaacaaaagtgaaaaa

SEQ ID NO: 42260 - DNA, 291 bp, Homo sapiens
agactgtgtctcccaaaattcttgtgttggaaacttagttcccaatgtaatgatactggcaggtgtggcctagtggggggtgtttagatcatgagggcttcagcctcatgaatggattaatgttgatatctcaggagtgagtttcctcttgctctctgtagccctctctcttgccacatgatgacttccaccaggttatgactcaacaggaaggccctcacaagatgtggaacctcaatcttagacttcccagcctccagaagtgagccaaataaatttctgttcattata

SEQ ID NO: 42261 - DNA, 428 bp, Homo sapiens
caagccccttaaaagtttgttggaattagcatctttttcacatacctgagtcttaaggttcattcgtgtttctccctggaccgtccactcctgctccaacttctcactaacaaaactattgtctgtgacctttctaacccccagaacagcataaggtacacaaacttctgctctgccttaggtgttagggacgtcattaatgcttactggaaaagcacaccccagagagctgggttttggctgtggcaggtaaaaaaatctttcagatcttgcaatgctggaaaccttaaaccttttggttttttagctaaagtgattggcaacagaatgtgacatctgaggttgcatggcctgcaatagccataattaaccacatgagctcacattttcccactggagattcagtggtcttggggtgatgaaagtga

SEQ ID NO: 42262 - DNA, 520 bp, Homo sapiens
tgaatgaatagtttaggtcatatttttttctgggagattatgaaaatcaagttatctatttttttgttttgaacagtaataaataagctagtttcgcaaactgggaatactgtttatattatgcagatgatttcttgtcatttccagcttgccaaagtaaacataagatgattgattaggattaaaatacattttctggccagttctaaaaatatatatattaggaatgctgattgtacattttcaaatcaagcaaatgtattgcctttccaattcaatacataaatgctcctgttaaacactggtgaagcatctgtttttatactttatagggagattagtggcaactctgcttgtctgttaaaaaattcatgcaactgtgtattttatggtcgactgacatatttctgtcttaattccataggaaaaattattctatgtctttaaaattgcctgctttgggtttactttacagatggtataagattagaataaagtttctcgattaattcaaaactga

SEQ ID NO: 42263 - DNA, 635 bp, Homo sapiens
aggccggcccctgatggatccccaccgactgtggctgtctcaggaacctgcatggctttcacttgcacactcatgccccgtcagacctgtgtgaattggttagtgttaaggccctaagcactcatttgcgtaatgagagtctttcacttagaaactagctcatcctgctgaccctctgggccagcatttagcatctgtacctggagcctcggctgtgggaactctggccaccggtctaggcattatcatgaggggagccctgttagaacagaggattctcaaaggcttatttcttccctctgacagtcatgaagtgggttacattcatgtaagttggaggagatttattcagtgcttgctctgaatgacgaagttggcctgtctaagggaagctcagatgccatggaatgcagttcccagcccacttcagtccctgtgaaatctgtcagcggatgccttttaaggatgcagtctaatttgtggagagtaagatataaggcttaggggtgatgaagatcacagctctgaattgaagcagattttagagctattagaatcctatgcagtgcacctatcaaaacatacatttctgatgaaagaaattttattccgaagtcaaattatagttgtttcaa

SEQ ID NO: 42264 - DNA, 1416 bp, Homo sapiens
ccgcagagctgatggcattgagatccattcccggaggggtcagctcctgacgggttcctgagccagtcttaacctgggcaaaggagatgaggagccgagcctgatgcattgtgatggccatctgcccagaattggcccaaacggacaaaagtgctcttgcaaacctttctgatgagactgagactttgaagaactttactgatgaggtacagacttccagctcattcagctcctctggaggacggcagtcctcgcccctgacctctgggagcaaactggagagggaaaagcagactccaagcttggaacaaggagacacacaatctgagcttttggactataaaaattatgaaaagaagttgagtaaaaaatggatcaactacctcaagctcaaagactctaactttgaacggcaccaaccagacaccaaacttccaacagaaatcactcgggtatcagatgaagaattgaatgccctgcagtcttattgcaccatgaagataaatttgattcatcgtagaggggattctaagaagaagacgagcagcagacataaaaagctgcatcttggattggatgtagaggcttcagagagagatgcctttagttgtactgtacccgatgaacttttgaacagaatctactttaaaaacatgaggacaacgccaaaacaggaggcagcagctaagcaacacatatcttatcagtgtccctattgtaacaggaaaagagcggagctggccctgtctgcctttctgaaacaaaagaagactttactggagtcatttctactccaagagagaatagatgaacatcttcataccaaagactttctcacccgtattggagaagcacatcaagactttcccaggctttcagatgaccccagaataatctggaaaagactgactgagaaaagtcatatcagatactctggttttgaaagatcagagacagagcagaagatgcagcgagatggaaatagtgcttgtcatttaccattttctctgccatttctcaagcgacttactctaatcaaaccagagctggtgattgttaatgataatgtgtaatgtggatagatgtctttgttgtgtatttgagtaattaccataatttctacaggcacttgggaaactaacttaagactttactatgcttccttcacagatttgaggactaagaactttcactttttttttcctattatagaaggcactgttgtagttggaatagttataaaaacttttacaaaattccaagagaactatgttggtagtttgggccaggatgttgatggtacagaagcaaagtagtatggggatgtaagagaaacttaaaaagtaataactgtctttggcgatcaaatggctatggggaattaataaatagtagatgtttgaaatgttaaaaagg

SEQ ID NO: 42265 - DNA, 460 bp, Homo sapiens
tgtgttctgaagagatcattattagtgtctggctgggagatttaacctgtctgctcctcagtttatctgctagttggagaaagcttcagaaatggccttctactttgggagccttgaaccttgaagccttcctcctatatcttataacccagccgaggttatgcaggagtcccctcctgtgcccttcgttgcattttcagtccaccttctgagggttgccaggtggaatatgtgcatgacctggaggtgtccaggctctggtggcccacaagtctgactgcacatcacagtcacctggtagactttgaatttgtttcttagggtattaaaacaaataagtggaagaagaaataaaagtggcccataatttcatggtcctgacaatcccctactgacattaaaaaaataaagcaataggtgcacttggctagagaatgcatatagtgctaactaagaagaa

SEQ ID NO: 42266 - DNA, 184 bp, Homo sapiens
cctgtactcaatgaaattttcctgtacctacccatgagtgcaccttttggcttaagctagtgactttttatgtactacagccccagtaaagagatggagaaactgggaagtaaattgtagttagggttggagagttgcctcaggcatgaaaggttgggatttgagaaatatggaaggactttta

SEQ ID NO: 42267 - DNA, 456 bp, Homo sapiens
cgcaaggctaggtggcagctgtctgtggggagcttctgtctcatttcatctgggcttgggatgaatggaaaggctcgtgcatctgattgatgagcactagcttgtagatgacagcataggccttctgcttcctaactcttgtcagcctgctccaagcactggctttccagcaagcagctatttcctcagccctttcttcttccccagtcaggcaggctttaacctaagcccaaactaaatgccagcagtattctccaagctcttgattcctatctactgattggctggcatagcctcatggagactgtagtcaaagaagagtgtttaggctctaagtatgagaagattcaaggattgtattgacaagagagcaaacatagaatttttgtacaatgcagagagatcagagaaatggaaagagacggagaccaggagagacaacaagaaaaagaagag

SEQ ID NO: 42268 - DNA, 284 bp, Homo sapiens
aagagattctcctgcttcagcctcccaagtagctgggactacaggtgcacaccatcacacctggctaatttttgtatttttagtagagacggggtttcaccatgttggccaggctggtctcaaactcctgacctcaagtgatccgcccgcctcagcctcccaaagtgctgggattacaggcgtgagccactgtgcctggctgagcattttgtttattaacagggccccccaagatgcacactgtaggtgaaaggtaatggaccagaggagaacaatgtggctga

SEQ ID NO: 42269 - DNA, 576 bp, Homo sapiens
tttcttagtttcttagtcatgtattaggtgtcaaccaagacagggaatacagacagagcagtaaagagttcagccccagactcaatcctatatgtgatttttgggcccatccataaacaatgacaaagacttgaccaagtgggtcccacagggagagctgccctccccacactagtgcatagtcctctaatggcagtttcagtaagggctgcagggccatgctcacacacagatcagcatcacttgactggtgcctcccctggaggcctctccactgtgggaccttggcagaccttccccaggcatgtttgcccaagacctccttttcatggggagaggaggaggagtcttgaagacaattgtcttccttctgattcaatactcagtgcttttccgctcccagccttttcctgaccttccataaaactgcaggagcctgttgttcagggttcctttgatagtgagacaactccacatctgtgctgacccatgtgatccttgatagagctgtttcatgaaggaaaaaaaggatggggactggaccgtcagggctttttccagtttaacctcaaaggt

SEQ ID NO: 42270 - DNA, 421 bp, Homo sapiens
ttttttttttttgggaatactagcatccctttgtatgttactaagtttgatttaaaaaagaattctatggtcaaataatcttggaaaacaatgagtaaaataaagttaaatatatatctttacggcagactcctccccatctctacctttctcctatcactatgaaaactgtcacaaattgcaaatggtgcaaaagagtaaggttttctcttactcctatccctacttgttctatttagacttataagcaaattcttttgaaagttttctcagagtctttaaaaacatgcattgtggattactaattggaagacctggtatattttattcttatttaaagtaatatttttttgtgaggatcatattcaacacctcagactgggaaacaatgttctacaacagtaagacttacttacttgtc

SEQ ID NO: 42271 - DNA, 229 bp, Homo sapiens
ctgaaaactaagtctgacagaacgtctgttggcaaaattcacgtgaaatttccctaaggcaggtggaactggttgaagaaaaccaatgttttcttggttttcagtggtacggcgtggtgattatagttaacaataatgtatacttgaaatttgctaagagaatagatttaagtattctcactacaggaaaaaaagggaactgtgtgaggtgctagatagttaattagtt

SEQ ID NO: 42272 - DNA, 288 bp, Homo sapiens
aaacagtttacaagtattttaggactattatcagctaagcactaaatcagtcatcgagaattattccatgtttttatgcagagtttaaatacaaggaatgtactcttttagataaatagatcctaaagcatgttttctaatcaagaaatgtctcaaggggctaggtgtgctggctcaacgtctataatcttagcactttgggaaacagagggtggagaatcactggagccccaggagttcaagaccagcctgggtaacatagtgaggtttcatctctacaaaaaataa

SEQ ID NO: 42273 - DNA, 783 bp, Homo sapiens
gtgtgcaaggacttgggactgccaaggtgaacacagtgatctgtgctagagctggccaatgaggaagggcagatgtgcagacctaagggactaagggacatgccagggaggaaatgggcaagatccaggtgacagagtgtcgggtgggggtgtggggatgtgaaaaggtggcttcctggagtggtctgaaggctgaggcctcggtgcaggtaaaagcagcagagcttcttgaattataatgtgcctgggagtcacctaggaatgtggttcgaatgcgggttctgatttgtggtctggggtgaggcatgagactgtgcatttctaataagctcctgggtgacctgtatggtgatgatcctcggacactccgagcgacaagagcttagatggcattctttgcctctgctgtgcttagtctatggcacactaatctgtacacacacatctctgtcccctcaatcctccccatgagcctgcattcccctggcagccctggcaaggtacacgtctgtacaatgctatctatgacccccgtgttctcttaaaggcagagggagaaacactccatcttggagccacagccttgcactttgtgtcttcacgagggctgcggcacattggccctgggtccatcaggaaaacaaaaggagctctcttcagagaccacccaacttaccatgcagccgagcctttcctgctgaagcaaccagattgccttatgggtacagggcaagggggcaagaaacccagtgcagaaagtggtctagtggctaaaaaccattt

SEQ ID NO: 42274 - DNA, 385 bp, Homo sapiens
gcatcctgttcagttgatgggtagcgtttcctatgaatacagagatatgttctgcaagccaaaataaatacgtaagtgaataaagctgaaatgaagcaaataaccagccgggtgaacaggactcagcagaagaaaccattgaggccggagatctgacttgcaagtcctgttgcatctttcagttcttgaacgtggtttgggaaccttgcctttcccttttgtcctgtgcctttgtggccatctcctgcacaaagttggttttcttttatgggccagtctaagtcctggtgttaagaatacagcaggaaacaaaaaagacacaggccctcctctccaggagctccctgtggggtcagggggaaagaccttgatcaaaataaagtgg

SEQ ID NO: 42275 - DNA, 520 bp, Homo sapiens
tctttcattcaatccaaagaagaccttcaaactcacttgcctgaggcactcataagctctaggtttttcatcctcatgaaagaaagataagatttactattgagaagtgagaaatcctgcagtaaaaactcagtgagggttatcggtttgtatcctttaactaagtcaatcctgcctttgtagaatcttaatttattattatcaacttatttgcctcttcaactatagtccataatgccaaactgattgtcatgtgttagcattactacatctaaagtataagagagggtgctgtgctctaaatgtttctgttccttcaaaattcacgttgaaatagtaactcccaaaatgattagattagaaagtgtgaaatttgggaggtgattagatcacaagggcagcaccctcatgaatgggattagtgcccttataaaagaggcctcagagagacctttgtcccttctaccacatgaggatgtggcaagaaggtgtcatctatgaaatagaaaagtggaccttc

SEQ ID NO: 42276 - DNA, 458 bp, Homo sapiens
aagccaagtgggctggtacagcagctatagccacatcccacataacttaaggaaaattcctccacaaaaggagctgaaacccaggaaaatgcattctgctcaatatcatgtaaagcaataatttactcaattaactaaaaagagagcaggcaaaattcaattcaaaagagaacccaaaacattgatgtagaaatataaaagttaaatttttttgttactggttatcatttatcaaagtttatcttattattatttccatccaagtttaacccctacttaatgcttttaactacctgtgcaggtcaattgtaccttaatgaaactaatgtttcctcaaacacgggtgagatatgctacgtgaaaaatactacattctagatgtttctgccttcctaccctaacccgtatctaataccacatagcagagagatagacaagctgctcttttatgacaacat

SEQ ID NO: 42277 - DNA, 791 bp, Homo sapiens
aaaaaaaaagaatttagtaaaaacaaagaaaagaaactgataggacatgttaggccgagcgtggtggttcatgcctgtaatcccagcactttggaaggctgaggcatgagaaccgcctaaacccaagaggcggagtttgcagtgaggcaagattgcgccagtgcactccagcctgggcaacagagggagactctgtctcaaaacaaacaaacaaaaacatgttaatggcagtgtgccttatttcatccagcacacaaactcaagcacctcatcatttcttatcttttttttttttttttagatggagtcttgctctgttgcccaggctcgagtacagtggtgcaatctcggctcactgcaacctccacctcctgggttcaagccattctcctcctcagctatttgtgggactgaagcgatggcttgagcctgggagctccaggctgcagtgagcagagatcacaccactgcattccagcctgggcaacaaagaccctgtctcaaaaaacaaaacaaacaaacaaaaaaacccaaaaatgtatatatatatgtatacatatatgtatgtgtgtatatatatttcaaatacataacataaaagcacctttccaaaaaatattagattgacaatggtgtattaaaataaacaatattctaattttcccagtcctttctgagtatatcagtaaacaagctgtctctaagttaaagtgtaattgcttttaattgatagtcatttgctaaaccttggcaaagtctttttggcatactgtaatcacccaacgggttct

SEQ ID NO: 42278 - DNA, 543 bp, Homo sapiens
cgtcctcctcggcctctcaaaatgctgggattacaagcatgaggcattgctcctggctctgattttttaaatctaatttagcattagaacctagtgtcacagggatgggtgttaacacatgtacttgaatagaaaaatttcagggctggacgtggtgactcatgctgtaatcccagcactttgggaggctgagatgggagaattgcttgagtctgagagtttgagatcagcctgggcaacaaagaccctgtctcaaaaaacaaaacaaacaaacaaaaaaacccaaaaatgtatatatatatgtatacatatatgtatgtgtgtatatatatttcaaatacataacataaaagcacctttccaaaaaatattagattgacaatggtgtattaaaataaacaatattctaattttcccagtcctttctgagtatatcagtaaacaagctgtctctaagttaaagtgtaattgcttttaattgatagtcatttgctaaaccttggcaaagtctttttggcatactgtaatcacccaacgggttct

SEQ ID NO: 42279 - DNA, 298 bp, Homo sapiens
atatacaaaattagtcataaaaagatgcatgaccacagatgtgaagaagattaaatgattactaatggatgctgtgttcaactcatgctattaaattgcttctgtttctaattttatttgaaattttatttgaaacagatgcctttctaggaaagtatgccaaatgtaacttaagatgaggtaaaaaagaaacctgaacaaaccggtaactgtggaagaaattgaaaaagttctcaaagaattatctcttcaaatgtttctagatctagatggtcttgcaggaaggtgttttaaactt

SEQ ID NO: 42280 - DNA, 579 bp, Homo sapiens
  misc_feature (568)..(569): n is a, c, g, or t
  misc_feature (571)..(571): n is a, c, g, or t
  misc_feature (573)..(575): n is a, c, g, or t
  misc_feature (578)..(578): n is a, c, g, or t
cctcttctcccttcccacgacaagccatagaattacaagcacaggtataaatatctttcagctgattaaatggtgtcctgccaaaagaagatttgttttgagtataatttcttggatgctcttctaaaggagaatgatctttctttagaggcctccatggaaacgcagtgttacattttccattcttttagagaagggtaacaaaagaactatcttcctgctgaaatcaagaaatcgagggttggaggatcctaagctgtccagaaccctatgactgagtcagctggtaattcctggtaagaacttggcgtttttgaagccgcctgggccggataagtcaggaggtccaaagcagccttccagatcaagtcctgcagtggaagcacctcctcccatcctccctccaaatcaggaaatgtgctcagagctaggtttggggacaatttgaacagacagtctttgttccctgcccagcacattcccacctggtgggagctaaaagccgcagcagggaagggtctatccctctgagggtcgggaacataacggggctgcagcgttcggcccnntngnnnttnt

SEQ ID NO: 42281 - DNA, 1068 bp, Homo sapiens
aaaaacaacatcaaacagaacatagtaaatatatctgtaatgtatacttttttctagtttgggactgcatcatccacatagcttcttttctgtcctctagacaagggctccaggagtaagtggcagatttggttctgagagctaagctcaccaacttgtctccccctcaacagatgagggaagggcagggagcccgttcagtgactcctggcgctgcagaatcactcatctttggaggtgagcagagagagctctgaggagtttccttcttgcaactcaggcggagctttctttaactcaggagcagcctccattgctcccgccaacccctcaccatggccccttgtccccttgtcccaaccatagcatagagatgacaagagagaggcagtcctatttctgagactggaccaattaaaatgactgcactggctcaaaggactctgaacctgtcttgtcctgggtcctccagttgttggaagccactcttttccccaaccatgctgaaatgccacctttaccacacactgatgtcttacatagacttagatctatttctggaacttctcttctcttcgcttacttgggtgtctcatctggcaccagccatacaattttaactattgtcaatttctaatgtcttattatgtggtgggatgagtcccttcactcttcttttacaaaatttcctagttattctctcacatctattcttccacataaactttaaattgtgcccagtcctccaccccctgtcccattcccacccccaaattctgggctctgtcattccctgtgccatcatcttccccccattgtaattactgtccactcagggctgtgaaatagactatgttctataaagagggacaaaaagggcatcctgatcttgagagaagcctgctgttcctcccatcatttcacctgccccctaagcccaggagttgtcatgagaggtcaccaggcccccactcaatctcagcttgggaaccaaagtcacccaccttggttgtgttggggtggacccgccatctgtccctggtccagacgagaaagaggagtctctcc

SEQ ID NO: 42282 - DNA, 162 bp, Homo sapiens
gcatatgcagcaaacgaataagtctatctagctttctggattctgagaattgtcacctttcaggccagtttccaattgttcattcacttcactaagagctatgtttaagtgcctgtgtgtgtgccagggaccatactaggcactaggctatggcagtgaagc

SEQ ID NO: 42283 - DNA, 427 bp, Homo sapiens
gttaattcttactcattcttctaatttagctgagatgtcaacttcttttagaaagccttaattcctccttccccagactactctcacagcagagttatcagttatcactgtacttgcctcatgacgttttgtttacccacctctacccaaaaggaccaagttctttgagggcaaagatttctaccttagctcttcaatcctacatctagcactgagtgtagcagcacacagtggatgctgaattaatgaattcataaacttgccacatctattgaagcctcaatataaatggcaaaatgtggcaatcctatttatttatttatttatttattgagatggagtctcgctgtcacccaggttggagtgcagtagagcgatctcggctcactgcaattccagcctggcaacagagcgagactcaatctca

SEQ ID NO: 42284 - DNA, 148 bp, Homo sapiens
ctaccttgataaatatttcaaatgcattgaaaagaaactgtactataaatgctgtttggtgagtgttctgtaagtgtcagatcaaagttgttgctactgtatttctgattttctgtatgcttgcgttttttttttttttttttttttg

SEQ ID NO: 42285 - DNA, 529 bp, Homo sapiens
taaatatatagaaatcctaaagggtccctgtgacataagaaatacacatttggtctctgccccaggttcctggcacagagcttctaaaatgctagtaacttcctgagtggtaggggtgaggggaacatcttttgttatacataagaagcccttttcaaacagatctgagtttatgctaatgatgtgactggcagaggatgggggctggttgccagagaaaccaaccatgtgattagaaggttgaaactttcagccttatcttcctaccgggaggggacaggggctgaagactgagctcatcatcaatgatttaatcaattgtgcccatgtaatggagcctccacttccaaacgaagggtttcagagagcttctaggttggtgaacacatccatgtaccaggaggtctaccccactccacggggacagaaactcttgtgtaggggacccttttagatttcattctatatacctcttcagctggctgttcattttataatcaaccaataaatgttaagtaaagtgtttctc

SEQ ID NO: 42286 - DNA, 374 bp, Homo sapiens
tgatctctttttttttttgagatggactctcactctgtcgcccaggctggagtgcagtggcgcaacctcgcctcactgcaacctctgcctcctgggttcaagcgattctcctccctcagcctcccgagtagctggtgggcatgggcgcctgccaccatgcccggctaatttttcatatttttagtagagatggggtttcaccatgttggccaggctggtctcgaactcctggcctcaagtgatcctcctgcctcagcctcccacagcactggaattacaggcatgagtcactgttcccggtccagctgaggattttgacagggattggtttatgtctatatgtgaactggggagtattggaatattgacatcgt

SEQ ID NO: 42287 - DNA, 382 bp, Homo sapiens
taaaaagttgtgaggactgggggaggccagctcagccccaacaacttctgagcctccatggtctggctggctgactctggcctggacagtctctactcctaaggcatttttatgactgcctgaaacaaaacaggccatttccaagactggcactggttcagaacaaccacaagagatagggatggctggagtttcagtgctgcagggagtttcaagttctgcaagggaatctcctgcctagcccatgcaagtgattatacacaaggccaagcacagaatgggttcagctaccttctgagcacacatgtagctgtgtgtggggctgcagggctgcagggctggggagcatccaggaggcccaacctattacgcaggcccttcc

SEQ ID NO: 42288 - DNA, 386 bp, Homo sapiens
gagtaggaatgtgttcggggtggcaaagggttgctagtcatataggctcgtgttttgaggcagaatttaaacaaggaggtaaagcccaggccctgacacaagggctctgcactacagggaggctgagctgggcagcctctgttcttcccaagcctgcatcttcatcttgatccatagtcccacagtcttcattctcctcaactctgcacaaaagatcatataaaatacttcatgaaggctgggctccatggctcacgcctgcaatcccagcactttggaaggccatggcaggtggatcacttgaggtcaggagttcgagaccagcctggtcaacaaggtgaaaccctgtctctgctaaaaatacaaaaattagccaggcatggtgg

SEQ ID NO: 42289 - DNA, 375 bp, Homo sapiens
tgagatggagtcttgctctgtcgccaggctggagtgcagtggcgcgatcttggttcactgcaacctccgcctcccgggttcaagcaattctgcaacagcctccagagtaggtgggactacgggcgcctgccaccacgcctggctaatttttttggtatttttagtagatggggtttcaccatgttggccaggatggtctcgaactcctgacctcatgtgatccacccgccttggcctcccgaagtgctgggattacaggtgtgagccactgcacccagccagcagaagtttaaaatatataaattacatgaataaactcttcatgggtcagggattgatctagatgtcaaaaggaacccaaatatgtacaaaaac

SEQ ID NO: 42290 - DNA, 332 bp, Homo sapiens
aaacacatgcaggattaaaaaaaaaaaaaaaagaaatccatacctagaaacattatagtgagactgtaggaaaccaaagacacagagaaatatcttaaatacaactgctatggtttagatacttgttccctccaaaattcatgttgaaatttaatccccatgtgacagtatcgagagggggtctttaagagataatcgggtcatgagggctctgccctcataaatggattaatccatttctgaattaataggttatggattaatgtgttatcacaggagtgggactgtgactttataggaagaagacagagctgagctagcatgctcagccc

SEQ ID NO: 42291 - DNA, 421 bp, Homo sapiens
actggaagggagcatgaagaatcttctgaggttatggttatattgacccagatcaaaaaatccagatatacatgtattgacaatggaaaaacacacacgactcaatactgatgttgtgtgcactcttctgtatttttttgaaatttttattatcgaaaaagaaaaaaatatcagtctcagtccactgctgaagtcttcctttgtttcagaaccctcctctgatgaaaatgaacttagatgtacatcctagaaaggcaatatggcatgccttgggattacgaattaactttagccaagaaaacaaggaattttaaatatctcatattcatctgctatttttacatggccgtcatgggtataaaatgaataaagaactgcaaagataaagggaggagaagaaaatgtggctaggaagtatctg

SEQ ID NO: 42292 - DNA, 280 bp, Homo sapiens
aaatacggtgtagtggtttggtgcacctactttggagacataaaattgagaattaattgatattatttatagaaattatcacagtactcaaataaatagtaagcaaacacttactggttgtttttattgtattatctttgtaatttaagaactaaaaggagtcacaagaagttagcataacgagcatctgacagaaaaattaactgatagaataagagataatggttcatgcagacttgaatcacatggcttattaaatcaaaggtacattaatgcttaa

SEQ ID NO: 42293 - DNA, 461 bp, Homo sapiens
caaaactagagcttttccagtccaattttaaactaattccatctcacacaaaacaagtgcacactatatcaaaatttgggggataactgctaaagcagtacttacagggaaatttatagcctatattattatacaagaagagagttcacaaataaatgacagttcattttaagaaattaggaaaaccagccaggcatgctggctcatgcctgtaatcccagtgctttgggatcacttgaagccaggagttcaagaccagcttgagcaatacagtgagactccatctccaaaaacaaaaacaaacaaaaaagttagccaggtgtgatggcacgtgcctgtggtcgcagctacttgggaggctgaggattacttgagcccaggagttcaaggttgcagtgagctatcatagtgccactgcattctatcctgggttgacagagagagaccctgtctcaaaacaa

SEQ ID NO: 42294 - DNA, 335 bp, Homo sapiens
taatatcacatgagatgatagaaaagttacgtattaatgttgtcctgctgccttcacctatttcttattatatgctccattcaacccagaatttatagatttgaatatcttaattttaattttgaaggataaaacatgtatttatgaatttgttttaaatggctaaagggtaacattcagcagtatagcactggaacaatttccatttggtttaaaaaaacaacaacatatatgtggaacacagttcacattttttttattttgcgcaacttcgatgctttcaacactgcatacattaccaaaagcacaaaaatagatgctgtactatcaaattg

SEQ ID NO: 42295 - DNA, 349 bp, Homo sapiens
aaatgaaaaaaactccctttcccagtatcagaatacactgtaaatcctcattatttaaaacagtatagtagttttataggaagagaaaattatttctatggaacagactatgtagttcaaaaatagacttgtgtatgtgaataatcagttggaaaaaattgaggattcaataaattataaaattggttatttagtatccatttagaaaaaggttagatcattgtatcatacaatacacagaaagtttattacagataaactgcttcagcggaaaccataaaacgtcaactagcttctaggattttttctttaagattatggtgggaaaagcctttcttagcataataaa

SEQ ID NO: 42296 - DNA, 1070 bp, Homo sapiens
tttcaaaaagtcagatgactaagggccttggagcgtttttgtgtttgagatattagctccggtcaattccaaagagtaccagattctttcaaaaagtcagatgagtaagggcgctagccagttaagtgaggcatctcaattgcaagattttctctgcatcggtcaggttagtgatattaacagcgaaaagagatttttgttaaggggaaagtaattaagttaacactgtggatcaccttcggccaagggacacgactggagattaaacgtaagtaatttttcactattgtcttctgaaatttgggtctgatggccagtattgacttttagaggcttaaataggagtttggtaaagattggtaaatgagggcatttaagatttgccatgggttgcaaaagttaaactcagcttcaaaaatggatttggagaaaaaaagattaaattgctctaaactgaatgacacaaagtaaaaaaaaaaagtgtaactaaaaaggaacccttgtatttctaaggagcaaaagtaaatttatttttgttcactcttgccaaatattgtattggttgttgctgattatgcatgatacagaaaagtggaaaaatacattttttagtctttctcccttttgtttgataaattattttgtcagacaacaataaaaatcaatagcacgccctaagaaaaatcagggaaaagtgaagtgtacctatttgctatgtagaagaggcagcttacttgaaaatcagcagcaatgttgtttttagagtctgtaataagtaataaactcaaaaagacacattctataggaataagggcttcacagatagagctcattttttaaaaatccaatttgtacattagactaaacgtgaaattatctcttattgtaatggtggaaaggtggttattcccaaaagctcaatctcaaagaaatgtgtttaaatgaaaaaaagtaaataattgcattttttaatgaccgtgggtctgtgaaaaaaataggaaatattttaaagagtatgttctttcattatcctctgttattacttgtctacatttttattctgccaagaa

SEQ ID NO: 42297 - DNA, 1355 bp, Homo sapiens
  misc_feature (107)..(107): n is a, c, g, or t
  misc_feature (113)..(113): n is a, c, g, or t
  misc_feature (117)..(117): n is a, c, g, or t
  misc_feature (119)..(119): n is a, c, g, or t
  misc_feature (122)..(122): n is a, c, g, or t
  misc_feature (126)..(126): n is a, c, g, or t
  misc_feature (187)..(187): n is a, c, g, or t
tctataacagttggtatcaggagaaagcagagttcaggctttgctcgtgatctacgatgcatccactctgagagccggggtcccatcatgtttcatgtgtccctggntctggnacananttnactntcaccatcagcagcctgcagcctgaagattttgcaacatattactgtcagcaatatgatgntctcgtgttcactcactttcggcggagggaccaaggtggagatcaaacgtaagtgcactttcctaatgctttttcttataaggttttaaatttggagcgtttttgtgtttgagatattagctccggtcaattccaaagagtaccagattctttcaaaaagtcagatgagtaagggatagaaaagtagttcatcttaaggaacagccaagcgctagccagttaagtgaggcatctcaattgcaagattttctctgcatcggtcaggttagtgatattaacagcgaaaagagatttttgttaaggggaaagtaattaagttaacactgtggatcaccttcggccaagggacacgactggagattaaacgtaagtaatttttcactattgtcttctgaaatttgggtctgatggccagtattgacttttagaggcttaaataggagtttggtaaagattggtaaatgagggcatttaagatttgccatgggttgcaaaagttaaactcagcttcaaaaatggatttggagaaaaaaagattaaattgctctaaactgaatgacacaaagtaaaaaaaaaaagtgtaactaaaaaggaacccttgtatttctaaggagcaaaagtaaatttatttttgttcactcttgccaaatattgtattggttgttgctgattatgcatgatacagaaaagtggaaaaatacattttttagtctttctcccttttgtttgataaattattttgtcagacaacaataaaaatcaatagcacgccctaagaaaaatcagggaaaagtgaagtgtacctatttgctatgtagaagaggcagcttacttgaaaatcagcagcaatgttgtttttagagtctgtaataagtaataaactcaaaaagacacattctataggaataagggcttcacagatagagctcattttttaaaaatccaatttgtacattagactaaacgtgaaattatctcttattgtaatggtggaaaggtggttattcccaaaagctcaatctcaaagaaatgtgtttaaatgaaaaaaagtaaataattgcattttttaatgaccgtgggtctgtgaaaaaaataggaaatattttaaagagtatgttctttcattatcctctgttattacttgtctacatttttattctgccaagaa

SEQ ID NO: 42298 - DNA, 869 bp, Homo sapiens
  misc_feature (86)..(86): n is a, c, g, or t
tagaggatcccctggatcgaggtgcagatgtgacatacagatgactcaaattcccccttccctggccgcctctgtcggagagaggntcaccatgacttgccgggccagcgagggaatcggcgcctttttaggatggtatcaaaagaagccgggagcagcccctagactcctcgtatatggtgcgaccaatttgcagagcggagtcccttctagattcagtggtcgtggggttgggagcgatgtcagtctcaccatcgagaatctccagccttgaagacttcgctcgtgtatatctgtccagttctcttcttccctttttcgtacggccccgggaccactctggaccacaagcgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttctacaggggagagtgttagtgattatctaactgaagtaattcattctagggtagatggctgaattcccttaaccctcccaaccattttactaatttttttgtcaaacatttatcactgtatctgcccaatcattttaataaagggactcatttccagttggcagaatgtatgtatatgtgagaaagaaatatttgaaatggagatctcacaga

SEQ ID NO: 42299 - DNA, 701 bp, Homo sapiens
attagaggatccggaacgttacttgcagagtggagtccctcatgttcgctggcagtcggtctgggactcatttcaccctcacgatcgcagtcttcaagttgaaagattcttggactttactttttgtcacaaggttatgcggcccccttcaccttcggcccggggaccacagtcagtgtcaatcgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttctacaggggagagtgttagtgattatctaactgaagtaattcattctagggtagatggctgaattcccttaaccctcccaaccattttactaatttttttgtcaaacatttatcactgtatctgcccaatcattttaataaagggactcatttccagttggcagaatgtatgtatatgtgagaaagaaatatttgaaatggagatctcacaga

SEQ ID NO: 42300 - DNA, 805 bp, Homo sapiens
  misc_feature (164)..(164): n is a, c, g, or t
  misc_feature (170)..(170): n is a, c, g, or t
  misc_feature (174)..(174): n is a, c, g, or t
  misc_feature (176)..(176): n is a, c, g, or t
  misc_feature (179)..(179): n is a, c, g, or t
  misc_feature (183)..(183): n is a, c, g, or t
  misc_feature (244)..(244): n is a, c, g, or t
  misc_feature (257)..(257): n is a, c, g, or t
  misc_feature (276)..(276): n is a, c, g, or t
  misc_feature (278)..(278): n is a, c, g, or t
  misc_feature (282)..(282): n is a, c, g, or t
tccggtgttcctttgtctcagggaaaagcacctctctgcaggtcagtcagagtcttacagcaatccttggctggtacagcataatctggcaggctccaggctcctcatctattgatgcaacccgaagggccatttgcatcccggacaggttcagtggcagtggntctggnacananttnactntcaccatcagcagcctgcagcctgaagattttgcaacatattactgtcagcaatatgatgntctcgtgttcacnttcggccctgggaccaaantngatntcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttctacaggggagagtgttagtgattatctaactgaagtaattcattctagggtagatggctgaattcccttaaccctcccaaccattttactaatttttttgtcaaacatttatcactgtatctgcccaatcattttaataaagggactcatttccagttggcagaatgtatgtatatgtgagaaagaaatatttgaaatggagatctcacaga

SEQ ID NO: 42301 - DNA, 888 bp, Homo sapiens
ggctgggcccccacttacagagtaaggggacacaacggacccacatgggcacctttgggacaagagattttgcttgagacagctcccattgcatcaggagtccgtgtctgtgtacagggtaagccgaccccaatcccagagaccacagggtcgggggaaggcccatgcaggctcagtgagcaggggtggcatccgaaacccggccagcacgctggaaactgcctgacacctttttggctttggcagaaagccagtgggcattgatgaacccattggccttgtctagggctcctcagtgacaagcagggctgcctccgccgtactgtggagcaaggcaggccaagccctaggaactcctgctggagacaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttctacaggggagagtgttagtgattatctaactgaagtaattcattctagggtagatggctgaattcccttaaccctcccaaccattttactaatttttttgtcaaacatttatcactgtatctgcccaatcattttaataaagggactcatttccagttggcagaatgtatgtatatgtgagaaagaaatatttgaaatggagatctcacaga

SEQ ID NO: 42302 - DNA, 489 bp, Homo sapiens
gcaaagtcaccagagtctagatccgggccaaacaccctgaatttggggctagcccaggctggtcagtgggccccagttggaccccagaaaggtcactataaatggtcagccttggggagagggcctgccagggtccaaggattcacaggctgagttgtcctggtatcattacaagagcagcacttactgggcgttcaccgggccaacagctccacatacaatgccccttccattgcacaataagcccgtgaggcacatatgattatttcccatactcatccatatttggaaaaactgagccttggcattagtggtgacagggctgtggcagagcctgtgcacccatccaccaggccagacaaggccctgggcaggaggagaggaaaagaaaggggaactgctcccagcagagcctcgttctatgctgtcgggctgtgcttcacccaagttatttcattttccccgacttgtctctcagagagttgaggc

SEQ ID NO: 42303 - DNA, 976 bp, Homo sapiens
attgatggatattctctcattaacccattcctagcttcctagcacataagattaccatgactgaccacaagcaattattttataaattattatgaataactgcaaatgttcccccaagaaaacatttcaggaaggactttgctgtcttgatttccttgcttgacaccagcccagctgccaccccagctccagggaattccttccactgcagggaatttttctgctagtcttccagggcttatctttgtaaatggacgatactccagtctccattccctggagctcttgcctcttcctgttggggtgcacccctccagtcacaccaagcaaagcttccttcctttcttctgtccctctcacttgccatggctccatggttacaacatacacccttgacacttacctgaaaagaatctctgagtctataagatgctcagacatgactctcctcatcattaaggaacttagtttagatgatttctctgattgtttccagttctaaaaaagtattattttatatttaacaatagtatagcatcaacttacatcctaaaatccttttggttccttgcaaattgtctttttgcctcctttataacatcacggtatgttggagcaggtagtgtgctaggcttattattaaggaatgattttcaattaggaacatttgggaagtaaacagtacccttcacagaggaaccaaggggaccgtgtgaccttcacttttcagtaatgaagagtctcaagtataaacatgaatattatgtctggagttacactcagaggactgaaagaagaaaacatcactttaaacttgtgtcccattatctcaaccacagcaaccatagggcactatgatttaatagtttcataaatcctgtaattaccttttgtatgtgtttgttttaaaagcagcaacttgttaaaggtaaatattaaaaattaccaaaatattaaaaatgtaccaaaattcatt

SEQ ID NO: 42304 - DNA, 364 bp, Homo sapiens
gaaagattgaaagactgctagatatctgatcaatatgcatcagcagctaattagaaaatataataatgatgataataacagtaataaacccataattaaaaccaacaaaaatgctttgagataagaaatatttatcaaaaggaagagatcatgtcttttgtgggaacatgagtggactggaggctattatcctcagcaaactaacgcagaacagaaaactaaatatcacatgttctcacttataagtgggagctaaatgatgagaatatacggacacaaagaaggaaacaacagacactggggcctacttaagggcaaagggtgggggggggagaggagcagaagagacaactattgggaactg

SEQ ID NO: 42305 - DNA, 455 bp, Homo sapiens
gctatgttcccaatgcatcctccttaaattctccttatgttgaaatcctaaccgccaaaattatgttatttggaggtcggcctttgggaggtaaacaggtcatgaaggtgggactctcttgaatgggattagtgcccttataaaagactttttgcacttactatctaccttcccctctccttctacccctcattttactcagagcctgagagagctgcttatccttttgccatgtgggatcatattaaaaaggtgtccgttgtcagggaagggaacatcacacaccggggcctgttggggttagggggctaggggagggataccattaggagaaataggtaatgtaggtgacgggttgatgggtgcggcaaaaccaccatggcacgtgtatacctatataacaaaccagcacattctacacatgtatcccagaacttaaagtataatttaaaaaa

SEQ ID NO: 42306 - DNA, 491 bp, Homo sapiens
ggctcaagcagtcctcctgccttcgcctcccaaagtgctgggattacaggtgtgagccaccacaccaggccccaaaatattttcaatgttatatactcttggtatctgtattttcaccctggaatagaggttccacaaaggtagtcaaggttatggttctgctacctcatcctcattttcattgtttattattattattagctaatacttatatgctacttactatgtactacactgtactaagcatttcatgcttattagatcatttaatcttcaacctaatgagataggtgtatatatatatacagatgaagaaactgaggcgcagagaggctaagtgactggataaaagtcatacagctagtacacggtagggctgtggtttggacccaggcattctggttccagaagactgcactcaggactattaatttttaaaagattgaacacggtagggaaaaaaaaaaaacaaacccacaaatattttaacc

SEQ ID NO: 42307 - DNA, 490 bp, Homo sapiens
tagctgatcagaggatcccagtcgtacgaatgagctccccaagctcccaagggagtataggcgtgagtcaccatgcctggccagaaaccttattttgtggtagttgttcagctataccttgcagaattttttatgtgaatcctcagtaaatcccaaacagcttctctcagtactaacacatggctgataaatggtactgaattctttgtaaatctcaccaatctcaacagaatttctggttcggggtaaaaaaaaaaatttccgtttactttctgtagaaaatacccactcagaatccactctctgttatgtgtaacaatggacagaaattttactgttgttggtacaaaacaatgactcatcccaaatcatctcttggaattaagaatgtaatcgtaatacactcatactcatatgtacgtgctcagtcgaacggactgcagtccgttcgactgagctcgtgatgtgcccgcctgggcctcccaaagtg

SEQ ID NO: 42308 - DNA, 301 bp, Homo sapiens
atgccctctatgctccaatataatggtgctgcctggcatcattgaaaacattaaaaaaacttttctaaaaagtatttgaggactgggcatggtggctcatgcctataatcccaacactttggaaggctggtctcaagcagtccttctgcctcagctccccaagctcccaagggagtataggcgtgagtcaccatgcctggccagaaaccttattttgtggtagttgttcagctataccttgcagtaagccaagatcgtgccactgcactccagtgtgggtgacagagcgagactccatctc

SEQ ID NO: 42309 - DNA, 627 bp, Homo sapiens
tttttaagagttggagtctctttctctctattgcgtaggctggagtgccacagtcgttgggactacaggtactgccaccatgcctaattaaaaaaaattaaaagatggggtcttgctgtgttgtccaggctggtcttgaactcctggtctcaagcagtccttctgcctcagctccccaagctcccaagggagtataggcgtgagtcaccatgcctggccagaaaccttattttgtggtagttgttcagctataccttgcagaattttttatgtgaatcctcagtaaatcccaaacagcttctctcagtactaacacatggctgataaatggtactgaattctttgtaaatctcaccaatctcaacagaatttctggttcggggtaaaaaaaaaaatttccgtttactttctgtagaaaatacccactcagaatccactctctgttatgtgtaacaatggacagaaattttactgttgttggtacaaaacaatgactcatcccaaatcatctcttggaattaagaatgtaatcgtaatacactcatactcatatgtacgtgctcagtcgaacggactgcagtccgttcgactgagctcgtgatgtgcccgcctgggcctcccaaagtg

SEQ ID NO: 42310 - DNA, 234 bp, Homo sapiens
ccttccccaaattagattttttatacctcctttcatgccctagttttaaaaattgttttcccaaatttttattttgaaaaatttcagacccaaagcaaagtagaaagaatagtatggtaatgtctttccctccttgcctaagtttaccaattgttacttgatatagatatgtaaacctttttcccctaagccttgtgaaaggaaatcacagacttagagacacttaatctctaa

SEQ ID NO: 42311 - DNA, 379 bp, Homo sapiens
gtatgtccaaacaagtctaaaattactctttcaataactaaaattcttttttagtggtacataaaataactatttgtcttacaatcaatggtgtctaagagtaaataaaaaggataacgaaatactgtagcagcacctactaatgcagcactgactctcgtccaggcactcttctgagtgctttgctggtcttcctcacagtaaccccatgaagtaggcacaattattaccctattttacagatgaggaaactgagccacaagtgaagccattagtaagtgctagtaagcggcagagtcaagattccaagccagaccctctggttcccaataccccgctcctacccaccacgctacactgcctgcctagtgaacagacc

SEQ ID NO: 42312 - DNA, 354 bp, Homo sapiens
ccccaggaatcactgccccagtgcagcaggagaagcgccttccctcatgccctaagcctgccttttctgttgtcccccagctcctgggccaggtggagccccccctgaagctggtttctacctgccctcgcctccccactgcagcccacagttcggctttcagggctgaacccagagcccagaggatggagaagccagaaagcggggaggtaagggagagggcgtctaggcacaccacagaggtgattgggctgtgacggggacaatccgcacaacacgagctaagctcacacccctagggagtgatttttccggactgcccccatcccaatctccacctcctctgctttactt

SEQ ID NO: 42313 - DNA, 504 bp, Homo sapiens
aattcttccaccagcatgcataattgagagagatgtgttaattacccttacatgacagctggtaggacttcctagacaaactctgagaggagtattgatctggaatcattgtaagtcactgtactgtggtgatataaaggtaaagccctcgcaacagttttgaatgagcaggtcaatgtgtggggcctctgtgaactggggcctgcaggcatgtggcagccagccagtgttcgtccagcaacaaaaggaccagtgtggttctttgcatgacattttaatgagtgatacaaggaaaatcccaaagatgtaatcccttttattataatagctctatggctcaaaatgggttgttatcaaagagaaacacaattccagaaagtgaggataagatttttgtttttatcccctgtatctgtgaacagcattctcatcattgactgttatttaagggaactgagtgcacagcgtttgactcagcactgtggacattttgaagagggagca

SEQ ID NO: 42314 - DNA, 852 bp, Homo sapiens
agcgggcatgcgcgctcgcgctcccgccctctagctgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaagcctacccttggtacgttagacacttacatcctgttccctcagcacacgcctttatcgcatcacactccaccactgtacattgcctgcgcacctgcgcttggacgaccaagttaccaaaccttgtgtgtcacaccgtgaacataatccttccgcgtcgaaataagcaggaatgctacctggcagcgtggtgctcacgaacagaacattcgtgggcgatcatgaacattgccgtcagacaagggaccttgcagctaggatcgtaccacgtggctgacacaatagaagttgagacccgctagttggactcta

SEQ ID NO: 42315 - DNA, 642 bp, Homo sapiens
ttcacccagggaaccaactttggacatgttttcgaattttaatccaacccaatatagggaattttggccctcgagcccaaaaattgggcaccagccactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggatttttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaactaccacaaacaatgactgtgg

SEQ ID NO: 42316 - DNA, 918 bp, Homo sapiens
cttcatctctactaaaaatataaaaattagcccagtgtgggccaccatacccagccgggagaatgcatttcacattgcttatgcaagtccaggactgtcctctagcatcacagttaaaataaaaacctagagcaaatgctaatgttttcactttctttctttttcccctccttttctcaataggatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagtttggcccttaagaagtcatgattaacttatgaaaaaattatttggggacaggagtgtgataccttccttggtttttttttgcagccctcaaatcctatcttcctgccccacaagtgtgagcagctacccctgatactccttttctttaatgatttaactatcaacttgataaataacttataggtgatagtgataattcctgattcaagaatgcatctgataaaaaagaatagaaatggaaagtgggactgagagggagtcagcaggcatgctgcggtggcaggtcactccctctgccactatccc

SEQ ID NO: 42317 - DNA, 2660 bp, Homo sapiens
agcgggcatgcgcgctcgcgctcccgccctctagctgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggattcctttgtttcttcctcttcctctcagcctgtatctctattttcgacctcacaagtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagtacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggatttttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaactaccacaaacaatgactgtgg

SEQ ID NO: 42318 - DNA, 2287 bp, Homo sapiens
cgcggtgactctagcggatccctttagtgtactgtgggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagtacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggatttttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaactaccacaaacaatgactgtgg

SEQ ID NO: 42319 - DNA, 2603 bp, Homo sapiens
agcgggcatgcgcgctcgcgctcccgccctctagctgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagtacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggatttttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaactaccacaaacaatgactgtgg

SEQ ID NO: 42320 - DNA, 768 bp, Homo sapiens
  misc_feature (426)..(426): n is a, c, g, or t
  misc_feature (450)..(450): n is a, c, g, or t
  misc_feature (536)..(536): n is a, c, g, or t
  misc_feature (546)..(546): n is a, c, g, or t
  misc_feature (591)..(591): n is a, c, g, or t
  misc_feature (595)..(595): n is a, c, g, or t
agcgggcatgcgcgctcgcgctcccgccctctagctgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggctgacttgggcaacagcagtgactacaagtgccatactgaccaattggaagagtctttgcttatcggagctgttctaaaaggcttattagtntaggtcttcattctatttaatgtnttcatgcctttataaactttttacttccagccaatttttcccattgtcttggtacaggtcagctgtgtccaagttagtaagggttncagctagccnaaaaatggtatatcatttgctgaaattctaaacaaaataattaangttnaagcacagatgatgcatgctacccttagtgttgctaccaatgtggggaaaagcttgactcgatagtacatgcagtcagcgcctgcatcttcacaatcacctgagaaatgaaatgcaaggactgagctctggtttggccctcataagctggtccccagaaaaacaagatataac

SEQ ID NO: 42321 - DNA, 419 bp, Homo sapiens
tgtcagtgctaaaaagaggccgctaaccaaccaccacaaaagacatctcagatatttagagccctttccctctccctttccccattggtttcactttttgagggaaattcttatgcttttctcttataaattgccattgataaggttgtaataaacatcagagtttagaggaaggcaaagaataatagttttagctgtggaacggatgtgagctgatccttgggttcaacaatcattttgaaattgaggtttacccatagattccattagcctatatagagaagtgcattatttggtgtaaagtacctcctgtgttcacttagtgcccattcttagccttatatttcctgacgtgcatgtggacttcttttttcagtgattaccacacataaatttgttcttttccatttttgttatga

SEQ ID NO: 42322 - DNA, 320 bp, Homo sapiens
tttttttttttaagttcagaggtacaagttcaggggtactgaaatgacttccaaaaacatttctccagatttctcatctctcccagcttcaagcctctatttccaaaagcatacactacatgtccatctagatatcttactaaataactcactatctatgtgtcccaaacagtggtggcaacaagggatgaccaggtcaagattgatcatttctctactaggcacctctcacaactataccaaagaaagaaaatcatatgtccgtactgcaaatgcagcaacttcttctaccatcttaggccccacacatataaattcag

SEQ ID NO: 42323 - DNA, 553 bp, Homo sapiens
aggggtgcatgaaggccccagcccagccagtgacacagaggttgggaagaccagggcgtgaagcttctgtgcttggagaacaggagggcttgtggagctgtggttgatggcgtgtccaggaagcctggccaggctggggtctggcaacagcctcaccacgatggcatggcggtgggcccggcctctacccgctgcgccacagctcctggctcctggctccaggtcatctctgcccacagccagtgtctctggtgagcctgggcaggtgggaggccgaagctgtgccccactggtttggatgctgagctctggggtgacctgcaccctgtagtcctacagttcacacgctatggatgcctgaagggatgggtgtcccgtttctgaaacccacagagcagccttgattgggaggcgtcctgtgcccatctcgtgccccccgtccttctcctgcgtccaggttctggttctgccgcctcctccgcacgctgctcaccagcctgctaagtggatgtgaataaacaatcatgcagggtttggtgcattctttcctgga

SEQ ID NO: 42324 - DNA, 356 bp, Homo sapiens
gtggtgtggagggcagaggcagtggtgggaagcctgtgtgtggccgacgcatgcttttacgctgtcatcacggccttgctttctatagcagggatctgagaagcaggcaggcagctgctctgcccgagactgtcaggagttggtggatgtgaatccatgtctgaagggatgggtgtcccgtttctgaaacccacagagcagccttgattgggaggcgtcctgtgcccatctcgtgccccccgtccttctcctgcgtccaggttctggttctgccgcctcctccgcacgctgctcaccagcctgctaagtggatgtgaataaacaatcatgcagggtttggtgcattctttcctgga

SEQ ID NO: 42325 - DNA, 808 bp, Homo sapiens
cttttgccagaggaacatcaaagggcagagcaaacagagaactagggggataagagagaagaaaagaagaatggagagagaggtttgcccagaaggaaaacgaagagccagattgaaatctgactctggcttgagaacaggacgggtcccagagtttgaccactgccagaatccagtgtttcaagatggagttggtgaagcatccaagattttggatcctgggcctcagtgacactccatcacccaactaaaaagatgttctctgggacctctctcaggctgatgttcttctcatcaagctcccgaatgtgtctcgcactattggacactttttgggggtacacaggtcttctctcctcccctcctgcagaggcaccaaaaccaagaccaaatgggggttctctagccgccaacttgaaacgctctgagacttctgtgtatttgatgcttcttcaagtcagctctgacgtggccaattccctgacctgggaaatatttacatagtactctagatcattccttcttcctagtaactgcaactttgttgcttctgtgtttgactcacagccactttcccccatgcggaagtgagtgggtgtacgtgagggtgtgagtggggtgtgtgcgtgggcgtgtgggcgtgaggtgtgtgtttaaatataatcacaccataatttattcagctatatggagtagtagactagaaagagaaactggtatttgctttaactacctgctgcttgtaagcgcttcctctgtaactcaggcgtaactgttatacattaaaagaaattaaaagcattttgaa

SEQ ID NO: 42326 - DNA, 358 bp, Homo sapiens
cctggcctatttccactacttttgattgaactttaatgtgacttaatttgtctggtgatgaaagaagttttcaaagggagggaatcatctttttcactattgtaaagataaataagcaagtcgaacttgccctctttcccatatgatgaatcctgtaactttaatgcattcagcataacagatgcagtagttttaaagattactggacagaatatttccgccttaaaagttgtttctctgccaggcatggtggcttatgcctataatcttagcactttgggaggccaaggtgggaggattgcttgaggccaggagttcaagaccagcctaagcaacatagcaagactccgtctcttaa

SEQ ID NO: 42327 - DNA, 336 bp, Homo sapiens
gcagtaagttgtactaacttcaaaccacaaacatgctagaaatcctgactatacccttataccttgtgcttttatttgtagacaatgattgagagtcaggttttagtggctccattggctattcattgaaatagcccacctgccctaattattgcccaagaaaacaatgacttaactaatttcactaataaagtgccctataaatcttctaataccacatgaggtaagagacatgtatccatgtttggacagatgaggacacagaaaaggtagataactagcttaatgtcccactgcttgttttatttattttttgagatggaatttcgctcttgt

SEQ ID NO: 42328 - DNA, 409 bp, Homo sapiens
tactgagtgggtcccctgatagtattaaatgcagcctccttggcctgtcatttggagccctctgtgatttggccttaacccccagctccctcaaccaacttggttcccattacttcgctttataccagtgaaggtatacctggtctactaggctggaatgcacttccttccccagcgcccccagcatgcccctccctgctttctttaccttcattctccaatgcaaaatgtcatctctcccatgaagtattttttgattcccccagttagatgtgcttcatgccacctctagaccctcttcactcttctgtgtctggtaggaagggactgtggagtgtggagggcgagtgcggctttggggccagacactcccgctcccctctgtctatggagaacctgggtcagggga

SEQ ID NO: 42329 - DNA, 703 bp, Homo sapiens
actctttatgtctcaagaacaggttgtcttcatttattcaagtcatgctttatgttacttaagtgttattattaaactgtcttcatgtatatcttacacagatagtggtaattttattcttagttatatactctttgtgagtgaggttgtaaattgggtctttcattatatattctgtcatttgagaagaaatttaattgtatatgttatattccttatataaccatttaccctttgaaatctcttatttgtagtaattttgcagttgattcctttggtctttctaggtatgaaatcatattatcagttaataatgatcatttgcctctttctttccttttctaatatggtaccacttccagaacagtgccaagtaagagtgatgctagcagccacccttatcttactcctgatgttaatggaagtgcttttattttgtcattaaaaatgatttttaagagacagggtctcccttaagagggttggccagacctagtggctcaaacttataatcccagcactttggaaggccgaggcaggtggattgcttgagctcagcagttcaagaccagcccaggcaacatagtgagacctcgtctctactaaaaattcaacaaagaaaattagcctggaagtaattacctgggactacaggcatgcactgtaaataaataaataaataaataaataaataaataaataa

SEQ ID NO: 42330 - DNA, 217 bp, Homo sapiens
gaatttgacattatatttaatcattgcatggtctttcaacgtataagaaactgaaatccttggtagataagcagcctggggcatttctttcttcaccactttcctgaaggcttccagggtagaaatacagagtgataggatgatctggggtgagcacggttattggctgtctatttctagttaaagtcactgcttgctttgggaagtttgtacagag

SEQ ID NO: 42331 - DNA, 406 bp, Homo sapiens
gtttatgcactgtgctatatatttccttatttacacagcctgttaagcatttatatggctttttttcctatgctaaaagggccttgtgtgcaatgccttttaggttcttgtcttttgcctctttatcatcttatacttttacaaagctctcagcctacaaactatgaggccagaagctagatgagcaaacttgagaactgcatctaaattaaatgtaactgttcttcaattgagggtcttatgatcatttctctgtagaaagtatacgagctttaccacatataatctatgattgtaatctattggttcttaagcttggctgtatgttataatcaacttggagctttaacagtcactaatgctgaaatcttaccccacctcccaaactgatttaattggtcttgag

SEQ ID NO: 42332 - DNA, 448 bp, Homo sapiens
gtctatgggcagaggggtggctccctactctgcaccctatgtactttgttcactacctctgtgagagaactaacatttcctctctccacccacagcctatgggccagttcatctccccatgctggatttcagcttataccccagcatggctcctgagcagtacaaggtggtatagtcagagctttgggaggctgggaactgagcagaagagctggatagtttaggcaaggaatgatcaaggccccaactgaagcaaagtggaaatgatttccatggccagttgaaaacaaccctgtggcattgcacagtgggaatccatgaagataaagagccagaagatatgagtgtgactcctggctccgtcactcttgatctgagtgactcgagaaagtcccttaacatctctgagcctgcttctccatccaaccaatggataagataatgtatg

SEQ ID NO: 42333 - DNA, 579 bp, Homo sapiens
cttccaaagtggctgtaacagtttgcattttcaccagcaatgagtgagacttcctgttactccacatccttgccaacatttggtgttgccagtattttgaattttgggtattttaataggtgcatagtagaatcttattgttttagtttgcaatttcctaatgacatatggcattgggcatcttatgcttgtttgtcacgtatgtatcttctttgataaggtgtctgctcagatctgttacccattgggttttttttattgatgatttttcagtgttctttatatattttagatatcagccctttatcagattatgtattttgcagatattttctcccagacagtggcttgtcttttcattcatttaacaatgtctttcattgagcagacatttgtaatgaaaaaatttcgactgttcagtttttttcagggatcgtgcttttagcattgtacccaaaaagtcatcaccaaacacaagttcacctagattttctcctatgttatcttccagaagttttacagttttgtgttttgcatttaggtctatgatccattttgagtaaatttttgtgaaagata

SEQ ID NO: 42334 - DNA, 384 bp, Homo sapiens
gtttttcgtatgtccaagatactgtaaaaggtacttctggattttgtagacgtgtgtacagtgtgggccacgttagccagttgtttgtgcctggctacttcaaaactcagcgaaagtgtttgcttttccagcagtgatgagaattctgacctagggcctgtgacaacagtttttgcttgctcgttgtattgcatttcaatctgtggactcggtcagtcatatgttacttaagaccttccagatttttttttcctgtcttagctttttctctcttttaattacgtggtgtagtcctcatcagtttgcagtctccctgtcctctaaaatctgttttgtttttttccatgatgttaaaaaaacaaaaaaatgttaaattttcttata

SEQ ID NO: 42335 - DNA, 415 bp, Homo sapiens
tggagcactgctttgttactgttagaagcaccattaaggcagtgacttgtttacattgttttagggcagctcacctctacagctgctctacctttcatgatcaacagaaataaaacaaactcagttcaggccctctttattaagcaattacttccttctgatgtacactaaaaaatgcatttagttacactgagatgctctcttgtttcagacaatacgaagaaaaataaactatttctctttcaagggtcatcatatctataatgggtggtttatagtaagtagctttcttgtttccttgggcaaaagaagcttcagaattttccttagccctctcagttttctggggaaagtgtggctaaacaaatttccaggttttctcgggctttacctcctcattaaataacagtgatag

SEQ ID NO: 42336 - DNA, 325 bp, Homo sapiens
aatctctacttgggaccttgcccctgaggcgcaagggtcaggctatgtgggaccccctcccttttgcattgttgcatggttttaacatcattaacttggaacaaaaacacattatagagtatggtttttaagaaataattttgtttggggaagaaaattcaaattgacaaatggcagttaaaatttggattcttttgcagttatggtacttgctattcatgcaaatcagtatccacccagggtgctcctgtttgacattgccagtggatttgataagatcttatgaaccatgccatctcttctagtttcctctgagttgactgga

SEQ ID NO: 42337 - DNA, 355 bp, Homo sapiens
tctcaccatgttggtcaggctggtcttgaactcctgaccttgtgatctgcctgcctcggcctcccaaagtgcagccactgcgcccggccaggctgaccattttgtatgggaaagtcagcactttcgtgaatgaacacattgatcaagccactgaggaaaatgtgattcaaatcataaggaggccaggacgaaggtcacacaaagagcccctgactctaatctacaatcatgacgaagggggccccagtccagttctaggagaagcctccctgccacatcctgtgacaagtttcacaccagcagggatcttgctgagccagttaggtgggctgagtccagccctggaagatgggcc

SEQ ID NO: 42338 - DNA, 632 bp, Homo sapiens
tttgttctgtagaagaaaattctttttcatttttgtcaatataaagaattgcctttttaggaaacaaatatagttatgccttattttcttgagtataaaacttagacatgtttactctccttctgggcaataccagggcattggaacaattttaattccactggtccctcatcagtttatttttgaaatttaatctaatagacttttaaacacataagacattattctatgttatgatcatggttcatttagatatgtctacatattcacatattctttgtgaaacgttttttcttgtatcttctgcccatttgggatcatcatcttgtacttcctctagaagttcctttcatgcggtctactggtgggaaactctttggagtttttatttttgtttttgtgcagaaatgtctttgtttgtttaatgtagtaatagatgagaatctacatttcctccattctggaatgatattttcactggatataaaattttgtgttggtggttattttcctttagcacactgaagataaacttccaccaccctctagcatctattgctgttcttgagaggttaactgttagtcttaatacagttcttttgatgataatttatattccccctccccccacc

SEQ ID NO: 42339 - DNA, 2080 bp, Homo sapiens
tctagggggcatctgtgctaactgacctgggattatgttggatggcatatgactgcaaattcaaagaaaccaatttataataagtttatagtaagttaaaggtttgttttactctcatgtgaagggaatctggaggaaggaaagccagggctggagtggctgcctttgatcatgggagcacactccttctgcccgatcattgggagcacactccttctgcctgatcgttgggagcacactcctgcctgatcatgggcgcacgctccttctgcccgatcgttgggagcacactccttctgcccaatcattgggctcacgctccttctgcccgatcgctgggctcacgctccttctgcccgatcttgggcgcacgctccttctgcccgatcgttgggcgcacgctccttctgcccgatcgttgggcgcatgctccttctgcccgatcgttgggagcacgctcattctgcccgattgttgggagcacgctccttctgcccgatcgttgggcgcacgctccttctgcccgatcgttgggcgcacgcttcttctgcctgatcgttgggcgcacgctccttctgcctgatcgttgggcgcacgctccttctgcctgatcgttgggagcacgctccttctgcctgattgttggaagcacgctccttctgccttcagactccttgatttttagtgcagtttccatcactgaggctgcctcatgggctgagatggctgttgaagcactgaacctcacatccacaattcaggcaggaagcagaaggaagggcaatgggcaaaggggctgtgccttgcagccgatccagcctccctttgctgcagaggaggcagggaaatgcggtatttactgggaacattgctgcccctcctccaaattgagggtcttggctcgaaggacaaaagccagaaaggataggtggattagtgcttcttaaacttttgcgtgcatcagaatcacccagaaagatgttaaaactcactcttcaaggccccatccccagagattcggattctggggatttggaatctggggtggggtctgaagaatctgcattttttaacaaactcccaggtgacatagatggcatcaattctcaagccatattttgagtagcactgacactcttccaataggtggtactttgacttgtcagggaagttctattgctctgataacttaaaaccaacccaaccagaagctcacaaaaactagcagcctgtgaaaaatgatcaccattttcctagagctccgagacaactagtggtagtgcaacagtaacccaaaaatgtcaatgaaaatatttccttccccagaaactgcttggtttcactcaggtcctgtccttatgggcctgtgtctggttgcagggcttgaagtatttcggaagctcagcagaggttgaaccctttcccctgggggttggtgatctttgttttggccatttccacctggtgaagattttcatagacaaatatgcttgtggcatcctgtaattcattgtgccttatgatggacctctgattctataagcttccccctagctagggatgcacgggggtgatcaagacatgactagatgtgaacctgacctgcagacagtccacctgaacgtgcctggaaatgtctcccgaaaaggatgaaaagcctcctcctttagacaaggaagacagagtggagcaaatttctctacatagatctcattcgaaaacaaatttacagaatgcagaatggctactgtgtgtcttgtgctatgctaggtctctctctctctaagtggactctgaccctgtccaaaacattgtgcttttgcatgtagctgtgtcgcatttaggcccagctctaagaaccgtttggaaataaatcacatagagcctttgattgtgaggcaggcttaaagtacattttgtttgatttgcagaggcatggtgaggaatttatatgcatggctgttgtggcagcagcgagatttccaaaaagatgaatgatgaaatgaaacagactgaagctatctcacaaatgttaaatggagaaataaaagttgttatagtcattgctaaaaaaaaaaga

SEQ ID NO: 42340 - DNA, 498 bp, Homo sapiens
ttatccctctgctccgtggaagctgttaagtggggagctattgaagaaggacttacaatgtttgtttcccgtctctcagggattactgtcctatgctggccaatgtctaatgtgtaaagaccattgatttacatgcttttctgtttattaattatttcaggcagtgggtaaatgtattccctattatttcaccttgactcaaaaccctgcctactcgtttttaaagtttaagctcaagcattaaatcctctccaaagtgtttcatattccattttctattcaggaatgatttgtttgcaaagaccacaagctctttcaaaaaagctgtaattggccaggtgtggtggctcacgcctgtaatcccattcagcactttgggaggccggggcaggaagattgcttgaggcaagattgcttgaggagtctctaactcctcaagcaggagttagagaccaggctgggcaacataccaagacctcatctttgttaaaaattgaa

SEQ ID NO: 42341 - DNA, 421 bp, Homo sapiens
tatatttttataggtaacgcttcagtgaatatcttaggaagtctttaattcagtaacctggagatacattgtattagaagaaatgtgttaaatttcatatttataaaagagccaatagatttttgttgtgaaaagatttattttaaataatatgaacatccaggcccagtggcttacacctgtaatcccagcactttgggaggctgaggtgggctgatcactggagtccaggagttcaagaccagcctgggcaacatagtgggaccccatctcttaaaaaaaatacaaaaattatttagacgttgtagtgctggcctgctgtcccagctactccggaggctgagcttgaacctgggaggctgaagctgcagtgagccgtgatcgcacaccactccagcgtgagctacagagtctcaaaaaa

SEQ ID NO: 42342 - DNA, 375 bp, Homo sapiens
actcagccctggactgtggctgccaaccagcaccagaaatgaacaaggcctcacagtggccctgctgtagggggagaagaagaagtcagcatgcatgaggagatggcccagaatggggacagcagggacaagccacccccaaaaagggttgctcactcaaggaccatctgtgacactgtgtttcctaatggaggagggctggggaccagggctgatgctcaagaccggggctcggatcagcactgctcagcagccataggaccctgggctgccccagccttaatttcctcctctgcaggatggggagagccaggccactttacacagggcactgttaggggcaggctctgtgaccatgcacgctctctaggtaaa

SEQ ID NO: 42343 - DNA, 535 bp, Homo sapiens
  misc_feature (490)..(490): n is a, c, g, or t
actcagccctggactgtggctgccaaccagcaccagaaatgaacaaggcctcacagtggccctgctgtagggggagaagaagaagtcagcatgcatgaggagatggcccagaatggggacagcagggacaagccacccccaaaaagggttgctcactcaaggaccatctgtgacactgtgtttcctaatggaggagggctggggaccagggctgatgctcaagaccggggctcggatcagcactgctcagcagccataggacccctcttccccagcccagtcacagggaagaaaggagggggagaagggaccagagagggcaagtctgccccccttaggagaaagcaccaaagggtggaaggaaggtttccgcatcccctcgctctggaagctgggagctgagggaagagcaaggggttgagcctggtgggggcttcatgtccgcacagcactggagcagacaagatggtgtgggggaaagggcagcaanggtgctctctctcagtccctcttccccagcggggatcctctgatc

SEQ ID NO: 42344 - DNA, 1578 bp, Homo sapiens
  misc_feature (1413)..(1413): n is a, c, g, or t
  misc_feature (1423)..(1423): n is a, c, g, or t
tcagaattgagcttttgttcctgcatctcagaaataccaggaagaagtcagcatctcattaaacaggagttgtctaaactgtggaagaaaatatcccccattctttatcctacgctgaatccacaagtcttcccatcttccaccatcttctgacagttccataatatattggtatccctcacagggcagggacaggaaggaaataaatctttctgccacttgtttccaaccgaaaaggaaaaaagttaaaaattactaaagtgttctgaaaagagatttcaagtggtctgtgctgcttttttgccttgttacgcacataacttgtgactggctagataggccacgtgtatttatcagccaagattccattgcagcagatgatttcaaaacctctttgtgtgctgggccgtgctaggtagctggaatatctgaggtaaattaagcactgatttgttcccagagttgtgcataattctttaaaagtaggctcgtttttttcgtttttttgtccaggatcacctaagtgaagtactcgtggttctaagttgctaacccagggaaagaggatattttcctgtcctaaccttggtttttgaaatatgcttctcctgtgtgccctctctggggtatctggcccacagtagattgctcagcagatatttgaatgagcagatgctttgctttgtcctcctgtgccaggctcctccccacatcctctggatcagctccacgtgcctagattcagactccgtgattcaccgtgggggcccttaataggcattcagtctgaaagaaggtggaggagaataatgtctcccaggatcaaatgagactcagggctgttccttcaaagacagaaacttgcagagctgcacagcagcagggaaacattgagaagggggtggaaatttgatgtactgtgaataatgaaggccggatctttaaaaagaaaaagggacggggtgctggcagaaacccagctctgcgctagcacaatctgtacacctggctgcctttgcccttgagcttctatttcttggggatggggagggcaaaaaagtttgccccagacactggcttctgtttgaacaggaagtggggagtcagtgatcccagaggggacttcagcatcaggacatatgctttggtggcctcagcagacctggcctaggcaggctttcaggtggcacccaggggctttatggcctgcaggtaaggccccttcatccgggtcagacttagcaaataaaaatataggacactcaattaagtttgcattttggataaacagtgaagaagttcctagtgtaagtatgtcccagttctatgtggctgccctacctgggcttgcctctgctggtactagctgcccagagaccttcaggcctgccacgggctgccgggacctctttnggatttcttntaagtaactgctccatactcccctgccttccccttggccatcaagatgatgtggaacatctcggcaggttcctccagcgaagcatcttgaacacaatgagccaggagctggtcccagcgagccgagtggccttgggctggggagtatggagcagt

SEQ ID NO: 42345 - DNA, 1475 bp, Homo sapiens
tcagaattgagcttttgttcctgcatctcagaaataccaggaagaagtcagcatctcattaaacaggagttgtctaaactgtggaagaaaatatcccccattctttatcctacgctgaatccacaagtcttcccatcttccaccatcttctgacagttccataatatattggtatccctcacagggcagggacaggaaggaaataaatctttctgccacttgtttccaaccgaaaaggaaaaaagttaaaaattactaaagtgttctgaaaagagatttcaagtggtctgtgctgcttttttgccttgttacgcacataacttgtgactggctagataggccacgtgtatttatcagccaagattccattgcagcagatgatttcaaaacctctttgtgtgctgggccgtgctaggtagctggaatatctgaggtaaattaagcactgatttgttcccagagttgtgcataattctttaaaagtaggctcgtttttttcgtttttttgtccaggatcacctaagtgaagtactcgtggttctaagttgctaacccagggaaagaggatattttcctgtcctaaccttggtttttgaaatatgcttctcctgtgtgccctctctggggtatctggcccacagtagattgctcagcagatatttgaatgagcagatgctttgctttgtcctcctgtgccaggctcctccccacatcctctggatcagctccacgtgcctagattcagactccgtgattcaccgtgggggcccttaataggcattcagtctgaaagaaggtggaggagaataatgtctcccaggatcaaatgagactcagggctgttccttcaaagacagaaacttgcagagctgcacagcagcagggaaacattgagaagggggtggaaatttgatgtactgtgaataatgaaggccggatctttaaaaagaaaaagggacggggtgctggcagaaacccagctctgcgctagcacaatctgtacacctggctgcctttgcccttgagcttctatttcttggggatggggagggcaaaaaagtttgccccagacactggcttctgtttgaacaggaagtggggagtcagtgatcccagaggggacttcagcatcaggacatatgctttggtggcctcagcagacctggcctaggcaggctttcaggtggcacccaggggctttatggcctgcaggtaaggccccttcatccgggtcagacttagcaaataaaaatataggacactcaattaagtttgcattttggataaacagtgaagaagttcctagtgtaagtatgtcccagttctatgtggctgccctacctgggcttgcctctgctggtactagctgcccagagaccttcaggcctgccacgggctgccgggacctctattatttaatataatatttccttattctattcttactgtagattgagtttattatctttatctcc

SEQ ID NO: 42346 - DNA, 250 bp, Homo sapiens
gagcgaggtgatctagaggatcccagatgatgagagaacccccaagattagtgcaagagatatttgtgtgagggaatgagcacttctaagtcagtgaaagctaccaacctgtatataccctctgacttttttttggagacaaaattttgctcttgttgcccaggctggagtacaatggcgcgatctcagctcaccgcaacctctgcctcctggattcaaatgattctcctgcctcagcctcctgagtagc

SEQ ID NO: 42347 - DNA, 1046 bp, Homo sapiens
  misc_feature (55)..(56): n is a, c, g, or t
  misc_feature (60)..(60): n is a, c, g, or t
  misc_feature (64)..(64): n is a, c, g, or t
  misc_feature (76)..(76): n is a, c, g, or t
  misc_feature (78)..(79): n is a, c, g, or t
  misc_feature (81)..(81): n is a, c, g, or t
cacaataacaacaacaaaaagatatgtagttataaattataaataattagaaaannttcntaanactaaacaaagnannantctaatcagaatatatcataaggactcaacccctaaaggagatttgtgaagatgaaatgtgatgattttgtccaggcatggtggcttattcctgtaattaatgccagcactttgggaggccgaggcagatggattgcttgcacctaggagtccaggaccagcctgagcaacataacaaaaccgcatctctgcaaaaaatgcaaaaattagttgagcgtggtgcacgtctgattctcccatttcagcctcccaagtagctgggactataggctcgtgccatcatgcctggctaatttttttattttttgtagaaatggggtttcaccatgttgcccaggctggtctctaattcctggactcaagcagtccaccagcctcagccttccagagtgctgggattacaggcatgagactgcaactggccacgccttttttttgtttaatgaaaccaatgacaatgtaaaagtctgtgctttagcatttcttcttaaagaacgatgaaactctttgatgaattaagatggaagattagctgagctgaacttactattgatagcgtgtaaactggttgcatctatttggagttcttactgtgacgagaggtctctgaaagggaatgtatttgttgaaaagtctttgggtacaaaacaagaaagggtaaccctttatcaaaaagaccaaagaaattctcattgtcctaggtcatgaaataatactcagggcatcctcctcacaacttggaaaatatagaacttgtgcattacctcatcccactggcttccagattatatgtgcaagagatatttgtgtgagggaatgagcacttctaagtcagtgaaagctaccaacctgtatataccctctgacttttttttggagacaaaattttgctcttgttgcccaggagtgagctgagattgtgccactgcacttcagcctgggctacagaatgagacctatccaaa

SEQ ID NO: 42348 - DNA, 767 bp, Homo sapiens
  misc_feature (109)..(110): n is a, c, g, or t
  misc_feature (114)..(114): n is a, c, g, or t
  misc_feature (118)..(118): n is a, c, g, or t
  misc_feature (130)..(130): n is a, c, g, or t
  misc_feature (132)..(133): n is a, c, g, or t
  misc_feature (135)..(135): n is a, c, g, or t
gaaaaatgatatatctccgctaagatgagatgatccgttagataaaactagacatagtaaacaaagataattgtggttaataaaattactaaacaataaattagaaaannttcntaanactaaacaaagnannantctaatcagaatatatcataaggactcaacccctaaaggagatttgtgaagatgaaatgtgatgattttaggcatgagactgcaactggccacgccttttttttgtttaatgaaaccaatgacaatgtaaaagtctgtgctttagcatttcttcttaaagaacgatgaaactctttgatgaattaagatggaagattagctgagctgaacttactattgatagcgtgtaaactggttgcatctatttggagttcttactgtgacgagaggtctctgaaagggaatgtatttgttgaaaagtctttgggtacaaaacaagaaagggtaaccctttatcaaaaagaccaaagaaattctcattgtcctaggtcatgaaataatactcagggcatcctcctcacaacttggaaaatatagaacttgtgcattacctcatcccactggcttccagattatatgtgcaagagatatttgtgtgagggaatgagcacttctaagtcagtgaaagctaccaacctgtatataccctctgacttttttttggagacaaaattttgctcttgttgcccaggagtgagctgagattgtgccactgcacttcagcctgggctacagaatgagacctatccaaa

SEQ ID NO: 42349 - DNA, 708 bp, Homo sapiens
  misc_feature (55)..(56): n is a, c, g, or t
  misc_feature (60)..(60): n is a, c, g, or t
  misc_feature (64)..(64): n is a, c, g, or t
  misc_feature (76)..(76): n is a, c, g, or t
  misc_feature (78)..(79): n is a, c, g, or t
  misc_feature (81)..(81): n is a, c, g, or t
cacaataacaacaacaaaaagatatgtagttataaattataaataattagaaaannttcntaanactaaacaaagnannantctaatcagaatatatcataaggactcaacccctaaaggagatttgtgaagatgaaatgtgatgattttgtccaggcatggtggcttattcctgtaattaatgccagcactttgggaggccgaggcagatggattgcttgcacctaggagtccaggaccagcctgagcaacataacaaaaccgcatctctgcaaaaaatgcaaaaattagttgagcgtggtgcacgtctgattctcccatttcagcctcccaagtagctgggactataggctcgtgccatcatgcctggctaatttttttattttttgtagaaatggggtttcaccatgttgcccaggctggtctctaattcctggactcaagcagtccaccagcctcagccttccagagtgctgggattacaggcatgagactgcaactggccacgccttttttttgtttaatgaaaccaatgacaatgtaaaagtctgtgctttagcatttcttcttaaagaacgatgaaactctttgatgaattaagatggaagattagctgagctgaacttactattgatagcgtgtaaactgagtgagctgagattgtgccactgcacttcagcctgggctacagaatgagacctatccaaa

SEQ ID NO: 42350 - DNA, 354 bp, Homo sapiens
ctctctcatctagcttcctgacagtagcatttggggaaatataattcttcttttcattttgccctctctctgcccctttcagttgaaactagcaatgtacctgctagtatagttttctcaaaaactttgtgagcctcctgtgaatcctattggggttaaatccactttaaaaacccacagccacaaatgtctttgaggaaagcccttctgtaccttgagttcgtgctgagatagctgagggacaatgttcttcagcttcctagaggctacattgcttgcctgagggaatctgtgagacttaacctgaatccctttgcgtgactgaatattaattcaatttatttttctaagaat

SEQ ID NO: 42351 - DNA, 846 bp, Homo sapiens
ataagtactatggagcacctttgagaaacgtaggtgcaaaatcatatgttgcctattcccccatattttcttgaggcagggaaagataccactactaattctcactgcttacaggcataatcagaaatggttttttgtttgcctgtttttccttctggctagtaagaagcgtaaaagagataatgaaatatttgtggtcaaaagaaagatgcaagggaaattccaaatagtatggagtaacattatttaaactttaatacatgtttaagcatccccaagggagcttgttaacagtacagattcctgggcccccagagggtctgtggttgagcccaggaatgtgcatttttattttattgagcactctgcctgactctggctcaggtagtccctgggaaactcttcaggaaacattcctgtagaaaatatatctatttaaatatcatctgttttatcccacaatgtttgtttcgtgttgcaagccattatcttctaggcatgggtaatccacattgagaggaaaatccacacaacattgtgcctgatttgctgccacctgtgtttgtgctggatcttgccagtgttagctttattttctttcaactggcaaaattctgataaagcatatagcttcacagtagagcaaaatgggtgacttaattgaaagtcatgactttcagcagtctaattatgctcatattttattttcttatagagagctgtctttattgtgtgtaattcccggaagaatgtaaagatttatctaattcctattgctctgccagttgtgttcaatgcaagcattgaagtaaaataaaaataacctttttaatatgtgtatttctg

SEQ ID NO: 42352 - DNA, 792 bp, Homo sapiens
ataagtactatggagcacctttgagaaacgtaggtgcaaaatcatatgttgcctattcccccatattttcttgaggcagggaaagataccactactaattctcactgcttacaggcataatcagaaatggttttttgtttgcctgtttttccttctggctagtaagaagcgtaaaagagataatgaaatatttgtggtcaaaagaaagatgcaagggaaattccaaatagtatggagtaacattatttaaactttaatacatgtttaagcatccccaagggagcttgttaacagtacagattcctgggcccccagagggtctgtggttgagcccaggaatgtgcatttttattttattgagcactctgcctgactctggctcaggtagtccctgggaaactcttcaggaaacattcctgtagaaaatatatctatttaaatatcatctgttttatcccacaatgtttgtttcgtgttgcaagccattatcttctaggcatgggtaatccacattgagaggttgccagtgttagctttattttctttcaactggcaaaattctgataaagcatatagcttcacagtagagcaaaatgggtgacttaattgaaagtcatgactttcagcagtctaattatgctcatattttattttcttatagagagctgtctttattgtgtgtaattcccggaagaatgtaaagatttatctaattcctattgctctgccagttgtgttcaatgcaagcattgaagtaaaataaaaataacctttttaatatgtgtatttctg

SEQ ID NO: 42353 - DNA, 980 bp, Homo sapiens
gaggagttggcgagcgcagaggttaataacctagcgcggcgtttctggtggccaggcatcccggtcctcgcgcgtggcgcagcctcccagcgccggaccgacccatgtcgcgcccgcattgggtcccgggaccccggcgggagtgccgcgtccgtcctttccagtcgccgggagtctgagtcgcgggccacgcgggagtggcggtggagagcccgccggtcgttatgaggacggatctaaaatgaccagcaaacggaaaccttgccaaacgcagctcaggagatccatcagtgagcagttgcgggactccacggccagagcctgggatctgctgtggaagaacgtccgggagaggcggctggcaggactatctcttgagctgggcagtgaccaccacatggggcagaagaaagttctagagaagaaggtctgatgcctagaaagaaggaaaggacaccactggtgaagcgggagatttaaccttctttgaactcctcccttttttccttacttgaactgtaaagcaagtggtttgctaggtgttctgcccttaaacccatgcacccacatcctcatcagcctgaaagcattctggggaagatgcccagaatctatagcaccttgagagaaggtcactagcaagctaaattagaagtggagattatggatgattccaacactcaatgttgtaagcatacaatgttcattccacattttctctccaacacagtggccacatttagtgtgcacctaagaaataaacagacttttttggtttggacccagaaataaattgtggtaacccagcagttttgactgttgatgtttaaaaacctgtacatgcactgtagacctcaattaataacaattagtaactttccctgttatcatgctaaattgtatattctacatgatggatggtgttagagaaatttttgtggtctagtaaacttttgttgcttcataacttcaaaaactta

SEQ ID NO: 42354 - DNA, 324 bp, Homo sapiens
tctccaatctcttagttgcgctttagtttattttgaagactttgatttaagtaaaataagtgaaagcattgtaaccactattctgtgtgctccgtaacatgctaatcctgctttatgtttttttttttaacaccaagttatcatggaacaaggatggaagcacctatttcttctctaagatttttcaagaaatttttggccatatttttcagcagattgttcagttattagtatgctgttatctcatcatttcacacttgcatttatgaaatgaaactgttagtgtgagtcacagtgacacttagccaccttgcaggcatttta

SEQ ID NO: 42355 - DNA, 229 bp, Homo sapiens
tacagggagtcagtcttggtgcaaggtgaggccacagagctgtaatgggcctgaccagcctcgcactgtacaagcaccaatctagagctaggactgaagctgcaagatgactgacaggactctgggggcattagctccctccaacaaatggtggtctcacgtttcaagggctgtggtcacctccttcctcgtgacacccctggacatggtggaaggtccatttgcagcc

SEQ ID NO: 42356 - DNA, 1524 bp, Homo sapiens
gatatacattgtttgcaaagtaaatgaaacaggttaacttcctggatgcttacttttagcagaaatatatcagatagcaaacttgctgacagatgaatcacagctttgcccacctgtaatgaggatacactgctggatcccagattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccactgattttatatctctttgctctgatttccgtgacatggctttggggaggactacacatggcctacagacacttctggatgttggttctctttgtcattttcaacagtctgcagggactttatgttttcatggtttatttcattttacacaaccaaatgtgttgccctatgaaggccagttacactgtggaaatgaatgggcatcctggacccagcacagcctttttcacgcccgggagtggaatgcctcctgctggaggggaaatcagcaagtccacccagaatctcatcggtgctatggaggaggtgccacctgactgggagagagcatccttccaacagggcagtcaggccagccctgatttaaagccaagtccacaaaatggagccacgttcccgtcctctggaggatatggccaggggtcactgatagccgatgaggagtcccaggagtttgatgatttaatatttgcattaaaaactggtgctggtctcagtgtcagtgataatgaatctggtcaaggcagccaggaggggggcaccttgactgactcccagatcgtggagctcaggaggatacccatcgccgacactcacctgtagcacctcactaaccattcgactgagcacactttcatatttgtatcagcttttgtgctaaaactctctaagtacatccacctgtgtaataggaacctgtgaattgtactggatgattaatacaaacgtgattgttgtatttggagtataaattactgattgtatgtgacctgaaaattcactgctataagaaaggtggagtcagtttgtatcagttaataggatgttcatattccaaggatattagttgtttttttaatcatcctatatggctaacattgtttaatgaaagtaataatcaataaagcaatagaatcta

SEQ ID NO: 42357 - DNA, 1743 bp, Homo sapiens
gatatacattgtttgcaaagtaaatgaaacaggttaacttcctggatgcttacttttagcagaaatatatcagatagcaaacttgctgacagatgaatcacagctttgcccacctgtaatgaggatacactgctggatcccagattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccactgattttatatctctttgctctgatttccgtgacatggctttggggaggactacacatggcctacagacacttctggatgttggttctctttgtcattttcaacagtctgcagggactttatgttttcatggtttatttcattttacacaaccaaatgtgttgccctatgaaggccagttacactgtggaaatgaatgggcatcctggacccagcacagcctttttcacgcccgggagtggaatgcctcctgctggaggggaaatcagcaagtccacccagaatctcatcggtgctatggaggaggtgccacctgactgggagagagcatccttccaacagggcagtcaggccagccctgatttaaagccaagtccacaaaatggagccacgttcccgtcctctggaggatatggccaggggtcactgatagccgatgaggagtcccaggagtttgatgatttaatatttgcattaaaaactggtgctggtctcagtgtcagtgataatgaatctggtcaaggcagccaggaggggggcaccttgactgactcccagatcgtggagctcaggaggatacccatcgccgacactcacctgtagcacctcactaaccattcgactgagcacactttcatatttgtatcagcttttgtgctaaaactctctaagtacatccacctgtgtaataggaacctgtgaattgtactggatgattaatacaaacgtgattgttgtatttggagtataaattactgattgtatgtgacctgaaaattcactgctataagaaaggtggagtcagtttgtatcagttaataggatgttcatattccaaggatattagttgtttttttaatcatcctatatggctaacattgtttaatgaaagtaataatcaataaagcaatagaatctatttggtatcatccagcttcattattgataaagaaacattgtgcatgggcaaaaaaagctaactctatatgtagatgatgacaagcaccctgtgccatcttgcatgaatccaggtgatccagattcaagacttcactgcaactagaagactttaattctgaaaactgtaaaatggtctgtctgttgatgatcctgcacataaatgttgattggagtactg

SEQ ID NO: 42358 - DNA, 1469 bp, Homo sapiens
gatatacattgtttgcaaagtaaatgaaacaggttaacttcctggatgcttacttttagcagaaatatatcagatagcaaacttgctgacagatgaatcacagctttgcccacctgtaatgaggatacactgctggatcccagattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccactgattttatatctctttgctctgatttccgtgacatggctttggggaggactacacatggcctacagacacttctggatgttggttctctttgtcattttcaacagtctgcagggactttatgttttcatggtttatttcattttacacaaccaaatgtgttgccctatgaaggccagttacactgtggaaatgaatgggcatcctggacccagcacagcctttttcacgcccgggagtggaatgcctcctgctggaggggaaatcagcaagtccacccagaatctcatcggtgctatggaggaggtgccacctgactgggagagagcatccttccaacagggcagtcaggccagccctgatttaaagccaagtccacaaaatggagccacgttcccgtcctctggaggatatggccaggggtcactgatagccgatgaggagtcccaggagtttgatgatttaatatttgcattaaaaactggtgctggtctcagtgtcagtgataatgaatctggtcaaggcagccaggaggggggcaccttgactgactcccagatcgtggagctcaggaggatacccatcgccgacactcacctgtgctaaaactctctaagtacatccacctgtgtaataggaacctgtgaattgtactggatgattaatacaaacgtgattgttgtatttggagtataaattactgattgtatgtgacctgaaaattcactgctataagaaaggtggagtcagtttgtatcagttaataggatgttcatattccaaggatattagttgtttttttaatcatcctatatggctaacattgtttaatgaaagtaataatcaataaagcaatagaatcta

SEQ ID NO: 42359 - DNA, 1566 bp, Homo sapiens
ttggcttctgccctcaaccaaaatggcgctagctcggaagctgccgaggtgctaggagttgccgaagcaagtccggaagctaccgagcgagtccggaagttgccgaaagggagcagcggggaaggaggatggcggatatcatcgcaagactccgggaggacgggatccaaaaacgtgtgatacaggaaggccgaggagagctcccggactttcaagatgggaccaaggccacgttccactaccggacgctgcacagtgacgacgagggcaccgtgctggacgacagccgggctcgtggcaagcccatggagctcatcattggcaagaagttcaagctgcctgtgtgggagaccatcgtgtgcaccatgcgagaaggggagattgcccagttcctctgtgacatcaagcatgtggtcctgtacccgctggtggccaagagtctccgcaacatcgcggtgggcaaggaccccctggagggccagcggcactgctgcggtgttgcacagatgcgtgaacacagctccctgggccatgctgacctggacgccctgcagcagaacccccagcccctcatcttccacatggagatgctgaaggtggagagccctggcacgtaccagcaggacccatgggccatgacagacgaagagaaggcaaaggcagtgccacttatccaccaggagggcaaccggttgtaccgcgaggggcatgtgaaggaggctgctgccaagtactacgatgccattgcctgcctcaagaacctgcagatgaaggaacagcctgggtcccctgaatggatccagctggacaagcagatcacgccgctgctgctcaactactgccagtgcaagctggtggtcgaggagtactacgaggtgctggaccactgctcttccatcctcaacaagtacgacgacaacgtcaaggcctacttcaagcggggcaaggcccacgcggccgtgtggaatgcccaggaggcccaggctgactttgccaaagtgctggagctggacccagccctggcgcctgtggtgagccgagagctgcgggccctggaggcacggatccggcagaaggacgaagaggacaaagcccggttccgggggatcttctcccattgacaggagcacttggccctgccttacctgccaagcccactgctgcagctgccagcccccctgcccgtgctgcgtcatgcttctgtgtatataaaggcctttatttatctctctctctgagtctgctgagctgctccactgggagagccgggtcatcacctggcattcctggtacttgggtggctgttgggaggcaaagaatcagggttcaaatcctagcccctccacccaccagctctgaggctctggtgtccctgttagagaaattacgatgagctctttcaccaaggaagtgtctctcgctggccagggctggggcgccccaggagcccacagtcttaagggggagatgaagtgggtacaagctaggtagctgggcacctgagggaggtagtctcctggtgctgccctcccactccagcctcggatcccatggtctcctggcctc

SEQ ID NO: 42360 - DNA, 745 bp, Homo sapiens
ggaaacccagggccgggagtggtcctcgggtatctgggtttcaaggctcatgatcctttgtagatggaagggccttctgaaaacacttagaccaactgccgctgtttagagtggaaaaccaagaccctgggacgtgcaaagccggagaacgggcccagaggccacgttccactaccggacgctgcacagtgacgacgagggcaccgtgctggacgacagccgggctcgtggcaagcccatggagctcatcattggcaagaagttcaagctgcctgtgtgggagaccatcgtgtgcaccatgcgagaaggggagattgcccagttcctctgtgacatcaagcatgtggtcctgtacccgctggtggccaagagtctccgcaacatcgcggtgggcaaggaccccctggagggccagcggcactgctgcggtgttgcacagatgcgtgaacacagctccctgggccatgctgacctggacgccctgcagcagaacccccagcccctcatcttccacatggagatgctgaaggtggagagccctggcacgtaccagcaggacccatgggccatgacagacgaagagaaggcaaaggcagtgccacttatccaccaggagggcaaccggttgtaccgcgaggggcatgtgaaggaggctgctgccaagtactacgatgccattgcctgcctcaagaacctgcagatgaagtcccctgtaggatctagtaaacaacagtaccgctgcttg

SEQ ID NO: 42361 - DNA, 1231 bp, Homo sapiens
ttggcttctgccctcaaccaaaatggcgctagctcggaagctgccgaggtgctaggagttgccgaagcaagtccggaagctaccgagcgagtccggaagttgccgaaagggagcagcggggaaggaggatggcggatatcatcgcaagactccgggaggacgggatccaaaaacgtgtgatacaggaaggccgaggagagctcccggactttcaagatgggaccaaggccacgttccactaccggacgctgcacagtgacgacgagggcaccgtgctggacgacagccgggctcgtggcaagcccatggagctcatcattggcaagaagttcaagctgcctgtgtgggagaccatcgtgtgcaccatgcgagaaggggagattgcccagttcctctgtgacatcaagcatgtggtcctgtacccgctggtggccaagagtctccgcaacatcgcggtgggcaaggaccccctggagggccagcggcactgctgcggtgttgcacagatgcgtgaacacagctccctgggccatgctgacctggacgccctgcagcagaacccccagcccctcatcttccacatggagatgctgaaggtggagagccctggcacgtaccagcaggacccatgggccatgacagacgaagagaaggcaaaggcagtgccacttatccaccaggagggcaaccggttgtaccgcgaggggcatgtgaaggaggctgctgccaagtactacgatgccattgcctgcctcaagaacctgcagatgaaggaacagcctgggtcccctgaatggatccagctggacaagcagatcacgccgctgctgctcaactactgccagtgcaagctggtggtcgaggagtactacgaggtgctggaccactgctcttccatcctcaacaagtacgacgacaacgtcaaggcctacttcaagcggggcaaggcccacgcggccgtgtggaatgcccaggaggcccaggctgactttgccaaagtgctggagctggacccagccctggcgcctgtggtgagccgagagctgcgggccctggaggcacggatccggcagaaggacgaagaggacaaagcccggttccgggggatcttctcccattgacaggagcacttggccctgccttacctgccaagcccactgctgcagctgccagcccccctgcccgtgctgcgtcatgcttctgtgtatataaaggcctttatttatctctc

SEQ ID NO: 42362 - DNA, 1909 bp, Homo sapiens
ttggcttctgccctcaaccaaaatggcgctagctcggaagctgccgaggtgctaggagttgccgaagcaagtccggaagctaccgagcgagtccggaagttgccgaaagggagcagcggggaaggaggatggcggatatcatcgcaagactccgggaggacgggatccaaaaacgtgtgatacaggaaggccgaggagagctcccggactttcaagatgggaccaaggccacgttccactaccggacgctgcacagtgacgacgagggcaccgtgctggacgacagccgggctcgtggcaagcccatggagctcatcattggcaagaagttcaagctgcctgtgtgggagaccatcgtgtgcaccatgcgagaaggggagattgcccagttcctctgtgacatcaagcatgtggtcctgtacccgctggtggccaagagtctccgcaacatcgcggtgggcaaggaccccctggagggccagcggcactgctgcggtgttgcacagatgcgtgaacacagctccctgggccatgctgacctggacgccctgcagcagaacccccagcccctcatcttccacatggagatgctgaaggtggagagccctggcacgtaccagcaggacccatgggccatgacagacgaagagaaggcaaaggcagtgccacttatccaccaggagggcaaccggttgtaccgcgaggggcatgtgaaggaggctgctgccaagtactacgatgccattgcctgcctcaagaacctgcagatgaaggaacagcctgggtcccctgaatggatccagctggacaagcagatcacgccgctgctgctcaactactgccagtgcaagctggtggtcgaggagtactacgaggtgctggaccactgctcttccatcctcaacaagtacgacgacaacgtcaaggcctacttcaagcggggcaaggcccacgcggccgtgtggaatgcccaggaggcccaggctgactttgccaaagtgctggagctggacccagccctggcgcctgtggtgagccgagagctgcgggccctggaggcacggatccggcagaaggacgaagaggacaaagcccggttccgggggatcttctcccattgacaggagcacttggccctgccttacctgccaagcccactgctgcagctgccagcccccctgcccgtgctgcgtcatgcttctgtgtatataaaggcctttatttatctctcaaaaaaaaaaaaaaaaaaaaaaaaaaaaaaaaaaaaaaaaaaaaaaaaaaaaaaaaaaagagagagggggggcgcgcgcgccccaagagagtctctctccccgcggggggcgcgccccaggttccgcgcgccgctccacccgcgtgttttgtgtgtgtgaacaaagaggggcgccccacataaggagaggagacgtctatattattataaagcgctagagagcgaacggcggcgcgcgccttttttcttacacaaacgactgtgtgcggagagagggagagacacaagccgtgcgcaaccacggcgagagacctcttttgagggagagaggagacccccttatatctctctcgcgggggggggggggagccaccatatatctgtggcgcgacaaatactctctcccccacacagagagagatttttatcaaacgagctcatctccacgagagggagacacatatctatctccatatctcttctaccacgcgcgtgtgctgtatctcctgcgcgctgtgctacaacaacacaaccgcgacagaaattgtcctggtcgcgcgcgcgacaaaggaagaatttttgtgcgcccgcctcccccggggggcgcacttccgctgcttcaccacagacaaattttttttatcccccgggccgtactgatattttacaataagttgg

SEQ ID NO: 42363 - DNA, 1178 bp, Homo sapiens
  misc_feature (1157)..(1157): n is a, c, g, or t
ttggcttctgccctcaaccaaaatggcgctagctcggaagctgccgaggtgctaggagttgccgaagcaagtccggaagctaccgagcgagtccggaagttgccgaaagggagcagcggggaaggaggatggcggatatcatcgcaagactccgggaggacgggatccaaaaacgtgtgatacaggaaggccgaggagagctcccggactttcaagatgggaccaaggccacgttccactaccggacgctgcacagtgacgacgagggcaccgtgctggacgacagccgggctcgtggcaagcccatggagctcatcattggcaagaagttcaagctgcctgtgtgggagaccatcgtgtgcaccatgcgagaaggggagattgcccagttcctctgtgacatcaagcatgtggtcctgtacccgctggtggccaagagtctccgcaacatcgcggtgggcaaggaccccctggagggccagcggcactgctgcggtgttgcacagatgcgtgaacacagctccctgggccatgctgacctggacgccctgcagcagaacccccagcccctcatcttccacatggagatgctgaaggtggagagccctggcacgtaccagcaggacccatgggccatgacagacgaagagaaggcaaaggcagtgccacttatccaccaggagggcaaccggttgtaccgcgaggggcatgtgaaggaggctgctgccaagtactacgatgccattgcctgcctcaagaacctgcagatgaaggaacagcctgggtcccctgaatggatccagctggacaagcagatcacgccgctgctgctcaactactgccagtgcaagctggtggtcgaggagtactacgaggtgctggaccactgctcttccatcctcaacaagtacgacgacaacgtcaaggcctacttcaagcggggcaaggcccacgcggccgtgtggaatgcccaggaggcccaggctgactttgccaaagtgctggagctggacccagccctggcgcctgtggtgagccgagagctgcgggccctggaggcacggatccggcagaaggacgaagaggacaaagcccggttccgggggatcttctcccattgacaggagcacttggccctgacacatatacacacatanacacacacacacacacacaca

SEQ ID NO: 42364 - DNA, 1021 bp, Homo sapiens
ttggcttctgccctcaaccaaaatggcgctagctcggaagctgccgaggtgctaggagttgccgaagcaagtccggaagctaccgagcgagtccggaagttgccgaaagggagcagcggggaaggaggatggcggatatcatcgcaagactccgggaggacgggatccaaaaacgtgtgatacaggaaggccgaggagagctcccggactttcaagatgggaccaaggccacgttccactaccggacgctgcacagtgacgacgagggcaccgtgctggacgacagccgggctcgtggcaagcccatggagctcatcattggcaagaagttcaagctgcctgtgtgggagaccatcgtgtgcaccatgcgagaaggggagattgcccagttcctctgtgacatcaagcatgtggtcctgtacccgctggtggccaagagtctccgcaacatcgcggtgggcaaggaccccctggagggccagcggcactgctgcggtgttgcacagatgcgtgaacacagctccctgggccatgctgacctggacgccctgcagcagaacccccagcccctcatcttccacatggagatgctgaaggtggagagccctggcacgtaccagcaggacccatgggccatgacagacgaagagaaggcaaaggcagtgccacttatccaccaggagggcaaccggttgtaccgcgaggggcatgtgaaggaggctgctgccaagtactacgatgccattgcctgcctcaagaacctgcagatgaaggctgactttgccaaagtgctggagctggacccagccctggcgcctgtggtgagccgagagctgcgggccctggaggcacggatccggcagaaggacgaagaggacaaagcccggttccgggggatcttctcccattgacaggagcacttggccctgccttacctgccaagcccactgctgcagctgccagcccccctgcccgtgctgcgtcatgcttctgtgtatataaaggcctttatttatctctc

SEQ ID NO: 42365 - DNA, 812 bp, Homo sapiens
ttggcttctgccctcaaccaaaatggcgctagctcggaagctgccgaggtgctaggagttgccgaagcaagtccggaagctaccgagcgagtccggaagttgccgaaagggagcagcggggaaggaggatggcggatatcatcgcaagactccgggaggacgggatccaaaaacgtgtgatacaggaaggccgaggagagctcccggactttcaagatgggaccaaggccacgttccactaccggacgctgcacagtgacgacgagggcaccgtgctggacgacagccgggctcgtggcaagcccatggagctcatcattggcaagaagttcaagctgcctgtgtgggagaccatcgtgtgcaccatgcgagaaggggagattgcccagttcctctgtgacatcaagcatgtggtcctgtacccgctggtggccaagagtctccgcaacatcgcggtgggcaaggaccccctggagggccagcggcactgctgcggtgttgcacagatgcgtgaacacagctccctgggccatgctgacctggacgccctgcagcagaacccccagcccctcatcttccacatggagatgctgaaggtggagagccctggcacgtaccagcaggacccatgggccatgacagacgaagagaaggcaaaggcagtgccacttatccaccaggagggcaaccggttgtaccgcgaggggcatgtgaaggaggctgctgccaagtactacgatgccattgcctgcctcaagaacctgcagatgaagtcccctgtaggatctagtaaacaacagtaccgctgcttg

SEQ ID NO: 42366 - DNA, 711 bp, Homo sapiens
cgtggtgaattcgtcgtcgtggtccatggtgcagcagaacccccagcccctcatcttccacatggagatgctgaaggtggagagccctggcacgtaccagcaggacccatgggccatgacagacgaagagaaggcaaaggcagtgccacttatccaccaggagggcaaccggttgtaccgcgaggggcatgtgaaggaggctgctgccaagtactacgatgccattgcctgcctcaagaacctgcagatgaaggaacagcctgggtcccctgaatggatccagctggacaagcagatcacgccgctgctgctcaactactgccagtgcaagctggtggtcgaggagtactacgaggtgctggaccactgctcttccatcctcaacaagtacgacgacaacgtcaaggcctacttcaagcggggcaaggcccacgcggccgtgtggaatgcccaggaggcccaggctgactttgccaaagtgctggagctggacccagccctggcgcctgtggtgagccgagagctgcgggccctggaggcacggatccggcagaaggacgaagaggacaaagcccggttccgggggatcttctcccattgacaggagcacttggccctgccttacctgccaagcccactgctgcagctgccagcccccctgcccgtgctgcgtcatgcttctgtgtatataaaggcctttatttatctctc

SEQ ID NO: 42367 - DNA, 865 bp, Homo sapiens
ttggcttctgccctcaaccaaaatggcgctagctcggaagctgccgaggtgctaggagttgccgaagcaagtccggaagctaccgagcgagtccggaagttgccgaaagggagcagcggggaaggaggatggcggatatcatcgcaagactccgggaggacgggatccaaaaacgtgtgatacaggaaggccgaggagagctcccggactttcaagatgggaccaaggccacgttccactaccggacgctgcacagtgacgacgagggcaccgtgctggacgacagccgggctcgtggcaagcccatggagctcatcattggcaagaagttcaagctgcctgtgtgggagaccatcgtgtgcaccatgcgagaaggggagattgcccagttcctctgtgacatcaagcatgtggtcctgtacccgctggtggccaagagtctccgcaacatcgcggtgggcaaggaccccctggagggccagcggcactgctgcggtgttgcacagatgcgtgaacacagctccctgggccatgctgacctggacgcccacaacgtcaaggcctacttcaagcggggcaaggcccacgcggccgtgtggaatgcccaggaggcccaggctgactttgccaaagtgctggagctggacccagccctggcgcctgtggtgagccgagagctgcgggccctggaggcacggatccggcagaaggacgaagaggacaaagcccggttccgggggatcttctcccattgacaggagcacttggccctgccttacctgccaagcccactgctgcagctgccagcccccctgcccgtgctgcgtcatgcttctgtgtatataaaggcctttatttatctctc

SEQ ID NO: 42368 - DNA, 538 bp, Homo sapiens
ttagcacttggcacagtgctgggcacacaggagatgtgacatcgatgtttgtttgatgctttttgagtgacaagtagctctgctgctggtgtgtgatgtctgggggcccagccagcccagatgtgggtcaggtctgctgctgacggacgcagctgtggtgtccccgagccccgctgtgatatgccccatgccctgcaggtggagagccctggcacgtaccagcaggacccatgggccatgacagacgaagagaaggcaaaggggccgtgtggaatgcccaggaggcccaggctgactttgccaaagtgctggagctggacccagccctggcgcctgtggtgagccgagagctgcgggccctggaggcacggatccggcagaaggacgaagaggacaaagcccggttccgggggatcttctcccattgacaggagcacttggccctgccttacctgccaagcccactgctgcagctgccagcccccctgcccgtgctgcgtcatgcttctgtgtatataaaggcctttatttatctctc

SEQ ID NO: 42369 - DNA, 1266 bp, Homo sapiens
  misc_feature (1251)..(1251): n is a, c, g, or t
  misc_feature (1263)..(1263): n is a, c, g, or t
ttggcttctgccctcaaccaaaatggcgctagctcggaagctgccgaggtgctaggagttgccgaagcaagtccggaagctaccgagcgagtccggaagttgccgaaagggagcagcggggaaggaggatggcggatatcatcgcaagactccgggaggacgggatccaaaaacgtgtgatacaggaaggccgaggagagctcccggactttcaagatgggaccaaggccacgttccactaccggacgctgcacagtgacgacgagggcaccgtgctggacgacagccgggctcgtggcaagcccatggagctcatcattggcaagaagttcaagctgcctgtgtgggagaccatcgtgtgcaccatgcgagaaggggagattgcccagttcctctgtgacatcaagcatgtggtcctgtacccgctggtggccaagagtctccgcaacatcgcggtgggcaaggaccccctggagggccagcggcactgctgcggtgttgcacagatgcgtgaacacagctccctgggccatgctgacctggacgccctgcagcagaacccccagcccctcatcttccacatggagatgctgaaggtggagagccctggcacgtaccagcaggacccatgggccatgacagacgaagagaaggcaaaggcagtgccacttatccaccaggagggcaaccggttgtaccgcgaggggcatgtgaaggaggctgctgccaagtactacgatgccattgcctgcctcaagaacctgcagatgaaggaacagcctgggtcccctgaatggatccagctggacaagcagatcacgccgctgctgctcaactactgccagtgcaagctggtggtcgaggagtactacgaggtgctggaccactgctcttccatcctcaacaagtacgacgacaacgtcaaggcctacttcaagcggggcaaggcccacgcggccgtgtggaatgcccaggaggcccaggctgactttgccaaagtgctggagctggacccagccctggcgcctgtggtgagccgagagctgcgggccctggaggcacggatccggcagaaggacgaagaggacaaagcccggttccgggggatcttctcccattgacaggagcacttggccctgccttacctgccaagcccactgctgcagctgccagcccccctgcccgtgctgcgtcatgcttctgtgtatataaaggcctttatttatctctcaaaaaaaaaaaacacacaanaaacacaacacnaca

SEQ ID NO: 42370 - DNA, 1325 bp, Homo sapiens
  misc_feature (1310)..(1310): n is a, c, g, or t
  misc_feature (1322)..(1322): n is a, c, g, or t
ttggcttctgccctcaaccaaaatggcgctagctcggaagctgccgaggtgctaggagttgccgaagcaagtccggaagctaccgagcgagtccggaagttgccgaaagggagcagcggggaaggaggatggcggatatcatcgcaagactccgggaggacgggatccaaaaacgtgtgatacaggaaggccgaggagagctcccggactttcaagatgggaccaaggccacgttccactaccggacgctgcacagtgacgacgagggcaccgtgctggacgacagccgggctcgtggcaagcccatggagctcatcattggcaagaagttcaagctgcctgtgtgggagaccatcgtgtgcaccatgcgagaaggggagattgcccagttcctctgtgacatcaagcatgtggtcctgtacccgctggtggccaagagtctccgcaacatcgcggtgggcaaggaccccctggagggccagcggcactgctgcggtgttgcacagatgcgtgaacacagctccctgggccatgctgacctggacgccctgcagcagaacccccagcccctcatcttccacatggagatgctgaaggtggagagccctggcacgtaccagcaggacccatgggccatgacagacgaagagaaggcaaaggcagtgccacttatccaccaggagggcaaccggttgtaccgcgaggggcatgtgaaggaggctgctgccaagtactacgatgccattgcctgcctcaagaacctgcagatgaaggaacagcctgggtcccctgaatggatccagctggacaagcagatcacgccgctgctgctcaactactgccagtgcaagctggtggtcgaggagtactacgaggtgctggaccactgctcttccatcctcaacaagtacgacgacaacgtcaaggcctacttcaagcggggcaaggcccacgcggccgtgtggaatgcccaggaggcccaggctgactttgccaaagtgctggagctggacccagccctggcgcctgtggtgagccgagagctgcgggccctggaggcacggatccggcagaaggacgaagaggacaaagcccggttccgggggatcttctcccattgacaggagcacttggccctgccttacctgccaagcccactgctgcagctgccagcccccctgcccgtgctgcgtcatgcttctgtgtatataaaggcctttatttatctctcaaaaaaaaaaaaaaaaaaaaaaaaaaaaaaaaaaaaaaaaaaaaaaaaaaaaaaaaaaaaaaaaaaaaaaacacacaanaaacacaacacnaca

SEQ ID NO: 42371 - DNA, 1144 bp, Homo sapiens
tgacctagaggacccgtcagttccagcagcggggaaggaggatggcggatatcatcgcaagactccgggaggacgggatccaaaaacgtgtgatacaggaaggccgaggagagctcccggactttcaagatgggaccaaggccacgttccactaccggacgctgcacagtgacgacgagggcaccgtgctggacgacagccgggctcgtggcaagcccatggagctcatcattggcaagaagttcaagctgcctgtgtgggagaccatcgtgtgcaccatgcgagaaggggagattgcccagttcctctgtgacatcaagcatgtggtcctgtacccgctggtggccaagagtctccgcaacatcgcggtgggcaaggaccccctggagggccagcggcactgctgcggtgttgcacagatgcgtgaacacagctccctgggccatgctgacctggacgccctgcagcagaacccccagcccctcatcttccacatggagatgctgaaggtggagagccctggcacgtaccagcaggacccatgggccatgacagacgaagagaaggcaaaggcagtgccacttatccaccaggagggcaaccggttgtaccgcgaggggcatgtgaaggaggctgctgccaagtactacgatgccattgcctgcctcaagaacctgcagatgaaggaacagcctgggtcccctgaatggatccagctggacaagcagatcacgccgctgctgctcaactactgccagtgcaagctggtggtcgaggagtactacgaggtgctggaccactgctcttccatcctcaacaagtacgacgacaacgtcaaggcctacttcaagcggggcaaggcccacgcggccgtgtggaatgcccaggaggcccaggctgactttgccaaagtgctggagctggacccagccctggcgcctgtggtgagccgagagctgcgggccctggaggcacggatccggcagaaggacgaagaggacaaagcccggttccgggggatcttctcccattgacaggagcacttggccctgccttacctgccaagcccactgctgcagctgccagcccccctgcccgtgctgcgtcatgcttctgtgtatataaaggcctttatttatctctc

SEQ ID NO: 42372 - DNA, 1042 bp, Homo sapiens
ttggcttctgccctcaaccaaaatggcgctagctcggaagctgccgaggtgctaggagttgccgaagcaagtccggaagctaccgagcgagtccggaagttgccgaaagggagcagcggggaaggaggatggcggatatcatcgcaagactccgggaggacgggatccaaaaacgtgtgatacaggaaggccgaggagagctcccggactttcaagatgggaccaaggccacgttccactaccggacgctgcacagtgacgacgagggcaccgtgctggacgacagccgggctcgtggcaagcccatggagctcatcattggcaagaagttcaagctgcctgtgtgggagaccatcgtgtgcaccatgcgagaaggggagattgcccagttcctctgtgacatcaaggtggagagccctggcacgtaccagcaggacccatgggccatgacagacgaagagaaggcaaaggcagtgccacttatccaccaggagggcaaccggttgtaccgcgaggggcatgtgaaggaggctgctgccaagtactacgatgccattgcctgcctcaagaacctgcagatgaaggaacagcctgggtcccctgaatggatccagctggacaagcagatcacgccgctgctgctcaactactgccagtgcaagctggtggtcgaggagtactacgaggtgctggaccactgctcttccatcctcaacaagtacgacgacaacgtcaaggcctacttcaagcggggcaaggcccacgcggccgtgtggaatgcccaggaggcccaggctgactttgccaaagtgctggagctggacccagccctggcgcctgtggtgagccgagagctgcgggccctggaggcacggatccggcagaaggacgaagaggacaaagcccggttccgggggatcttctcccattgacaggagcacttggccctgccttacctgccaagcccactgctgcagctgccagcccccctgcccgtgctgcgtcatgcttctgtgtatataaaggcctttatttatctctc

SEQ ID NO: 42373 - DNA, 789 bp, Homo sapiens
ttggcttctgccctcaaccaaaatggcgctagctcggaagctgccgaggtgctaggagttgccgaagcaagtccggaagctaccgagcgagtccggaagttgccgaaagggagcagcggggaaggaggatggcggatatcatcgcaagactccgggaggacgggatccaaaaacgtgtgatacaggaaggccgaggagagctcccggactttcaagatgggaccaaggccacgttccactaccggacgctgcacagtgacgacgagggcaccgtgctggacgacagccgggctcgtggcaagcccatggagctcatcattggcaagaagttcaagctgcctgtgtgggagaccatcgtgtgcaccatgcgagaaggggagattgcccagttcctctgtgacatcaagcatgtggtcctgtacccgctggtggccaagagtctccgcaacatcgcggtgggcaaggaccccctggagggccagcggcactgctgcggtgttgcacagatgcgtgaacacagctccctgggccatgctgacctggacgccctgcagcagaacccccagcccctcatcttccacatggagatgctgaaggtggagagccctggcacgtaccagcaggacccatgggccatgacagacgaagagaaggcaaaggggggatcttctcccattgacaggagcacttggccctgccttacctgccaagcccactgctgcagctgccagcccccctgcccgtgctgcgtcatgcttctgtgtatataaaggcctttatttatctctc

SEQ ID NO: 42374 - DNA, 660 bp, Homo sapiens
ttggcttctgccctcaaccaaaatggcgctagctcggaagctgccgaggtgctaggagttgccgaagcaagtccggaagctaccgagcgagtccggaagttgccgaaagggagcagcggggaaggaggatggcggatatcatcgcaagactccgggaggacgggatccaaaaacgtgtgatacaggaaggccgaggagagctcccggactttcaagatgggaccaaggccacgttccactaccggacgctgcacagtgacgacgagggcaccgtgctggacgacagccgggctcgtggcaagcccatggagctcatcattggcaagaagttcaagctgcctgtgtgggagaccatcgtgtgcaccatgcgagaaggggagattgcccagttcctctgtgacatcaagcatgtggtcctgtacccgctggtggccaagagtctccgcaacatcgcggtgggcaaggaccccctggagggccagcggcactgctgcggtgttgcacagatgcgtgaacacagctccctgggccatgctgacctggacgccctcgcccctgagttgcagctcgcccctgagttagctgcagctcgcccctgagttagttgcggctcgcccctgagttagtcgcagctcgcccctgagttagttgcggctcgcc

SEQ ID NO: 42375 - DNA, 1206 bp, Homo sapiens
caaagcccagctacaggcgggcgactgcggggggcccctgaggcggcgggggccatggctggggtcgcgtgcttgggaaaagctgccgacgcagatgaatggtgcgacagcggcctgggctccctgggtccggacgcagcggcccccggaggacctgggttgggcgcggagttgggcccggggctgtcgtgggctcccctcgtcttcggctacgtcactgaggatggggacacggcactgcacttggctgtgattcatcagcatgaacccttcctggattttcttctaggcttctcggccggcactgagtacatggacctgcagaatgacctaggccagacagccctgcacctggcagccatcctgggggagacatccacggtggagaagctgtacgcagcaggcgccgggctgtgtgtggcggagcgtaggggccacacggcgctgcacctggcctgccgtgtgggggcacacgcctgtgcccgtgccctgcttcagccccgcccccggcgccccagggaagcccccgacacctacctcgctcagggccctgaccgtactcccgacaccaaccatacccctgtcgccttgtaccccgattccgacttggagaaggaagaagaggagagtgaggaggactggaagctgcagctggaggctgaaaactacgagggccacaccccactccacgtggccgttatccacaaagatgtggagatggtccggctgctccgagatgctggagctgaccttgacaaaccggagcccacgtgcggccggagcccccttcatttggcagtggaggcccaggcagccgatgtgctggagcttctcctgagggcaggcgcgaaccctgctgcccgcatgtacggtggccgcaccccactcggcagtgccatgctccggcccaaccccatcctcgcccgcctcctccgtgcacacggagcccctgagcccgagggcgaggacgagaaatccggcccctgcagcagcagtagcgacagcgacagcggagacgagggcgatgaatacgacgacattgtggttcacagcagccgcagccaaacccggctgcctcccaccccagcctcaaaacctcttcctgacgacccccgccccgtgtgatttgtttcattgttaatataatttccagtttaataaacaaaaccctagttctgacaaccagaaaaaaaactgatcttgtct

SEQ ID NO: 42376 - DNA, 388 bp, Homo sapiens
ggtccggaattcccggttcgactactactactaaattcgcggccgcgtcgacgttctgagagctaggaaactgggaggttgagccaggagcaggggaacttgggctttgaggcgagacctaattcttagggtgctctatgaggacatgggtggtgggcaaagtgacagccgcctgagcccctctgcctggtcccctttgcccccagatgaatacgacgacattgtggttcacagcagccgcagccaaacccggctgcctcccaccccagcctcaaaacctcttcctgacgacccccgccccgtgtgatttgtttcattgttaatataatttccagtttaataaacaaaaccctagttctgacaaccagaaaaaaaactgatcttgtct

SEQ ID NO: 42377 - DNA, 373 bp, Homo sapiens
caaagcccagctacaggcgggcgactgcggggggcccctgaggcggcgggggccatggctggggtcgcgtgcttgggaaaagctgccgacgcagatgaatggtgcacacggagcccctgagcccgagggcgaggacgagaaatccggcccctgcagcagcagtagcgacagcgacagcggagacgagggcgatgaatacgacgacattgtggttcacagcagccgcagccaaacccggctgcctcccaccccagcctcaaaacctcttcctgacgacccccgccccgtgtgatttgtttcattgttaatataatttccagtttaataaacaaaaccctagttctgacaaccagaaaaaaaactgatcttgtct

SEQ ID NO: 42378 - DNA, 2276 bp, Homo sapiens
caaagcccagctacaggcgggcgactgcggggggcccctgaggcggcgggggccatggctggggtcgcgtgcttgggaaaagctgccgacgcagatgaatggtgcgacagcggcctgggctccctgggtccggacgcagcggcccccggaggacctgggttgggcgcggagttgggcccggggctgtcgtgggctcccctcgtcttcggctacgtcactgaggatggggacacggcactgcacttggctgtgattcatcagcatgaacccttcctggattttcttctaggcttctcggccggcactgagtacatggacctgcagaatgacctaggccagacagccctgcacctggcagccatcctgggggagacatccacggtggagaagctgtacgcagcaggcgccgggctgtgtgtggcggagcgtaggggccacacggcgctgcacctggcctgccgtgtgggggcacacgcctgtgcccgtgccctgcttcagccccgcccccggcgccccagggaagcccccgacacctacctcgctcagggccctgaccgtactcccgacaccaaccatacccctgtcgccttgtaccccgattccgacttggagaaggaagaagaggagagtgaggaggactggaagctgcagctggaggctgaaaactacgagggccacaccccactccacgtggccgttatccacaaagatgtggagatggtccggctgctccgagatgctggagctgaccttgacaaaccggagcccacgtgcggccggagcccccttcatttggcagtggaggcccaggcagccgatgtgctggagcttctcctgagggcaggcgcgaaccctgctgcccgcatgtacggtggccgcaccccactcggcagtgccatgctccggcccaaccccatcctcgcccgcctcctccgtgcacacggagcccctgagcccgagggcgaggacgagaaatccggcccctgcagcagcagtagcgacagcgacagcggagacgagggcgtgagtcaggaggagagacagggcagcccagctggggggtcaggatagaccggcaggcaagaagcccaagaagataattaggcaccgaccttgggctgctgttagagaactcaggcagcagcgccagtgacacggggcactagtcaggagagacctggacaggggtggtgggaagagcttgggcagaagtggctgaaaaactaaggcagtggcaaaggtagaactcaggcaggggtggagaaaaggcgttggtcgcagtgattggtgaacacagcgggggtgggtggtagcgctgggggtgattttaggcagcaagaattggagaactcacactgcgaaaagaaaaccttgggtggcagtgatttgaacaccggcagtgctggggcaggacccgagccagcggtggggagagatatagtcagagaacccagcaatacagatccgtccttgggcaaggcgcggtgctggatgatgggtgcggaggaatttgggtaaaggcagagggaaggggtggaggagggccagctcagttgccgaaactctggagtggcggctggctagaaattggtctgtagaaatgaccttgaaaatggagttctggccaggtgcggtggctcacgcctgtaatcccagcactttgggaggccgaggcaggcagatcacgaggtcaggagttcgagaccagcctggccaacatggcaagaccctgtctctactaaaaatacaaaaattagctgggcgtggtggcgcatgcctataatcccagctacttgggaggctgaggtaggagaattgcttgaacctgggaggtggaggttgcagtgaacctagatcacgccactgcattccagcctgggcaacagagcgagactccatcttaaaaaaaaaaaaaaaaaaaagaaagaaaagaaaatggagttctgagagctaggaaactgggaggttgagccaggagcaggggaacttgggctttgaggcgagacctaattcttagggtgctctatgaggacatgggtggtgggcaaagtgacagccgcctgagcccctctgcctggtcccctttgcccccagatgaatacgacgacattgtggttcacagcagccgcagccaaacccggctgcctcccaccccagcctcaaaacctcttcctgacgacccccgccccgtgtgatttgtttcattgttaatataatttccagtttaataaacaaaaccctagttctgacaaccagaaaaaaaactgatcttgtct

SEQ ID NO: 42379 - DNA, 1360 bp, Homo sapiens
caaagcccagctacaggcgggcgactgcggggggcccctgaggcggcgggggccatggctggggtcgcgtgcttgggaaaagctgccgacgcagatgaatggtgcgacagcggcctgggctccctgggtccggacgcagcggcccccggaggacctgggttgggcgcggagttgggcccggggctgtcgtgggctcccctcgtcttcggctacgtcactgaggatggggacacggcactgcacttggctgtgattcatcagcatgaacccttcctggattttcttctaggcttctcggccggcactgagtacatggacctgcagaatgacctaggccagacagccctgcacctggcagccatcctgggggagacatccacggtggagaagctgtacgcagcaggcgccgggctgtgtgtggcggagcgtaggggccacacggcgctgcacctggcctgccgtgtgggggcacacgcctgtgcccgtgccctgcttcagccccgcccccggcgccccagggaagcccccgacacctacctcgctcagggccctgaccgtactcccgacaccaaccatacccctgtcgccttgtaccccgattccgacttggagaaggaagaagaggagagtgaggaggactggaagctgcagctggaggctgaaaactacgagggccacaccccactccacgtggccgttatccacaaagatgtggagatggtccggctgctccgagatgctggagctgaccttgacaaaccggagcccacgtgcggccggagcccccttcatttggcagtggaggcccaggcagccgatgtgctggagcttctcctgagggcaggcgcgaaccctgctgcccgcatgtacggtggccgcaccccactcggcagtgccatgctccggcccaaccccatcctcgcccgcctcctccgtgcacacggagcccctgagcccgagggcgaggacgagaaatccggcccctgcagcagcagtagcgacagcgacagcggagacgagggcgtgagtcaggaggagagacagggcagcccagctggggggtcaggatagaccggcaggcaagaagcccaagaagataattaggcaccgaccttgggctgctgttagagaactcaggcagcagcgccagtgacacggggcactagtcaggagagacgatgaatacgacgacattgtggttcacagcagccgcagccaaacccggctgcctcccaccccagcctcaaaacctcttcctgacgacccccgccccgtgtgatttgtttcattgttaatataatttccagtttaataaacaaaaccctagttctgacaaccagaaaaaaaactgatcttgtct

SEQ ID NO: 42380 - DNA, 1150 bp, Homo sapiens
caaagcccagctacaggcgggcgactgcggggggcccctgaggcggcgggggccatggctggggtcgcgtgcttgggaaaagctgccgacgcagatgaatggtgcgacagcggcctgggctccctgggtccggacgcagcggcccccggaggacctgggttgggcgcggagttgggcccggggctgtcgtgggctcccctcgtcttcggctacgtcactgaggatggggacacgcttctcggccggcactgagtacatggacctgcagaatgacctaggccagacagccctgcacctggcagccatcctgggggagacatccacggtggagaagctgtacgcagcaggcgccgggctgtgtgtggcggagcgtaggggccacacggcgctgcacctggcctgccgtgtgggggcacacgcctgtgcccgtgccctgcttcagccccgcccccggcgccccagggaagcccccgacacctacctcgctcagggccctgaccgtactcccgacaccaaccatacccctgtcgccttgtaccccgattccgacttggagaaggaagaagaggagagtgaggaggactggaagctgcagctggaggctgaaaactacgagggccacaccccactccacgtggccgttatccacaaagatgtggagatggtccggctgctccgagatgctggagctgaccttgacaaaccggagcccacgtgcggccggagcccccttcatttggcagtggaggcccaggcagccgatgtgctggagcttctcctgagggcaggcgcgaaccctgctgcccgcatgtacggtggccgcaccccactcggcagtgccatgctccggcccaaccccatcctcgcccgcctcctccgtgcacacggagcccctgagcccgagggcgaggacgagaaatccggcccctgcagcagcagtagcgacagcgacagcggagacgagggcgatgaatacgacgacattgtggttcacagcagccgcagccaaacccggctgcctcccaccccagcctcaaaacctcttcctgacgacccccgccccgtgtgatttgtttcattgttaatataatttccagtttaataaacaaaaccctagttctgacaaccagaaaaaaaactgatcttgtct

SEQ ID NO: 42381 - DNA, 1013 bp, Homo sapiens
cagacgcgctttcgtacaacacccagagcgccccagttagggcactgcacttggctgtgattcatcagcatgaacccttcctggattttcttctaggcttctcggccggcactgagtacatggacctgcagaatgacctaggccagacagccctgcacctggcagccatcctgggggagacatccacggtggagaagctgtacgcagcaggcgccgggctgtgtgtggcggagcgtaggggccacacggcgctgcacctggcctgccgtgtgggggcacacgcctgtgcccgtgccctgcttcagccccgcccccggcgccccagggaagcccccgacacctacctcgctcagggccctgaccgtactcccgacaccaaccatacccctgtcgccttgtaccccgattccgacttggagaaggaagaagaggagagtgaggaggactggaagctgcagctggaggctgaaaactacgagggccacaccccactccacgtggccgttatccacaaagatgtggagatggtccggctgctccgagatgctggagctgaccttgacaaaccggagcccacgtgcggccggagcccccttcatttggcagtggaggcccaggcagccgatgtgctggagcttctcctgagggcaggcgcgaaccctgctgcccgcatgtacggtggccgcaccccactcggcagtgccatgctccggcccaaccccatcctcgcccgcctcctccgtgcacacggagcccctgagcccgagggcgaggacgagaaatccggcccctgcagcagcagtagcgacagcgacagcggagacgagggcgatgaatacgacgacattgtggttcacagcagccgcagccaaacccggctgcctcccaccccagcctcaaaacctcttcctgacgacccccgccccgtgtgatttgtttcattgttaatataatttccagtttaataaacaaaaccctagttctgacaaccagaaaaaaaactgatcttgtct

SEQ ID NO: 42382 - DNA, 1076 bp, Homo sapiens
cagacgcgctttcgtacaacacccagagcgccccagttaggtaagaaagcgcgcgaggaccggactacgagtcccagaaggcgtggcgtcagcagccatgttgggcactgcacttggctgtgattcatcagcatgaacccttcctggattttcttctaggcttctcggccggcactgagtacatggacctgcagaatgacctaggccagacagccctgcacctggcagccatcctgggggagacatccacggtggagaagctgtacgcagcaggcgccgggctgtgtgtggcggagcgtaggggccacacggcgctgcacctggcctgccgtgtgggggcacacgcctgtgcccgtgccctgcttcagccccgcccccggcgccccagggaagcccccgacacctacctcgctcagggccctgaccgtactcccgacaccaaccatacccctgtcgccttgtaccccgattccgacttggagaaggaagaagaggagagtgaggaggactggaagctgcagctggaggctgaaaactacgagggccacaccccactccacgtggccgttatccacaaagatgtggagatggtccggctgctccgagatgctggagctgaccttgacaaaccggagcccacgtgcggccggagcccccttcatttggcagtggaggcccaggcagccgatgtgctggagcttctcctgagggcaggcgcgaaccctgctgcccgcatgtacggtggccgcaccccactcggcagtgccatgctccggcccaaccccatcctcgcccgcctcctccgtgcacacggagcccctgagcccgagggcgaggacgagaaatccggcccctgcagcagcagtagcgacagcgacagcggagacgagggcgatgaatacgacgacattgtggttcacagcagccgcagccaaacccggctgcctcccaccccagcctcaaaacctcttcctgacgacccccgccccgtgtgatttgtttcattgttaatataatttccagtttaataaacaaaaccctagttctgacaaccagaaaaaaaactgatcttgtct

SEQ ID NO: 42383 - DNA, 1358 bp, Homo sapiens
gtggcagtcaagtgtggggcccacctcgtgtttcctgtctttcaggggtcactgtgattcattgcacgatgtccagtgtcttcaacactgttgcttcatataccgtatttcgtctgactcttgtttgtttgtttgtttgtttcacgtgggagtgaattctggtccatgttacttcattttgggcagaagtggaaatcccactgaataaacattgattccacgaatttgctgatgaaactctgacctctgacctcccagatagctgacagggggttccagaactgtggtcacaaggcctagcatacagtaggcgccccatgtttgttcaatgaaggaatgcaagaggacttgaactttgccctctcaccccggtctttgtccccagggcactgcacttggctgtgattcatcagcatgaacccttcctggattttcttctaggcttctcggccggcactgagtacatggacctgcagaatgacctaggccagacagccctgcacctggcagccatcctgggggagacatccacggtggagaagctgtacgcagcaggcgccgggctgtgtgtggcggagcgtaggggccacacggcgctgcacctggcctgccgtgtgggggcacacgcctgtgcccgtgccctgcttcagccccgcccccggcgccccagggaagcccccgacacctacctcgctcagggccctgaccgtactcccgacaccaaccatacccctgtcgccttgtaccccgattccgacttggagaaggaagaagaggagagtgaggaggactggaagctgcagctggaggctgaaaactacgagggccacaccccactccacgtggccgttatccacaaagatgtggagatggtccggctgctccgagatgctggagctgaccttgacaaaccggagcccacgtgcggccggagcccccttcatttggcagtggaggcccaggcagccgatgtgctggagcttctcctgagggcaggcgcgaaccctgctgcccgcatgtacggtggccgcaccccactcggcagtgccatgctccggcccaaccccatcctcgcccgcctcctccgtgcacacggagcccctgagcccgagggcgaggacgagaaatccggcccctgcagcagcagtagcgacagcgacagcggagacgagggcgatgaatacgacgacattgtggttcacagcagccgcagccaaacccggctgcctcccaccccagcctcaaaacctcttcctgacgacccccgccccgtgtgatttgtttcattgttaatataatttccagtttaataaacaaaaccctagttctgacaaccagaaaaaaaactgatcttgtct

SEQ ID NO: 42384 - DNA, 1229 bp, Homo sapiens
caaagcccagctacaggcgggcgactgcggggggcccctgaggcggcgggggccatggctggggtcgcgtgcttgggaaaagctgccgacgcagatgaatggtgcgacagcggcctgggctccctgggtccggacgcagcggcccccggaggacctgggttgggcgcggagttgggcccggggctgtcgtgggctcccctcgtcttcggctacgtcactgaggatggggacacggcactgcacttggctgtgattcatcagcatgaacccttcctggattttcttctaggcttctcggccggcactgagtacatggacctgcagaatgacctaggccagacagccctgcacctggcagccatcctgggggagacatccacggtggagaagctgtacgcagcaggcgccgggctgtgtgtggcggagcgtaggggccacacggcgctgcacctggcctgccgtgtgggggcacacgcctgtgcccgtgccctgcttcagccccgcccccggcgccccagggaagcccccgacacctacctcgctcagggccctgaccgtactcccgacaccaaccatacccctgtcgccttgtaccccgattccgacttggagaaggaagaagaggagagtgaggaggactggaagctgcagctggaggctgaaaactacgagggccacaccccactccacgtggccgttatccacaaagatgtggagatggtccggctgctccgagatgctggagctgaccttgacaaaccggagcccacgtgcggccggagcccccttcatttggcagtggaggcccaggcagccgatgtgctggagcttctcctgagggcaggcgcgaaccctgctgcccgcatgtacggtggccgcaccccactcggcagtgccatgctccggcccaaccccatcctcgcccgcctcctccgtgcacacggagcccctgagcccgagggcgaggacgagaaatccggcccctgcagcagcagtagcgacatgacagccgcctgagcccctctgcctggtcccctttgcccccagatgaatacgacgacattgtggttcacagcagccgcagccaaacccggctgcctcccaccccagcctcaaaacctcttcctgacgacccccgccccgtgtgatttgtttcattgttaatataatttccagtttaataaacaaaaccctagttctgacaaccagaaaaaaaactgatcttgtct

SEQ ID NO: 42385 - DNA, 1084 bp, Homo sapiens
tcgctattcatcggcacccagtgctatgatttcttctcttacatgcgatgaggtgccgatgaatagcgtcctgtattgttatttttcgtcactacctccccgggtcgggggtgggtggtagcgctgggggtgattttaggcagcaagaattggagaactcacactgcgaaaagaaaaccttgggtggcagtgatttgaacaccggcagtgctggggcaggacccgagccagcggtggggagagatatagtcagagaacccagcaatacagatccgtccttgggcaaggcgcggtgctggatgatgggtgcggaggaatttgggtaaaggcagagggaaggggtggaggagggccagctcagttgccgaaactctggagtggcggctggctagaaattggtctgtagaaatgaccttgaaaatggagttctggccaggtgcggtggctcacgcctgtaatcccagcactttgggaggccgaggcaggcagatcacgaggtcaggagttcgagaccagcctggccaacatggcaagaccctgtctctactaaaaatacaaaaattagctgggcgtggtggcgcatgcctataatcccagctacttgggaggctgaggtaggagaattgcttgaacctgggaggtggaggttgcagtgaacctagatcacgccactgcattccagcctgggcaacagagcgagactccatcttaaaaaaaaaaaaaaaaaaaagaaagaaaagaaaatggagttctgagagctaggaaactgggaggttgagccaggagcaggggaacttgggctttgaggcgagacctaattcttagggtgctctatgaggacatgggtggtgggcaaagtgacagccgcctgagcccctctgcctggtcccctttgcccccagatgaatacgacgacattgtggttcacagcagccgcagccaaacccggctgcctcccaccccagcctcaaaacctcttcctgacgacccccgccccgtgtgatttgtttcattgttaatataatttccagtttaataaacaaaaccctagttctgacaaccagaaaaaaaactgatcttgtct

SEQ ID NO: 42386 - DNA, 590 bp, Homo sapiens
caaagcccagctacaggcgggcgactgcggggggcccctgaggcggcgggggccatggctggggtcgcgtgcttgggaaaagctgccgacgcagatgaatggtgcgacagcggcctgggctccctgggtccggacgcagcggcccccggaggacctgggttgggcgcggagttgggcccggggctgtcgtgggctcccctcgtcttcggctacgtcactgaggatggggacacgtgagtgaaccttaggctgccaaacggagccctaggacccggcgtcacattcctcattaatctctgatccctgaggcttcctaacctcatactcctaaatctgacttccgatgctgaacttcctgacctctaacccccgagtcctaacttttaacaaaaccaatcttctatctagctatgatcctaacccaatcatttcttaccttcttttcttgaactatgattctcagctcctggaatccacattgtatccactgatacccaaacctgactccagtcctgagacttctgttagaactgtggcttctcctgacttctaacctccaaatatgatctttgattcttagttcccgattt

SEQ ID NO: 42387 - DNA, 403 bp, Homo sapiens
cttggctggagccaggctggccttcagggttggtcagtctccacaggggactctggcctcccgtgggctgccacagggccaaccccagtgaaagaaatgaaatgactgaatatgttcatgtcattagaaaaaggatgcagcagggggtggggaggagttggttaatggaatcaaatttgcagcaagataggagtctagtgtttggcggcactgtagggtgactattgctaacaataatttactgtgtattttcaagtagctagaagagagaattttgaatgttcctgtcaacctaaataacaaagacaggctcgctaaagatatttaatcaaaagtagggcattgcaacaggaatatgtgtgctgtagtaaactgtgtgcatattccaggaggtaaagaaaaa

SEQ ID NO: 42388 - DNA, 352 bp, Homo sapiens
aggaggctgaggcaggagaatcacttgaacctgggaggtggaggttgcagtgaaccagatcgcgccatgcactccagcctgggcaacagagaaagactccgtctaaaaaaaaaaagaagaagaaagaaaagaaaatacagcaatatatgtaactgtattgaacatcttcaaggcaggaaccatgctagatacatatttgtatgccctgcagactcggtagcactttatttatttgctaacattttattgtgctgcttactgtatgccaagcacgttacaagtacacctaacatattaacgaatgtccattcaaaaacacttggtaaaaacgttatatttaaatctattcaat

SEQ ID NO: 42389 - DNA, 419 bp, Homo sapiens
actcgacaaaggatgatgtggtgaccaaagaagtctgcatactatgttgcatttgcttggggatcccagaccaccaatgtgaattgtcacggagacccctaccaatacctactgtgcttcatgaatgaacggcattcaagatccctagagtaagcacagcagatggacggcggtgttatggggctttctcgtgaggcccgtccacgtaaccagtgacagcgagcctatgaggggtgcagccaggcttgcagctttctgaggctccggcttaatgcagcagagactttagagctgtattgtccaatacagtagccactagccaggtgggtgaatacaacgaggaaatgaattttaaattttaattaattcaaatagtcacatgtagtcaatgtccaataggatagccactaacgtcgacg

SEQ ID NO: 42390 - DNA, 425 bp, Homo sapiens
caccaccacacccggctaatttttgtatttttagtagacatggggtttcgccacgttggccaggctggtctcgcactcctgacctcaagtgatccacctgcctccgcctcccaaagtgctgggattacagcgtgagccactgcaaccagccagtactatgtatataattattattattgaaaatctgtgagaacaatcaaattgcagctgcgactcactgagtatttacccagggcagggctatgccaagcacttactcatcatcttgtgcaatccttacaaaaatcctagcaaacatcgataggcctggggaaatcaaggctcagagaggccaaccaacttgcccaaagtcatagagtgaaggcaggtatgacccagagcccatgtctaccatgtctacacttcactgcctccctgcatgtcag

SEQ ID NO: 42391 - DNA, 366 bp, Homo sapiens
tccacagttcctgccgcatgggaggcatggccccggggtcctggtggccactcgtgcctggtggagagcgagggcagcctgacggagaacatctgggccttcgctggcatctccaggccctgtgccctggccctgttgcggagagacgtgctgggggccttcctgctgtggcctgagctgggtgctagcggccagtggtgtctgtccgtgcgcacgagtgcggcgtggtgccccaccaggtcttccggaaccacctgggccgctactgcttggagcacctgccggcagagttccccagcctggaggctctggtggagaaccacgcggttactgaacgtagcctcttctgtcccctcgacatgggcc

SEQ ID NO: 42392 - DNA, 716 bp, Homo sapiens
actaaacgtaagcttcagaaaccgaaacttaatagaagagctcaagagccgcggccagacgtttgcggagtccagggtctttcggagttgaatttgcagctgggctccttcactttggtctcggcttttatctgcctccctgagtacgctgagttcgcatgctgcccgtgtaactgtttgtttgtttgtttgtttgtttgtttgagatagcgtctcactgtgtcacccagtcgtgatctcaagggatgcgcccgcctctgcctcccaaggtgctgggattacaggcggaaacttaagtccctgcttccactccagtcttttgatttcaacaagcaacactgcaatggctatacatctatggctgttatttctgtttggggtgtaaactgagaaatttggagctaaaatctatatacattttaagttttgacgggatattgcccaaatagctttaaaaatccactcttaccccacaattgtaggagactgcttctcttccataccttcgccaatggtgctttgtaataaggacccaataaagacaagagtggtattggggatctaggcagaaaatgtcaaacacccataccttaaacattttgtcccctttgaattcattcagcaaatattgacaaacaactgtaagagccagactttgttcaaagtactgtcaatataacaataaagaaaacagacacgggccttaaacttattga

SEQ ID NO: 42393 - DNA, 482 bp, Homo sapiens
aaagtgttcagcattttagaatgagaagacagactccttcctaatctaatctgtggatgtcatcctagtgaaacctgaacagaggaactgaagttagaagatatgaaaacaaatgtacaataatgagacagtgggccgtggctggaggagagcaatctgtgtgtcattactgattgctcactgtgctccagaccagacactgagcccggaggctttctgtatttcacctcatttcattttcacaccagccataggaggtagataccatcctccccttttaagaggagaaaactgagtcttgcctgagttctattaaatgacagaaccaagattcaaagctaaatacatctgatttcaaagctctaaaaaggtacaaaaaagcaacacatcacatagattgacctcaggcagagtccattatatgtaatctatgaatatatatgtatttatatttgtgtgttttatataatacattatacatt

SEQ ID NO: 42394 - DNA, 4110 bp, Homo sapiens
ctgagtctgcaggtgacactgcttaggtacggagcgcggagtcggagcggggacgcgccgggctgcagctctgggatgcaatccgcctgcctcgcaagctgctcgccgctgcgctggcagcgcttacgctgagctcggaggatcccattaggacttgcccggggatgtgcacctgccgtgcgctccgaggtcagtggcaggtctgcaggcagccgagggagcggtgaagccggaagacctgtctctgcccatgtgcaaggcagtgatttcgggtgagagagcgggtgggtgagtctctttagagttggaaagaaggcaaaatcttgggtttctcctcggcggagggacaggggactcccccagttgggtcttgcacttcccttacctctcccaccccgcgtgcgccccggcccagtgccgaagccccacttcaaagatgctctgggagaccgggatcctggctgctcagcgggaaggcagcaggcaagtggtctaacgttggcggcggtggcggtggcggcggcggcggcaccgacagtaaagcggggagcaagagaatttgaaaagagacatccgctccctctcacacgctgagggggaggcattcgcgtttccccaaatgagaaagaaccacaagaaatcatgaagtaaaaactttggaaagctgccactggagatgttgcacaaaaacctggaatcttttaggagtctcctcccagtcgttgaaggtttggggagcagctgatacagcaaggagggctcttgcaaggattcaagctccgagccctggaggagcagcacggagcgggagagcgtggcgagagaatgaagaaaccaatcgcccgggagaagcatgaggtggcagtgtggcactcggtttagagggcttcggccggcggtggccccatggacagccctgctggcactgggcctgcctggctgggtgttggctgtctcagccacggcggctgctgtggtccccgagcagcatgcctccgtagctggccagcatcccctggactggctgctcacagaccggggccccttccaccgcgctcaggagtatgctgacttcatggagcggtaccgccagggtttcaccaccaggtacaggatttatagggagtttgcccgttggaaggtgaacaacttggctctggaaaggaaggacttcttcagtttgccattgcctcttgccccagagtttatccggaacattcgcctccttggaaggagacccaatctgcaacaggttacagaaaatctgattaaaaagtacggcactcatttcttactttctgccacccttggaggagaagagtccctgaccatttttgtggacaagcagaaactgggaagaaagacagagacaacaggaggtgcctctataatcgggggcagtgggaacagcacagctgtgtccctggagaccctgcaccagctggccgcctcctacttcatcgacagagagagcacgctgcgacggctgcaccatatccagatagccacgggggccatcaaggtcaccgagaccaggaccggtcctctgggctgcagcaactatgacaatctggactcagtcagttctgtcttggtacagagtccagagaacaaagtacagttacttggccttcaggtgctgctgcctgagtatctgcgtgagcgctttgtagctgcagcactcagctacatcacatgcagctctgagggtgagctcgtctgcaaggagaatgactgctggtgcaagtgcagccccaccttccctgaatgcaactgccctgatgctgacatccaggccatggaggacagcctgctgcagatccaggactcctgggccactcacaaccggcagtttgaagagtcagaagagttccaggccctgctgaaaaggctgcccgatgaccggttcctgaactccacagctatctcccagttctgggccatggacaccagccttcagcaccgctaccagcagctgggagctggcttgaaagtgctgttcaaaaagacccatcggatcctacgccggctcttcaacctctgcaagcgctgccatcgccagcctcgcttccgcctgcccaaggagaggtccttgtcctactggtggaaccgaatccagtccctcctctactgtggggaaagcacctttcctggcactttcctggaacagagccacagctgcacctgcccctatgaccaatcttcctgccagggccccatcccatgtgccttgggcgaagggcccgcgtgtgcccactgtgctccagacaatagcacacgctgtgggagctgcaacccgggctatgtgctggcccaggggctgtgccggccagaggtggccgagtccctggaaaactttcttgggctggagacagacttgcaggacctggagctaaagtacctgctgcagaagcaggatagccgcattgaggtacactccatcttcatcagcaatgacatgcggctgggcagctggtttgacccttcctggaggaagcgcatgctgctcaccctgaagagcaacaagtacaagcctgggctggtgcacgtgatgttggccttgtccttgcagatctgtctcaccaagaacagcaccctggagcctgtcatggccatctacgtcaacccctttgggggcagccactctgagagctggttcatgcctgtgaatgagggcagctttcctgactgggaaaggactaacgtggatgcagctgcccagtgccaaaactggactatcaccttggggaataggtggaagactttctttgagacagttcatgtttacctacggagccgaatcaagtccctggatgacagctccaatgagacaatctactatgagcccctggagatgactgatccctctaagaatttgggttacatgaaaattaacaccttgcaggtctttggctacagcctgccctttgacccagatgctatccgggacttaattctccagttggactacccatatactcaaggttcccaggactctgcactcttgcagctcattgagctcagggaccgggtgaaccagctttctccacctggcaaagtccgacttgaccttttctcctgcttgctccggcatcggcttaagctggccaacaatgaggtgggcaggatccagtcctccctgagggctttcaattctaagctgccaaaccctgtggaatatgagaccggcaaactctgtagctaatgggcggcccacttcagcactgggcaaggaggggatccatgaatctggggtacaaagataatctaagccctcaccttagtgccaacagggtgtgctcccacgagactttcagcatccagtagatgggacctcgaggctcgagctgaagcaggcgagagagaaacagctactgcgtgcgtgcgcgcacgcatacacacacacacacacacactggcacagggaggctacaactaagcagcctcagatctgtaaagttgattggtgctttctaaaatgaatgcaattgaaagaaaggagccaaggaagagattaagaaaaagaaccagctgaaccatgaaacaaacaaaaatcctaaaagtgattcttgtcattcaagaaagcaagaggggacaacaatgggaggggtcggagctcttccttcccctctgtggagtcacttttgtattctttttaaccagatttcttaaaatgttgttgttttgtgaatcctgacattggttcttacttttgtatgctgcctcctctgtgccctcccagacgctgactgggaaacacaagaagtacaaccaacaggaaccagcgccaagggcaggcagcggcctccttgctcccctcccttactcctccctctgctgcctcctccccccaccaagtttcagggccctggattgttcccagttcccattgtggtcccttcagagctcctttccaacagcatctctctgtcgaagaaagaagctctgtcaagttagagagagacaatgtgtaggaaatgttcttttttaaaaaaaaataacaaaaacaaaacaaaactatttattttgtgattgttttccttgttaatctgctccaaccacctgaacatctaagtaaacatttatctggtttaatatatttttggaaaa

SEQ ID NO: 42395 - DNA, 5199 bp, Homo sapiens
ctgagtctgcaggtgacactgcttaggtacggagcgcggagtcggagcggggacgcgccgggctgcagctctgggatgcaatccgcctgcctcgcaagctgctcgccgctgcgctggcagcgcttacgctgagctcggaggatcccattaggacttgcccggggatgtgcacctgccgtgcgctccgaggtcagtggcaggtctgcaggcagccgagggagcggtgaagccggaagacctgtctctgcccatgtgcaaggcagtgatttcgggtgagagagcgggtgggtgagtctctttagagttggaaagaaggcaaaatcttgggtttctcctcggcggagggacaggggactcccccagttgggtcttgcacttcccttacctctcccaccccgcgtgcgccccggcccagtgccgaagccccacttcaaagatgctctgggagaccgggatcctggctgctcagcgggaaggcagcaggcaagtggtctaacgttggcggcggtggcggtggcggcggcggcggcaccgacagtaaagcggggagcaagagaatttgaaaagagacatccgctccctctcacacgctgagggggaggcattcgcgtttccccaaatgagaaagaaccacaagaaatcatgaagtaaaaactttggaaagctgccactggagatgttgcacaaaaacctggaatcttttaggagtctcctcccagtcgttgaaggtttggggagcagctgatacagcaaggagggctcttgcaaggattcaagctccgagccctggaggagcagcacggagcgggagagcgtggcgagagaatgaagaaaccaatcgcccgggagaagcatgaggtggcagtgtggcactcggtttagagggcttcggccggcggtggccccatggacagccctgctggcactgggcctgcctggctgggtgttggctgtctcagccacggcggctgctgtggtccccgagcagcatgcctccgtagctggccagcatcccctggactggctgctcacagaccggggccccttccaccgcgctcaggagtatgctgacttcatggagcggtaccgccagggtttcaccaccaggtacaggatttatagggagtttgcccgttggaaggtgaacaacttggctctggaaaggaaggacttcttcagtttgccattgcctcttgccccagagtttatccggaacattcgcctccttggaaggagacccaatctgcaacaggttacagaaaatctgattaaaaagtacggcactcatttcttactttctgccacccttggaggagaagagtccctgaccatttttgtggacaagcagaaactgggaagaaagacagagacaacaggaggtgcctctataatcgggggcagtgggaacagcacagctgtgtccctggagaccctgcaccagctggccgcctcctacttcatcgacagagagagcacgctgcgacggctgcaccatatccagatagccacgggggccatcaaggtcaccgagaccaggaccggtcctctgggctgcagcaactatgacaatctggactcagtcagttctgtcttggtacagagtccagagaacaaagtacagttacttggccttcaggtgctgctgcctgagtatctgcgtgagcgctttgtagctgcagcactcagctacatcacatgcagctctgagggtgagctcgtctgcaaggagaatgactgctggtgcaagtgcagccccaccttccctgaatgcaactgccctgatgctgacatccaggccatggaggacagcctgctgcagatccaggactcctgggccactcacaaccggcagtttgaagagtcagaagagttccaggccctgctgaaaaggctgcccgatgaccggttcctgaactccacagctatctcccagttctgggccatggacaccagccttcagcaccgctaccagcagctgggagctggcttgaaagtgctgttcaaaaagacccatcggatcctacgccggctcttcaacctctgcaagcgctgccatcgccagcctcgcttccgcctgcccaaggagaggtccttgtcctactggtggaaccgaatccagtccctcctctactgtggggaaagcacctttcctggcactttcctggaacagagccacagctgcacctgcccctatgaccaatcttcctgccagggccccatcccatgtgccttgggcgaagggcccgcgtgtgcccactgtgctccagacaatagcacacgctgtgggagctgcaacccgggctatgtgctggcccaggggctgtgccggccagaggtggccgagtccctggaaaactttcttgggctggagacagacttgcaggacctggagctaaagtacctgctgcagaagcaggatagccgcattgaggtacactccatcttcatcagcaatgacatgcggctgggcagctggtttgacccttcctggaggaagcgcatgctgctcaccctgaagagcaacaagtacaagcctgggctggtgcacgtgatgttggccttgtccttgcagatctgtctcaccaagaacagcaccctggagcctgtcatggccatctacgtcaacccctttgggggcagccactctgagagctggttcatgcctgtgaatgagggcagctttcctgactgggaaaggactaacgtggatgcagctgcccagtgccaaaactggactatcaccttggggaataggtggaagactttctttgagacagttcatgtttacctacggagccgaatcaagtccctggatgacagctccaatgagacaatctactatgagcccctggagatgactgatccctctaagaatttgggttacatgaaaattaacaccttgcaggtctttggctacagcctgccctttgacccagatgctatccgggacttaattctccagttggactacccatatactcaaggttcccaggactctgcactcttgcagctcattgagctcagggaccgggtgaaccagctttctccacctggcaaagtccgacttgaccttttctcctgcttgctccggcatcggcttaagctggccaacaatgaggtgggcaggatccagtcctccctgagggctttcaattctaagctgccaaaccctgtggaatatgagaccggcaaactctgtagctaatgggcggcccacttcagcactgggcaaggaggggatccatgaatctggggtacaaagataatctaagccctcaccttagtgccaacagggtgtgctcccacgagactttcagcatccagtagatgggacctcgaggctcgagctgaagcaggcgagagagaaacagctactgcgtgcgtgcgcgcacgcatacacacacacacacacacactggcacagggaggctacaactaagcagcctcagatctgtaaagttgattggtgctttctaaaatgaatgcaattgaaagaaaggagccaaggaagagattaagaaaaagaaccagctgaaccatgaaacaaacaaaaatcctaaaagtgattcttgtcattcaagaaagcaagaggggacaacaatgggaggggtcggagctcttccttcccctctgtggagtcacttttgtattctttttaaccagatttcttaaaatgttgttgttttgtgaatcctgacattggttcttacttttgtatgctgcctcctctgtgccctcccagacgctgactgggaaacacaagaagtacaaccaacaggaaccagcgccaagggcaggcagcggcctccttgctcccctcccttactcctccctctgctgcctcctccccccaccaagtttcagggccctggattgttcccagttcccattgtggtcccttcagagctcctttccaacagcatctctctgtcgaagaaagaagctctgtcaagttagagagagacaatgtgtaggaaatgttcttttttaaaaaaaaataacaaaaacaaaacaaaactaaaaaaaaaaaaaaaaaaaaaaaaaaaaaaaaaaaaaaaaaacaaaaaaaaaaaaaaccaacacaaacgaaagagcaagagaagaaaagaaaagaaagaaagaggaggggggggggccccccccaggcgcccggcggcgcgccgccctcgccccacggcgcagacatcgcgcgtcacgacgaggacggctcaagcagacgacgcgctaacacaccaccacgcactgcgccacagcgacacgcaccccccctcccgcgaagcacgacccgcacccggcaacagctgaggaaaggcacacacactggagaggccacacacacggccggccacacgatgaaacaaaccgccgcccgcagccacccacaccccgccagcgacacacatggggccaccccgccccgatgacggaccggctcaaacggcgcgcgccacacaaagacaacatatgccaacccccccgtacgaccacggaccaaccaaagcacagagccggagacgccgcgcgaccacgcgcccacagcgcacccgagacctcagccagcacgcccgccgaggcgacgcgatacacacgcgaaccggccgcgcagaggcctagagccgctgctccccccagcacagggaccacaacgagccacgcgaagggcggcacacccacgaaaaggacacggcgcgaagcgcacccgaccgggaaagaagcaggaacggaggtgaagggcgcgggcaaggagcgaacggaagcaacgccaacacccaccgcacgtcacgccacgaagccgggaggggaggcagccataggagggccccgacaaccgcgccgacgcgcagacacgcagaacccagcaaccacgcggccccgcccgcaggcgagacgggcgtcaagaacagccgctcccgggccccgcgacccgcggggcgcgagcgcggccgagcggcggcctcgagacgcgcaccccgcacgagccggcgccgcaccaggactggccggtaggcgagccacgtggcccgcgagccccacacgcagcaccgttggacggctcgacacagccgccgtccgcacgcggagggagcggtggcaggccacggcgcccgcaccggccggcggacagagggcgccggaccgcaacgcgtgagcaacgcgcaacagaagaccgcacgccaccaccgaccaccaatacacgca

SEQ ID NO: 42396 - DNA, 3050 bp, Homo sapiens
ggggaggagggagatgccccttcaaggcttttgcccttcctgagggagcagaaaaagccacgaagactcctcgtaaacaacttgagagagagaattgtgtctcccctatgaagatggattgcttgagacagagttcaatagaagatgttaaacagataagctgagggcagggggactgagctttggaagagggcctttcaggcagcgaggccgctggcctgtggctccctctgatgagcttcttctaaagatggagaagagtccctgaccatttttgtggacaagcagaaactgggaagaaagacagagacaacaggaggtgcctctataatcgggggcagtgggaacagcacagctgtgtccctggagaccctgcaccagctggccgcctcctacttcatcgacagagagagcacgctgcgacggctgcaccatatccagatagccacgggggccatcaaggtcaccgagaccaggaccggtcctctgggctgcagcaactatgacaatctggactcagtcagttctgtcttggtacagagtccagagaacaaagtacagttacttggccttcaggtgctgctgcctgagtatctgcgtgagcgctttgtagctgcagcactcagctacatcacatgcagctctgagggtgagctcgtctgcaaggagaatgactgctggtgcaagtgcagccccaccttccctgaatgcaactgccctgatgctgacatccaggccatggaggacagcctgctgcagatccaggactcctgggccactcacaaccggcagtttgaagagtcagaagagttccaggccctgctgaaaaggctgcccgatgaccggttcctgaactccacagctatctcccagttctgggccatggacaccagccttcagcaccgctaccagcagctgggagctggcttgaaagtgctgttcaaaaagacccatcggatcctacgccggctcttcaacctctgcaagcgctgccatcgccagcctcgcttccgcctgcccaaggagaggtccttgtcctactggtggaaccgaatccagtccctcctctactgtggggaaagcacctttcctggcactttcctggaacagagccacagctgcacctgcccctatgaccaatcttcctgccagggccccatcccatgtgccttgggcgaagggcccgcgtgtgcccactgtgctccagacaatagcacacgctgtgggagctgcaacccgggctatgtgctggcccaggggctgtgccggccagaggtggccgagtccctggaaaactttcttgggctggagacagacttgcaggacctggagctaaagtacctgctgcagaagcaggatagccgcattgaggtacactccatcttcatcagcaatgacatgcggctgggcagctggtttgacccttcctggaggaagcgcatgctgctcaccctgaagagcaacaagtacaagcctgggctggtgcacgtgatgttggccttgtccttgcagatctgtctcaccaagaacagcaccctggagcctgtcatggccatctacgtcaacccctttgggggcagccactctgagagctggttcatgcctgtgaatgagggcagctttcctgactgggaaaggactaacgtggatgcagctgcccagtgccaaaactggactatcaccttggggaataggtggaagactttctttgagacagttcatgtttacctacggagccgaatcaagtccctggatgacagctccaatgagacaatctactatgagcccctggagatgactgatccctctaagaatttgggttacatgaaaattaacaccttgcaggtctttggctacagcctgccctttgacccagatgctatccgggacttaattctccagttggactacccatatactcaaggttcccaggactctgcactcttgcagctcattgagctcagggaccgggtgaaccagctttctccacctggcaaagtccgacttgaccttttctcctgcttgctccggcatcggcttaagctggccaacaatgaggtgggcaggatccagtcctccctgagggctttcaattctaagctgccaaaccctgtggaatatgagaccggcaaactctgtagctaatgggcggcccacttcagcactgggcaaggaggggatccatgaatctggggtacaaagataatctaagccctcaccttagtgccaacagggtgtgctcccacgagactttcagcatccagtagatgggacctcgaggctcgagctgaagcaggcgagagagaaacagctactgcgtgcgtgcgcgcacgcatacacacacacacacacacactggcacagggaggctacaactaagcagcctcagatctgtaaagttgattggtgctttctaaaatgaatgcaattgaaagaaaggagccaaggaagagattaagaaaaagaaccagctgaaccatgaaacaaacaaaaatcctaaaagtgattcttgtcattcaagaaagcaagaggggacaacaatgggaggggtcggagctcttccttcccctctgtggagtcacttttgtattctttttaaccagatttcttaaaatgttgttgttttgtgaatcctgacattggttcttacttttgtatgctgcctcctctgtgccctcccagacgctgactgggaaacacaagaagtacaaccaacaggaaccagcgccaagggcaggcagcggcctccttgctcccctcccttactcctccctctgctgcctcctccccccaccaagtttcagggccctggattgttcccagttcccattgtggtcccttcagagctcctttccaacagcatctctctgtcgaagaaagaagctctgtcaagttagagagagacaatgtgtaggaaatgttcttttttaaaaaaaaataacaaaaacaaaacaaaactatttattttgtgattgttttccttgttaatctgctccaaccacctgaacatctaagtaaacatttatctggtttaatatatttttggaaaa

SEQ ID NO: 42397 - DNA, 337 bp, Homo sapiens
tattgtggaaagtactgcatgctttggcataaaaatgtggagaaagaacaataaaagatagcctgtaggtgggacatgcgactcccacctgtatcccagttgttagggaggcgaggcaggagggtcatttgaggccaggagtttgagcccagcctgattaacatagtgaggcccgtgtctgtaaaaggaattttggaaaaattagctgggtgaggtggcacacccctgtagtcccagctatttcaggaggctgagatagaagaatccttagagcccaggagccggagctgcagtgagtcatgattgtgcccctgcagtccagcctgggtgacagagt

SEQ ID NO: 42398 - DNA, 269 bp, Homo sapiens
ctcaagataaagcttttccactcttctgtctgcttactgattcagggtggcaggcacaaaacaaaacgttccggttatattttccatcctgtttatatttaaattggctgtttattctttaataaagtgtataactgttggtctataacattatgaatgtgggattaagtggttagacttagcaggaatttgaaaatcagggtccaaatgtactaccctaagtacagtagcagaattacttctataaagaaaacttccctaagttacag

SEQ ID NO: 42399 - DNA, 468 bp, Homo sapiens
tgtaaagcttgtagtaaacatatggtacatagtaagcatcaataactcttggctccctgtcattgcgacatagctgccacccttcactcagcatacgtttaccacccttcactcagtatacgtttattgtacatgtctacgtgctgggaacatgaagataaataagacatggtctctagccttagggaacttatattctaacatgcatgtaacatatatgtaaaatgaaagttcttattctctcatctttccagctacttaaactttatccatagcccagtttactttcctcccatgtcagctaacttctgcatgataaaggacaggctttcatatcttagctatttctgtctaacagtgattcagtacttaccatgtaccccaaatgttgttaagaactggaatgcaaagatggtgtgtaagacagtctgtatctgtgagaagctaacattctgtagggagattaaa

SEQ ID NO: 42400 - DNA, 467 bp, Homo sapiens
taaatatttcaatgcactaacattcatcagacctaagtgtcctctaagaattattaaaagttttacctttctcctttaaaacaccaggagctagtaggacaatgttaaatttatatttttagattattttctagatatctggaataaatacaaactatatttcagagttttcaaaaaataacagttgtactcgttttttctttgagagaggtttggccatacaattatagtatgtatttagctaaaaagcaattaatataattatagcagagttaagaatttatatcagatcacgaataacattttaatgtttcaacaaaatatcccagaatttgaattggaaggattgttttgagttgctccaatccaaagtgcttttttacatatctgagggaaaaggtaaagagaggacatatgaattgcctaagacaactaattcatggcatattatacttatacagctattt

SEQ ID NO: 42401 - DNA, 1200 bp, Homo sapiens
cacacaaaaggccaaaggtgcacgattctcctcggggctccttcctctccgctcccttcccaaccaagaaggacacgcagaactttgctggagagatcaatgtttctagaacaccctgaaacaaaagtcctgatatgtgcaaataatacacacccacaaaagaaaataacctctttgcgctgacaccctgcctctccgaagaggacgttttctccctacttggaatttccatcagcacctgggttggtaccaaactcaggacgtggtggacacgctctctgactctgtatttcaggaagctgccaatcaatagagatttaaagcttctgacttccgcatatccgaataccaggtaggaaacatctgctttggagtaagagaaggccccagtacctgctttttctccggaaccgtgagagggagccatggggaggagaccagaatttcagccttcctatctccctttaccacaaggacgccttgaggacccaagtcaaattgagatctttcaaccacgggctcggaaacccgctttctgtgtccacttcaaccaaacacgtctaacaggcaggaatttagaggtggccaaggtaacgagaactagtggttttcaccctgtttggtgaccttcatagggcttatttatgcacttcaagcgcatgacctaatacatgttggtttggcttctcttctcgtaatagcagcctgtaaaaagcttttgagaattccccgtgttttctcatttgtgggtcaagaaaataaaatcgatatctaagtaaccttaaaaaaatggcctgcacaatctaaaaatttggaatgtttccactaggactaaggatatctctgaaagcctcaaagatcatcaaaatgaagtccaacatttgctgtttttaaggtgagatatttggtaacggagtatgagagaactggctaagggggctttttgacataagtcaaacaatgacatttaaaactcacgtaaaagcaattactgtgtggaatttttctgtgtttttctcatttcttaaacagaagtgtatatgttttcagcatagcttcttgctgtaattttctttcttgacaaacccacatcttaccatgaaacccaaagtatgcatgctgcagaaacaataatggttgaaacagacccggctgtctctggcatgatttttctttacaaaattaaaatgtcttttggct

SEQ ID NO: 42402 - DNA, 429 bp, Homo sapiens
tcttttttttttgagacggagtctcactctgttgcccagggtggagtgcagtggcgtgatcttggctcactgcaagctccgcctcctgggttcacgccattctcctgcctcagcctcctgagtagctgatactacaggtgcccgccaccacgcctggctaattttttgtatttttagtagagacggggtttcaccgtgttagccaggatggtctccatctcctgacctcgtgatccgcctgcctcagcctcccaaagtgctaggattataggcatgaaccaccgagccctgcctgtattttctttttcaaattaattttcctttccttttctctcctgttaatctccaattgatgttggcagtgtaagctgaagtacccattcctcagacactgtagtagtctgggacgtgattttggttctccgctct

SEQ ID NO: 42403 - DNA, 779 bp, Homo sapiens
cttatccctagggataaccacttgccatttttttacaatttcaattttttatgattataaaagtcatacacatttaaaaatacttcaaaataaatacaaaataaaaataaatgcttcattgcttaggttaccttggtacatgcaaggtctgagaccacatccatcaatgcagtttgctgcgtggattaccagatctctccaacattgacctcaattttttactctgagagcaaacagaatgggcaagggctgacctgaaatccttttgaaacacaagctggatcctagggctttgacctccactgctcactgccacatgggatccgtctctgtgccccactctgccccagccccactggccttcctgctgctgctcacacaggcctactcttaaggcctttgcatactctgttccctgcagaggcctctgcctctgaacaaatgtgggacccatctctgccaaggctgggaagcaaacagcccccactttgccttgtcagcctgtgtttgcaccattcctgtggtggcctctcccagctgctttcacgtgggatttgagctctgggaagctggaagtttgtggagtccacttccctcattttgcatatatggatgataaagcccacaggcaagggctctgacaaaaggaaagattccttccatttggcattgtgatgcagaggctgtcacagacaagcctgggaatttgggatacatcttgctgagcctagagacagaaaagagcttctaggctgccttccctgagccccgggccaggc

SEQ ID NO: 42404 - DNA, 327 bp, Homo sapiens
gtggagaaggtacagtctgtagaggtccaaaactcctgctgcattcaggttattctaattaagtgaagacaatgggaccatgctggggaccaaagatgaggctaatgtgaaggtataaaccacggaaacctagtactacttgactgttaggagcagtggtgacacaggtgctcccagaaccagcaatgccaggctagggagttttgagtccactccaggaacaatgggaacctcccaggagccccttatccaggcttatctgccccagatcactggagacagcctgcagaccaaaaccccagagagatgcagtggtgattccaactg

SEQ ID NO: 42405 - DNA, 456 bp, Homo sapiens
aagttattaaaataagaggtccttgatggcaaaaataataaaatggctctttggtggttaaaaggaccaatttggtccaatctcaactctttaaataaaaaggaattttgcttgaggtaagtaatttagttcctttgtggaaagttctttgacttctaagatgattcagagtttggaattactgatttagtcttctgactgtatcaggagtctttaaatatacattttcaattcaattaataagtcatgagttcagttaatttatcatcagtgcaatcagaaaccatcaaagtagactgagttgccagcctttacttctggctaatcctgacacatttcacatgtcatggattcctgaaattctgaagctgagattgctaatggttcagattggttactggatcattgtgttcctaaagaaaaattatacagctcgcttcaatgatgcagtttccc

SEQ ID NO: 42406 - DNA, 384 bp, Homo sapiens
tcatttcctcaacttcactactgtgtcgccctgtgggacagggaagtccaagtcggggaagaagcctgtggggaggggttggtgggagatggggagcccatatggcccagtgagtcaggaaaatagggtccagaggcagggaacataaggccaattcgcacttgagccataacaggaaatgtcctctccataggacgtatgccgtaaatgactttgtaactttacttcatccttttcgtttatatagggcgtacctcaagtagagggtatttaaacacaaaaactctgtaatggggcctttgagcccctattctcaggcccgttctcctcccacaccgtggagttgactttcattttcaataaatcccttccttccttccttta

SEQ ID NO: 42407 - DNA, 626 bp, Homo sapiens
tgaaaaagttcttcttctctacatcttcctcccactcctacaacccttgatccccacgtgagatctcatttcctccagctgggtcttctgcagagtgattagagcttctgccctccttgcagcatctctattgtaaaaggattgctgaagcttattaagccttgcagctcctaggaggaaaggtaccatatagaaataaaacaaatcaacaaattagtgtgttttgtagaagttgaataggactccacctatctgcatgagtgtgcacactgtgcagtcgcacaggcagtctcaaatgggaatttggaaaaagctaagctttttcacttgagaaaggtttacatattctttgcacctgggcacacacagcacaggctgttctcaggactcccaccagattaggcctgggacatgacagagcctgtcaggtccacgtttgctttccagtctccttgcttccagtctagctgtggcctgactccaagtccagtgtaagatttttttttttcagcaataaggaatcggttcattcacctgtacgaaaaccagtgggaggatcatgcataaggctcatatccttgctgtgaatttcaaaggactggctaagtaaataaaattatcatgcc

SEQ ID NO: 42408 - DNA, 2972 bp, Homo sapiens
  misc_feature (1336)..(1336): n is a, c, g, or t
cggagtaccgggatctcggtttccaaggactgtaacgccttcaaccgcccgccgcgatagagtgcccacgaccctgcctcgggaatcccgctctgcaccgccccaccagacccggactcggagccgcgagcggcccgagatgagcagcaatgactcctcccttatggctgggatcatttactatagccaggaaaagtacttccaccatgtgcagcaggctgcagctgtgggcctggaaaaattcagcaatgaccctgtgttgaagttctttaaagcctatggagtcctcaaagaaggcaatgtacttcatgatgcagcagaactactcagaggccctggaggtggtgaaccagatcactgtgacttcagggagcttcctgccagccctcgtcctgaagatgcagctgttcttagctcggcaggactgggagcagacagtagaaatgggacacagaatcctagaaaaagatgagagcaatattgatgcctgccaaattctaaccgtgcatgagcttgcaagagaaggaaacatgaccacagtaagttctttgaagactcagaaggtgatccttgaaacagaatcaaggaggaacccttcatgacctgtgcacctgacccaaagcccttgtagggagctcctggatctcagcttcctcttttctaccccacccctatactcgctgccaaggaggcctgctctggtttgactctttgagttgtgtagcttgggagtcaggcagcatcaggcagtgagattgattctaggctctgccatgtgctatctgtggaagcctgggcaggtgtccccacctggataagccgcaggcttcctgtttgtaaaatagacagaattccacacaggactaaatgtgataagaagtgggagagtttggaacagtccctggcacactacagtaattccatcaatgttaactgatagtagaagtcgtggtagtatttctgaattcaggaaatgccttttttttaggggatagttggaactgctcaggcattggccaggtaatactgggccccaaacatgctcgtaagtcttgtagttttccaaagaaaccaaaaatagccctcaaatgcagtcagaaacacctagaattcttagtgaaacctcaatacccagacaggttctcattttcagaaaggtttgtttttagccaaagcattgccttttagatcagtgaaatatattgcctctatggagagcatggcaaaccaggagtctctaaggggtcatggtgggaaggggaagcttctggtttcttctgcacagctctgagattgtggattttgtgggatggggtgaggtagaggggagagtccntatttgggagaaaaaggccccagcccttttcgtctctgggtaggaataagagaataggactatcctcagctccctgtgactccagatccctaagcaggccttcctggggcctggcctgaaagttaatcccaggggcagacttagcatttagctaactgagatttagcattagccccttttttactcccacttcaaaccttgggacctccccaccgaccccgggctggctacccagttctaattttgttcatacttactgaacagagtggacccataccatccttggttttgcttttggcacttctctgcagctgggaactaagaattccttactcctgggtggggagtgggaaagaacctaagctttggaatctgtcagtgacctaggtggctgggtgacctcagaccaattgcctaacctttctaacctttcatgtgttggacaggaaggtttggaaagttcgaatagttatactgacttacatttgattcatgtcaaaatggagcagaggcttctgggccagcactagttagtttgctgctggcctggcaggctgcactgtggacacagtgagggctagctcctggctctgcctgggtgggtctgaaaaggcaacttctcttcacaaactcaggaacagggctactctatgggttagccctgctccataaggagcagtcaaaaaaaaaagaaaaaaaagaaaaaaaaaaaacaaattcaagaacagagggcagtgccagctctgggtgaataatgtccccaggagttccacttataggcctttgaagtaattctgatgcctggaccactccaattcacttaaatctgaatttctggggggttgtgcctgggcatgggcattttttaaatctcccagctgatgctactatgcagtcagggttgagaaccacggcgcaactctgaccttgcaccttgcatgttgacattctctgttttgtccctgcaggctaccaatcacgttagaaatctgattaaggcactagagacaagggaacccgaaaatccaagcctccatcttaaaaaaattattgtggttagccgactggtaagaaggttctttcctggttctgaaatggtgcttctccctgctttccttagaggagaactgtgctcccccaggaagctccttgagtgccttacccctcccttctggctcaaacttgtcctttagggtagtggctcatatcctgctgtgcctacttgcctctggctgataactgtgacatgtgggttctacatccttagcctaggtgccccctcagagatgccatgaagatcagggagacggggtctgaaagtgcttttggagtgggctgtgccttatttggggaaagcgggtggtattgcagctgttatgcagcagagccacacccagctctagcctctagtgcctgggtgcccatctcccatattcttttttgtggaggtgacctgagaaggctggcctgcctaggcctctcaaacatcagggaaggttcaactagaccaggttgccaacaaatctgtatctctttcagacccttcagccccaaagcaagatttactagaagtagttgctgtaagaatgaaggcaactctgggaccccaggaaccagaactgtggagttgcatagg

SEQ ID NO: 42409 - DNA, 3139 bp, Homo sapiens
  misc_feature (1503)..(1503): n is a, c, g, or t
cggagtaccgggatctcggtttccaaggactgtaacgccttcaaccgcccgccgcgatagagtgcccacgaccctgcctcgggaatcccgctctgcaccgccccaccagacccggactcggagccgcgagcggcccgagatgagcagcaatgactcctcccttatggctgggatcatttactatagccaggaaaagtacttccaccatgtgcagcaggctgcagctgtgggcctggaaaaattcagcaatgaccctgtgttgaagttctttaaagcctatggagtcctcaaagaagaccgagaagcaattcaggagcttgagtacagcctgaaggaaatacgcaagacagtcagtgggactgcactgtactatgctggccttttcctctggctcataggccgccatgacaaggccaaagagtacattgaccgcatgctgaagatttctagaggcttcagagaggcaatgtacttcatgatgcagcagaactactcagaggccctggaggtggtgaaccagatcactgtgacttcagggagcttcctgccagccctcgtcctgaagatgcagctgttcttagctcggcaggactgggagcagacagtagaaatgggacacagaatcctagaaaaagatgagagcaatattgatgcctgccaaattctaaccgtgcatgagcttgcaagagaaggaaacatgaccacagtaagttctttgaagactcagaaggtgatccttgaaacagaatcaaggaggaacccttcatgacctgtgcacctgacccaaagcccttgtagggagctcctggatctcagcttcctcttttctaccccacccctatactcgctgccaaggaggcctgctctggtttgactctttgagttgtgtagcttgggagtcaggcagcatcaggcagtgagattgattctaggctctgccatgtgctatctgtggaagcctgggcaggtgtccccacctggataagccgcaggcttcctgtttgtaaaatagacagaattccacacaggactaaatgtgataagaagtgggagagtttggaacagtccctggcacactacagtaattccatcaatgttaactgatagtagaagtcgtggtagtatttctgaattcaggaaatgccttttttttaggggatagttggaactgctcaggcattggccaggtaatactgggccccaaacatgctcgtaagtcttgtagttttccaaagaaaccaaaaatagccctcaaatgcagtcagaaacacctagaattcttagtgaaacctcaatacccagacaggttctcattttcagaaaggtttgtttttagccaaagcattgccttttagatcagtgaaatatattgcctctatggagagcatggcaaaccaggagtctctaaggggtcatggtgggaaggggaagcttctggtttcttctgcacagctctgagattgtggattttgtgggatggggtgaggtagaggggagagtccntatttgggagaaaaaggccccagcccttttcgtctctgggtaggaataagagaataggactatcctcagctccctgtgactccagatccctaagcaggccttcctggggcctggcctgaaagttaatcccaggggcagacttagcatttagctaactgagatttagcattagccccttttttactcccacttcaaaccttgggacctccccaccgaccccgggctggctacccagttctaattttgttcatacttactgaacagagtggacccataccatccttggttttgcttttggcacttctctgcagctgggaactaagaattccttactcctgggtggggagtgggaaagaacctaagctttggaatctgtcagtgacctaggtggctgggtgacctcagaccaattgcctaacctttctaacctttcatgtgttggacaggaaggtttggaaagttcgaatagttatactgacttacatttgattcatgtcaaaatggagcagaggcttctgggccagcactagttagtttgctgctggcctggcaggctgcactgtggacacagtgagggctagctcctggctctgcctgggtgggtctgaaaaggcaacttctcttcacaaactcaggaacagggctactctatgggttagccctgctccataaggagcagtcaaaaaaaaaagaaaaaaaagaaaaaaaaaaaacaaattcaagaacagagggcagtgccagctctgggtgaataatgtccccaggagttccacttataggcctttgaagtaattctgatgcctggaccactccaattcacttaaatctgaatttctggggggttgtgcctgggcatgggcattttttaaatctcccagctgatgctactatgcagtcagggttgagaaccacggcgcaactctgaccttgcaccttgcatgttgacattctctgttttgtccctgcaggctaccaatcacgttagaaatctgattaaggcactagagacaagggaacccgaaaatccaagcctccatcttaaaaaaattattgtggttagccgactggtaagaaggttctttcctggttctgaaatggtgcttctccctgctttccttagaggagaactgtgctcccccaggaagctccttgagtgccttacccctcccttctggctcaaacttgtcctttagggtagtggctcatatcctgctgtgcctacttgcctctggctgataactgtgacatgtgggttctacatccttagcctaggtgccccctcagagatgccatgaagatcagggagacggggtctgaaagtgcttttggagtgggctgtgccttatttggggaaagcgggtggtattgcagctgttatgcagcagagccacacccagctctagcctctagtgcctgggtgcccatctcccatattcttttttgtggaggtgacctgagaaggctggcctgcctaggcctctcaaacatcagggaaggttcaactagaccaggttgccaacaaatctgtatctctttcagacccttcagccccaaagcaagatttactagaagtagttgctgtaagaatgaaggcaactctgggaccccaggaaccagaactgtggagttgcatagg

SEQ ID NO: 42410 - DNA, 3373 bp, Homo sapiens
  misc_feature (1737)..(1737): n is a, c, g, or t
cggagtaccgggatctcggtttccaaggactgtaacgccttcaaccgcccgccgcgatagagtgcccacgaccctgcctcgggaatcccgctctgcaccgccccaccagacccggactcggagccgcgagcggcccgagatgagcagcaatgactcctcccttatggctgggatcatttactatagccaggaaaagtacttccaccatgtgcagcaggctgcagctgtgggcctggaaaaattcagcaatgaccctgtgttgaagttctttaaagcctatggagtcctcaaagaagagcacatccaggatgccatcagtgacctggaaagcatcaggcatcacccagacgtgtccctgtgctccaccatggccctcatttatgctcacaaaagatgtgaaatcattgaccgagaagcaattcaggagcttgagtacagcctgaaggaaatacgcaagacagtcagtgggactgcactgtactatgctggccttttcctctggctcataggccgccatgacaaggccaaagagtacattgaccgcatgctgaagatttctagaggcttcagagaggcctatgtgctcagaggctgggtggacctgacctcagacaagccccacactgcgaagaaagccattgagtacctggaacaaggaattcaggacaccaaagatgtgctggggctgatgggaaaggcaatgtacttcatgatgcagcagaactactcagaggccctggaggtggtgaaccagatcactgtgacttcagggagcttcctgccagccctcgtcctgaagatgcagctgttcttagctcggcaggactgggagcagacagtagaaatgggacacagaatcctagaaaaagatgagagcaatattgatgcctgccaaattctaaccgtgcatgagcttgcaagagaaggaaacatgaccacagtaagttctttgaagactcagaaggtgatccttgaaacagaatcaaggaggaacccttcatgacctgtgcacctgacccaaagcccttgtagggagctcctggatctcagcttcctcttttctaccccacccctatactcgctgccaaggaggcctgctctggtttgactctttgagttgtgtagcttgggagtcaggcagcatcaggcagtgagattgattctaggctctgccatgtgctatctgtggaagcctgggcaggtgtccccacctggataagccgcaggcttcctgtttgtaaaatagacagaattccacacaggactaaatgtgataagaagtgggagagtttggaacagtccctggcacactacagtaattccatcaatgttaactgatagtagaagtcgtggtagtatttctgaattcaggaaatgccttttttttaggggatagttggaactgctcaggcattggccaggtaatactgggccccaaacatgctcgtaagtcttgtagttttccaaagaaaccaaaaatagccctcaaatgcagtcagaaacacctagaattcttagtgaaacctcaatacccagacaggttctcattttcagaaaggtttgtttttagccaaagcattgccttttagatcagtgaaatatattgcctctatggagagcatggcaaaccaggagtctctaaggggtcatggtgggaaggggaagcttctggtttcttctgcacagctctgagattgtggattttgtgggatggggtgaggtagaggggagagtccntatttgggagaaaaaggccccagcccttttcgtctctgggtaggaataagagaataggactatcctcagctccctgtgactccagatccctaagcaggccttcctggggcctggcctgaaagttaatcccaggggcagacttagcatttagctaactgagatttagcattagccccttttttactcccacttcaaaccttgggacctccccaccgaccccgggctggctacccagttctaattttgttcatacttactgaacagagtggacccataccatccttggttttgcttttggcacttctctgcagctgggaactaagaattccttactcctgggtggggagtgggaaagaacctaagctttggaatctgtcagtgacctaggtggctgggtgacctcagaccaattgcctaacctttctaacctttcatgtgttggacaggaaggtttggaaagttcgaatagttatactgacttacatttgattcatgtcaaaatggagcagaggcttctgggccagcactagttagtttgctgctggcctggcaggctgcactgtggacacagtgagggctagctcctggctctgcctgggtgggtctgaaaaggcaacttctcttcacaaactcaggaacagggctactctatgggttagccctgctccataaggagcagtcaaaaaaaaaagaaaaaaaagaaaaaaaaaaaacaaattcaagaacagagggcagtgccagctctgggtgaataatgtccccaggagttccacttataggcctttgaagtaattctgatgcctggaccactccaattcacttaaatctgaatttctggggggttgtgcctgggcatgggcattttttaaatctcccagctgatgctactatgcagtcagggttgagaaccacggcgcaactctgaccttgcaccttgcatgttgacattctctgttttgtccctgcaggctaccaatcacgttagaaatctgattaaggcactagagacaagggaacccgaaaatccaagcctccatcttaaaaaaattattgtggttagccgactggtaagaaggttctttcctggttctgaaatggtgcttctccctgctttccttagaggagaactgtgctcccccaggaagctccttgagtgccttacccctcccttctggctcaaacttgtcctttagggtagtggctcatatcctgctgtgcctacttgcctctggctgataactgtgacatgtgggttctacatccttagcctaggtgccccctcagagatgccatgaagatcagggagacggggtctgaaagtgcttttggagtgggctgtgccttatttggggaaagcgggtggtattgcagctgttatgcagcagagccacacccagctctagcctctagtgcctgggtgcccatctcccatattcttttttgtggaggtgacctgagaaggctggcctgcctaggcctctcaaacatcagggaaggttcaactagaccaggttgccaacaaatctgtatctctttcagacccttcagccccaaagcaagatttactagaagtagttgctgtaagaatgaaggcaactctgggaccccaggaaccagaactgtggagttgcatagg

SEQ ID NO: 42411 - DNA, 872 bp, Homo sapiens
cggagtaccgggatctcggtttccaaggactgtaacgccttcaaccgcccgccgcgatagagtgcccacgaccctgcctcgggaatcccgctctgcaccgccccaccagacccggactcggagccgcgagcggcccgagatgagcagcaatgactcctcccttatggctgggatcatttactatagccaggaaaagtacttccaccatgtgcagcaggctgcagctgtgggcctggaaaaattcagcaatgaccctgtgttgaagttctttaaagcctatggagtcctcaaagaagagcacatccaggatgccatcagtgacctggaaagcatcaggcatcacccagacgtgtccctgtgctccaccatggccctcatttatgctcacaaaagatgtgaaatcattgaccgagaagcaattcaggagcttgagtacagcctgaaggaaatacgcaagacagtcagtgggactgcactgtactatgctggccttttcctctggctcataggccgccatgacaaggccaaagagtacattgaccgcatgctgaagatttctagaggcttcagagaggcctatgtgctcagaggctgggtggacctgacctcagacaagccccacactgcgaagaaagccattgagtacctggaacaaggaattcaggacaccaaagatgtgctggggctgatgggaaaggcaatgtacttcatgatgcagcagaactactcagaggccctggaggtggtgaaccagatcactgtgacttcagggagcttcctgccagccctcgtcctgaagatgcagctgttcttagctcggcaggactgggagcagacagtagaaatgggacacaggtgagctactgcacaaa

SEQ ID NO: 42412 - DNA, 697 bp, Homo sapiens
gggcaccagacgagttgttaagttgtaaatatgaaaatttattttgcataggaaacaataatctctggtaaaaatcattactgcatataacaaaacaatgccttcaattaaagggggaaagtgagtttttaaacattggggttaatttagaagaaaatacagtatataataatctcaacatcatgttaaggaacatgattattttttaagatgacccctttgattgtatttcacaggattattgaacatggggaaggaagaggcctcacttgaggaagtgttagtctatctcaatcaaatctactgtgggcagatttctattgaaacctcccaacttcagagccaggatgagaaagactggtttgccaagcggtttgaggaactgcaaaaggagacgtttaccacagaagagcgaaaacatctgtcgaaactaatgctggaatctcaggctggagtgcagtggcgaaatctcagctcactgcaacctctgcctcctgggttcaagtgattctcctgcctcagcctcccgagtagctgggactacaggcacgtgccaccacgcccagctaatttttgtatttttagtagagacagggtttcaccatgttggccagcctggtctcaaactcctgacctcaagtgatcctcccacctcagcctcccaaagtgctgagattacaggcatgagccactatac

SEQ ID NO: 42413 - DNA, 5282 bp, Homo sapiens
  misc_feature (2)..(2): n is a, c, g, or t
  misc_feature (24)..(24): n is a, c, g, or t
anggctaggtacgaggctggtgtnaatcggccgaggcagggccggtgggatcccctcgggctcccgccttagcatgctggccgggacatctggtgaacatggcctctgctactgcggcagcagcacgacggggcctcggccgggctctccctctcctctggcgtggctaccagaccgagcggggcgtttacggctaccggccgaggaagcccgagagccgcgagccccagggcgccctggagcgccccccagttgatcatggccttgccaggttggtgacagtatattgtgagcatggtcataaagctgccaaaatcaaccccctcttcaccggacaagccctgctggagaatgtgcctgaaatccaagccctggtgcagacactgcagggacccttccacacggcaggattattgaacatggggaaggaagaggcctcacttgaggaagtgttagtctatctcaatcaaatctactgtgggcagatttctattgaaacctcccaacttcagagccaggatgagaaagactggtttgccaagcggtttgaggaactgcaaaaggagacgtttaccacagaagagcgaaaacatctgtcgaaactaatgctggaatctcaggagtttgaccactttctggccaccaagttctcgacagtgaagcgatatggaggcgaaggggctgaaagcatgatgggctttttccacgagctgctgaaaatgtcggcctacagcgggatcactgatgtcattattgggatgccccatagagggaggctgaatttattgacaggccttctgcagttccctccagagctgatgttccgtaaaatgcgaggcttaagtgaatttccagagaatttctcagccactggagacgtcctgtctcacctgacctcctctgtggacctgtactttggggcgcaccatcccctccatgtgacaatgttgcccaatccctcgcacctggaggccgtcaaccccgtggccgtgggcaaaactcgcggcaggcagcagtctcgccaagacggcgattactctccagacaactcagcccagccgggggacagggtcatttgcttacaggtccatggtgatgcttctttctgtggtcaagggattgttcctgaaacattcacgctgtccaatctcccacatttcagaattggtgggagtgtgcatttgattgttaataaccagctgggttacaccactccagctgaaagaggaaggtcttctttatactgcagtgatattgggaagcttgtgggctgtgccatcatccatgtcaatggagacagcccagaggaagtggtccgtgccacacgactggcttttgaataccaacgccagttccgcaaggatgtgattattgatctgttgtgctacaggcagtggggccacaatgagctggatgagccattctacaccaaccccatcatgtacaaaatcatcagagctcgaaagagcattccagacacatatgcagagcacctcattgctggcggactcatgacgcaggaggaggtgtctgaaataaaatcctcctactatgccaagttgaatgatcacttaaataacatggcccactacaggccccctgccctgaacctgcaggcccactggcagggcctggctcagccagaagcgcaaatcaccacctggagtacaggtgtgcccctcgacctcctgcggtttgttggcatgaagtctgtagaggtgccaagagagctgcagatgcacagtcacctgctgaagacacatgttcagtccagaatggagaagatgatggacggaatcaagctagactgggccaccgcggaagctcttgccttgggttctttacttgctcaaggttttaatgttcgtctaagtggccaagatgttggtcgtggaactttcagtcagaggcatgcaatggtggtttgccaggagacggatgacacctacatccccctgaaccatatggacccaaatcagaaggggtttctagaggtcagcaacagccccctgtcagaagaggccgtcctgggattcgaatatgggatgagcattgagagcccaaagttactgcccctgtgggaggcacagtttggcgatttcttcaatggtgcccagatcatctttgacacattcatctctggaggagaggccaagtggctcctacaaagcggcattgtcatcctccttccacatggctacgatggggctgggccagaccactcatcctgtcgaatagagcgtttcctgcagatgtgtgacagtgcggaagagggggtggacggagacactgtgaacatgtttgtggttcacccaacaactcctgcacagtatttccacttgcttaggagacagatggtccggaacttcagaaaaccactcattgttgcttcccctaagatgttactcaggctcccggcagccgtgtcaactcttcaagaaatggcaccaggaacaacatttaacccggtcattggtgattcatctgtggatccaaaaaaggttaagaccctcgtgttctgctccggcaaacatttctactccctggtgaaacaaagagaatctctgggggccaagaagcatgactttgccatcatccgagtagaggaactctgccccttcccgttggattctttacagcaagagatgagcaaatacaaacatgttaaagatcatatttggagtcaggaggaacctcagaacatgggtccgtggtcgtttgtttctccaaggtttgaaaagcagctggcctgcaagctccgtctggtgggccggccccctttgccagtacccgctgtaggaattggcacagttcacttgcaccagcatgaagatatcctcgccaagaccttcgcttgatgatgacttttgaagaaacactatttctctttaagaaaatggccattaaggccgggtggggtggcacatgcctgtaatcccagcactttgggaggccaaggctggtggatcacctgaggtcaggagttcgagaccagcctggccaacacggtgaaaccccgcctctactaaaaatacaaaaaatagccgggtgtggtggtgggcacctgtgatcccagcttcctgggaggctgaggcaagagaatcgcttgaatctgggaggcggaggttgcagtgagccaggatcacaccattgctgtccagcctgggtgacagagcaagactgcgtttcaaaaaaaaaaaaaaaaaaacccattaaaagaggcctccttcctccactctctcaacccctctgttgggtaacatgaaaagactgtattcctctaagatgttgggattgatatacgtgatttaatctgcaataggtggaataaccaggggaactggttatgaatatgtgaatgcaaccagcaaatttatccttgaaggtgtgatggtagaaataggaaaacaacaaaagaaaaacaataacaaaaaaagaaagtgtgatggctgggtgcagtggctcacgcctgtaatcccagcactttgggaggcttaggcggctggatcacctgaggtcaggagttcaagaccagcctggtcaacgtggtgaaacgccgtttctactaaaaatatgaaaattagttgggtgtggtggcatgcgcttgtagtctcagctactccggaggctgaggcaggagaattgcttgaacctggaaggcagaggttgcagtgagccgaaatggcgccactgtactccaacctgggcgacagagcaagactccatctcataaattaaaaggaaagtatgatagtgttatggattttagctctgagtgagctggaaaactaggtcattatctagatgatttcagacttgaccctaattgaccatatatgaccaggaaacacttctgagtttacagctccgtggagatgacctcaacactgcctcttgatttgtttgatgcatgtcactttcattaattttccccctcctttttgaaagtcctgtggcagtactaatattttcattttatgtaatctctggtgctgctttccagtcactgtatgaagtgttatccccaacactagcaaatctaggtcctactaaatacaaatctctgggtggatgatcttctagtactgtatttttaaattaaggagttttagttataatgaaattgatttgtagtctgttttgccgtaaacttgtttttctttaaattgttcttacagtgatatcttactatttttaactgtctggggtttctgatatggggatttcagcccctggttaatcagtcttgtccctacaagtccctgatgcagtatgtttatttgtgatgtttaaagaacatttcttggctgggcgctgcggcttgcgcctgtaatctcagcactttgggaggctgaggtgggtggatcacctgaggttgggagttcgagaccagcctgacaaaacatagtgaaaccccgtctctactaaaaatacaaaaattagctgggcgtggtggtgggtgtctgtaatcccagctattcgggaggctgaggcaggagaatcgcttgaacccaggaggtggaggttgcagtgagctgagatcctgccactgcactccagtctgggtgacagagcaagactccatctcaaaaaataaataaatagaaagagagagagaggaaaaaaaaaagaaaagaacacttctttatttgagggactttcccaacaccaggtgcttggggatttcttagagatcaccaaccgactccctcactgtgaaattaaaccaagtactggaaacgtaactaaacagcgaaccatgtagcttcacctgactcagtgctgggggcctctaccatctactgtgcttgtgtcatgatgctttttctctgaagtggtgtgggaagtaccaggggactggcagaagcccaggccctctctacttttaccagcaactgatcatgtctttcagaatccatgtacatataggctgttctagccacagtggtagatttatgattcacatccgaaagtgtgccttagttatcaatttaacatttctctagtattcatatcccttttcttaccatatacctcagtgtatccttcctgtgtcaagccttataaatcatgtaatttagtgccactcatgtaaatcagtaaaatcacaaaggtctatttaatgaaaacgatttaccaatgttgtttttttttaacaagaaaaaaaataaaagcacattgtcattttttttcctcagaaactcctggacttcttgaattaaaagatttcaaaagtctaagcacaaaaatgagatggaagattagatctttgtaaaaggtta

SEQ ID NO: 42414 - DNA, 4229 bp, Homo sapiens
  misc_feature (2)..(2): n is a, c, g, or t
  misc_feature (24)..(24): n is a, c, g, or t
anggctaggtacgaggctggtgtnaatcggccgaggcagggccggtgggatcccctcgggctcccgccttagcatgctggccgggacatctggtgaacatggcctctgctactgcggcagcagcacgacggggcctcggccgggctctccctctcctctggcgtggctaccagaccgagcggggcgtttacggctaccggccgaggaagcccgagagccgcgagccccagggcgccctggagcgccccccagttgatcatggccttgccaggttggtgacagtatattgtgagcatggtcataaagctgccaaaatcaaccccctcttcaccggacaagccctgctggagaatgtgcctgaaatccaagccctggtgcagacactgcagggacccttccacacggcaggattattgaacatggggaaggaagaggcctcacttgaggaagtgttagtctatctcaatcaaatctactgtgggcagatttctattgaaacctcccaacttcagagccaggatgagaaagactggtttgccaagcggtttgaggaactgcaaaaggagacgtttaccacagaagagcgaaaacatctgtcgaaactaatgctggaatctcaggagtttgaccactttctggccaccaagttctcgacagtgaagcgatatggaggcgaaggggctgaaagcatgatgggctttttccacgagctgctgaaaatgtcggcctacagcgggatcactgatgtcattattgggatgccccatagagggaggctgaatttattgacaggccttctgcagttccctccagagctgatgttccgtaaaatgcgaggcttaagtgaatttccagagaatttctcagccactggagacgtcctgtctcacctgacctcctctgtggacctgtactttggggcgcaccatcccctccatgtgacaatgttgcccaatccctcgcacctggaggccgtcaaccccgtggccgtgggcaaaactcgcggcaggcagcagtctcgccaagacggcgattactctccagacaactcagcccagccgggggacagggtcatttgcttacaggtccatggtgatgcttctttctgtggtcaagggattgttcctgaaacattcacgctgtccaatctcccacatttcagaattggtgggagtgtgcatttgattgttaataaccagctgggttacaccactccagctgaaagaggaaggtcttctttatactgcagtgatattgggaagcttgtgggctgtgccatcatccatgtcaatggagacagcccagaggaagtggtccgtgccacacgactggcttttgaataccaacgccagttccgcaaggatgtgattattgatctgttgtgctacaggcagtggggccacaatgagctggatgagccattctacaccaaccccatcatgtacaaaatcatcagagctcgaaagagcattccagacacatatgcagagcacctcattgctggcggactcatgacgcaggaggaggtgtctgaaataaaatcctcctactatgccaagttgaatgatcacttaaataacatggcccactacaggccccctgccctgaacctgcaggcccactggcagggcctggctcagccagaagcgcaaatcaccacctggagtacaggtgtgcccctcgacctcctgcggtttgttggcatgaagtctgtagaggtgccaagagagctgcagatgcacagtcacctgctgaagacacatgttcagtccagaatggagaagatgatggacggaatcaagctagactgggccaccgcggaagctcttgccttgggttctttacttgctcaaggttttaatgttcgtctaagtggccaagatgttggtcgtggaactttcagtcagaggcatgcaatggtggtttgccaggagacggatgacacctacatccccctgaaccatatggacccaaatcagaaggggtttctagaggtcagcaacagccccctgtcagaagaggccgtcctgggattcgaatatgggatgagcattgagagcccaaagttactgcccctgtgggaggcacagtttggcgatttcttcaatggtgcccagatcatctttgacacattcatctctggaggagaggccaagtggctcctacaaagcggcattgtcatcctccttccacatggctacgatggggctgggccagaccactcatcctgtcgaatagagcgtttcctgcagatgtgtgacagtgcggaagagggggtggacggagacactgtgaacatgtttgtggttcacccaacaactcctgcacagtatttccacttgcttaggagacagatggtccggaacttcagaaaaccactcattgttgcttcccctaagatgttactcaggctcccggcagccgtgtcaactcttcaagaaatggcaccaggaacaacatttaacccggtcattggtgattcatctgtggatccaaaaaaggttaagaccctcgtgttctgctccggcaaacatttctactccctggtgaaacaaagagaatctctgggggccaagaagcatgactttgccatcatccgagtagaggaactctgccccttcccgttggattctttacagcaagagatgagcaaatacaaacatgttaaagatcatatttggagtcaggaggaacctcagaacatgggtccgtggtcgtttgtttctccaaggtttgaaaagcagctggcctgcaagctccgtctggtgggccggccccctttgccagtacccgctgtaggaattggcacagttcacttgcaccagcatgaagatatcctcgccaagaccttcgcttgatgatgacttttgaagaaacactatttctctttaagaaaatggccattaaggccgggtggggtggcacatgcctgtaatcccagcactttgggaggccaaggctggtggatcacctgaggtcaggagttcgagaccagcctggccaacacggtgaaaccccgcctctactaaaaatacaaaaaatagccgggtgtggtggtgggcacctgtgatcccagcttcctgggaggctgaggcaagagaatcgcttgaatctgggaggcggaggttgcagtgagccaggatcacaccattgctgtccagcctgggtgacagagcaagactgcgtttcaaaaaaaaaaaaaaaaaaacccattaaaagaggcctccttcctccactctctcaacccctctgttgggtaacatgaaaagactgtattcctctaagatgttgggattgatatacgtgatttaatctgcaataggtggaataaccaggggaactggttatgaatatgtgaatgcaaccagcaaatttatccttgaaggtgtgatggtagaaataggaaaacaacaaaagaaaaacaataacaaaaaaagaaagtgtgatggctgggtgcagtggctcacgcctgtaatcccagcactttgggaggcttaggcggctggatcacctgaggtcaggagttcaagaccagcctggtcaacgtggtgaaacgccgtttctactaaaaatatgaaaattagttgggtgtggtggcatgcgcttgtagtctcagctactccggaggctgaggcaggagaattgcttgaacctggaaggcagaggttgcagtgagccgaaatggcgccactgtactccaacctgggcgacagagcaagactccatctcataaattaaaaggaaagtatgatagtgttatggattttagctctgagtgagctggaaaactaggtcattatctagatgatttcagacttgaccctaattgaccatatatgaccaggaaacacttctgagtttacagctccgtggagatgacctcaacactgcctcttgatttgtttgatgcatgtcactttcattaattttccccctcctttttgaaagtcctgtggcagtactaatattttcattttatgtaatctctggtgctgctttccagtcactgtatgaagtgttatccccaacactagcaaatctaggtcctactaaatacaaatctctgggtggatgatcttctagtactgtatttttaaattaaggagttttagttataatgaaattgatttgtagtctgttttgccgtaaacttgtttttctttaaattgttcttacagtgatatcttactatttttaactgtaggagcataatcggtaccgagctcgat

SEQ ID NO: 42415 - DNA, 4827 bp, Homo sapiens
  misc_feature (2)..(2): n is a, c, g, or t
  misc_feature (24)..(24): n is a, c, g, or t
anggctaggtacgaggctggtgtnaatcggccgaggattgaaacctcccaacttcagagccaggatgagaaagactggtttgccaagcggtttgaggaactgcaaaaggagacgtttaccacagaagagcgaaaacatctgtcgaaactaatgctggaatctcaggagtttgaccactttctggccaccaagttctcgacagtgaagcgatatggaggcgaaggggctgaaagcatgatgggctttttccacgagctgctgaaaatgtcggcctacagcgggatcactgatgtcattattgggatgccccatagagggaggctgaatttattgacaggccttctgcagttccctccagagctgatgttccgtaaaatgcgaggcttaagtgaatttccagagaatttctcagccactggagacgtcctgtctcacctgacctcctctgtggacctgtactttggggcgcaccatcccctccatgtgacaatgttgcccaatccctcgcacctggaggccgtcaaccccgtggccgtgggcaaaactcgcggcaggcagcagtctcgccaagacggcgattactctccagacaactcagcccagccgggggacagggtcatttgcttacaggtccatggtgatgcttctttctgtggtcaagggattgttcctgaaacattcacgctgtccaatctcccacatttcagaattggtgggagtgtgcatttgattgttaataaccagctgggttacaccactccagctgaaagaggaaggtcttctttatactgcagtgatattgggaagcttgtgggctgtgccatcatccatgtcaatggagacagcccagaggaagtggtccgtgccacacgactggcttttgaataccaacgccagttccgcaaggatgtgattattgatctgttgtgctacaggcagtggggccacaatgagctggatgagccattctacaccaaccccatcatgtacaaaatcatcagagctcgaaagagcattccagacacatatgcagagcacctcattgctggcggactcatgacgcaggaggaggtgtctgaaataaaatcctcctactatgccaagttgaatgatcacttaaataacatggcccactacaggccccctgccctgaacctgcaggcccactggcagggcctggctcagccagaagcgcaaatcaccacctggagtacaggtgtgcccctcgacctcctgcggtttgttggcatgaagtctgtagaggtgccaagagagctgcagatgcacagtcacctgctgaagacacatgttcagtccagaatggagaagatgatggacggaatcaagctagactgggccaccgcggaagctcttgccttgggttctttacttgctcaaggttttaatgttcgtctaagtggccaagatgttggtcgtggaactttcagtcagaggcatgcaatggtggtttgccaggagacggatgacacctacatccccctgaaccatatggacccaaatcagaaggggtttctagaggtcagcaacagccccctgtcagaagaggccgtcctgggattcgaatatgggatgagcattgagagcccaaagttactgcccctgtgggaggcacagtttggcgatttcttcaatggtgcccagatcatctttgacacattcatctctggaggagaggccaagtggctcctacaaagcggcattgtcatcctccttccacatggctacgatggggctgggccagaccactcatcctgtcgaatagagcgtttcctgcagatgtgtgacagtgcggaagagggggtggacggagacactgtgaacatgtttgtggttcacccaacaactcctgcacagtatttccacttgcttaggagacagatggtccggaacttcagaaaaccactcattgttgcttcccctaagatgttactcaggctcccggcagccgtgtcaactcttcaagaaatggcaccaggaacaacatttaacccggtcattggtgattcatctgtggatccaaaaaaggttaagaccctcgtgttctgctccggcaaacatttctactccctggtgaaacaaagagaatctctgggggccaagaagcatgactttgccatcatccgagtagaggaactctgccccttcccgttggattctttacagcaagagatgagcaaatacaaacatgttaaagatcatatttggagtcaggaggaacctcagaacatgggtccgtggtcgtttgtttctccaaggtttgaaaagcagctggcctgcaagctccgtctggtgggccggccccctttgccagtacccgctgtaggaattggcacagttcacttgcaccagcatgaagatatcctcgccaagaccttcgcttgatgatgacttttgaagaaacactatttctctttaagaaaatggccattaaggccgggtggggtggcacatgcctgtaatcccagcactttgggaggccaaggctggtggatcacctgaggtcaggagttcgagaccagcctggccaacacggtgaaaccccgcctctactaaaaatacaaaaaatagccgggtgtggtggtgggcacctgtgatcccagcttcctgggaggctgaggcaagagaatcgcttgaatctgggaggcggaggttgcagtgagccaggatcacaccattgctgtccagcctgggtgacagagcaagactgcgtttcaaaaaaaaaaaaaaaaaaacccattaaaagaggcctccttcctccactctctcaacccctctgttgggtaacatgaaaagactgtattcctctaagatgttgggattgatatacgtgatttaatctgcaataggtggaataaccaggggaactggttatgaatatgtgaatgcaaccagcaaatttatccttgaaggtgtgatggtagaaataggaaaacaacaaaagaaaaacaataacaaaaaaagaaagtgtgatggctgggtgcagtggctcacgcctgtaatcccagcactttgggaggcttaggcggctggatcacctgaggtcaggagttcaagaccagcctggtcaacgtggtgaaacgccgtttctactaaaaatatgaaaattagttgggtgtggtggcatgcgcttgtagtctcagctactccggaggctgaggcaggagaattgcttgaacctggaaggcagaggttgcagtgagccgaaatggcgccactgtactccaacctgggcgacagagcaagactccatctcataaattaaaaggaaagtatgatagtgttatggattttagctctgagtgagctggaaaactaggtcattatctagatgatttcagacttgaccctaattgaccatatatgaccaggaaacacttctgagtttacagctccgtggagatgacctcaacactgcctcttgatttgtttgatgcatgtcactttcattaattttccccctcctttttgaaagtcctgtggcagtactaatattttcattttatgtaatctctggtgctgctttccagtcactgtatgaagtgttatccccaacactagcaaatctaggtcctactaaatacaaatctctgggtggatgatcttctagtactgtatttttaaattaaggagttttagttataatgaaattgatttgtagtctgttttgccgtaaacttgtttttctttaaattgttcttacagtgatatcttactatttttaactgtctggggtttctgatatggggatttcagcccctggttaatcagtcttgtccctacaagtccctgatgcagtatgtttatttgtgatgtttaaagaacatttcttggctgggcgctgcggcttgcgcctgtaatctcagcactttgggaggctgaggtgggtggatcacctgaggttgggagttcgagaccagcctgacaaaacatagtgaaaccccgtctctactaaaaatacaaaaattagctgggcgtggtggtgggtgtctgtaatcccagctattcgggaggctgaggcaggagaatcgcttgaacccaggaggtggaggttgcagtgagctgagatcctgccactgcactccagtctgggtgacagagcaagactccatctcaaaaaataaataaatagaaagagagagagaggaaaaaaaaaagaaaagaacacttctttatttgagggactttcccaacaccaggtgcttggggatttcttagagatcaccaaccgactccctcactgtgaaattaaaccaagtactggaaacgtaactaaacagcgaaccatgtagcttcacctgactcagtgctgggggcctctaccatctactgtgcttgtgtcatgatgctttttctctgaagtggtgtgggaagtaccaggggactggcagaagcccaggccctctctacttttaccagcaactgatcatgtctttcagaatccatgtacatataggctgttctagccacagtggtagatttatgattcacatccgaaagtgtgccttagttatcaatttaacatttctctagtattcatatcccttttcttaccatatacctcagtgtatccttcctgtgtcaagccttataaatcatgtaatttagtgccactcatgtaaatcagtaaaatcacaaaggtctatttaatgaaaacgatttaccaatgttgtttttttttaacaagaaaaaaaataaaagcacattgtcattttttttcctcagaaactcctggacttcttgaattaaaagatttcaaaagtctaagcacaaaaatgagatggaagattagatctttgtaaaaggtta

SEQ ID NO: 42416 - DNA, 4769 bp, Homo sapiens
acctgcaatcccagcactttgggaggctaaggcaagaggagtgcttgagcccaggagttcaagaccatgggtaacctcgcaaaactctgtccctacaaaaataaaaattaggtggcatggtctctacaaacatgaaaattaggtggtgcacctatgctcccaaagtgctggaattacaggcataagccaccactcctggctttaaattttcttttttgttgtatgatttcaactcagcacttcttccctagactccattgtgatgaatgccatttttttccttttgaatgtatccacaatagctgatgttccgtaaaatgcgaggcttaagtgaatttccagagaatttctcagccactggagacgtcctgtctcacctgacctcctctgtggacctgtactttggggcgcaccatcccctccatgtgacaatgttgcccaatccctcgcacctggaggccgtcaaccccgtggccgtgggcaaaactcgcggcaggcagcagtctcgccaagacggcgattactctccagacaactcagcccagccgggggacagggtcatttgcttacaggtccatggtgatgcttctttctgtggtcaagggattgttcctgaaacattcacgctgtccaatctcccacatttcagaattggtgggagtgtgcatttgattgttaataaccagctgggttacaccactccagctgaaagaggaaggtcttctttatactgcagtgatattgggaagcttgtgggctgtgccatcatccatgtcaatggagacagcccagaggaagtggtccgtgccacacgactggcttttgaataccaacgccagttccgcaaggatgtgattattgatctgttgtgctacaggcagtggggccacaatgagctggatgagccattctacaccaaccccatcatgtacaaaatcatcagagctcgaaagagcattccagacacatatgcagagcacctcattgctggcggactcatgacgcaggaggaggtgtctgaaataaaatcctcctactatgccaagttgaatgatcacttaaataacatggcccactacaggccccctgccctgaacctgcaggcccactggcagggcctggctcagccagaagcgcaaatcaccacctggagtacaggtgtgcccctcgacctcctgcggtttgttggcatgaagtctgtagaggtgccaagagagctgcagatgcacagtcacctgctgaagacacatgttcagtccagaatggagaagatgatggacggaatcaagctagactgggccaccgcggaagctcttgccttgggttctttacttgctcaaggttttaatgttcgtctaagtggccaagatgttggtcgtggaactttcagtcagaggcatgcaatggtggtttgccaggagacggatgacacctacatccccctgaaccatatggacccaaatcagaaggggtttctagaggtcagcaacagccccctgtcagaagaggccgtcctgggattcgaatatgggatgagcattgagagcccaaagttactgcccctgtgggaggcacagtttggcgatttcttcaatggtgcccagatcatctttgacacattcatctctggaggagaggccaagtggctcctacaaagcggcattgtcatcctccttccacatggctacgatggggctgggccagaccactcatcctgtcgaatagagcgtttcctgcagatgtgtgacagtgcggaagagggggtggacggagacactgtgaacatgtttgtggttcacccaacaactcctgcacagtatttccacttgcttaggagacagatggtccggaacttcagaaaaccactcattgttgcttcccctaagatgttactcaggctcccggcagccgtgtcaactcttcaagaaatggcaccaggaacaacatttaacccggtcattggtgattcatctgtggatccaaaaaaggttaagaccctcgtgttctgctccggcaaacatttctactccctggtgaaacaaagagaatctctgggggccaagaagcatgactttgccatcatccgagtagaggaactctgccccttcccgttggattctttacagcaagagatgagcaaatacaaacatgttaaagatcatatttggagtcaggaggaacctcagaacatgggtccgtggtcgtttgtttctccaaggtttgaaaagcagctggcctgcaagctccgtctggtgggccggccccctttgccagtacccgctgtaggaattggcacagttcacttgcaccagcatgaagatatcctcgccaagaccttcgcttgatgatgacttttgaagaaacactatttctctttaagaaaatggccattaaggccgggtggggtggcacatgcctgtaatcccagcactttgggaggccaaggctggtggatcacctgaggtcaggagttcgagaccagcctggccaacacggtgaaaccccgcctctactaaaaatacaaaaaatagccgggtgtggtggtgggcacctgtgatcccagcttcctgggaggctgaggcaagagaatcgcttgaatctgggaggcggaggttgcagtgagccaggatcacaccattgctgtccagcctgggtgacagagcaagactgcgtttcaaaaaaaaaaaaaaaaaaacccattaaaagaggcctccttcctccactctctcaacccctctgttgggtaacatgaaaagactgtattcctctaagatgttgggattgatatacgtgatttaatctgcaataggtggaataaccaggggaactggttatgaatatgtgaatgcaaccagcaaatttatccttgaaggtgtgatggtagaaataggaaaacaacaaaagaaaaacaataacaaaaaaagaaagtgtgatggctgggtgcagtggctcacgcctgtaatcccagcactttgggaggcttaggcggctggatcacctgaggtcaggagttcaagaccagcctggtcaacgtggtgaaacgccgtttctactaaaaatatgaaaattagttgggtgtggtggcatgcgcttgtagtctcagctactccggaggctgaggcaggagaattgcttgaacctggaaggcagaggttgcagtgagccgaaatggcgccactgtactccaacctgggcgacagagcaagactccatctcataaattaaaaggaaagtatgatagtgttatggattttagctctgagtgagctggaaaactaggtcattatctagatgatttcagacttgaccctaattgaccatatatgaccaggaaacacttctgagtttacagctccgtggagatgacctcaacactgcctcttgatttgtttgatgcatgtcactttcattaattttccccctcctttttgaaagtcctgtggcagtactaatattttcattttatgtaatctctggtgctgctttccagtcactgtatgaagtgttatccccaacactagcaaatctaggtcctactaaatacaaatctctgggtggatgatcttctagtactgtatttttaaattaaggagttttagttataatgaaattgatttgtagtctgttttgccgtaaacttgtttttctttaaattgttcttacagtgatatcttactatttttaactgtctggggtttctgatatggggatttcagcccctggttaatcagtcttgtccctacaagtccctgatgcagtatgtttatttgtgatgtttaaagaacatttcttggctgggcgctgcggcttgcgcctgtaatctcagcactttgggaggctgaggtgggtggatcacctgaggttgggagttcgagaccagcctgacaaaacatagtgaaaccccgtctctactaaaaatacaaaaattagctgggcgtggtggtgggtgtctgtaatcccagctattcgggaggctgaggcaggagaatcgcttgaacccaggaggtggaggttgcagtgagctgagatcctgccactgcactccagtctgggtgacagagcaagactccatctcaaaaaataaataaatagaaagagagagagaggaaaaaaaaaagaaaagaacacttctttatttgagggactttcccaacaccaggtgcttggggatttcttagagatcaccaaccgactccctcactgtgaaattaaaccaagtactggaaacgtaactaaacagcgaaccatgtagcttcacctgactcagtgctgggggcctctaccatctactgtgcttgtgtcatgatgctttttctctgaagtggtgtgggaagtaccaggggactggcagaagcccaggccctctctacttttaccagcaactgatcatgtctttcagaatccatgtacatataggctgttctagccacagtggtagatttatgattcacatccgaaagtgtgccttagttatcaatttaacatttctctagtattcatatcccttttcttaccatatacctcagtgtatccttcctgtgtcaagccttataaatcatgtaatttagtgccactcatgtaaatcagtaaaatcacaaaggtctatttaatgaaaacgatttaccaatgttgtttttttttaacaagaaaaaaaataaaagcacattgtcattttttttcctcagaaactcctggacttcttgaattaaaagatttcaaaagtctaagcacaaaaatgagatggaagattagatctttgtaaaaggtta

SEQ ID NO: 42417 - DNA, 5032 bp, Homo sapiens
  misc_feature (2)..(2): n is a, c, g, or t
  misc_feature (24)..(24): n is a, c, g, or t
anggctaggtacgaggctggtgtnaatcggccgaggcagggccggtgggatcccctcgggctcccgccttagcatgctggccgggacatctggtgaacatggcctctgctactgcggcagcagcacgacggggcctcggccgggctctccctctcctctggcgtggctaccagaccgagcggggcgtttacggctaccggccgaggaagcccgagagccgcgagccccagggcgccctggagcgccccccagttgatcatggccttgccaggttggtgacagtatattgtgagcatggtcataaagctgccaaaatcaaccccctcttcaccggacaagccctgctggagaatgtgcctgaaatccaagccctggtgcagacactgcagggacccttccacacggcaggattattgaacatggggaaggaagaggcctcacttgaggaagtgttagtctatctcaatcaaatctactgtgggcagatttctattgaaacctcccaacttcagagccaggatgagaaagactggtttgccaagcggtttgaggaactgcaaaaggagacgtttaccacagaagagcgaaaacatctgtcgaaactaatgctggaatctcaggagtttgaccactttctggccaccaagttctcgacagtgaagcgatatggaggcgaaggggctgaaagcatgatgggctttttccacgagctgctgaaaatgtcggcctacagcgggatcactgatgtcattattgggatgccccatagagggaggctgaatttattgacaggccttctgcagttccctccagagctgatgttccgtaaaatgcgaggcttaagtgaatttccagagaatttctcagccactggagacgtcctgtctcacctgacctcctctgtggacctgtactttggggcgcaccatcccctccatgtgacaatgttgcccaatccctcgcacctggaggccgtcaaccccgtggccgtgggcaaaactcgcggcaggcagcagtctcgccaagacggcgattactctccagacaactcagcccagccgggggacagggtcatttgcttacaggtccatggtgatgcttctttctgtggtcaagggattgttcctgaaacattcacgctgtccaatctcccacatttcagaattggtgggagtgtgcatttgattgttaataaccagctgggttacaccactccagctgaaagaggaaggtcttctttatactgcagtgatattgggaagcttgtgggctgtgccatcatccatgtcaatggagacagcccagaggaagtggtccgtgccacacgactggcttttgaataccaacgccagttccgcaaggatgtgattattgatctgttgtgctacaggcagtggggccacaatgagctggatgagccattctacaccaaccccatcatgtacaaaatcatcagagctcgaaagagcattccagacacatatgcagagcacctcattgctggcggactcatgacgcaggaggaggtgtctgaaataaaatcctcctactatgccaagttgaatgatcacttaaataacatggcccactacaggccccctgccctgaacctgcaggcccactggcagggcctggctcagccagaagcgcaaatcaccacctggagtacaggtgtgcccctcgacctcctgcggtttgttggcatgaagtctgtagaggtgccaagagagctgcagatgcacagtcacctgctgaagacacatgttcagtccagaatggagaagatgatggacggaatcaagctagactgggccaccgcggaagctcttgccttgggttctttacttgctcaaggttttaatgttcgtctaagtggccaagatgttggtcgtggaactttcagtcagaggcatgcaatggtggtttgccaggagacggatgacacctacatccccctgaaccatatggacccaaatcagaaggggtttctagaggtcagcaacagccccctgtcagaagaggccgtcctgggattcgaatatgggatgagcattgagagcccaaagttactgcccctgtgggaggcacagtttggcgatttcttcaatggtgcccagatcatctttgacacattcatctctggaggagaggccaagtggctcctacaaagcggcattgtcatcctccttccacatggctacgatggggctgggccagaccactcatcctgtcgaatagagcgtttcctgcagatgtgtgacagtgcggaagagggggtggacggagacactgtgaacatgtttgtggttcacccaacaactcctgcacagtatttccacttgcttaggagacagatggtccggaacttcagaaaaccactcattgttgcttcccctaagatgttactcaggctcccggcagccgtgtcaactcttcaagaaatggcaccaggaacaacatttaacccggtcattggtgattcatctgtggatccaaaaaaggttaagaccctcgtgttctgctccggcaaacatttctactccctggtgaaacaaagagaatctctgggggccaagaagcatgactttgccatcatccgagtagaggaactctgccccttcccgttggattctttacagcaagagatgagcaaatacaaacatgttaaagatcatatttggagtcaggaggaacctcagaacatgggtccgtggtcgtttgtttctccaaggtttgaaaagcagctggcctgcaaggtaatcacacgttttctctggtagtgttttgtgttttgtgtgcatgttgtttttcttttctttctttctttcttttttttttttgagacagaagaatcgcttgaatctgggaggcggaggttgcagtgagccaggatcacaccattgctgtccagcctgggtgacagagcaagactgcgtttcaaaaaaaaaaaaaaaaaaacccattaaaagaggcctccttcctccactctctcaacccctctgttgggtaacatgaaaagactgtattcctctaagatgttgggattgatatacgtgatttaatctgcaataggtggaataaccaggggaactggttatgaatatgtgaatgcaaccagcaaatttatccttgaaggtgtgatggtagaaataggaaaacaacaaaagaaaaacaataacaaaaaaagaaagtgtgatggctgggtgcagtggctcacgcctgtaatcccagcactttgggaggcttaggcggctggatcacctgaggtcaggagttcaagaccagcctggtcaacgtggtgaaacgccgtttctactaaaaatatgaaaattagttgggtgtggtggcatgcgcttgtagtctcagctactccggaggctgaggcaggagaattgcttgaacctggaaggcagaggttgcagtgagccgaaatggcgccactgtactccaacctgggcgacagagcaagactccatctcataaattaaaaggaaagtatgatagtgttatggattttagctctgagtgagctggaaaactaggtcattatctagatgatttcagacttgaccctaattgaccatatatgaccaggaaacacttctgagtttacagctccgtggagatgacctcaacactgcctcttgatttgtttgatgcatgtcactttcattaattttccccctcctttttgaaagtcctgtggcagtactaatattttcattttatgtaatctctggtgctgctttccagtcactgtatgaagtgttatccccaacactagcaaatctaggtcctactaaatacaaatctctgggtggatgatcttctagtactgtatttttaaattaaggagttttagttataatgaaattgatttgtagtctgttttgccgtaaacttgtttttctttaaattgttcttacagtgatatcttactatttttaactgtctggggtttctgatatggggatttcagcccctggttaatcagtcttgtccctacaagtccctgatgcagtatgtttatttgtgatgtttaaagaacatttcttggctgggcgctgcggcttgcgcctgtaatctcagcactttgggaggctgaggtgggtggatcacctgaggttgggagttcgagaccagcctgacaaaacatagtgaaaccccgtctctactaaaaatacaaaaattagctgggcgtggtggtgggtgtctgtaatcccagctattcgggaggctgaggcaggagaatcgcttgaacccaggaggtggaggttgcagtgagctgagatcctgccactgcactccagtctgggtgacagagcaagactccatctcaaaaaataaataaatagaaagagagagagaggaaaaaaaaaagaaaagaacacttctttatttgagggactttcccaacaccaggtgcttggggatttcttagagatcaccaaccgactccctcactgtgaaattaaaccaagtactggaaacgtaactaaacagcgaaccatgtagcttcacctgactcagtgctgggggcctctaccatctactgtgcttgtgtcatgatgctttttctctgaagtggtgtgggaagtaccaggggactggcagaagcccaggccctctctacttttaccagcaactgatcatgtctttcagaatccatgtacatataggctgttctagccacagtggtagatttatgattcacatccgaaagtgtgccttagttatcaatttaacatttctctagtattcatatcccttttcttaccatatacctcagtgtatccttcctgtgtcaagccttataaatcatgtaatttagtgccactcatgtaaatcagtaaaatcacaaaggtctatttaatgaaaacgatttaccaatgttgtttttttttaacaagaaaaaaaataaaagcacattgtcattttttttcctcagaaactcctggacttcttgaattaaaagatttcaaaagtctaagcacaaaaatgagatggaagattagatctttgtaaaaggtta

SEQ ID NO: 42418 - DNA, 1514 bp, Homo sapiens
cgcttattttttttctgccatcggccgcgatccgcctgattgtgtttcatcgccctcgtgcttttatgatgagaaatgtggttttgtgggttgtgcactctctggaatatctacactttttttgctgctgatcatttgctggtgtgtgagtgtacctaccgctttggcagagaatgactctgcagttaagctaagggcgtgttcagattgtggaggaaaagtggccgccattttagacttgccgcatatgttatccccaacactagcaaatctaggtcctactaaatacaaatctctgggtggatgatcttctagtactgtatttttaaattaaggagttttagttataatgaaattgatttgtagtctgttttgccgtaaacttgtttttctttaaattgttcttacagtgatatcttactatttttaactgtctggggtttctgatatggggatttcagcccctggttaatcagtcttgtccctacaagtccctgatgcagtatgtttatttgtgatgtttaaagaacatttcttggctgggcgctgcggcttgcgcctgtaatctcagcactttgggaggctgaggtgggtggatcacctgaggttgggagttcgagaccagcctgacaaaacatagtgaaaccccgtctctactaaaaatacaaaaattagctgggcgtggtggtgggtgtctgtaatcccagctattcgggaggctgaggcaggagaatcgcttgaacccaggaggtggaggttgcagtgagctgagatcctgccactgcactccagtctgggtgacagagcaagactccatctcaaaaaataaataaatagaaagagagagagaggaaaaaaaaaagaaaagaacacttctttatttgagggactttcccaacaccaggtgcttggggatttcttagagatcaccaaccgactccctcactgtgaaattaaaccaagtactggaaacgtaactaaacagcgaaccatgtagcttcacctgactcagtgctgggggcctctaccatctactgtgcttgtgtcatgatgctttttctctgaagtggtgtgggaagtaccaggggactggcagaagcccaggccctctctacttttaccagcaactgatcatgtctttcagaatccatgtacatataggctgttctagccacagtggtagatttatgattcacatccgaaagtgtgccttagttatcaatttaacatttctctagtattcatatcccttttcttaccatatacctcagtgtatccttcctgtgtcaagccttataaatcatgtaatttagtgccactcatgtaaatcagtaaaatcacaaaggtctatttaatgaaaacgatttaccaatgttgtttttttttaacaagaaaaaaaataaaagcacattgtcattttttttcctcagaaactcctggacttcttgaattaaaagatttcaaaagtctaagcacaaaaatgagatggaagattagatctttgtaaaaggtta

SEQ ID NO: 42419 - DNA, 2248 bp, Homo sapiens
  misc_feature (2)..(2): n is a, c, g, or t
  misc_feature (24)..(24): n is a, c, g, or t
anggctaggtacgaggctggtgtnaatcggccgaggcagggccggtgggatcccctcgggctcccgccttagcatgctggccgggacatctggtgaacatggcctctgctactgcggcagcagcacgacggggcctcggccgggctctccctctcctctggcgtggctaccagaccgagcggggcgtttacggctaccggccgaggaagcccgagagccgcgagccccagggcgccctggagcgccccccagttgatcatggccttgccaggttggtgacagtatattgtgagcatggtcataaagctgccaaaatcaaccccctcttcaccggacaagccctgctggagaatgtgcctgaaatccaagccctggtgcagacactgcagggacccttccacacggcaggattattgaacatggggaaggaagaggcctcacttgaggaagtgttagtctatctcaatcaaatctactgtgggcagatttctattgaaacctcccaacttcagagccaggatgagaaagactggtttgccaagcggtttgaggaactgcaaaaggagacgtttaccacagaagagcgaaaacatctgtcgaaactaatgctggaatctcaggagtttgaccactttctggccaccaagttctcgacagtgaagcgatatggaggcgaaggggctgaaagcatgatgggctttttccacgagctgctgaaaatgtcggcctacagcgggatcactgatgtcattattgggatgccccatagagggaggctgaatttattgacaggccttctgcagttccctccagagctgatgttccgtaaaatgcgaggcttaagtgaatttccagagaatttctcagccactggagacgtcctgtctcacctgacctcctctgtggacctgtactttggggcgcaccatcccctccatgtgacaatgttgcccaatccctcgcacctggaggccgtcaaccccgtggccgtgggcaaaactcgcggcaggcagcagtctcgccaagacggcgattactctccagacaactcagcccagccgggggacagggtcatttgcttacaggtccatggtgatgcttctttctgtggtcaagggattgttcctgaaacattcacgctgtccaatctcccacatttcagaattggtgggagtgtgcatttgattgttaataaccagctgggttacaccactccagctgaaagaggaaggtcttctttatactgcagtgatattgggaagcttgtgggctgtgccatcatccatgtcaatggagacagcccagaggaagtggtccgtgccacacgactggcttttgaataccaacgccagttccgcaaggatgtgattattgatctgttgtgctacaggcagtggggccacaatgagctggatgagccattctacaccaaccccatcatgtacaaaatcatcagagctcgaaagagcattccagacacatatgcagagcacctcattgctggcggactcatgacgcaggaggaggtgtctgaaataaaatcctcctactatgccaagttgaatgatcacttaaataacatggcccactacaggccccctgccctgaacctgcaggcccactggcagggcctggctcagccagaagcgcaaatcaccacctggagtacaggtgtgcccctcgacctcctgcggtttgttggcatgaagtctgtagaggtgccaagagagctgcagatgcacagtcacctgctgaagacacatgttcagtccagaatggagaagatgatggacggaatcaagctagactgggccaccgcggaagctcttgccttgggttctttacttgctcaaggttttaatgttcgtctaagtggccaagatgttggtcgtggaactttcagtcagaggcatgcaatggtggtttgccaggagacggatgacacctacatccccctgaaccatatggacccaaatcagaaggggtttctagaggtcagcaacagccccctgtcagaagaggccgtcctgggattcgaatatgggatgagcattgagagcccaaagttactgcccctgtgggaggcacagtttggcgatttcttcaatggtgcccagatcatctttgacacattcatctctggagagaggccaagtggctcctacaaagcggctgtgcagacattcaattgttattaaaaaaaacaaacagcaatcacaccacagacagaaaaccaaccaacaaaggg

SEQ ID NO: 42420 - DNA, 1794 bp, Homo sapiens
  misc_feature (2)..(2): n is a, c, g, or t
  misc_feature (24)..(24): n is a, c, g, or t
anggctaggtacgaggctggtgtnaatcggccgaggcagggccggtgggatcccctcgggctcccgccttagcatgctggccgggacatctggtgaacatggcctctgctactgcggcagcagcacgacggggcctcggccgggctctccctctcctctggcgtggctaccagaccgagcggggcgtttacggctaccggccgaggaagcccgagagccgcgagccccagggcgccctggagcgccccccagttgatcatggccttgccaggttggtgacagtatattgtgagcatggtcataaagctgccaaaatcaaccccctcttcaccggacaagccctgctggagaatgtgcctgaaatccaagccctggtgcagacactgcagggacccttccacacggcaggattattgaacatggggaaggaagaggcctcacttgaggaagtgttagtctatctcaatcaaatctactgtgggcagatttctattgaaacctcccaacttcagagccaggatgagaaagactggtttgccaagcggtttgaggaactgcaaaaggagacgtttaccacagaagagcgaaaacatctgtcgaaactaatgctggaatctcaggagtttgaccactttctggccaccaagttctcgacagtgaagcgatatggaggcgaaggggctgaaagcatgatgggctttttccacgagctgctgaaaatgtcggcctacagcgggatcactgatgtcattattgggatgccccatagagggaggctgaatttattgacaggccttctgcagttccctccagagctgatgttccgtaaaatgcgaggcttaagtgaatttccagagaatttctcagccactggagacgtcctgtctcacctgacctcctctgtggacctgtactttggggcgcaccatcccctccatgtgacaatgttgcccaatccctcgcacctggaggccgtcaaccccgtggccgtgggcaaaactcgcggcaggcagcagtctcgccaagacggcgattactctccagacaactcagcccagccgggggacagggtcatttgcttacaggtacttggagcttctgaaattgaggccagaggtggggaaaactgggaagaatgtgtgggttgggagggctgaaagcacatggcagacattcatgatgaaactgagatgaccttttggaaaaagattctgggattgttttaaaaactaacaggagattcatgaggtttagtcttcaggcaactggctttagcctggggcttccacttctgttttccttgcatggcttatgaattaacttggggtttgggctggcaaacctgctccttcttagagcacagatgtcattatctctctggaagtatggccttcttggaaactttgtggttcccatacatataacaagacaagcgtgaaaaaaaaaaagactttaagtgtggttttacttcgtttcttgtttactttattatcttttcttttttatggctttttttttgagaccgagtctcactctgtcactcaggctggagtgcagtggcgaaatctcagctcactgcaacctctgcctcctgggttcaagtgattctcctgcctcagcctcccgagtagctgggactacaggcacgtgccaccacgcccagctaatttttgtatttttagtagagacagggtttcaccatgttggccagcctggtctcaaactcctgacctcaagtgatcctcccacctcagcctcccaaagtgctgagattacaggcatgagccactatac

SEQ ID NO: 42421 - DNA, 837 bp, Homo sapiens
  misc_feature (650)..(650): n is a, c, g, or t
agcggagtctgcgcggggttgggcggagcctgcgcggggccggtaggatcgcgtcgggagccggtaccgaggcccgagccgcgggagtcgagcgaagacagcgccgaggccgggtttccccctgggcctccccagcagcagccatgggcatcaaatttttagaagttatcaaaccattctgtgcagttctaccagaaattcagaaaccggaaaggaaaatccagtttagagagaaggttctgtggactgctataacgctcttcattttcttagtgtgttgtcagatcccactgtttggaatcatgtcatcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaactgtttggtatgatcattaccattgggcaagccattgtgtatgtcatgacggggatgtatggggaccctgcagaaatgggtgccggaatctgtctcctgatcatcattcagttgttgtgctggtttgattgtgctgctgttagatgagctgctacngaagggttacggcttggggtctgggatttccctctttattgccaccaaacatctgtgagaaccatgtctggaagggcttaagtcccactaccattaacactggcagagggtactgagtttgaaggtgcagttcatagcttctgtccattgtgggccacaggaaggacaagtcgagcttacgggaagc

SEQ ID NO: 42422 - DNA, 5177 bp, Homo sapiens
  misc_feature (2)..(2): n is a, c, g, or t
  misc_feature (24)..(24): n is a, c, g, or t
anggctaggtacgaggctggtgtnaatcggccgaggcagggccggtgggatcccctcgggctcccgccttagcatgctggccgggacatctggtgaacatggcctctgctactgcggcagcagcacgacggggcctcggccgggctctccctctcctctggcgtggctaccagaccgagcggggcgtttacggctaccggccgaggaagcccgagagccgcgagccccagggcgccctggagcgccccccagttgatcatggccttgccaggttggtgacagtatattgtgagcatggtcataaagctgccaaaatcaaccccctcttcaccggacaagccctgctggagaatgtgcctgaaatccaagccctggtgcagacactgcagggacccttccacacggcaggattattgaacatggggaaggaagaggcctcacttgaggaagtgttagtctatctcaatcaaatctactgtgggcagatttctattgaaacctcccaacttcagagccaggatgagaaagactggtttgccaagcggtttgaggaactgcaaaaggagacgtttaccacagaagagcgaaaacatctgtcgaaactaatgctggaatctcaggagtttgaccactttctggccaccaagttctcgacagtgaagcgatatggaggcgaaggggctgaaagcatgatgggctttttccacgagctgctgaaaatgtcggcctacagcgggatcactgatgtcattattgggatgccccatagagggaggctgaatttattgacaggccttctgcagttccctccagagctgatgttccgtaaaatgcgaggcttaagtgaatttccagagaatttctcagccactggagacgtcctgtctcacctgacctcctctgtggacctgtactttggggcgcaccatcccctccatgtgacaatgttgcccaatccctcgcacctggaggccgtcaaccccgtggccgtgggcaaaactcgcggcaggcagcagtctcgccaagacggcgattactctccagacaactcagcccagccgggggacagggtcatttgcttacaggtccatggtgatgcttctttctgtggtcaagggattgttcctgaaacattcacgctgtccaatctcccacatttcagaattggtgggagtgtgcatttgattgttaataaccagctgggttacaccactccagctgaaagaggaaggtcttctttatactgcagtgatattgggaagcttgtgggctgtgccatcatccatgtcaatggagacagcccagaggaagtggtccgtgccacacgactggcttttgaataccaacgccagttccgcaaggatgtgattattgatctgttgtgctacaggcagtggggccacaatgagctggatgagccattctacaccaaccccatcatgtacaaaatcatcagagctcgaaagagcattccagacacatatgcagagcacctcattgctggcggactcatgacgcaggaggaggtgtctgaaataaaatcctcctactatgccaagttgaatgatcacttaaataacatggcccactacaggccccctgccctgaacctgcaggcccactggcagggcctggctcagccagaagcgcaaatcaccacctggagtacaggtgtgcccctcgacctcctgcggtttgttggcatgaagtctgtagaggtgccaagagagctgcagatgcacagtcacctgctgaagacacatgttcagtccagaatggagaagatgatggacggaatcaagctagactgggccaccgcggaagctcttgccttgggttctttacttgctcaaggttttaatgttcgtctaagtggccaagatgttggtcgtggaactttcagtcagaggcatgcaatggtggtttgccaggagacggatgacacctacatccccctgaaccatatggacccaaatcagaaggggtttctagaggtcagcaacagccccctgtcagaagaggccgtcctgggattcgaatatgggatgagcattgagagcccaaagttactgcccctgtgggaggcacagtttggcgatttcttcaatggtgcccagatcatctttgacacattcatctctggaggagaggccaagtggctcctacaaagcggcattgtcatcctccttccacatggctacgatggggctgggccagaccactcatcctgtcgaatagagcgtttcctgcagatgtgtgacagtgcggaagagggggtggacggagacactgtgaacatgtttgtggttcacccaacaactcctgcacagtatttccacttgcttaggagacagatggtccggaacttcagaaaaccactcattgttgcttcccctaagatgttactcaggctcccggcagccgtgtcaactcttcaagaaatggcaccaggaacaacatttaacccggtcattggtgattcatctgtggatccaaaaaaggttaagaccctcgtgttctgctccggcaaacatttctactccctggtgaaacaaagagaatctctgggggccaagaagcatgactttgccatcatccgagtagaggaactctgccccttcccgttggattctttacagcaagagatgagcaaatacaaacatgttaaagatcatatttggagtcaggaggaacctcagaacatgggtccgtggtcgtttgtttctccaaggtttgaaaagcagctggcctgcaagctccgtctggtgggccggccccctttgccagtacccgctgtaggaattggcacagttcacttgcaccagcatgaagatatcctcgccaagaccttcgcttgatgatgacttttgaagaaacactatttctctttaagaaaatggccattaaggccgggtggggtggcacatgcctgtaatcccagcactttgggaggccaaggctggtggatcacctgaggtcaggagttcgagaccagcctggccaacacggtgaaaccccgcctctactaaaaatacaaaaaatagccgggtgtggtggtgggcacctgtgatcccagcttcctgggaggctgaggcaagagaatcgcttgaatctgggaggcggaggttgcagtgagccaggatcacaccattgctgtccagcctgggtgacagagcaagactgcgtttcaaaaaaaaaaaaaaaaaaacccattaaaagaggcctccttcctccactctctcaacccctctgttgggtaacatgaaaagactgtattcctctaagatgttgggattgatatacgtgatttaatctgcaataggtggaataaccaggggaactggttatgaatatgtgaatgcaaccagcaaatttatccttgaaggtgtgatggtagaaataggaaaacaacaaaagaaaaacaataacaaaaaaagaaagtgtgatggctgggtgcagtggctcacgcctgtaatcccagcactttgggaggcttaggcggctggatcacctgaggtcaggagttcaagaccagcctggtcaacgtggtgaaacgccgtttctactaaaaatatgaaaattagttgggtgtggtggcatgcgcttgtagtctcagctactccggaggctgaggcaggagaattgcttgaacctggaaggcagaggttgcagtgagccgaaatggcgccactgtactccaacctgggcgacagagcaagactccatctcataaattaaaaggaaagtatgatagtgttatggattttagctctgagtgagctggaaaactaggtcattatctagatgatttcagacttgaccctaattgaccatatatgaccaggaaacacttctgagtttacagctccgtggagatgacctcaacactgcctcttgatttgtttgatgcatgtcactttcattaattttccccctcctttttgaaagtcctgtggcagtactaatattttcattttatgtaatctctggtgctgctttccagtcactgtatgaagtgttatccccaacactagcaaatctaggtcctactaaatacaaatctctgggtggatgatcttctagtactgtatttttaaattaaggagttttagttataatgaaattgatttgtagtctgttttgccgtaaacttgtttttctttaaattgttcttacagtgatatcttactatttttaactgtctggggtttctgatatggggatttcagcccctggttaatcagtcttgtccctacaagtccctgatgcagtatgtttatttgtgatgtttaaagaacatttcttggctgggcgctgcggcttgcgcctgtaatctcagcactttgggaggctgaggtgggtggatcacctgaggttgggagttcgagaccagcctgacaaaacatagtgaaaccccgtctctactaaaaatacaaaaattagctgggcgtggtggtgggtgtctgtaatcccagctattcgggaggctgaggcaggagaatcgcttgaacccaggaggtggaggttgcagtgagctgagatcctgccactgcactccagtctgggtgacagagcaagactccatctcaaaaaataaataaatagaaagagagagagaggaaaaaaaaaagaaaagaacacttctttatttgagggactttcccaacaccaggtgcttggggatttcttagagatcaccaaccgactccctcactgtgaaattaaaccaagtactggaaacgtaactaaacagcgaaccatgtagcttcacctgactcagtgctgggggcctctaccatctactgtgcttgtgtcatgatgctttttctctgaagtggtgtgggaagtaccaggggactggcagaagcccaggccctctctacttttaccagcaactgatcatgtctttcagaatccatgtacatatacctcagtgtatccttcctgtgtcaagccttataaatcatgtaatttagtgccactcatgtaaatcagtaaaatcacaaaggtctatttaatgaaaacgatttaccaatgttgtttttttttaacaagaaaaaaaataaaagcacattgtcattttttttcctcagaaactcctggacttcttgaattaaaagatttcaaaagtctaagcacaaaaatgagatggaagattagatctttgtaaaaggtta

SEQ ID NO: 42423 - DNA, 4227 bp, Homo sapiens
  misc_feature (2)..(2): n is a, c, g, or t
  misc_feature (24)..(24): n is a, c, g, or t
anggctaggtacgaggctggtgtnaatcggccgaggcagggccggtgggatcccctcgggctcccgccttagcatgctggccgggacatctggtgaacatggcctctgctactgcggcagcagcacgacggggcctcggccgggctctccctctcctctggcgtggctaccagaccgagcggggcgtttacggctaccggccgaggaagcccgagagccgcgagccccagggcgccctggagcgccccccagttgatcatggccttgccaggttggtgacagtatattgtgagcatggtcataaagctgccaaaatcaaccccctcttcaccggacaagccctgctggagaatgtgcctgaaatccaagccctggtgcagacactgcagggacccttccacacggcaggattattgaacatggggaaggaagaggcctcacttgaggaagtgttagtctatctcaatcaaatctactgtgggcagatttctattgaaacctcccaacttcagagccaggatgagaaagactggtttgccaagcggtttgaggaactgcaaaaggagacgtttaccacagaagagcgaaaacatctgtcgaaactaatgctggaatctcaggagtttgaccactttctggccaccaagttctcgacagtgaagcgatatggaggcgaaggggctgaaagcatgatgggctttttccacgagctgctgaaaatgtcggcctacagcgggatcactgatgtcattattgggatgccccatagagggaggctgaatttattgacaggccttctgcagttccctccagagctgatgttccgtaaaatgcgaggcttaagtgaatttccagagaatttctcagccactggagacgtcctgtctcacctgacctcctctgtggacctgtactttggggcgcaccatcccctccatgtgacaatgttgcccaatccctcgcacctggaggccgtcaaccccgtggccgtgggcaaaactcgcggcaggcagcagtctcgccaagacggcgattactctccagacaactcagcccagccgggggacagggtcatttgcttacaggtccatggtgatgcttctttctgtggtcaagggattgttcctgaaacattcacgctgtccaatctcccacatttcagaattggtgggagtgtgcatttgattgttaataaccagctgggttacaccactccagctgaaagaggaaggtcttctttatactgcagtgatattgggaagcttgtgggctgtgccatcatccatgtcaatggagacagcccagaggaagtggtccgtgccacacgactggcttttgaataccaacgccagttccgcaaggatgtgattattgatctgttgtgctacaggcagtggggccacaatgagctggatgagccattctacaccaaccccatcatgtacaaaatcatcagagctcgaaagagcattccagacacatatgcagagcacctcattgctggcggactcatgacgcaggaggaggtgtctgaaataaaatcctcctactatgccaagttgaatgatcacttaaataacatggcccactacaggccccctgccctgaacctgcaggcccactggcagggcctggctcagccagaagcgcaaatcaccacctggagtacaggtgtgcccctcgacctcctgcggtttgttggcatgaagtctgtagaggtgccaagagagctgcagatgcacagtcacctgctgaagacacatgttcagtccagaatggagaagatgatggacggaatcaagctagactgggccaccgcggaagctcttgccttgggttctttacttgctcaaggttttaatgttcgtctaagtggccaagatgttggtcgtggaactttcagtcagaggcatgcaatggtggtttgccaggagacggatgacacctacatccccctgaaccatatggacccaaatcagaaggggtttctagaggtcagcaacagccccctgtcagaagaggccgtcctgggattcgaatatgggatgagcattgagagcccaaagttactgcccctgtgggaggcacagtttggcgatttcttcaatggtgcccagatcatctttgacacattcatctctggaggagaggccaagtggctcctacaaagcggcattgtcatcctccttccacatggctacgatggggctgggccagaccactcatcctgtcgaatagagcgtttcctgcagatgtgtgacagtgcggaagagggggtggacggagacactgtgaacatgtttgtggttcacccaacaactcctgcacagtatttccacttgcttaggagacagatggtccggaacttcagaaaaccactcattgttgcttcccctaagatgttactcaggctcccggcagccgtgtcaactcttcaagaaatggcaccaggaacaacatttaacccggtcattggtgattcatctgtggatccaaaaaaggttaagaccctcgtgttctgctccggcaaacatttctactccctggtgaaacaaagagaatctctgggggccaagaagcatgactttgccatcatccgagtagaggaactctgccccttcccgttggattctttacagcaagagatgagcaaatacaaacatgttaaagatcatatttggagtcaggaggaacctcagaacatgggtccgtggtcgtttgtttctccaaggtttgaaaagcagctggcctgcaagctccgtctggtgggccggccccctttgccagtacccgctgtaggaattggcacagttcacttgcaccagcatgaagatatcctcgccaagaccttcgcttgatgatgacttttgaagaaacactatttctctttaagaaaatggccattaaggccgggtggggtggcacatgcctgtaatcccagcactttgggaggccaaggctggtggatcacctgaggtcaggagttcgagaccagcctggccaacacggtgaaaccccgcctctactaaaaatacaaaaaatagccgggtgtggtggtgggcacctgtgatcccagcttcctgggaggctgaggcaagagaatcgcttgaatctgggaggcggaggttgcagtgagccaggatcacaccattgctgtccagcctgggtgacagagcaagactgcgtttcaaaaaaaaaaaaaaaaaaacccattaaaagaggcctccttcctccactctctcaacccctctgttgggtaacatgaaaagactgtattcctctaagatgttgggattgatatacgtgatttaatctgcaataggtggaataaccaggggaactggttatgaatatgtgaatgcaaccagcaaatttatccttgaaggtgtgatggtagaaataggaaaacaacaaaagaaaaacaataacaaaaaaagaaagtgtgatggctgggtgcagtggctcacgcctgtaatcccagcactttgggaggcttaggcggctggatcacctgaggtcaggagttcaagaccagcctggtcaacgtggtgaaacgccgtttctactaaaaatatgaaaattagttgggtgtggtggcatgcgcttgtagtctcagctactccggaggctgaggcaggagaattgcttgaacctggaaggcagaggttgcagtgagccgaaatggcgccactgtactccaacctgggcgacagagcaagactccatctcataaattaaaaggaaagtatgatagtgttatggattttagctctgagtgagctggaaaactaggtcattatctagatgatttcagacttgaccctaattgaccatatatgaccaggaaacacttctgagtttacagctccgtggagatgacctcaacactgcctcttgatttgtttgatgcatgtcactttcattaattttccccctcctttttgaaagtcctgtggcagtactaatattttcattttatgtaatctctggtgctgctttccagtcactgtatgaagtgttatccccaacactagcaaatctaggtcctactaaatacaaatctctgggtggatgatcttctagtactgtatttttaaattaaggagttttagttataatgaaattgatttgtagtctgttttgccgtaaacttgtttttctttaaattgttcttacagtgatatcttactatttttaactgtcctcaagaaagcacgggatcctctg

SEQ ID NO: 42424 - DNA, 5131 bp, Homo sapiens
  misc_feature (2)..(2): n is a, c, g, or t
  misc_feature (24)..(24): n is a, c, g, or t
anggctaggtacgaggctggtgtnaatcggccgaggcagggccggtgggatcccctcgggctcccgccttagcatgctggccgggacatctggtgaacatggcctctgctactgcggcagcagcacgacggggcctcggccgggctctccctctcctctggcgtggctaccagaccgagcggggcgtttacggctaccggccgaggaagcccgagagccgcgagccccagggcgccctggagcgccccccagttgatcatggccttgccaggttggtgacagtatattgtgagcatggtcataaagctgccaaaatcaaccccctcttcaccggacaagccctgctggagaatgtgcctgaaatccaagccctggtgcagacactgcagggacccttccacacggcaggattattgaacatggggaaggaagaggcctcacttgaggaagtgttagtctatctcaatcaaatctactgtgggcagatttctattgaaacctcccaacttcagagccaggatgagaaagactggtttgccaagcggtttgaggaactgcaaaaggagacgtttaccacagaagagcgaaaacatctgtcgaaactaatgctggaatctcaggagtttgaccactttctggccaccaagttctcgacagtgaagcgatatggaggcgaaggggctgaaagcatgatgggctttttccacgagctgctgaaaatgtcggcctacagcgggatcactgatgtcattattgggatgccccatagagggaggctgaatttattgacaggccttctgcagttccctccagagctgatgttccgtaaaatgcgaggcttaagtgaatttccagagaatttctcagccactggagacgtcctgtctcacctgacctcctctgtggacctgtactttggggcgcaccatcccctccatgtgacaatgttgcccaatccctcgcacctggaggccgtcaaccccgtggccgtgggcaaaactcgcggcaggcagcagtctcgccaagacggcgattactctccagacaactcagcccagccgggggacagggtcatttgcttacaggtccatggtgatgcttctttctgtggtcaagggattgttcctgaaacattcacgctgtccaatctcccacatttcagaattggtgggagtgtgcatttgattgttaataaccagctgggttacaccactccagctgaaagaggaaggtcttctttatactgcagtgatattgggaagcttgtgggctgtgccatcatccatgtcaatggagacagcccagaggaagtggtccgtgccacacgactggcttttgaataccaacgccagttccgcaaggatgtgattattgatctgttgtgctacaggcagtggggccacaatgagctggatgagccattctacaccaaccccatcatgtacaaaatcatcagagctcgaaagagcattccagacacatatgcagagcacctcattgctggcggactcatgacgcaggaggaggtgtctgaaataaaatcctcctactatgccaagttgaatgatcacttaaataacatggcccactacaggccccctgccctgaacctgcaggcccactggcagggcctggctcagccagaagcgcaaatcaccacctggagtacaggtgtgcccctcgacctcctgcggtttgttggcatgaagtctgtagaggtgccaagagagctgcagatgcacagtcacctgctgaagacacatgttcagtccagaatggagaagatgatggacggaatcaagctagactgggccaccgcggaagctcttgccttgggttctttacttgctcaaggttttaatgttcgtctaagtggccaagatgttggtcgtggaactttcagtcagaggcatgcaatggtggtttgccaggagacggatgacacctacatccccctgaaccatatggacccaaatcagaaggggtttctagaggagaggccaagtggctcctacaaagcggcattgtcatcctccttccacatggctacgatggggctgggccagaccactcatcctgtcgaatagagcgtttcctgcagatgtgtgacagtgcggaagagggggtggacggagacactgtgaacatgtttgtggttcacccaacaactcctgcacagtatttccacttgcttaggagacagatggtccggaacttcagaaaaccactcattgttgcttcccctaagatgttactcaggctcccggcagccgtgtcaactcttcaagaaatggcaccaggaacaacatttaacccggtcattggtgattcatctgtggatccaaaaaaggttaagaccctcgtgttctgctccggcaaacatttctactccctggtgaaacaaagagaatctctgggggccaagaagcatgactttgccatcatccgagtagaggaactctgccccttcccgttggattctttacagcaagagatgagcaaatacaaacatgttaaagatcatatttggagtcaggaggaacctcagaacatgggtccgtggtcgtttgtttctccaaggtttgaaaagcagctggcctgcaagctccgtctggtgggccggccccctttgccagtacccgctgtaggaattggcacagttcacttgcaccagcatgaagatatcctcgccaagaccttcgcttgatgatgacttttgaagaaacactatttctctttaagaaaatggccattaaggccgggtggggtggcacatgcctgtaatcccagcactttgggaggccaaggctggtggatcacctgaggtcaggagttcgagaccagcctggccaacacggtgaaaccccgcctctactaaaaatacaaaaaatagccgggtgtggtggtgggcacctgtgatcccagcttcctgggaggctgaggcaagagaatcgcttgaatctgggaggcggaggttgcagtgagccaggatcacaccattgctgtccagcctgggtgacagagcaagactgcgtttcaaaaaaaaaaaaaaaaaaacccattaaaagaggcctccttcctccactctctcaacccctctgttgggtaacatgaaaagactgtattcctctaagatgttgggattgatatacgtgatttaatctgcaataggtggaataaccaggggaactggttatgaatatgtgaatgcaaccagcaaatttatccttgaaggtgtgatggtagaaataggaaaacaacaaaagaaaaacaataacaaaaaaagaaagtgtgatggctgggtgcagtggctcacgcctgtaatcccagcactttgggaggcttaggcggctggatcacctgaggtcaggagttcaagaccagcctggtcaacgtggtgaaacgccgtttctactaaaaatatgaaaattagttgggtgtggtggcatgcgcttgtagtctcagctactccggaggctgaggcaggagaattgcttgaacctggaaggcagaggttgcagtgagccgaaatggcgccactgtactccaacctgggcgacagagcaagactccatctcataaattaaaaggaaagtatgatagtgttatggattttagctctgagtgagctggaaaactaggtcattatctagatgatttcagacttgaccctaattgaccatatatgaccaggaaacacttctgagtttacagctccgtggagatgacctcaacactgcctcttgatttgtttgatgcatgtcactttcattaattttccccctcctttttgaaagtcctgtggcagtactaatattttcattttatgtaatctctggtgctgctttccagtcactgtatgaagtgttatccccaacactagcaaatctaggtcctactaaatacaaatctctgggtggatgatcttctagtactgtatttttaaattaaggagttttagttataatgaaattgatttgtagtctgttttgccgtaaacttgtttttctttaaattgttcttacagtgatatcttactatttttaactgtctggggtttctgatatggggatttcagcccctggttaatcagtcttgtccctacaagtccctgatgcagtatgtttatttgtgatgtttaaagaacatttcttggctgggcgctgcggcttgcgcctgtaatctcagcactttgggaggctgaggtgggtggatcacctgaggttgggagttcgagaccagcctgacaaaacatagtgaaaccccgtctctactaaaaatacaaaaattagctgggcgtggtggtgggtgtctgtaatcccagctattcgggaggctgaggcaggagaatcgcttgaacccaggaggtggaggttgcagtgagctgagatcctgccactgcactccagtctgggtgacagagcaagactccatctcaaaaaataaataaatagaaagagagagagaggaaaaaaaaaagaaaagaacacttctttatttgagggactttcccaacaccaggtgcttggggatttcttagagatcaccaaccgactccctcactgtgaaattaaaccaagtactggaaacgtaactaaacagcgaaccatgtagcttcacctgactcagtgctgggggcctctaccatctactgtgcttgtgtcatgatgctttttctctgaagtggtgtgggaagtaccaggggactggcagaagcccaggccctctctacttttaccagcaactgatcatgtctttcagaatccatgtacatataggctgttctagccacagtggtagatttatgattcacatccgaaagtgtgccttagttatcaatttaacatttctctagtattcatatcccttttcttaccatatacctcagtgtatccttcctgtgtcaagccttataaatcatgtaatttagtgccactcatgtaaatcagtaaaatcacaaaggtctatttaatgaaaacgatttaccaatgttgtttttttttaacaagaaaaaaaataaaagcacattgtcattttttttcctcagaaactcctggacttcttgaattaaaagatttcaaaagtctaagcacaaaaatgagatggaagattagatctttgtaaaaggtta

SEQ ID NO: 42425 - DNA, 5337 bp, Homo sapiens
  misc_feature (2)..(2): n is a, c, g, or t
  misc_feature (24)..(24): n is a, c, g, or t
anggctaggtacgaggctggtgtnaatcggccgaggcagggccggtgggatcccctcgggctcccgccttagcatgctggccgggacatctggtgaacatggcctctgctactgcggcagcagcacgacggggcctcggccgggctctccctctcctctggcgtggctaccagaccgagcggggcgtttacggctaccggccgaggaagcccgagagccgcgagccccagggcgccctggagcgccccccagttgatcatggccttgccaggttggtgacagtatattgtgagcatggtcataaagctgccaaaatcaaccccctcttcaccggacaagccctgctggagaatgtgcctgaaatccaagccctggtgcagacactgcagggacccttccacacggcaggattattgaacatggggaaggaagaggcctcacttgaggaagtgttagtctatctcaatcaaatctactgtgggcagatttctattgaaacctcccaacttcagagccaggatgagaaagactggtttgccaagcggtttgaggaactgcaaaaggagacgtttaccacagaagagcgaaaacatctgtcgaaactaatgctggaatctcaggagtttgaccactttctggccaccaagttctcgacagtgaagcgatatggaggcgaaggggctgaaagcatgatgggctttttccacgagctgctgaaaatgtcggcctacagcgggatcactgatgtcattattgggatgccccatagagggaggctgaatttattgacaggccttctgcagttccctccagagctgatgttccgtaaaatgcgaggcttaagtgaatttccagagaatttctcagccactggagacgtcctgtctcacctgacctcctctgtggacctgtactttggggcgcaccatcccctccatgtgacaatgttgcccaatccctcgcacctggaggccgtcaaccccgtggccgtgggcaaaactcgcggcaggcagcagtctcgccaagacggcgattactctccagacaactcagcccagccgggggacagggtcatttgcttacaggtccatggtgatgcttctttctgtggtcaagggattgttcctgaaacattcacgctgtccaatctcccacatttcagaattggtgggagtgtgcatttgattgttaataaccagctgggttacaccactccagctgaaagaggaaggtcttctttatactgcagtgatattgggaagcttgtgggctgtgccatcatccatgtcaatggagacagcccagaggaagtggtccgtgccacacgactggcttttgaataccaacgccagttccgcaaggatgtgattattgatctgttgtgctacaggcagtggggccacaatgagctggatgagccattctacaccaaccccatcatgtacaaaatcatcagagctcgaaagagcattccagacacatatgcagagcacctcattgctggcggactcatgacgcaggaggaggtgtctgaaataaaatcctcctactatgccaagttgaatgatcacttaaataacatggcccactacaggccccctgccctgaacctgcaggcccactggcagggcctggctcagccagaagcgcaaatcaccacctggagtacaggtgtgcccctcgacctcctgcggtttgttggcatgaagtctgtagaggtgccaagagagctgcagatgcacagtcacctgctgaagacacatgttcagtccagaatggagaagatgatggacggaatcaagctagactgggccaccgcggaagctcttgccttgggttctttacttgctcaaggttttaatgttcgtctaagtggccaagatgttggtcgtggaactttcagtcagaggcatgcaatggtggtttgccaggagacggatgacacctacatccccctgaaccatatggacccaaatcagaaggggtttctagaggtcagcaacagccccctgtcagaagaggccgtcctgggattcgaatatgggatgagcattgagagcccaaagttactgcccctgtgggaggcacagtttggcgatttcttcaatggtgcccagatcatctttgacacattcatctctggaggagaggccaagtggctcctacaaagcggcattgtcatcctccttccacatggctacgatggggctgggccagaccactcatcctgtcgaatagagcgtttcctgcagatgtgtgacagtgcggaagagggggtggacggagacactgtgaacatgtttgtggttcacccaacaactcctgcacagtatttccacttgcttaggagacagatggtccggaacttcagaaaaccactcattgttgcttcccctaagatgttactcaggctcccggcagccgtgtcaactcttcaagaaatggcaccaggaacaacatttaacccggtcattggtgattcatctgtggatccaaaaaaggttaagaccctcgtgttctgctccggcaaacatttctactccctggtgaaacaaagagaatctctgggggccaagaagcatgactttgccatcatccgagtagaggaactctgccccttcccgttggattctttacagcaagagatgagcaaatacaaacatgttaaagatcatatttggagtcaggaggaacctcagaacatgggtccgtggtcgtttgtttctccaaggtttgaaaagcagctggcctgcaagtcaaatttttagaagttatcaaaccattctgtgcagttctaccagaaattcagaaaccggaaaggaaaatccagtttagagagaaggttctgtggactgctataacgctcttcattttcttagtgtgttgtcagatcccactgtttggaatcatgtcatcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaactgtttggtatgatcattaccattgggcaagccattgtgtatgtcatgacggggatgtatggggaccctgcagaaatgggtgccggaatctgtctcctgatcatcattcaggtaagaaatcctatattttcctatgcagataacaaaacagtttgattcctttttccttttctaacagttctttaggtgattggcttattcattttcttacttttgaattatttaattctagtattttgatcactgaagtgatacgtgtaaaatttttttaaaaccttctgtcaccgtgacgtgttcaagttgtgttgacgtgaaaaattcaaatttattctaatagcttcataactgcacaatacaaagaattatggatcaattgtattttattgattcttaagatacacatttgtcacattttgatgtctctagaatcaggatgtttttgtacagtaaacagtgccttccacttgcggtctgccaggaggcagtcatggtggtgtcactgcctgtgcgtgtgtcagcctgttcaggtcatgctgaccttagttggctgagtgtgatcttcacagaatgggtgtttgagttcaatcgctgtctaaaggtgttcagaaaatctgttgtgatttgttattgaaatgaaagtttatgtatagaagggcaagctagatgataaatatctaccactaggtctaaaatacgtttttgtaagtagaaaattaaaattctttgcaataaggtattgtgccataagttaattggcagtattcttttcttagtagtacacaaaataatgatgttttacatggtaatgtcttagagtcagtgaaacactgtttatacacacataaatatattccatgggttttttaaatggatgcttaggaatggaatttttaaaggtcaacataattattagtgtcctaagtatctttttttttttttttttgagacggagtctcactctgtactccagcctgcgtgacagagcgagactccgtctcagaaaaaaaaaaaaagaacataatatgtgtattgtgtctcatgtacactgttgaagaggtagcagcccatgattgatgaaatagtccagtgatcttatgagatacaagtttgttttcatgttctctctctgacattgtctatgcttagttattgtgttcatgcttattccttcatggtccaagttggctgtcccacctccaggcatcaaaccacattccaaacagcaaccaggaggaaatagtaagctgataggtcatggggaattaggttggaagccattgctttttaatttacagaagtccattctccccaggcacttctttctaagtctcattgatcagaactcaaccacgtggccaccatcagcagaaacatctctctgtagcaccgtgaaacacatgagaacataactggggatgaccgttgttacttgaactattttgaaagatctgacataaaggtcatcgccttgtgcacttcaatgggtgttactgcaaaactcccagggctaggcatggcgacatacacccgaaatctcagctatctgggaggctgaggtgggaggattgcttgagcccacgagtttgaggctgaagtgtgcctgtgaatagctactgcactccagtgcctaggacacatagggagacctcacttttttatggctgcatagtattccatggtaaagaaatgtaccacattttctttatccacttcactgttgatgggcatttatccacttcactgttggtgggaatttaggttgaatccatgtctttgctattgaagtcacactttttaatcaagttatttaactttcctgtgttcatttgtgttatataccagaacatttttatttctatggttttaatgccacctaatatgattatcaatgtgtcattctccataaatcattgtgttatacatgttaaacgattaggtattaagtgtataggtataaatcacttagaataatgactaacacattgtatgaactaaataagtactgattcatctgattcatcaaatttccattattcataccattcattatttattaagtggtgtagtatttgttcttatcaacatttgcttttctgtcctatctaaatattaatgaaacagtggatgtgggctcagtgtgctgtcttgaaataatccaaagtcaaatggcatgcttcactggtttcctttagatgcaataactcatttgactcacacaataaaaatgagtattaagt

SEQ ID NO: 42426 - DNA, 1453 bp, Homo sapiens
  misc_feature (95)..(95): n is a, c, g, or t
  misc_feature (108)..(108): n is a, c, g, or t
aacagtccctctacccatgtgccctctagagccctaccatcaaaacccgagaagaagaggggacgacactgaaggattggagactgggctggatncatgtaatggggncagcgctgctgggcccagacagactgtggtggcctgcgcagcgagcaggcgtgtgcgtgtgttggggataaatacgtgatgttatccccaacactagcaaatctaggtcctactaaatacaaatctctgggtggatgatcttctagtactgtatttttaaattaaggagttttagttataatgaaattgatttgtagtctgttttgccgtaaacttgtttttctttaaattgttcttacagtgatatcttactatttttaactgtctggggtttctgatatggggatttcagcccctggttaatcagtcttgtccctacaagtccctgatgcagtatgtttatttgtgatgtttaaagaacatttcttggctgggcgctgcggcttgcgcctgtaatctcagcactttgggaggctgaggtgggtggatcacctgaggttgggagttcgagaccagcctgacaaaacatagtgaaaccccgtctctactaaaaatacaaaaattagctgggcgtggtggtgggtgtctgtaatcccagctattcgggaggctgaggcaggagaatcgcttgaacccaggaggtggaggttgcagtgagctgagatcctgccactgcactccagtctgggtgacagagcaagactccatctcaaaaaataaataaatagaaagagagagagaggaaaaaaaaaagaaaagaacacttctttatttgagggactttcccaacaccaggtgcttggggatttcttagagatcaccaaccgactccctcactgtgaaattaaaccaagtactggaaacgtaactaaacagcgaaccatgtagcttcacctgactcagtgctgggggcctctaccatctactgtgcttgtgtcatgatgctttttctctgaagtggtgtgggaagtaccaggggactggcagaagcccaggccctctctacttttaccagcaactgatcatgtctttcagaatccatgtacatataggctgttctagccacagtggtagatttatgattcacatccgaaagtgtgccttagttatcaatttaacatttctctagtattcatatcccttttcttaccatatacctcagtgtatccttcctgtgtcaagccttataaatcatgtaatttagtgccactcatgtaaatcagtaaaatcacaaaggtctatttaatgaaaacgatttaccaatgttgtttttttttaacaagaaaaaaaataaaagcacattgtcattttttttcctcagaaactcctggacttcttgaattaaaagatttcaaaagtctaagcacaaaaatgagatggaagattagatctttgtaaaaggtta

SEQ ID NO: 42427 - DNA, 213 bp, Homo sapiens
ccggacaagccctgctggagaatgtgcctgaaatccaagccctggtgcagacactgcagggacccttccacacggcaggtatggcttctgcacagcaggcgggagctcggagctgcacaccaggccaggctcctgcctctgttcttgaagaagcagcatccccactggagctgaggctcccgcaggtgtgaggagacccgaggggcatgttga

SEQ ID NO: 42428 - DNA, 371 bp, Homo sapiens
actgtggagtgatggtgagggtatatattagagttctccagagaaacacaaccaataggatgtttatctatatacctatatatagatgtgtatataggatgtttatttatctatagagagaaaaaaaaaggagattgattgattctaaggaattggctcatgtgattgtgggctggcagaatcggaatctgtagggcagcctgacaggctggagacttcaaagaagagttggtatttcaagtcaaaatgcagtttggagacagaataccttttttgtgtgagatctaagtcttttggtcttcaactattcggatgaagcccacgtacattatggaaggtgctcctctttactcaaagtttaccgatttaag

SEQ ID NO: 42429 - DNA, 446 bp, Homo sapiens
ccttctcaagacaaattaactcacatccatcccacccaaacctggctgccctgggcctctggacagaccagaagacattcatcatttaaaggaatttaagtgtgaaacctaacctaccaatgaaccgctagttcagaaggtaaaagaattcatttctggccaggcgcggtggtcacgcctgtgatcccagcactctgggaggctgagtcaggtggatcacttgaggtcaggagtttgagagcagcctgaccaacatggtgaaaccccgtctctactaacaacaaaaaaaattagccggcgtgggggtgcacacctgtagtcccagctactcaagggactgaggcaccagagtcacttgaacccgggatgcagaggttgcagcgagccgagattgtgccactgcactcctgcctggtgacagagtgaaactgtgtctcaaaaaaaaa

SEQ ID NO: 42430 - DNA, 120 bp, Homo sapiens
tgcccccaccctccccttcaggctgggctgcacagagggatgaactgaatgggtcacattcttacccctcaagtgctttggagagagggtagaaggaaggaggagacaaaccagttatca

SEQ ID NO: 42431 - DNA, 421 bp, Homo sapiens
gtctcactctgttgcccaggctggtctataactcctggccccaaatgatcctcccatctcagcctctcaaagctctgggattgcaggtgtgaatcatctcacctagccagcaagtgatacagctgaaagaaaacaatttgactctataaagcactgagatgtttttgacttgaaacaagcaccaaagtctcagtcgtttatccagaatcacagcctccctgagatgaaaggagcctaagagatcatcaagtcagtgtgacatgatttgcaaggataccagatgatcaactcaaggctccaaaaagttgagacagaacttgaatgatggtctcctggcttgtaatcttctacacaacgtgccatcaaatggatcatttgggggtgatatattcacaagaatttggccaagttggcaaatact

SEQ ID NO: 42432 - DNA, 483 bp, Homo sapiens
atacattctggaaattgctcaagaggcagctttggcattagaatagcaactttcaaagcagtgaacgtcagcacttctatttctccttctttttggcgtgcattacatgaagctggaaggactaattggctaaatgaagggactcagtgtcgcagagttgaaatcctggcatgtaaatggagaggtggggagagactttgcatgcatatctatatggcctccctttgtgaattatcataatagaaatggttctgccccttctctagtttccctgcgagatgagttggggtgtgaagtgcatggcacagaaattcaccatgctttgtatctatgattacttgtgtctgtgtgcatcttttccactcctaaattgcatgtttacccaaagttgctgaataatacattgtttcaaaagatgtgtccctgaattaaggttgttatgtgacaattataatatgaccgtgtacagctgctaacaactgt

SEQ ID NO: 42433 - DNA, 493 bp, Homo sapiens
tcatgctattccccattaacatctggatcttcgagttggaaaggaatgtatccatccccataggctggagctatttcattggttggctggtgcttatcctatacttcacctgcgcgatcctttgctacttcaaccataaaagtttctggagtctgattctgagccaccccagtggtgccgtgtcctgcagcagcagtttcggctcagtagaagaatctccaagggcacagacgatcacagacacccccatcacccaggagggagtcctggatcctgagcagaaggatacacatgtgtaatcttttctgaactcctggcaccaagttctgtccattcatctgaccccatctcctcatcctcccccagcccttgaataggttggtcctcatcattgcaaggaatgagaaagggaggattttgcactcctctgctttctccctgccttgattgagcttgagtgatgtggaataaattgtccgtctcttcaaaaaca

SEQ ID NO: 42434 - DNA, 467 bp, Homo sapiens
gggtcttatcttccctttggtctcaccctacttgtcacttaacctcccagtcacaactttcctctcccctgtccctgtcctttcccagcgatcctttgctacttcaaccataaaagtttctggagtctgattctgagccaccccagtggtgccgtgtcctgcagcagcagtttcggctcagtagaagaatctccaagggcacagacgatcacagacacccccatcacccaggagggagtcctggatcctgagcagaaggatacacatgtgtaatcttttctgaactcctggcaccaagttctgtccattcatctgaccccatctcctcatcctcccccagcccttgaataggttggtcctcatcattgcaaggaatgagaaagggaggattttgcactcctctgctttctccctgccttgattgagcttgagtgatgtggaataaattgtccgtctcttcaaaaaca

SEQ ID NO: 42435 - DNA, 657 bp, Homo sapiens
tgatagatgtaaaatattattgtaacttatttggataaagttcttcaaaagaaacagagctatacaatgaggtaggatctggattatttgtctaagtgagagattgcgaatatcaaaatatctgtctcacttcttctgtgaatgacacagagtagaaataaattcactttaaaaatatgactgaattttgaaaatcaagactgaatctcacatagctgcagacaggaactaagccagcctctttgtatgtggtaacaagtacagtataagaatgaaagatttaccatccttgaaagctctaatgaaaatcaaatccagcaatatatattcaactgtgtacaggatttaagaaacttattttatgaaggaagtaatagtgtgtagatatagattctgaagtctttaaacgtgtcttaataaattaagattcactggcattgagctgagctaccaggtgacccttggggacaaaaaacccacacaagtgaatttcacacaccagtataccttcaacaatatacttttgacacacacaaacctttgatttggtttcagagattttgcaaaatagtaccaatgtaatttacaactgtcatctttgaaattgtgtaaaagtggaataattttctgaagaaataaatcatggtttgtcaatga

SEQ ID NO: 42436 - DNA, 327 bp, Homo sapiens
agacggagtcctgctctgtcgcccaggctggagtgcagtggcgcgatctcggcttgctgcacgctccgcctcccgggttcatgccattctcctgcctcagcctcccgagtagctgggactacaggtgcccgccgccacgcccggctaattttttgtatttttagtacagacggggtttcaccgtgttagtcaggacagtctcgatctcccgagctcgtgatccacccgcctcggcctcccaaagtgctgggattacaggcatgagccactgcgcccggccagctccaggtaatttttaatgagtagaggcgggatgtctgaggggct

SEQ ID NO: 42437 - DNA, 571 bp, Homo sapiens
aaatactcaaaaatgtgtggctgtcctcactatccatggtgatcttgaaagagagggaaaaaatgtataatacaaatgtatacatatacacacataaatatatacacacatatggatatacgtacacacatatatgtggtatgtgtattagacatatacatgtattatttatatatgtgttagatatcctacatgcctttgtgcctaaaatatatatttatttctatatatcaattatatctataataccaaagaaatggtgaatttttcagtgttattaacctggcatccagatcatgtcccttcaaggaggtctatctcaggagaaagtcaccattgtagtctggcagacaatgaacagtgcttccttgggaggccagtgggtgagctgggcaagggacaatggccgtcaggggactatcagtgctctctggtgctgggcagacagtctattgttagtgacccaagaagagtccctctgactcctgccaaagttgacagcaattggaaagacttcacccttaaagaggatatccactaatctggtccctgcttgcagctagctttaaaa

SEQ ID NO: 42438 - DNA, 1153 bp, Homo sapiens
gacttggggccggccgcgggcaggcgggcatctggcggccgaggccgggacttcggggcccctcccgggcgagtcgcggggcggcggcgggaaggggcgccgcacggaggaagtgccctcttggccgcagccagagccgcgccgcaggtgccgcgatgtcgtcctggccggggcgcgaggatgcgagggctgggggcgcgtggtggccgcgggagccgctggatcaggaactgcagcgggcccgggagcagaagcggcggcggcacgacgcccagcagctgcagcagctcaagcgcctggagtccttttatgaaaaacctcctcctgggcttatcaaggttggcattgcaaatggtacggtcaccgaacaggctacaaagaatgccctttctttatcaaagacaaccaaaagttacaacagttcagagtagcacatgaggatttcatgtatgacatcatacgagacaataaacaacatgaaaagaatgtaaggatacagcagttaaaacagttactggaggattctacctcaggtgaagataggagcagctccagttcctctgaaggtaaagagggaagcacaaatcttccaagtcaaatgagggttctgactcagagtgacaaggatgtgacttgttcaacattctcttctcaaacactgaccaaggaacagaggaagatgcagtcagagaaagtagcaggatagagacgccgagagaggagtatatgtgggtcacagcagtgagctcccacccgccttgcagtgaagatgtgaccccaggagagggagtgtctccttccaggtgctagctctggacagcagctgattttaggcaggaaagtttcttcatcgttgtcctccctgctggtcacatgagtttacgattccttagaagtgtctcccacagggtggcaggactgggagaatctctgaggcgtgtcttccaggccctcccacagcttgtgccctccacagtgtagacttgaacacttggcctcatgtgatccttccaccttggcctcccaaagcattgggattacaggcgagagccactggttggctaaaatatttatatttacctgacatgatttgttgatttgggggctagggagttcttaaaacaacaataaaaaatcttctgtggctgcattc

SEQ ID NO: 42439 - DNA, 975 bp, Homo sapiens
ttttttttttttgagatggagtttcgctcttgttgcccaggctggagtacaatggcatgatctcggctcaccgcgacctccgcctcccaggttggcattgcaaatggtacggtcaccgaacaggctacaaagaatgccctttctttatcaaagacaaccaaaagttacaacagttcagagtagcacatgaggatttcatgtatgacatcatacgagacaataaacaacatgaaaagaatgtaaggatacagcagttaaaacagttactggaggattctacctcaggtgaagataggagcagctccagttcctctgaaggtaaagagaaacacaagaaaaagaagaagaaagaaaagcataagaaaaggaagaaagaaaagaaaaagaagaaaaaacggaagcacaaatcttccaagtcaaatgagggttctgactcagagtgacaaggatgtgacttgttcaacattctcttctcaaacactgaccaaggaacagaggaagatgcagtcagagaaagtagcaggatagagacgccgagagaggagtatatgtgggtcacagcagtgagctcccacccgccttgcagtgaagatgtgaccccaggagagggagtgtctccttccaggtgctagctctggacagcagctgattttaggcaggaaagtttcttcatcgttgtcctccctgctggtcacatgagtttacgattccttagaagtgtctcccacagggtggcaggactgggagaatctctgaggcgtgtcttccaggccctcccacagcttgtgccctccacagtgtagacttgaacacttggcctcatgtgatccttccaccttggcctcccaaagcattgggattacaggcgagagccactggttggctaaaatatttatatttacctgacatgatttgttgatttgggggctagggagttcttaaaacaacaataaaaaatcttctgtggctgcattc

SEQ ID NO: 42440 - DNA, 1287 bp, Homo sapiens
gtgaacagatgtcgactcaacctgagaaagaaggtatttgttctagtgactaaatttataaatgagattcagagccacttgattaatagaagatatttactttgaaaaatacagcgagacacactaaaaaaattgaccttttgcagtacttttcattggattgcttcataatttcttggtgttggaaaattaattcctaaagcacaagattaaaggatgcttgggtaagcaattagtttacctgtcttttctgggaccttacacggttcatccatgattgcattttcttttagaattggagtttaatgaataaaaactttaatataatctactgattctttatctcactaaggtgaaacactcttatcttacagaaatatttccccttttctttgcttttaggttggcattgcaaatggtacggtcaccgaacaggctacaaagaatgccctttctttatcaaagacaaccaaaagttacaacagttcagagtagcacatgaggatttcatgtatgacatcatacgagacaataaacaacatgaaaagaatgtaaggatacagcagttaaaacagttactggaggattctacctcaggtgaagataggagcagctccagttcctctgaaggtaaagagaaacacaagaaaaagaagaagaaagaaaagcataagaaaaggaagaaagaaaagaaaaagaagaaaaaacggaagcacaaatcttccaagtcaaatgagggttctgactcagagtgacaaggatgtgacttgttcaacattctcttctcaaacactgaccaaggaacagaggaagatgcagtcagagaaagtagcaggatagagacgccgagagaggagtatatgtgggtcacagcagtgagctcccacccgccttgcagtgaagatgtgaccccaggagagggagtgtctccttccaggtgctagctctggacagcagctgattttaggcaggaaagtttcttcatcgttgtcctccctgctggtcacatgagtttacgattccttagaagtgtctcccacagggtggcaggactgggagaatctctgaggcgtgtcttccaggccctcccacagcttgtgccctccacagtgtagacttgaacacttggcctcatgtgatccttccaccttggcctcccaaagcattgggattacaggcgagagccactggttggctaaaatatttatatttacctgacatgatttgttgatttgggggctagggagttcttaaaacaacaataaaaaatcttctgtggctgcattc

SEQ ID NO: 42441 - DNA, 692 bp, Homo sapiens
taatgatagatctgtctactgtcatttaagaggaaatatacacaattctagcttataatagacagacatctactctttaaaggctggaaaaaaagggtctcacctgtggccaggagcggtggctcacgcctgtaatcccagcactttgagaggccgcggtggacagatcacgagagcttcccctgtgtctgctgtttctcaaaatgatccttagccaaaaaggtgtgctttgaggtagcatattctggtctcctacagctattcaactgaggacagagtagttatgaaaaacctcctcctgggcttatcaaggttagtgtgaagtttgtactcttggttatcccactagacatacttacagactcagtaatgcattatgaaaaatggttgcatgacatttaaatgcccttttatgaaaagcctgtttctttcctgcagatgactgaggggtcataatttttagtgttgtcacaagcctctgcctttgtggaaatttcatcagccatgtttcccttccctgaggaaccagtgcaggcccacatgggttccttggccgtggcccccttctctctgactggggaacggcatctttaagctcagctgcctccttttcttgtcagccttacttggctcagtccctcagtccatcctgtgttggtttcttgagtatcagcagctcagagagcagtcaa

SEQ ID NO: 42442 - DNA, 1825 bp, Homo sapiens
gacttggggccggccgcgggcaggcgggcatctggcggccgaggccgggacttcggggcccctcccgggcgagtcgcggggcggcggcgggaaggggcgccgcacggaggaagtgccctcttggccgcagccagagccgcgccgcaggtgccgcgatgtcgtcctggccggggcgcgaggatgcgagggctgggggcgcgtggtggccgcgggagccgctggatcaggaactgcagcgggcccgggagcagaagcggcggcggcacgacgcccagcagctgcagcagctcaagcgcctggagtccttgtgagtctcgagcagccgtctgggccgcagtccgcgcgccgcccgttttctgggaacaggggcgcccggcgccgtgttgggcgctgggctgggtcctccaagcccccaggacccaggcaggggtgcgggcctgtgaggaacctagtgcctgcgacgggacttctagtcctcactgggtggggagcgaggcccgcccggccacggaggggccctggaggccgcggcgcgggtgggcgggggcctcggcccggggaggcggcagcggcttgcgctcctcgcccccgctttggtgtgggcgtcgcctcttttggggaagccaagagttattggcgcttgctcggcatttgtggaccgaacaggcaagttcaaccgagcacgctgcccccgcgctccacctctgagttccctgggccactgcgacatggagaaaccccgttcttttcatcctctgctatggagaagggacgaggacacgggtcctgcagtgttggtgtggcgaggcccggaagaagagagaatgggcggcggggactggccacggcgctgctagaaagggtctcacctgtggccaggagcggtggctcacgcctgtaatcccagcactttgagaggccgcggtggacagatcacgaggttggcattgcaaatggtacggtcaccgaacaggctacaaagaatgccctttctttatcaaagacaaccaaaagttacaacagttcagagtagcacatgaggatttcatgtatgacatcatacgagacaataaacaacatgaaaagaatgtaaggatacagcagttaaaacagttactggaggattctacctcaggtgaagataggagcagctccagttcctctgaaggtaaagagaaacacaagaaaaagaagaagaaagaaaagcataagaaaaggaagaaagaaaagaaaaagaagaaaaaacggaagcacaaatcttccaagtcaaatgagggttctgactcagagtgacaaggatgtgacttgttcaacattctcttctcaaacactgaccaaggaacagaggaagatgcagtcagagaaagtagcaggatagagacgccgagagaggagtatatgtgggtcacagcagtgagctcccacccgccttgcagtgaagatgtgaccccaggagagggagtgtctccttccaggtgctagctctggacagcagctgattttaggcaggaaagtttcttcatcgttgtcctccctgctggtcacatgagtttacgattccttagaagtgtctcccacagggtggcaggactgggagaatctctgaggcgtgtcttccaggccctcccacagcttgtgccctccacagtgtagacttgaacacttggcctcatgtgatccttccaccttggcctcccaaagcattgggattacaggcgagagccactggttggctaaaatatttatatttacctgacatgatttgttgatttgggggctagggagttcttaaaacaacaataaaaaatcttctgtggctgcattc

SEQ ID NO: 42443 - DNA, 1413 bp, Homo sapiens
gacttggggccggccgcgggcaggcgggcatctggcggccgaggccgggacttcggggcccctcccgggcgagtcgcggggcggcggcgggaaggggcgccgcacggaggaagtgccctcttggccgcagccagagccgcgccgcaggtgccgcgatgtcgtcctggccggggcgcgaggatgcgagggctgggggcgcgtggtggccgcgggagccgctggatcaggaactgcagcgggcccgggagcagaagcggcggcggcacgacgcccagcagctgcagcagctcaagcgcctggagtccttaaagggtctcacctgtggccaggagcggtggctcacgcctgtaatcccagcactttgagaggccgcggtggacagatcacgagagcttcccctgtgtctgctgtttctcaaaatgatccttagccaaaaaggtgtgctttgaggtagcatattctggtctcctacagctattcaactgaggacagagtagttatgaaaaacctcctcctgggcttatcaaggttggcattgcaaatggtacggtcaccgaacaggctacaaagaatgccctttctttatcaaagacaaccaaaagttacaacagttcagagtagcacatgaggatttcatgtatgacatcatacgagacaataaacaacatgaaaagaatgtaaggatacagcagttaaaacagttactggaggattctacctcaggtgaagataggagcagctccagttcctctgaaggtaaagagaaacacaagaaaaagaagaagaaagaaaagcataagaaaaggaagaaagaaaagaaaaagaagaaaaaacggaagcacaaatcttccaagtcaaatgagggttctgactcagagtgacaaggatgtgacttgttcaacattctcttctcaaacactgaccaaggaacagaggaagatgcagtcagagaaagtagcaggatagagacgccgagagaggagtatatgtgggtcacagcagtgagctcccacccgccttgcagtgaagatgtgaccccaggagagggagtgtctccttccaggtgctagctctggacagcagctgattttaggcaggaaagtttcttcatcgttgtcctccctgctggtcacatgagtttacgattccttagaagtgtctcccacagggtggcaggactgggagaatctctgaggcgtgtcttccaggccctcccacagcttgtgccctccacagtgtagacttgaacacttggcctcatgtgatccttccaccttggcctcccaaagcattgggattacaggcgagagccactggttggctaaaatatttatatttacctgacatgatttgttgatttgggggctagggagttcttaaaacaacaataaaaaatcttctgtggctgcattc

SEQ ID NO: 42444 - DNA, 1223 bp, Homo sapiens
gacttggggccggccgcgggcaggcgggcatctggcggccgaggccgggacttcggggcccctcccgggcgagtcgcggggcggcggcgggaaggggcgccgcacggaggaagtgccctcttggccgcagccagagccgcgccgcaggtgccgcgatgtcgtcctggccggggcgcgaggatgcgagggctgggggcgcgtggtggccgcgggagccgctggatcaggaactgcagcgggcccgggagcagaagcggcggcggcacgacgcccagcagctgcagcagctcaagcgcctggagtccttttatgaaaaacctcctcctgggcttatcaaggttggcattgcaaatggtacggtcaccgaacaggctacaaagaatgccctttctttatcaaagacaaccaaaagttacaacagttcagagtagcacatgaggatttcatgtatgacatcatacgagacaataaacaacatgaaaagaatgtaaggatacagcagttaaaacagttactggaggattctacctcaggtgaagataggagcagctccagttcctctgaaggtaaagagaaacacaagaaaaagaagaagaaagaaaagcataagaaaaggaagaaagaaaagaaaaagaagaaaaaacggaagcacaaatcttccaagtcaaatgagggttctgactcagagtgacaaggatgtgacttgttcaacattctcttctcaaacactgaccaaggaacagaggaagatgcagtcagagaaagtagcaggatagagacgccgagagaggagtatatgtgggtcacagcagtgagctcccacccgccttgcagtgaagatgtgaccccaggagagggagtgtctccttccaggtgctagctctggacagcagctgattttaggcaggaaagtttcttcatcgttgtcctccctgctggtcacatgagtttacgattccttagaagtgtctcccacagggtggcaggactgggagaatctctgaggcgtgtcttccaggccctcccacagcttgtgccctccacagtgtagacttgaacacttggcctcatgtgatccttccaccttggcctcccaaagcattgggattacaggcgagagccactggttggctaaaatatttatatttacctgacatgatttgttgatttgggggctagggagttcttaaaacaacaataaaaaatcttctgtggctgcattc

SEQ ID NO: 42445 - DNA, 1306 bp, Homo sapiens
gacttggggccggccgcgggcaggcgggcatctggcggccgaggccgggacttcggggcccctcccgggcgagtcgcggggcggcggcgggaaggggcgccgcacggaggaagtgccctcttggccgcagccagagccgcgccgcaggtgccgcgatgtcgtcctggccggggcgcgaggatgcgagggctgggggcgcgtggtggccgcgggagccgctggatcaggaactgcagcgggcccgggagcagaagcggcggcggcacgacgcccagcagctgcagcagctcaagcgcctggagtccttaaagggtctcacctgtggccaggagcggtggctcacgcctgtaatcccagcactttgagaggccgcggtggacagatcacgagttatgaaaaacctcctcctgggcttatcaaggttggcattgcaaatggtacggtcaccgaacaggctacaaagaatgccctttctttatcaaagacaaccaaaagttacaacagttcagagtagcacatgaggatttcatgtatgacatcatacgagacaataaacaacatgaaaagaatgtaaggatacagcagttaaaacagttactggaggattctacctcaggtgaagataggagcagctccagttcctctgaaggtaaagagaaacacaagaaaaagaagaagaaagaaaagcataagaaaaggaagaaagaaaagaaaaagaagaaaaaacggaagcacaaatcttccaagtcaaatgagggttctgactcagagtgacaaggatgtgacttgttcaacattctcttctcaaacactgaccaaggaacagaggaagatgcagtcagagaaagtagcaggatagagacgccgagagaggagtatatgtgggtcacagcagtgagctcccacccgccttgcagtgaagatgtgaccccaggagagggagtgtctccttccaggtgctagctctggacagcagctgattttaggcaggaaagtttcttcatcgttgtcctccctgctggtcacatgagtttacgattccttagaagtgtctcccacagggtggcaggactgggagaatctctgaggcgtgtcttccaggccctcccacagcttgtgccctccacagtgtagacttgaacacttggcctcatgtgatccttccaccttggcctcccaaagcattgggattacaggcgagagccactggttggctaaaatatttatatttacctgacatgatttgttgatttgggggctagggagttcttaaaacaacaataaaaaatcttctgtggctgcattc

SEQ ID NO: 42446 - DNA, 1039 bp, Homo sapiens
tggggaatggtttagtaaagtatgcgtctgttagaatttataattgtaagtactgtgggaacctacagaaatgactaggacaaggaaaagaatacaaaaatggtttgtacactggttacagtcacataaacataggcattcaggtgaagaagaatggagaaaacaggtaaaaataaaaataagtactgtctttgtgatgtggttattcatgatccttccatattgcttttgaatgacatatttatctaagcaactgttgtaagttaaagctaaaactgactgttctttgatcaattttgaatgtttaggatacagcagttaaaacagttactggaggattctacctcaggtgaagataggagcagctccagttcctctgaaggtaaagagaaacacaagaaaaagaagaagaaagaaaagcataagaaaaggaagaaagaaaagaaaaagaagaaaaaacggaagcacaaatcttccaagtcaaatgagggttctgactcagagtgacaaggatgtgacttgttcaacattctcttctcaaacactgaccaaggaacagaggaagatgcagtcagagaaagtagcaggatagagacgccgagagaggagtatatgtgggtcacagcagtgagctcccacccgccttgcagtgaagatgtgaccccaggagagggagtgtctccttccaggtgctagctctggacagcagctgattttaggcaggaaagtttcttcatcgttgtcctccctgctggtcacatgagtttacgattccttagaagtgtctcccacagggtggcaggactgggagaatctctgaggcgtgtcttccaggccctcccacagcttgtgccctccacagtgtagacttgaacacttggcctcatgtgatccttccaccttggcctcccaaagcattgggattacaggcgagagccactggttggctaaaatatttatatttacctgacatgatttgttgatttgggggctagggagttcttaaaacaacaataaaaaatcttctgtggctgcattc

SEQ ID NO: 42447 - DNA, 2029 bp, Homo sapiens
gacttggggccggccgcgggcaggcgggcatctggcggccgaggccgggacttcggggcccctcccgggcgagtcgcggggcggcggcgggaaggggcgccgcacggaggaagtgccctcttggccgcagccagagccgcgccgcaggtgccgcgatgtcgtcctggccggggcgcgaggatgcgagggctgggggcgcgtggtggccgcgggagccgctggatcaggaactgcagcgggcccgggagcagaagcggcggcggcacgacgcccagcagctgcagcagctcaagcgcctggagtccttgtgagtctcgagcagccgtctgggccgcagtccgcgcgccgcccgttttctgggaacaggggcgcccggcgccgtgttgggcgctgggctgggtcctccaagcccccaggacccaggcaggggtgcgggcctgtgaggaacctagtgcctgcgacgggacttctagtcctcactgggtggggagcgaggcccgcccggccacggaggggccctggaggccgcggcgcgggtgggcgggggcctcggcccggggaggcggcagcggcttgcgctcctcgcccccgctttggtgtgggcgtcgcctcttttggggaagccaagagttattggcgcttgctcggcatttgtggaccgaacaggcaagttcaaccgagcacgctgcccccgcgctccacctctgagttccctgggccactgcgacatggagaaaccccgttcttttcatcctctgctatggagaagggacgaggacacgggtcctgcagtgttggtgtggcgaggcccggaagaagagagaatgggcggcggggactggccacggcgctgctagaaagggtctcacctgtggccaggagcggtggctcacgcctgtaatcccagcactttgagaggccgcggtggacagatcacgaggttggcattgcaaatggtacggtcaccgaacaggctacaaagaatgccctttctttatcaaagacaaccaaaagttacaacagttcagagtagcacatgaggatttcatgtatgacatcatacgagacaataaacaacatgaaaagaatgtaaggatacagcagttaaaacagttactggaggattctacctcaggtgaagataggagcagctccagttcctctgaaggtaaagagaaacacaagaaaaagaagaagaaagaaaagcataagaaaaggaagaaagaaaagaaaaagaagaaaaaacggaagcacaaatcttccaagtcaaatgagggttctgactcagagtgacaaggatgtgacttgttcaacattctcttctcaaacactgaccaaggaacagaggaagatgcagtcagagaaagtagcaggatagagacgccgagagaggagtatatgtgggtcacagcagtgagctcccacccgccttgcagtgaagatgtgaccccaggagagggagtgtctccttccaggtgctagctctggacagcagctgattttaggcaggaaagtttcttcatcgttgtcctccctgctggtcacatgagtttacgattccttagaagtgtctcccacagggtggcaggactgggagaatctctgaggcgtgtcttccaggccctcccacagcttgtgccctccacagtgtagacttgaacacttggcctcatgtgatccttccaccttggcctcccaaagcattgggattacaggcgagagccactggttggctaaaatatttatatttacctgacatgatttgttgatttgggggctagggagttcttaaaacaacaataaaaaatcttctgtggctgcattcaaaaaaaaaagaacaaaaacaactttgtgggcgccctcgggccagaaaaaagtttcaaaccatccggtgggcgcgggccagtgggtaggaccgggcaagggtccaaggaaccggcaagacaggggggtcccccaaaaaacccggggacggggtcggaccccgagggtcgggcacgggtcaaagggcagggtaaccccgggggga

SEQ ID NO: 42448 - DNA, 1358 bp, Homo sapiens
gacttggggccggccgcgggcaggcgggcatctggcggccgaggccgggacttcggggcccctcccgggcgagtcgcggggcggcggcgggaaggggcgccgcacggaggaagtgccctcttggccgcagccagagccgcgccgcaggtgccgcgatgtcgtcctggccggggcgcgaggatgcgagggctgggggcgcgtggtggccgcgggagccgctggatcaggaactgcagcgggcccgggagcagaagcggcggcggcacgacgcccagcagctgcagcagctcaagcgcctggagtccttaaagggtctcacctgtggccaggagcggtggctcacgcctgtaatcccagcactttgagaggccgcggtggacagatcacgagagcttcccctgtgtctgctgtttctcaaaatgatccttagccaaaaaggtgtgctttgaggtagcatattctggtctcctacagctattcaactgaggacagagtagttatgaaaaacctcctcctgggcttatcaaggttggcattgcaaatggtacggtcaccgaacaggctacaaagaatgccctttctttatcaaagacaaccaaaagttacaacagttcagagtagcacatgaggatttcatgtatgacatcatacgagacaataaacaacatgaaaagaatgtaaggatacagcagttaaaacagttactggaggattctacctcaggtgaagataggagcagctccagttcctctgaaggtaaagagaaacacaagaaaaagaagaagaaagaaaagcataagaaaaggaagaaagaaaagaaaaagaagaaaaaacggaagcacaaatcttccaagtcaaatgagggttctgactcagagtgacaaggatgtgacttgttcaacattctcttctcaaacactgaccaaggaacagaggaagatgcagtcagagaaagtagcaggatagagacgccgagagaggagtatatgtgggtcacagcagtgagctcccacccgccttgcagtgaagatgtgaccccaggagagggagtgtctccttccaggtgctagctctggacagcagctgattttaggcaggaaagtttcttcatcgttgtcctccctgctggtcacatgagtttacgattccttagaagtgtctcccacagggtggcaggactgggagaatctctgaggcgtgtcttccaggccctcccacagcttgtgccctccacagtgtagacttgaacacttggcctcatgtgatccttccaccttggcctcccaaagcatgatttgttgatttgggggctagggagttcttaaaacaacaataaaaaatcttctgtggctgcattc

SEQ ID NO: 42449 - DNA, 1395 bp, Homo sapiens
gacttggggccggccgcgggcaggcgggcatctggcggccgaggccgggacttcggggcccctcccgggcgagtcgcggggcggcggcgggaaggggcgccgcacggaggaagtgccctcttggccgcagccagagccgcgccgcaggtgccgcgatgtcgtcctggccggggcgcgaggatgcgagggctgggggcgcgtggtggccgcgggagccgctggatcaggaactgcagcgggcccgggagcagaagcggcggcggcacgacgcccagcagctgcagcagctcaagcgcctggagtccttgtgagtctcgagcagccgtctgggccgcagtccgcgcgccgcccgttttctgggaacaggggcgcccggcgccgtgttgggcgctgggctgggtcctccaagcccccaggacccaggcaggggtgcgggcctgtgaggaacctagtgcctgcgacgggacttctagtcctcactgggtggggagcgaggcccgcccggccacggaggggccctggaggccgcggcgcgggtgggcgggggcctcggcccggggaggcggcagcggcttgcgctcctcgcccccgctttggtgtgggcgtcgcctcttttggggaagccaagagttattggcgcttgctcggcatttgtggaccgaacaggcaagttcaaccgagcacgctgcccccgcgctccacctctgagttccctgggccactgcgacatggagaaaccccgttcttttcatcctctgctatggagaagggacgaggacacgggtcctgcagtgttggtgtggcgaggcccggaagaagagagaatgggcggcggggactggccacggcgctgctagaaagggtctcacctgtggccaggagcggtggctcacgcctgtaatcccagcactttgagaggccgcggtggacagatcacgagagcttcccctgtgtctgctgtttctcaaaatgatccttagccaaaaaggtgtgctttgaggtagcatattctggtctcctacagctattcaactgaggacagagtaggtaagattttagttgttttactacccttgtctccttccttcctatgtagtcatattataataatttttgctaaattagtagttaatattaacataagtattactttgcaatatcattcacttttgcatcaaatagtgacctatgatttattttgtatttttaaagtagttaataagagcctgggtgaccgagaaagaccgcatctccaaaaaaaaaaaaagggtctcacctgaaatggagattccctttatagatgaacatttgtcttacaaagggtgacttcggctctcttttcagagcttccctgtgtctgctgtttctcaaatgatctagccaaaaggtggcttt

SEQ ID NO: 42450 - DNA, 882 bp, Homo sapiens
acaaagagaattacctcggtatttctaaacttgagtactgttttatagtacgactcttccagtttatgcagttatttcctcatgaagaatattatttcgtgtattttctcattgggaaattatttttatagccttaatgagttatcagtgatatgacccttaaaaggattaaaacatgttgagcgtgtggctacatcaaacagtaaaagaaaaaaaaactgttttctgtaacataggggtttaattttatttaactaacggtccatgaagcctaaccaaaccttaaccttctctgtcccttaaggcacatgaggatttcatgtatgacatcatacgagacaataaacaacatgaaaagaatgtaaggtgaggttgtcctggtgatagtatctatttaaagttttaacttatataaagttggaaaaaaaccttctagcactaggagagtgatatagtaaacatggcacttcaattgtgaaatatttattgggtaggagtcatggctgacaagaccagtgttggggaatcagcaggccagcctcctcctccttgggttagcttaaagctgtaggcttggtccagttctctgaccactgcagttgatattagccacccatgttgtgctatttacttgcatggtacaattggtaccatgcaaggtaattcagtttatctcctctaacgtcttaaggatctcagcttttgttaaagattatacctagacaagattagagagtgaataatcaggagagtttgttttttcaaactggttacattaaattataattgttgagggtgtagattatctattaggaaattgagcagttggggaatggtttagtaaagtatgcgtctgttagaatttataattgtaagtactgt

SEQ ID NO: 42451 - DNA, 3038 bp, Homo sapiens
gacttggggccggccgcgggcaggcgggcatctggcggccgaggccgggacttcggggcccctcccgggcgagtcgcggggcggcggcgggaaggggcgccgcacggaggaagtgccctcttggccgcagccagagccgcgccgcaggtgccgcgatgtcgtcctggccggggcgcgaggatgcgagggctgggggcgcgtggtggccgcgggagccgctggatcaggaactgcagcgggcccgggagcagaagcggcggcggcacgacgcccagcagctgcagcagctcaagcgcctggagtccttgtgagtctcgagcagccgtctgggccgcagtccgcgcgccgcccgttttctgggaacaggggcgcccggcgccgtgttgggcgctgggctgggtcctccaagcccccaggacccaggcaggggtgcgggcctgtgaggaacctagtgcctgcgacgggacttctagtcctcactgggtggggagcgaggcccgcccggccacggaggggccctggaggccgcggcgcgggtgggcgggggcctcggcccggggaggcggcagcggcttgcgctcctcgcccccgctttggtgtgggcgtcgcctcttttggggaagccaagagttattggcgcttgctcggcatttgtggaccgaacaggcaagttcaaccgagcacgctgcccccgcgctccacctctgagttccctgggccactgcgacatggagaaaccccgttcttttcatcctctgctatggagaagggacgaggacacgggtcctgcagtgttggtgtggcgaggcccggaagaagagagaatgggcggcggggactggccacggcgctgctagaaagggtctcacctgtggccaggagcggtggctcacgcctgtaatcccagcactttgagaggccgcggtggacagatcacgaggttggcattgcaaatggtacggtcaccgaacaggctacaaagaatgccctttctttatcaaagacaaccaaaagttacaacagttcagagtagcacatgaggatttcatgtatgacatcatacgagacaataaacaacatgaaaagaatgtaaggatacagcagttaaaacagttactggaggattctacctcaggtgaagataggagcagctccagttcctctgaaggtaaagagaaacacaagaaaaagaagaagaaagaaaagcataagaaaaggaagaaagaaaagaaaaagaagaaaaaacggaagcacaaatcttccaagtcaaatgagggttctgactcagagtgacaaggatgtgacttgttcaacattctcttctcaaacactgaccaaggaacagaggaagatgcagtcagagaaagtagcaggatagagacgccgagagaggagtatatgtgggtcacagcagtgagctcccacccgccttgcagtgaagatgtgaccccaggagagggagtgtctccttccaggtgctagctctggacagcagctgattttaggcaggaaagtttcttcatcgttgtcctccctgctggtcacatgagtttacgattccttagaagtgtctcccacagggtggcaggactgggagaatctctgaggcgtgtcttccaggccctcccacagcttgtgccctccacagtgtagacttgaacacttggcctcatgtgatccttccaccttggcctcccaaagcattgggattacaggcgagagccactggttggctaaaatatttatatttacctgacatgatttgttgatttgggggctagggagttcttaaaacaacaataaaaaatcttctgtggctgcattctacttcacttgctttctactgccagagtcccatgattttcacagagtgactgactcagaaaaggtttaggaatatagggggatttctgtactaggtcaggtatccacatcccaaaatccatccctccctttcttcctcttcctgttgcctgaccacagcccacctgtgctcttgtagctgaaactaggccacagtagaggcatctcaggaggccagggtgtgtctgcagctggaggagaggaagtctatcctttgctgcgccaaagtgaagccggatcttgctcataggcaagtgtgtccctctgtggctagcactggtctcttgctgctttaggcactcagtcagggtcccagaaactcactcccattttctgccacttttcctggggtttggattccctcctttttaaggaacagccaagccaggcccagactgacccttcttcaagtctcatcagtcaatgctcctgttcttggcctcggaataccacctcaggaaaacaatcggttgagattggaatggccaggacttaactatttctgaaaactgtaaggccagtggattcagccttgccttacacttatccttgtcatgcagaacacaggccatctgtcctctgccatatgctcagcatttcttacccaggtacagccggtcctcttcttccaggaattggctactgtccctctgcaatcccattcatgataaaagcattcttatacaacacaaaagatgctgcatcaatgattctcaaacctccaagacatccaaatcaactagcatgcttaagatgcagattcctgtgctcgactcaccaacttccagaattttccattccctaggtctgaggtgaacctgggaatctgccttgctaacaaatgatgctgacactgttgatttggggaccccacttggagaacctgggctctagatctctaccctcttactgaagccttcttccacttcctgctttaactggaatccagccgtccacccctgtagcccttgcaaagtgaattgtcccttttccctcactctgtttttttctcctctgtttctagcctagattccaaggaacatcactttggcctgtcatctcccctgatctgtgatccttttgtccagctttccccaaagaagcatcaatcaaaatcttccgctttgctcctatagacagactacaggggaaaaatcccagagcccctacaaatc

SEQ ID NO: 42452 - DNA, 1351 bp, Homo sapiens
gacttggggccggccgcgggcaggcgggcatctggcggccgaggccgggacttcggggcccctcccgggcgagtcgcggggcggcggcgggaaggggcgccgcacggaggaagtgccctcttggccgcagccagagccgcgccgcaggtgccgcgatgtcgtcctggccggggcgcgaggatgcgagggctgggggcgcgtggtggccgcgggagccgctggatcaggaactgcagcgggcccgggagcagaagcggcggcggcacgacgcccagcagctgcagcagctcaagcgcctggagtccttgtgagtctcgagcagccgtctgggccgcagtccgcgcgccgcccgttttctgggaacaggggcgcccggcgccgtgttgggcgctgggctgggtcctccaagcccccaggacccaggcaggggtgcgggcctgtgaggaacctagtgcctgcgacgggacttctagtcctcactgggtggggagcgaggcccgcccggccacggaggggccctggaggccgcggcgcgggtgggcgggggcctcggcccggggaggcggcagcggcttgcgctcctcgcccccgctttggtgtgggcgtcgcctcttttggggaagccaagagttattggcgcttgctcggcatttgtggaccgaacaggcaagttcaaccgagcacgctgcccccgcgctccacctctgagttccctgggccactgcgacatggagaaaccccgttcttttcatcctctgctatggagaagggacgaggacacgggtcctgcagtgttggtgtggcgaggcccggaagaagagagaatgggcggcggggactggccacggcgctgctagaaagggtctcacctgtggccaggagcggtggctcacgcctgtaatcccagcactttgagaggccgcggtggacagatcacgagttatgaaaaacctcctcctgggcttatcaaggttagtgtgaagtttgtactcttggttatcccactagacatacttacagactcagtaatgcattatgaaaaatggttgcatgacatttaaatgcccttttatgaaaagcctgtttctttcctgcagatgactgaggggtcataatttttagtgttgtcacaagcctctgcctttgtggaaatttcatcagccatgtttcccttccctgaggaaccagtgcaggcccacatgggttccttggccgtggcccccttctctctgactggggaacggcatctttaagctcagctgcctccttttcttgtcagccttacttggctcagtccctcagtccatcctgtgttggtttcttgagtatcagcagctcagagagcagtcaa

SEQ ID NO: 42453 - DNA, 1343 bp, Homo sapiens
tgagcagcagcaagatttattgaaagagcgaaagaacaaaacttccacagcatggaaggggacccgagcgggttgccgctgccagctcgggtggcctgcttttattcccttacttggccccacccacatcctgctgattggtccattttacagagagctgattggtccattttacagagtgttgactggtccattttacaatactttagctagacagaaaagttctccaagtccccacccaacccagaagcccagccggcttcacctctcaatgggatgatctgttggtgatgggatgatctgttcagcaaaccgccatggcacacgtttacctgtgtaacaaacctgaacatcctgcacatgtacccttgaatttaaaataaaagttgaagcaaaaaatgtatttccaacgaaaatatagcatttaatgtgagatgtgccataatctctgtcctaccttcttaagggcaatggatgaaatcagtatctactggaaggagtaaaaatattaaataattgaagcaaaatggattggaagcccaaaatttggagattttcttggggtgctctgtggtaagaataatgccccccccgcaatcgtatccatggccaagtctccagaacctgtgaacatgctactttacatagcaaaagggactttgcagatgttattaaattaaggatttgcggatggggcaattattctggattatgcaggtggacctggtgcgtccttagaagaaagaggcaaaagagtcagaggagagaaggagatgtgaagaaggaagcagagagagagatttgaggctactacactgttggtttttaagatggatgaaagaattcaggcagcctctggaagctggaaaaggctatctgcctagagcctccggaggagtgtagcgtcatcaataccttgactttggctcattgaaacccatttcagacttctgacctccagaactgtaagaaagagtaaatctgtgaaattttaagtcaccaagtttgtggtaatttgttacagccactaaaagaaactagtatattccccccaaaacatatacagaatgaaagatcaataacattgcttatttattttttccttcttattatttgttgtgccttgcctttcaataaaatatgattattcataatcaaaggtgattgttacccatgatctctgatttagcaacattttcatgtaatatttcttgatttaactagattaatatcagcaaatgacttagtaagtagtgcttcaaataaaatggcataaaacaagataaactccttggaaccctttcacattgaattaaaattaaaacatcttcatgaagaaaact

SEQ ID NO: 42454 - DNA, 420 bp, Homo sapiens
catgaagttctattatgagattttaaaatcttaactgaaagcactcagaagtatttcacatttctttaatcattttattcatatggttcttattatacctatgttcttaggattgttttctgttttgtttagaagcctagaaaatgtgtagggctttcattgatcttattgaagattttaacagagttgtggacataatagattacctctcaatagcagggataaatattggtttttgatcaagaatatgaaatgagttgtttgtcctgaaccacccccaagcaggaaagacttgcagcattaccagaattttttcttttatcctttattgaaagggaaactcccagatagaatgtgtaacatacaagttggtgttaaagatgtttgttggttttgtgtttaaatgcaaagatcatgttt

SEQ ID NO: 42455 - DNA, 712 bp, Homo sapiens
acaagtttctgctttatagtgtgttcattctagtggactgttctatctcaagtataaaactgcagtagtccaaatcacatgctccctgtaatttcttatagaaacagtttcttgagaggttttatcatatatcattacaattatgtggaccttacaaattaatactttttactaagcaaaatgtttaaagactatgtgagaaaacaaggattaaactttaaattttatccttcgttcatttctaaacctggttttgagcttgtccaaaaaagggcagtttttctttccagtatttaggatgtatgttgcagtttgatagttctgtgaaacctaaataattatttaatcttaagttacagttctcagtactgtaccacctggcatattattgggtgatttattgaccctttaacattttgtcattatatgttatgttgtttttttacatctaacactttaaaagtaattttgtgaagcaactaactttataatgtatttatagaaatgtatttcttagaagtttctgtgcccaaacataaattataataggatcctacatttgaataaaaattattcttttggccgagtgcggtggctcatgcatgtaatcccagcactttggaaggccaaggtgggaggatcacttgagcccagaagttcaagatcagcttgggtaacatagtgagaccccatccatctctacaaaaaataa

SEQ ID NO: 42456 - DNA, 908 bp, Homo sapiens
attctgaggccccctctgcgagcagctaggatgtggaaagcggttcctgcttgcatctctggggcagaggcctccaccagcaggctctcctccattcctccagtcctggcggaagcaaggccctcctaggcagctggtggataacagaggagggtcctaagagcaccacaggaagaacccttggctgggccaggacttggacgttgaggtctcggtgtcccgcatgagatgtctgcagaatgagacttacagtgcgctgagccctggcaaaagtgaggacgttgtgcttcgatggagccaggagttcagcaccttgactctaggccagttcggatgagctggcgtctattctgcccacaccccagcccaacctgcccacgttctctattgttttgagaccccattgctttcaggctgccccttctgggtctgttactcggcccctactcacatttccttgggttggagcaacagtcccagagagggccacggtgggagctgcgccctccttaaaagatgactttacataaaatgttgatcttcaaaaaaaaccaacaaagacaaaaaaagagacatagaaaacataaacagaaaagaataacaagagacacaaaaacaacaaagcacaaagagtaagaagacagaaaaaacaagaggggggggccgcaaaagaaaatactaccgtaggagcgggactaacgttgtgcgtgcagacaccacagacgagtgtagagagaagagcggtggcgccacactaagagagggagtacatttatactcgcgcgtagaggggagtacatggtataaaaccgcgagcgcgagatgaaaaaagcgatccgcaagggtgtgaattgtggaagggaaacacacaaacaggggggcgaggaacaacattggcggaaaacgat

SEQ ID NO: 42457 - DNA, 547 bp, Homo sapiens
cgtgcgccccgccccgcgcctgcggctctctctgcggcttggcccgttagaggcggcttgtgtccacgggacgcgggcggatcttctccggccatgaggaagccagccgctggcttccttccctcactcctgaaggtgctgctcctgcctctggcacctgccgcagcccaggattcgactcaggcctccactccaggcagccctctctctcctaccgaatacgaacgcttcttcgcactgctgactccaacctggaaggcagagactacctgccgtctccgtgcaacccacggctgccggaatcccacactcgtccagctggaccaatatgaaaaccacggcttagtgcccgatggtgagggccagactaggggggaaaccgaggcacccagagtgttcacccaaacctcagggcaaaaacccctgtgctcatgtgaggcggggaagggcatggctggcaccacaccatgagctcgtactctccaccctccccatggcgtggagtccattgcccacagccccaccccaagctccccacgggttcatc

SEQ ID NO: 42458 - DNA, 2296 bp, Homo sapiens
cgtgcgccccgccccgcgcctgcggctctctctgcggcttggcccgttagaggcggcttgtgtccacgggacgcgggcggatcttctccggccatgaggaagccagccgctggcttccttccctcactcctgaaggtgctgctcctgcctctggcacctgccgcagcccaggattcgactcaggcctccactccaggcagccctctctctcctaccgaatacgaacgcttcttcgcactgctgactccaacctggaaggcagagactacctgccgtctccgtgcaacccacggctgccggaatcccacactcgtccagctggaccaatatgaaaaccacggcttagtgcccgatggtgctgtctgctccaacctcccttatgcctcctggtttgagtctttctgccagttcactcactaccgttgctccaaccacgtctactatgccaagagagtcctgtgttcccagccagtctctattctctcacctaacactctcaaggagatagaagcttcagctgaagtctcacccaccacgatgacctcccccatctcaccccacttcacagtgacagaacgccagaccttccagccctggcctgagaggctcagcaacaacgtggaagagctcctacaatcctccttgtccctgggaggccaggagcaagcgccagagcacaagcaggagcaaggagtggagcacaggcaggagccgacacaagaacacaagcaggaagaggggcagaaacaggaagagcaagaagaggaacaggaagaggagggaaagcaggaagaaggacaggggactaaggagggacgggaggctgtgtctcagctgcagacagactcagagcccaagtttcactctgaatctctatcttctaacccttcctcttttgctccccgggtacgagaagtagagtctactcctatgataatggagaacatccaggagctcattcgatcagcccaggaaatagatgaaatgaatgaaatatatgatgagaactcctactggagaaaccaaaaccctggcagcctcctgcagctgccccacacagaggccttgctggtgctgtgctattcgatcgtggagaatacctgcatcataacccccacagccaaggcctggaagtacatggaggaggagatccttggtttcgggaagtcggtctgtgacagccttgggcggcgacacatgtctacctgtgccctctgtgacttctgctccttgaagctggagcagtgccactcagaggccagcctgcagcggcaacaatgcgacacctcccacaagactccctttgtcagccccttgcttgcctcccagagcctgtccatcggcaaccaggtagggtccccagaatcaggccgcttttacgggctggatttgtacggtgggctccacatggacttctggtgtgcccggcttgccacgaaaggctgtgaagatgtccgagtctctgggtggctccagactgagttccttagcttccaggatggggatttccctaccaagatttgtgacacagactatatccagtacccaaactactgttccttcaaaagccagcagtgtctgatgagaaaccgcaatcggaaggtgtcccgcatgagatgtctgcagaatgagacttacagtgcgctgagccctggcaaaagtgaggacgttgtgcttcgatggagccaggagttcagcaccttgactctaggccagttcggatgagctggcgtctattctgcccacaccccagcccaacctgcccacgttctctattgttttgagaccccattgctttcaggctgccccttctgggtctgttactcggcccctactcacatttccttgggttggagcaacagtcccagagagggccacggtgggagctgcgccctccttaaaagatgactttacataaaatgttgatcttcaaaaaaaaccaacaaagacaaaaaaagagacatagaaaacataaacagaaaagaataacaagagacacaaaaacaacaaagcacaaagagtaagaagacagaaaaaacaagaggggggggccgcaaaagaaaatactaccgtaggagcgggactaacgttgtgcgtgcagacaccacagacgagtgtagagagaagagcggtggcgccacactaagagagggagtacatttatactcgcgcgtagaggggagtacatggtataaaaccgcgagcgcgagatgaaaaaagcgatccgcaagggtgtgaattgtggaagggaaacacacaaacaggggggcgaggaacaacattggcggaaaacgat

SEQ ID NO: 42459 - DNA, 1878 bp, Homo sapiens
cgtgcgccccgccccgcgcctgcggctctctctgcggcttggcccgttagaggcggcttgtgtccacgggacgcgggcggatcttctccggccatgaggaagccagccgctggcttccttccctcactcctgaaggtgctgctcctgcctctggcacctgccgcagcccaggattcgactcaggcctccactccaggcagccctctctctcctaccgaatacgaacgcttcttcgcactgctgactccaacctggaaggcagagactacctgccgtctccgtgcaacccacggctgccggaatcccacactcgtccagctggaccaatatgaaaaccacggcttagtgcccgatggtgctgtctgctccaacctcccttatgcctcctggtttgagtctttctgccagttcactcactaccgttgctccaaccacgtctactatgccaagagagtcctgtgttcccagccagtctctattctctcacctaacactctcaaggagatagaagcttcagctgaagtctcacccaccacgatgacctcccccatctcaccccacttcacagtgacagaacgccagaccttccagccctggcctgagaggctcagcaacaacgtggaagagctcctacaatcctccttgtccctgggaggccaggagcaagcgccagagcacaagcaggagcaaggagtggagcacaggcaggagccgacacaagaacacaagcaggaagaggggcagaaacaggaagagcaagaagaggaacaggaagaggagggaaagcaggaagaaggacaggggactaaggagggacgggaggctgtgtctcagctgcagacagactcagagcccaagtttcactctgaatctctatcttctaacccttcctcttttgctccccgggtacgagaagtagagtctactcctatgataatggagaacatccaggagctcattcgatcagcccaggaaatagatgaaatgaatgaaatatatgatgagaactcctactggagaaaccaaaaccctggcagcctcctgcagctgccccacacagaggccttgctggtgctgtgctattcgatcgtggagaatacctgcatcataacccccacagccaaggcctggaagtacatggaggaggagatccttggtttcgggaagtcggtctgtgacagccttgggcggcgacacatgtctacctgtgccctctgtgacttctgctccttgaagctggagcagtgccactcagaggccagcctgcagcggcaacaatgcgacacctcccacaagactccctttgtcagccccttgcttgcctcccagagcctgtccatcggcaaccaggtagggtccccagaatcaggccgcttttacgggctggatttgtacggtgggctccacatggacttctggtgtgcccggcttgccacgaaaggctgtgaagatgtccgagtctctgggtggctccagactgagttccttagcttccaggatggggatttccctaccaagatttgtgacacagactatatccagtacccaaactactgttccttcaaaagccagcagtgtctgatgagaaaccgcaatcggaagtcctggcggaagcaaggccctcctaggcagctggtggataacagaggagggtcctaagagcaccacaggaagaacccttggctgggccaggacttggacgttgaggtctcggtctgtctcctcttcttactcaccaagtagcctgggatgaggcacttccccctctgagcctcagccgcctgtttctgcatgaaaggggttgggctgcttgatgtctcctctggctttaaaaacccacatttgagtttcctccttccctctactgccctgtgccca

SEQ ID NO: 42460 - DNA, 1646 bp, Homo sapiens
cgtgcgccccgccccgcgcctgcggctctctctgcggcttggcccgttagaggcggcttgtgtccacgggacgcgggcggatcttctccggccatgaggaagccagccgctggcttccttccctcactcctgaaggtgctgctcctgcctctggcacctgccgcagcccaggattcgactcaggcctccactccaggcagccctctctctcctaccgaatacgaacgcttcttcgcactgctgactccaacctggaaggcagagactacctgccgtctccgtgcaacccacggctgccggaatcccacactcgtccagctggaccaatatgaaaaccacggcttagtgcccgatggtgctgtctgctccaacctcccttatgcctcctggtttgagtctttctgccagttcactcactaccgttgctccaaccacgtctactatgccaagagagtcctgtgttcccagccagtctctattctctcacctaacactctcaaggagatagaagcttcagctgaagtctcacccaccacgatgacctcccccatctcaccccacttcacagtgacagaacgccagaccttccagccctggcctgagaggctcagcaacaacgtggaagagctcctacaatcctccttgtccctgggaggccaggagcaagcgccagagcacaagcaggagcaaggagtggagcacaggcaggagccgacacaagaacacaagcaggaagaggggcagaaacaggaagagcaagaagaggaacaggaagaggagggaaagcaggaagaaggacaggggactaaggagggacgggaggctgtgtctcagctgcagacagactcagagcccaagtttcactctgaatctctatcttctaacccttcctcttttgctccccgggtacgagaagtagagtctactcctatgataatggagaacatccaggagctcattcgatcagcccaggaaatagatgaaatgaatgaaatatatgatgagaactcctactggagaaaccaaaaccctggcagcctcctgcagctgccccacacagaggccttgctggtgctgtgctattcgatcgtggagaatacctgcatcataacccccacagccaaggcctggaagtacatggaggaggagatccttggtttcgggaagtcggtctgtgacagccttgggcggcgacacatgtctacctgtgccctctgtgacttctgctccttgaagctggagcagtgccactcagaggccagcctgcagcggcaacaatgcgacacctcccacaagactccctttgtcagccccttgcttgcctcccagagcctgtccatcggcaaccaggtagggtccccagaatcaggccgcttttacgggctggatttgtacgtcgggcatcctctatgacataggaatagagccaggtccacgagaaagaactgcgaggacggtagactgtatagtgccggcaccagagcgagtgctgtaacgggacaggatgcgaatggcgctcaacgcaagagggtgtcgacatcgagtatcacagggcaaggatgcgacatggtcgtctcgggacaggatgccgagctggtgtctgcgggagagagccgacgagtcgggtcgtcgtccacagatatgca

SEQ ID NO: 42461 - DNA, 2407 bp, Homo sapiens
cgtgcgccccgccccgcgcctgcggctctctctgcggcttggcccgttagaggcggcttgtgtccacgggacgcgggcggatcttctccggccatgaggaagccagccgctggcttccttccctcactcctgaaggtgctgctcctgcctctggcacctgccgcagcccaggattcgactcaggcctccactccaggcagccctctctctcctaccgaatacgaacgcttcttcgcactcctgaaggtgctgctcctgcctctggcacctgccgcagcccaggattcgactcaggcctccactccaggcagccctctctctcctaccgaatacgaacgcttcttcgcactgctgactccaacctggaaggcagagactacctgccgtctccgtgcaacccacggctgccggaatcccacactcgtccagctggaccaatatgaaaaccacggcttagtgcccgatggtgctgtctgctccaacctcccttatgcctcctggtttgagtctttctgccagttcactcactaccgttgctccaaccacgtctactatgccaagagagtcctgtgttcccagccagtctctattctctcacctaacactctcaaggagatagaagcttcagctgaagtctcacccaccacgatgacctcccccatctcaccccacttcacagtgacagaacgccagaccttccagccctggcctgagaggctcagcaacaacgtggaagagctcctacaatcctccttgtccctgggaggccaggagcaagcgccagagcacaagcaggagcaaggagtggagcacaggcaggagccgacacaagaacacaagcaggaagaggggcagaaacaggaagagcaagaagaggaacaggaagaggagggaaagcaggaagaaggacaggggactaaggagggacgggaggctgtgtctcagctgcagacagactcagagcccaagtttcactctgaatctctatcttctaacccttcctcttttgctccccgggtacgagaagtagagtctactcctatgataatggagaacatccaggagctcattcgatcagcccaggaaatagatgaaatgaatgaaatatatgatgagaactcctactggagaaaccaaaaccctggcagcctcctgcagctgccccacacagaggccttgctggtgctgtgctattcgatcgtggagaatacctgcatcataacccccacagccaaggcctggaagtacatggaggaggagatccttggtttcgggaagtcggtctgtgacagccttgggcggcgacacatgtctacctgtgccctctgtgacttctgctccttgaagctggagcagtgccactcagaggccagcctgcagcggcaacaatgcgacacctcccacaagactccctttgtcagccccttgcttgcctcccagagcctgtccatcggcaaccaggtagggtccccagaatcaggccgcttttacgggctggatttgtacggtgggctccacatggacttctggtgtgcccggcttgccacgaaaggctgtgaagatgtccgagtctctgggtggctccagactgagttccttagcttccaggatggggatttccctaccaagatttgtgacacagactatatccagtacccaaactactgttccttcaaaagccagcagtgtctgatgagaaaccgcaatcggaaggtgtcccgcatgagatgtctgcagaatgagacttacagtgcgctgagccctggcaaaagtgaggacgttgtgcttcgatggagccaggagttcagcaccttgactctaggccagttcggatgagctggcgtctattctgcccacaccccagcccaacctgcccacgttctctattgttttgagaccccattgctttcaggctgccccttctgggtctgttactcggcccctactcacatttccttgggttggagcaacagtcccagagagggccacggtgggagctgcgccctccttaaaagatgactttacataaaatgttgatcttcaaaaaaaaccaacaaagacaaaaaaagagacatagaaaacataaacagaaaagaataacaagagacacaaaaacaacaaagcacaaagagtaagaagacagaaaaaacaagaggggggggccgcaaaagaaaatactaccgtaggagcgggactaacgttgtgcgtgcagacaccacagacgagtgtagagagaagagcggtggcgccacactaagagagggagtacatttatactcgcgcgtagaggggagtacatggtataaaaccgcgagcgcgagatgaaaaaagcgatccgcaagggtgtgaattgtggaagggaaacacacaaacaggggggcgaggaacaacattggcggaaaacgat

SEQ ID NO: 42462 - DNA, 516 bp, Homo sapiens
gcggcttgtgtccacgggacgcgggcggatcttctccggccatgaggaagccagccgctggcttccttccctcactcctgaagggtgagaggtttacacctgctccaacagactctccccgggctagtcctctccctcccgagagctctgcttttacggtttctggatcgcttcctcatggtggtcgcgctgggtcggctccctaggtcctgggatactcccatctccccccgcccgcggccggacctttgcctctgtctctagactccccccgccctggtcagcagggataaccctcaccccgttcctaatttgccagtctgggtctgtctgtcctggtctcggagcgggttttggggttcggtccttccatcatccgttcgcccgctccgcagtgctgctcctgcctctggcacctgccgcagcccaggattcgactcaggcctccactccaggcagccctctctctcctaccgaatacgaacgcttcttcgcactgctgactccaacctggaa

SEQ ID NO: 42463 - DNA, 2407 bp, Homo sapiens
cgtgcgccccgccccgcgcctgcggctctctctgcggcttggcccgttagaggcggcttgtgtccacgggacgcgggcggatcttctccggccatgaggaagccagccgctggcttccttccctcactcctgaaggtgctgctcctgcctctggcacctgccgcagcccaggattcgactcaggcctccactccaggcagccctctctctcctaccgaatacgaacgcttcttcgcactgctgactccaacctggaaggcagagactacctgccgtctccgtgcaacccacggctgccggaatcccacactcgtccagctggaccaatatgaaaaccacggcttagtgcccgatggtgctgtctgctccaacctcccttatgcctcctggtttgagtctttctgccagttcactcactaccgttgctccaaccacgtctactatgccaagagagtcctgtgttcccagccagtctctattctctcacctaacactctcaaggagatagaagcttcagctgaagtctcacccaccacgatgacctcccccatctcaccccacttcacagtgacagaacgccagaccttccagccctggcctgagaggctcagcaacaacgtggaagagctcctacaatcctccttgtccctgggaggccaggagcaagcgccagagcacaagcaggagcaaggagtggagcacaggcaggagccgacacaagaacacaagcaggaagaggggcagaaacaggaagagcaagaagaggaacaggaagaggagggaaagcaggaagaaggacaggggactaaggagggacgggaggctgtgtctcagctgcagacagactcagagcccaagtttcactctgaatctctatcttctaacccttcctcttttgctccccgggtacgagaagtagagtctactcctatgataatggagaacatccaggagctcattcgatcagcccaggaaatagatgaaatgaatgaaatatatgatgagaactcctactggagaaaccaaaaccctggcagcctcctgcagctgccccacacagaggccttgctggtgctgtgctattcgatcgtggagaatacctgcatcataacccccacagccaaggcctggaagtacatggaggaggagatccttggtttcgggaagtcggtctgtgacagccttgggcggcgacacatgtctacctgtgccctctgtgacttctgctccttgaagctggagcagtgccactcagaggccagcctgcagcggcaacaatgcgacacctcccacaagactccctttgtcagccccttgcttgcctcccagagcctgtccatcggcaaccaggtagggtccccagaatcaggccgcttttacgggctggatttgtacggtgggctccacatggacttctggtgtgcccggcttgccacgaaaggctgtgaagatgtccgagtctctgggtggctccagactgagttccttagcttccaggatggggatttccctaccaagatttgtgacacagactatatccagtacccaaactactgttccttcaaaagccagcagtgtctgatgagaaaccgcaatcggaagtcctggcggaagcaaggccctcctaggcagctggtggataacagaggagggtcctaagagcaccacaggaagaacccttggctgggccaggacttggacgttgaggtctcggtgtcccgcatgagatgtctgcagaatgagacttacagtgcgctgagccctggcaaaagtgaggacgttgtgcttcgatggagccaggagttcagcaccttgactctaggccagttcggatgagctggcgtctattctgcccacaccccagcccaacctgcccacgttctctattgttttgagaccccattgctttcaggctgccccttctgggtctgttactcggcccctactcacatttccttgggttggagcaacagtcccagagagggccacggtgggagctgcgccctccttaaaagatgactttacataaaatgttgatcttcaaaaaaaaccaacaaagacaaaaaaagagacatagaaaacataaacagaaaagaataacaagagacacaaaaacaacaaagcacaaagagtaagaagacagaaaaaacaagaggggggggccgcaaaagaaaatactaccgtaggagcgggactaacgttgtgcgtgcagacaccacagacgagtgtagagagaagagcggtggcgccacactaagagagggagtacatttatactcgcgcgtagaggggagtacatggtataaaaccgcgagcgcgagatgaaaaaagcgatccgcaagggtgtgaattgtggaagggaaacacacaaacaggggggcgaggaacaacattggcggaaaacgat

SEQ ID NO: 42464 - DNA, 1649 bp, Homo sapiens
cgtgcgccccgccccgcgcctgcggctctctctgcggcttggcccgttagaggcggcttgtgtccacgggacgcgggcggatcttctccggccatgaggaagccagccgctggcttccttccctcactcctgaaggtgctgctcctgcctctggcacctgccgcagcccaggattcgactcaggcctccactccaggcagccctctctctcctaccgaatacgaacgcttcttcgcactgctgactccaacctggaaggcagagactacctgccgtctccgtgcaacccacggctgccggaatcccacactcgtccagctggaccaatatgaaaaccacggcttagtgcccgatggtgctgtctgctccaacctcccttatgcctcctggtttgagtctttctgccagttcactcactaccgttgctccaaccacgtctactatgccaagagagtcctgtgttcccagccagtctctattctctcacctaacactctcaaggagatagaagcttcagctgaagtctcacccaccacgatgacctcccccatctcaccccacttcacagtgacagaacgccagaccttccagccctggcctgagaggctcagcaacaacgtggaagagctcctacaatcctccttgtccctgggaggccaggagcaagcgccagagcacaagcaggagcaaggagtggagcacaggcaggagccgacacaagaacacaagcaggaagaggggcagaaacaggaagagcaagaagaggaacaggaagaggagggaaagcaggaagaaggacaggggactaaggagggacgggaggctgtgtctcagctgcagacagactcagagcccaagtttcactctgaatctctatcttctaacccttcctcttttgctccccgggtacgagaagtagagtctactcctatgataatggagaacatccaggagctcattcgatcagcccaggaaatagatgaaatgaatgaaatatatgatgagaactcctactggagaaaccaaaaccctggcagcctcctgcagctgccccacacagaggccttgctggtgctgtgctattcgatcgtggagaatacctgcatcataacccccacagccaaggcctggaagtacatggaggaggagatccttggtttcgggaagtcggtctgtgacagccttgggcggcgacacatgtctacctgtgccctctgtgacttctgctccttgaagctggagcagtgccactcagaggccagcctgcagcggcaacaatgcgacacctcccacaagactccctttgtcagccccttgcttgcctcccagagcctgtccatcggcaaccaggtagggtccccagaatcaggccgcttttacgggctggatttgtacggtgggctccacatggacttctggtgtgcccggcttgccacgaaaggctgtgaagatgtccgagtctctgggtggctccagactgagttccttagcttccaggatggggatttccctaccaagatttgtgacacagactatatccagtacccaaactactgttccttcaaaagccagcagtgtctgatgagaaaccgcaatcggaaggtgagcacccctgccctgcccctccttctcccagcaccccctcaatc

SEQ ID NO: 42465 - DNA, 2134 bp, Homo sapiens
gctggtacaggtcccgagttttggggatctccaggcagccctctctctcctaccgaatacgaacgcttcttcgcactgctgactccaacctggaaggcagagactacctgccgtctccgtgcaacccacggctgccggaatcccacactcgtccagctggaccaatatgaaaaccacggcttagtgcccgatggtgctgtctgctccaacctcccttatgcctcctggtttgagtctttctgccagttcactcactaccgttgctccaaccacgtctactatgccaagagagtcctgtgttcccagccagtctctattctctcacctaacactctcaaggagatagaagcttcagctgaagtctcacccaccacgatgacctcccccatctcaccccacttcacagtgacagaacgccagaccttccagccctggcctgagaggctcagcaacaacgtggaagagctcctacaatcctccttgtccctgggaggccaggagcaagcgccagagcacaagcaggagcaaggagtggagcacaggcaggagccgacacaagaacacaagcaggaagaggggcagaaacaggaagagcaagaagaggaacaggaagaggagggaaagcaggaagaaggacaggggactaaggagggacgggaggctgtgtctcagctgcagacagactcagagcccaagtttcactctgaatctctatcttctaacccttcctcttttgctccccgggtacgagaagtagagtctactcctatgataatggagaacatccaggagctcattcgatcagcccaggaaatagatgaaatgaatgaaatatatgatgagaactcctactggagaaaccaaaaccctggcagcctcctgcagctgccccacacagaggccttgctggtgctgtgctattcgatcgtggagaatacctgcatcataacccccacagccaaggcctggaagtacatggaggaggagatccttggtttcgggaagtcggtctgtgacagccttgggcggcgacacatgtctacctgtgccctctgtgacttctgctccttgaagctggagcagtgccactcagaggccagcctgcagcggcaacaatgcgacacctcccacaagactccctttgtcagccccttgcttgcctcccagagcctgtccatcggcaaccaggtagggtccccagaatcaggccgcttttacgggctggatttgtacggtgggctccacatggacttctggtgtgcccggcttgccacgaaaggctgtgaagatgtccgagtctctgggtggctccagactgagttccttagcttccaggatggggatttccctaccaagatttgtgacacagactatatccagtacccaaactactgttccttcaaaagccagcagtgtctgatgagaaaccgcaatcggaaggtgtcccgcatgagatgtctgcagaatgagacttacagtgcgctgagccctggcaaaagtgaggacgttgtgcttcgatggagccaggagttcagcaccttgactctaggccagttcggatgagctggcgtctattctgcccacaccccagcccaacctgcccacgttctctattgttttgagaccccattgctttcaggctgccccttctgggtctgttactcggcccctactcacatttccttgggttggagcaacagtcccagagagggccacggtgggagctgcgccctccttaaaagatgactttacataaaatgttgatcttcaaaaaaaaccaacaaagacaaaaaaagagacatagaaaacataaacagaaaagaataacaagagacacaaaaacaacaaagcacaaagagtaagaagacagaaaaaacaagaggggggggccgcaaaagaaaatactaccgtaggagcgggactaacgttgtgcgtgcagacaccacagacgagtgtagagagaagagcggtggcgccacactaagagagggagtacatttatactcgcgcgtagaggggagtacatggtataaaaccgcgagcgcgagatgaaaaaagcgatccgcaagggtgtgaattgtggaagggaaacacacaaacaggggggcgaggaacaacattggcggaaaacgat

SEQ ID NO: 42466 - DNA, 2201 bp, Homo sapiens
cgtgcgccccgccccgcgcctgcggctctctctgcggcttggcccgttagaggcggcttgtgtccacgggacgcgggcggatcttctccggccatgaggaagccagccgctggcttccttccctcactcctgaaggtgctgctcctgcctctggcacctgccgcagcccaggattcgactcaggcctccactccaggcagccctctctctcctaccgaatacgaacgcttcttcgcactgctgactccaacctggaaggcagagactacctgccgtctccgtgcaacccacggctgccggaatcccacactcgtccagctggaccaatatgaaaaccacggcttagtgcccgatgagagtcctgtgttcccagccagtctctattctctcacctaacactctcaaggagatagaagcttcagctgaagtctcacccaccacgatgacctcccccatctcaccccacttcacagtgacagaacgccagaccttccagccctggcctgagaggctcagcaacaacgtggaagagctcctacaatcctccttgtccctgggaggccaggagcaagcgccagagcacaagcaggagcaaggagtggagcacaggcaggagccgacacaagaacacaagcaggaagaggggcagaaacaggaagagcaagaagaggaacaggaagaggagggaaagcaggaagaaggacaggggactaaggagggacgggaggctgtgtctcagctgcagacagactcagagcccaagtttcactctgaatctctatcttctaacccttcctcttttgctccccgggtacgagaagtagagtctactcctatgataatggagaacatccaggagctcattcgatcagcccaggaaatagatgaaatgaatgaaatatatgatgagaactcctactggagaaaccaaaaccctggcagcctcctgcagctgccccacacagaggccttgctggtgctgtgctattcgatcgtggagaatacctgcatcataacccccacagccaaggcctggaagtacatggaggaggagatccttggtttcgggaagtcggtctgtgacagccttgggcggcgacacatgtctacctgtgccctctgtgacttctgctccttgaagctggagcagtgccactcagaggccagcctgcagcggcaacaatgcgacacctcccacaagactccctttgtcagccccttgcttgcctcccagagcctgtccatcggcaaccaggtagggtccccagaatcaggccgcttttacgggctggatttgtacggtgggctccacatggacttctggtgtgcccggcttgccacgaaaggctgtgaagatgtccgagtctctgggtggctccagactgagttccttagcttccaggatggggatttccctaccaagatttgtgacacagactatatccagtacccaaactactgttccttcaaaagccagcagtgtctgatgagaaaccgcaatcggaaggtgtcccgcatgagatgtctgcagaatgagacttacagtgcgctgagccctggcaaaagtgaggacgttgtgcttcgatggagccaggagttcagcaccttgactctaggccagttcggatgagctggcgtctattctgcccacaccccagcccaacctgcccacgttctctattgttttgagaccccattgctttcaggctgccccttctgggtctgttactcggcccctactcacatttccttgggttggagcaacagtcccagagagggccacggtgggagctgcgccctccttaaaagatgactttacataaaatgttgatcttcaaaaaaaaccaacaaagacaaaaaaagagacatagaaaacataaacagaaaagaataacaagagacacaaaaacaacaaagcacaaagagtaagaagacagaaaaaacaagaggggggggccgcaaaagaaaatactaccgtaggagcgggactaacgttgtgcgtgcagacaccacagacgagtgtagagagaagagcggtggcgccacactaagagagggagtacatttatactcgcgcgtagaggggagtacatggtataaaaccgcgagcgcgagatgaaaaaagcgatccgcaagggtgtgaattgtggaagggaaacacacaaacaggggggcgaggaacaacattggcggaaaacgat

SEQ ID NO: 42467 - DNA, 382 bp, Homo sapiens
aactcaggggcgagctgctaactcagggcgagctgctaactcagggcgagctgctaactcaggggcgagctgctcccgaggtggccttgagaaggaagaagcaggatgacagagcctgagcagcggaaccagcctgcaccctcccttctggcccagcgacctgggctgtggctgagacaataatgaggccagaagtagccggagcctgtcaggaagggcaggggaggactgtggggtctgggctctgtcgctgtaaccatctgctcccaggctgtgtgcagaaaatggcatttacactattgtgcagctcattctcatgaaatactgccattgttgctaaataaagcttgtgtgctctgaatatagccaagcaaaaaaaaag

SEQ ID NO: 42468 - DNA, 2994 bp, Homo sapiens
agcggagagcgtcccccggcgaggacgagcgagcacggcgcccgcacctccccgcaccgcccgcgctgcgcgcccggaggagcgaccgccgcagttctcgagctccagctgcattccctccgcgtccgccccacgcttctcccgctccgggccccgcaatggcccaggcagtgtggtcgcgcctcggccgcatcctctggcttgcctgcctcctgccctgggccccggcaggggtggccgcaggcctgtatgaactcaatctcaccaccgatagccctgccaccacgggagcggtggtgaccatctcggccagcctggtggccaaggacaacggcagcctggccctgcccgctgacgcccacctctaccgcttccactggatccacaccccgctggtgcttactggcaagatggagaagggtctcagctccaccatccgtgtggtcggccacgtgcccggggaattcccggtctctgtctgggtcactgccgctgactgctggatgtgccagcctgtggccaggggctttgtggtcctccccatcacagagttcctcgtgggggaccttgttgtcacccagaacacttccctaccctggcccagctcctatctcactaagaccgtcctgaaagtctccttcctcctccacgacccgagcaacttcctcaagaccgccttgtttctctacagctgggacttcggggacgggacccagatggtgactgaagactccgtggtctattataactattccatcatcgggaccttcaccgtgaagctcaaagtggtggcggagtgggaagaggtggagccggatgccacgagggctgtgaagcagaagaccggggacttctccgcctcgctgaagctgcaggaaacccttcgaggcatccaagtgttggggcccaccctaattcagaccttccaaaagatgaccgtgaccttgaacttcctggggagccctcctctgactgtgtgctggcgtctcaagcctgagtgcctcccgctggaggaaggggagtgccaccctgtgtccgtggccagcacagcgtacaacctgacccacaccttcagggaccctggggactactgcttcagcatccgggccgagaatatcatcagcaagacacatcagtaccacaagatccaggtgtggccctccagaatccagccggctgtctttgctttcccatgtgctacacttatcactgtgatgttggccttcatcatgtacatgaccctgcggaatgccactcagcaaaaggacatggtggagaacccggagccaccctctggggtcaggtgctgctgccagatgtgctgtgggcctttcttgctggagactccatctgagtacctggaaattgttcgtgagaaccacgggctgctcccgcccctctataagtctgtcaaaacttacaccgtgtgagcactccccctccccaccccatctcagtgttaactgactgctgacttggagtttccagcagggtggtgtgcaccactgaccaggaggggttcatttgcgtggggctgttggcctggatcatccatccatctgtacagttcagccactgccacaagcccctccctctctgtcacccctgaccccagccattcacccatctgtacagtccagccactgacataagccccactcggttaccacccccttgaccccctacctttgaagaggcttcgtgcaggactttgatgcttggggtgttccgtgttgactcccaggtgggcctggctgcccactgcccattcctctcatattggcacatctgctgtccattgggggttctcagtttcctcccccagacagccctacctgtgccagagagctagaaagaaggtcataaagggttaaaaatccataactaaaggttgtacacatagatgggcacactcacagagagaagtgtgcatgtacacacaccacacacacacacacacacacacacacagaaatataaacacatgcgtcacatgggcatttcagatgatcagctctgtatctggttaagtcggttgctgggatgcaccctgcactagagctgaaaggaaatttgacctccaagcagccctgacaggttctgggcccgggccctccctttgtgctttgtctctgcagttcttgcgccctttataaggccatcctagtccctgctggctggcagggggctggatggggggcaggactaatactgagtgattgcagagtgctttataaatatcaccttattttatcgaaacccatctgtgaaactttcactgaggaaaaggccttgcagcggtagaagaggttgagtcaaggccgggcgcggtggctcacgcctgtaatcccagcactttgggaggccgaggcgggtggatcacgagatcaggagatcgagaccaccctggctaacacggtgaaaccccgtctctactaaaaaaatacaaaaagttagccgggcgtggtggtgggtgcctgtagtcccagctactcgggaggctgaggcaggagaatggtgcgaacccgggaggcggagcttgcagtgagcccagatggcgccactgcactccagcctgagtgacagagcgagactctgtctccaaaaaaaaaaaaaagaagaggttgagtcagcagggacttgggttccctgtgtgtgaggggggcattcttgcctgccagctgctcccgaggtggccttgagaaggaagaagcaggatgacagagcctgagcagcggaaccagcctgcaccctcccttctggcccagcgacctgggctgtggctgagacaataatgaggccagaagtagccggagcctgtcaggaagggcaggggaggactgtggggtctgggctctgtcgctgtaaccatctgctcccaggctgtgtgcagaaaatggcatttacactattgtgcagctcattctcatgaaatactgccattgttgctaaataaagcttgtgtgctctgaatatagccaagcaaaaaaaaag

SEQ ID NO: 42469 - DNA, 2844 bp, Homo sapiens
agcggagagcgtcccccggcgaggacgagcgagcacggcgcccgcacctccccgcaccgcccgcgctgcgcgcccggaggagcgaccgccgcagttctcgagctccagctgcattccctccgcgtccgccccacgcttctcccgctccgggccccgcaatggcccaggcagtgtggtcgcgcctcggccgcatcctctggcttgcctgcctcctgccctgggccccggcaggggtggccgcaggcctgtatgaactcaatctcaccaccgatagccctgccaccacgggagcggtggtgaccatctcggccagcctggtggccaaggacaacggcagcctggccctgcccgctgacgcccacctctaccgcttccactggatccacaccccgctggtgcttactggcaagatggagaagggtctcagctccaccatccgtgtggtcggccacgtgcccggggaattcccggtctctgtctgggtcactgccgctgactgctggatgtgccagcctgtggccaggggctttgtggtcctccccatcacagagttcctcgtgggggaccttgttgtcacccagaacacttccctaccctggcccagctcctatctcactaagaccgtcctgaaagtctccttcctcctccacgacccgagcaacttcctcaagaccgccttgtttctctacagctgggacttcggggacgggacccagatggtgactgaagactccgtggtctattataactattccatcatcgggaccttcaccgtgaagctcaaagtggtggcggagtgggaagaggtggagccggatgccacgagggctgtgaagcagaagaccggggacttctccgcctcgctgaagctgcaggaaacccttcgaggcatccaagtgttggggcccaccctaattcagaccttccaaaagatgaccgtgaccttgaacttcctggggagccctcctctgactgtgtgctggcgtctcaagcctgagtgcctcccgctggaggaaggggagtgccaccctgtgtccgtggccagcacagcgtacaacctgacccacaccttcagggaccctggggactactgcttcagcatccgggccgagaatatcatcagcaagacacatcagtaccacaagatccaggtgtggccctccagaatccagccggctgtctttgctttcccatgtgctacacttatcactgtgatgttggccttcatcatgtacatgaccctgcggaatgccactcagcaaaaggacatggtggagaacccggagccaccctctggggtcaggtgctgctgccagatgtgctgtgggcctttcttgctggagactccatctgagtacctggaaattgttcgtgagaaccacgggctgctcccgcccctctataagtctgtcaaaacttacaccgtgtgagcactccccctccccaccccatctcagtgttaactgactgctgacttggagtttccagcagggtggtgtgcaccactgaccaggaggggttcatttgcgtggggctgttggcctggatcatccatccatctgtacagttcagccactgccacaagcccctccctctctgtcacccctgaccccagccattcacccatctgtacagtccagccactgacataagccccactcggttaccacccccttgaccccctacctttgaagagagctagaaagaaggtcataaagggttaaaaatccataactaaaggttgtacacatagatgggcacactcacagagagaagtgtgcatgtacacacaccacacacacacacacacacacacacacagaaatataaacacatgcgtcacatgggcatttcagatgatcagctctgtatctggttaagtcggttgctgggatgcaccctgcactagagctgaaaggaaatttgacctccaagcagccctgacaggttctgggcccgggccctccctttgtgctttgtctctgcagttcttgcgccctttataaggccatcctagtccctgctggctggcagggggctggatggggggcaggactaatactgagtgattgcagagtgctttataaatatcaccttattttatcgaaacccatctgtgaaactttcactgaggaaaaggccttgcagcggtagaagaggttgagtcaaggccgggcgcggtggctcacgcctgtaatcccagcactttgggaggccgaggcgggtggatcacgagatcaggagatcgagaccaccctggctaacacggtgaaaccccgtctctactaaaaaaatacaaaaagttagccgggcgtggtggtgggtgcctgtagtcccagctactcgggaggctgaggcaggagaatggtgcgaacccgggaggcggagcttgcagtgagcccagatggcgccactgcactccagcctgagtgacagagcgagactctgtctccaaaaaaaaaaaaaagaagaggttgagtcagcagggacttgggttccctgtgtgtgaggggggcattcttgcctgccagctgctcccgaggtggccttgagaaggaagaagcaggatgacagagcctgagcagcggaaccagcctgcaccctcccttctggcccagcgacctgggctgtggctgagacaataatgaggccagaagtagccggagcctgtcaggaagggcaggggaggactgtggggtctgggctctgtcgctgtaaccatctgctcccaggctgtgtgcagaaaatggcatttacactattgtgcagctcattctcatgaaatactgccattgttgctaaataaagcttgtgtgctctgaatatagccaagcaaaaaaaaag

SEQ ID NO: 42470 - DNA, 1703 bp, Homo sapiens
ccccgttctgcaggaatccggttcgatgtgctgtgggcctttcttgctggagactccatctgagtacctggaaattgttcgtgagaaccacgggctgctcccgcccctctataagtctgtcaaaacttacaccgtgtgagcactccccctccccaccccatctcagtgttaactgactgctgacttggagtttccagcagggtggtgtgcaccactgaccaggaggggttcatttgcgtggggctgttggcctggatcatccatccatctgtacagttcagccactgccacaagcccctccctctctgtcacccctgaccccagccattcacccatctgtacagtccagccactgacataagccccactcggttaccacccccttgaccccctacctttgaagaggcttcgtgcaggactttgatgcttggggtgttccgtgttgactcccaggtgggcctggctgcccactgcccattcctctcatattggcacatctgctgtccattgggggttctcagtttcctcccccagacagccctacctgtgccagagagctagaaagaaggtcataaagggttaaaaatccataactaaaggttgtacacatagatgggcacactcacagagagaagtgtgcatgtacacacaccacacacacacacacacacacacacacagaaatataaacacatgcgtcacatgggcatttcagatgatcagctctgtatctggttaagtcggttgctgggatgcaccctgcactagagctgaaaggaaatttgacctccaagcagccctgacaggttctgggcccgggccctccctttgtgctttgtctctgcagttcttgcgccctttataaggccatcctagtccctgctggctggcagggggctggatggggggcaggactaatactgagtgattgcagagtgctttataaatatcaccttattttatcgaaacccatctgtgaaactttcactgaggaaaaggccttgcagcggtagaagaggttgagtcaaggccgggcgcggtggctcacgcctgtaatcccagcactttgggaggccgaggcgggtggatcacgagatcaggagatcgagaccaccctggctaacacggtgaaaccccgtctctactaaaaaaatacaaaaagttagccgggcgtggtggtgggtgcctgtagtcccagctactcgggaggctgaggcaggagaatggtgcgaacccgggaggcggagcttgcagtgagcccagatggcgccactgcactccagcctgagtgacagagcgagactctgtctccaaaaaaaaaaaaaagaagaggttgagtcagcagggacttgggttccctgtgtgtgaggggggcattcttgcctgccagctgctcccgaggtggccttgagaaggaagaagcaggatgacagagcctgagcagcggaaccagcctgcaccctcccttctggcccagcgacctgggctgtggctgagacaataatgaggccagaagtagccggagcctgtcaggaagggcaggggaggactgtggggtctgggctctgtcgctgtaaccatctgctcccaggctgtgtgcagaaaatggcatttacactattgtgcagctcattctcatgaaatactgccattgttgctaaataaagcttgtgtgctctgaatatagccaagcaaaaaaaaag

SEQ ID NO: 42471 - DNA, 1419 bp, Homo sapiens
tcggcccggtgacttgagtatccctgcactgtagatcgttccattcacccatctgtacagtccagccactgacataagccccactcggttaccacccccttgaccccctacctttgaagaggcttcgtgcaggactttgatgcttggggtgttccgtgttgactcccaggtgggcctggctgcccactgcccattcctctcatattggcacatctgctgtccattgggggttctcagtttcctcccccagacagccctacctgtgccagagagctagaaagaaggtcataaagggttaaaaatccataactaaaggttgtacacatagatgggcacactcacagagagaagtgtgcatgtacacacaccacacacacacacacacacacacacacagaaatataaacacatgcgtcacatgggcatttcagatgatcagctctgtatctggttaagtcggttgctgggatgcaccctgcactagagctgaaaggaaatttgacctccaagcagccctgacaggttctgggcccgggccctccctttgtgctttgtctctgcagttcttgcgccctttataaggccatcctagtccctgctggctggcagggggctggatggggggcaggactaatactgagtgattgcagagtgctttataaatatcaccttattttatcgaaacccatctgtgaaactttcactgaggaaaaggccttgcagcggtagaagaggttgagtcaaggccgggcgcggtggctcacgcctgtaatcccagcactttgggaggccgaggcgggtggatcacgagatcaggagatcgagaccaccctggctaacacggtgaaaccccgtctctactaaaaaaatacaaaaagttagccgggcgtggtggtgggtgcctgtagtcccagctactcgggaggctgaggcaggagaatggtgcgaacccgggaggcggagcttgcagtgagcccagatggcgccactgcactccagcctgagtgacagagcgagactctgtctccaaaaaaaaaaaaaagaagaggttgagtcagcagggacttgggttccctgtgtgtgaggggggcattcttgcctgccagctgctcccgaggtggccttgagaaggaagaagcaggatgacagagcctgagcagcggaaccagcctgcaccctcccttctggcccagcgacctgggctgtggctgagacaataatgaggccagaagtagccggagcctgtcaggaagggcaggggaggactgtggggtctgggctctgtcgctgtaaccatctgctcccaggctgtgtgcagaaaatggcatttacactattgtgcagctcattctcatgaaatactgccattgttgctaaataaagcttgtgtgctctgaatatagccaagcaaaaaaaaag

SEQ ID NO: 42472 - DNA, 2688 bp, Homo sapiens
agcggagagcgtcccccggcgaggacgagcgagcacggcgcccgcacctccccgcaccgcccgcgctgcgcgcccggaggagcgaccgccgcagttctcgagctccagctgcattccctccgcgtccgccccacgcttctcccgctccgggccccgcaatggcccaggcagtgtggtcgcgcctcggccgcatcctctggcttgcctgcctcctgccctgggccccggcaggggtggccgcagagttcctcgtgggggaccttgttgtcacccagaacacttccctaccctggcccagctcctatctcactaagaccgtcctgaaagtctccttcctcctccacgacccgagcaacttcctcaagaccgccttgtttctctacagctgggacttcggggacgggacccagatggtgactgaagactccgtggtctattataactattccatcatcgggaccttcaccgtgaagctcaaagtggtggcggagtgggaagaggtggagccggatgccacgagggctgtgaagcagaagaccggggacttctccgcctcgctgaagctgcaggaaacccttcgaggcatccaagtgttggggcccaccctaattcagaccttccaaaagatgaccgtgaccttgaacttcctggggagccctcctctgactgtgtgctggcgtctcaagcctgagtgcctcccgctggaggaaggggagtgccaccctgtgtccgtggccagcacagcgtacaacctgacccacaccttcagggaccctggggactactgcttcagcatccgggccgagaatatcatcagcaagacacatcagtaccacaagatccaggtgtggccctccagaatccagccggctgtctttgctttcccatgtgctacacttatcactgtgatgttggccttcatcatgtacatgaccctgcggaatgccactcagcaaaaggacatggtggagaacccggagccaccctctggggtcaggtgctgctgccagatgtgctgtgggcctttcttgctggagactccatctgagtacctggaaattgttcgtgagaaccacgggctgctcccgcccctctataagtctgtcaaaacttacaccgtgtgagcactccccctccccaccccatctcagtgttaactgactgctgacttggagtttccagcagggtggtgtgcaccactgaccaggaggggttcatttgcgtggggctgttggcctggatcatccatccatctgtacagttcagccactgccacaagcccctccctctctgtcacccctgaccccagccattcacccatctgtacagtccagccactgacataagccccactcggttaccacccccttgaccccctacctttgaagaggcttcgtgcaggactttgatgcttggggtgttccgtgttgactcccaggtgggcctggctgcccactgcccattcctctcatattggcacatctgctgtccattgggggttctcagtttcctcccccagacagccctacctgtgccagagagctagaaagaaggtcataaagggttaaaaatccataactaaaggttgtacacatagatgggcacactcacagagagaagtgtgcatgtacacacaccacacacacacacacacacacacacacagaaatataaacacatgcgtcacatgggcatttcagatgatcagctctgtatctggttaagtcggttgctgggatgcaccctgcactagagctgaaaggaaatttgacctccaagcagccctgacaggttctgggcccgggccctccctttgtgctttgtctctgcagttcttgcgccctttataaggccatcctagtccctgctggctggcagggggctggatggggggcaggactaatactgagtgattgcagagtgctttataaatatcaccttattttatcgaaacccatctgtgaaactttcactgaggaaaaggccttgcagcggtagaagaggttgagtcaaggccgggcgcggtggctcacgcctgtaatcccagcactttgggaggccgaggcgggtggatcacgagatcaggagatcgagaccaccctggctaacacggtgaaaccccgtctctactaaaaaaatacaaaaagttagccgggcgtggtggtgggtgcctgtagtcccagctactcgggaggctgaggcaggagaatggtgcgaacccgggaggcggagcttgcagtgagcccagatggcgccactgcactccagcctgagtgacagagcgagactctgtctccaaaaaaaaaaaaaagaagaggttgagtcagcagggacttgggttccctgtgtgtgaggggggcattcttgcctgccagctgctcccgaggtggccttgagaaggaagaagcaggatgacagagcctgagcagcggaaccagcctgcaccctcccttctggcccagcgacctgggctgtggctgagacaataatgaggccagaagtagccggagcctgtcaggaagggcaggggaggactgtggggtctgggctctgtcgctgtaaccatctgctcccaggctgtgtgcagaaaatggcatttacactattgtgcagctcattctcatgaaatactgccattgttgctaaataaagcttgtgtgctctgaatatagccaagcaaaaaaaaag

SEQ ID NO: 42473 - DNA, 400 bp, Homo sapiens
attattggaggctccatcaaacaggttctccttcctttgattaatggaaggagcccagtctttcgggtgtttctcctttgaagtatatcttactaaaatgtcttacctctgaagttcatttgcaacctcatatgcgactcttgctaatgtatatctgctcactaggtgtctagtttgaggggatgacaagagcatcatttactccctatgctcattcctgaaaccttattttattgcagtggaaactgagatctggccaaagtttgatgatttgcccaggctggcattaaaatacagttctcttctaccacccttttctgtcttcatgctatactccttgagatgatgaccacaagtttaagtttagtattgccataaagttggggttggggctttgcat

SEQ ID NO: 42474 - DNA, 681 bp, Homo sapiens
tttaaagtctgaagctcggccaggtgcggtggctcacgcctgtaatcccaaaactttggaaggctgaggcaggtggatcacctgaggtcaggaggagttcaagaccagcctggccaacgtggtgaaaccccatctctataaaagtacaaaagggcatgatggcaggtgcctgtaatctcagctactcagtaggctggagcgggagaattgcttgaacctgggaggtggaggtttcagtgagccaagatagcgccattgcactccagcgtgggcgacagcaagagacttcatttcgataaataagtaaataaataaataaagtctgaagctccactggtcactccttttattgattatttgcagctggtctaaccagttacgtatgtctggcttgattacatggccagagcaacataaaagccctgctgggaacttctgatttgagctcttccaaaaccaggatggatgcctcacatagatcatgatgattcaatccaaaggcactttgcagtgcagtccacatgtgcataaggaccatggggagcttgtatttgggaattctgagattcctgatgtttacctacctagtctttctcttgctgccctgtatcctttgcctttaaataaaaatcttaagtgataatgctctgtgaagcctggataatcctttcaaatatttgg

SEQ ID NO: 42475 - DNA, 641 bp, Homo sapiens
tttaaagtctgaagctcggccaggtgcggtggctcacgcctgtaatcccaaaactttggaaggctgaggcaggtggatcacctgaggtcaggaggagttcaagaccagcctggccaacgtggtgaaaccccatctctataaaagtacaaaagggcatgatggcaggtgcctgtaatctcagctactcagtaggctggagcgggagaattgcttgaacctgggaggtggaggtttcagtgagccaagatagcgccattgcactccagcgtgggcgacagcaagagacttcatttcgataaataagtaaataaataaataaagtctgaagctccactggtcactccttttattgattatttgcagctggtctaaccagttacgtatgtctggcttgattacatggccagagcaacataaaagccctgctgggaacttctgatttgagctcttccaaaaccaggatggatgcctcacatagatcatgatgattcaatccaaaggcactttgcagtgcagtccacatgtgcataaggaccatggggagcttgtatttgggaattctgagattcctgatgtttacctacctagtctttctcttgctgccctgtatcctttgcctttaaataaaaatcttaagtgat

SEQ ID NO: 42476 - DNA, 4676 bp, Homo sapiens
  misc_feature (1300)..(1300): n is a, c, g, or t
  misc_feature (2594)..(2594): n is a, c, g, or t
ggttggctcttgcacttcctggctctctggacttggttatgtgattgagcctccatggcctccgtgtctttgtctgtcaatgggtttgattaaagcgttgacctcataggttcttaggaggattaatgagaacattttatgtaaagctgcttacatggagccttggtatgtgccggaaagctttagccctttattaaaagtgacagcagacccagcacggtggctcatgcctgtaatcccagcactttgggaggctgaggcgggcagatcacttggggtcaggagttcgagaccagctactcgggaggcagaggcaggagaatcgcttgaacctggggtgcagaggttgcagtaagctgagctcgcaccactgcactccagcctgagtgacagagtgaaactcagtctcaaaaaaaaaaaaaaaaaaagagtggcagtagtggtgggggagacccccatcccccttgctggggtttcctaggaaagaaggctggtgagagctgttgctggtggtgggccctgagccgcagggtctgagggcctaccctgtgctaccccagagctgcctgagaactggacagacacgcgggagacgctgctggaggggatgctgttcagcctcaagtacctgggcatgacgctagtggagcagcccaagggtgaggagctgtcggccgccgccatcaagaggatcgtggctacagctaaggccagtgggaagaagctgcagaaggtgactctgaaggtgtcgccacggggaattatcctgacagacaacctcaccaaccagctcattgagaacgtgtccatatacaggatctcctattgcacagcagacaagatgcacgacaaggtgtttgcatacatcgcccagagccagcacaaccagagcctcgagtgccacgccttcctctgcaccaagcggaagatggcacaggctgttaccctcaccgtagcccaggccttcaaagtcgcctttgagttttggcaggtgtccaaggaagagaaagagaagagggacaaagccagccaagagggaggggacgtcctgggggcccgccaagactgcaccccccccttgaagagcttggtcgccactgggaacctgctggacttagaggagacggctaaggccccgctgtccacggtcagcgccaacaccaccaacatggacgaggtgccgcggccacaagccttgagtggcagcagtgttgtctgggtgagtggttgtgtggccagcagatcggtgatcctcagcctgacctctgggtgagcctggggctgctccagggaccaggcnctgggacccgtgacttgtgggcctctgggaggaccagacccagcccggtagtgcccaggcgcaggataggggatgaacaatgtcccttttgaacctgaggctgcatccccaacaggcttggctcccagcacagctgtctcctcacaatgcttggcctcttggcctgagcgtccacggctctgcccaccacaagaccagccaaaggcgcccttgttcttggtgtggcagagctcgctcctaccacccctccccctcagccgcctgaatgaggacccagagacttgggcagtcaccagcttggtccctgactccctcagggactcagggcaagccccctgacctctctgtctcagctttttcatctcagtaagggtgatgacctctgccaacggaatctccccgaggaacctgaaatttaattttaatttttcatttggaaataatttcagactgtgttacaaaattagtacagagaattcctgttcacccgtcatccagattccccaattgttaacatcttgcatgaccacattacactggtcagaatcaggaaacaaacacgatactgtgctgttatataatctatagaacttacacatttctccaggtgccccttcagtgtcctgtttctggcccaggatccattgcagaatcacatgttaacttgtcgtctctttaatttttaaaaatctgggtactgggggctcccctggtgtccctcgagcctgttctctgctgtttgggaaccacccttgccacttgcccatcctcaccagaaggccatggagggacctcacctgtcgcttttctgctgaggctgtgggactcctggcatcagttatccctcatgaacttggaattttggcttggcttttggaagtaaatgaaggcaagaaaactcccttccccaccctcttccttttggaatttgaaagccatagaagtcatcaggtccaatgccctcctcttattgaaggaaaagctgagtttcaacgtggagcagtgacttgcccaaggtctcacgggcaggtagcatggaccagggcactgaacccacctgggtctccagacaccctgggacatggcctttctcctctcccacgtctccagctttgggtccttgggctgagatgctggcgatgcacccaggcaggaggcctgcctgaggccgtgcctccaggcgcccaccctgagcttgtgtcctgagtccctgtagcttacccagggctgggacaagccccagctgtgagcatgggctcccccaaacatagttcttatctcctgctttgttttncccaaggagctggatgatggcctggatgaagcgttttcgaggcttgcccagtctcggacaaaccctcaggtcctggacactggcctgacagcccaggacatgcattacgcccagtgcctctcgcctgtcgactgggacaagcctgacagcagcggcacagagcaggatgacctcttcagcttctgagggcccggggccagccggacacaagcggccctgacacgtgatggaccaaagccacctgctgcgggggagccagttctggggcccgcctgccacctctcccagccctcagcattgtcagcctgaagatcagagctgcagccagtcaggcaggggagagatttttcttttaagccctgctctttctctgagaaccaaaagatgccttgaatatttattcagtgacttctggcttatgctcagaagccagtctgcgtcaggcacgtctcctgctgcgtgacatgtgcagtgctgtaatcggctcccgcttgctctcctggagcaagctctgccctggctgtgggtatcaggactgtgaccaaagcatttctagtcccttctctctttctaaggacccaaatttccctgggggcatcctgcttcctgaaagctgttggatttcagtgatttttccccccaccccccagcacaggagagcacccacagccgcagaaggggaatgtgtcctcctgctctgcttcctcagggcccagcaggcgggggtttgagccctggaccccaggctcttagagactaaggggcagctcctgaccaaagacgatacagcttggcactttaaagcattaacagcaggtgtgaccctgagggctcctccatggtgctgcattgagtccagctttccttctgcccttcctccaggagaaggggcccaaggtccccgtggatggtctccacctgtgcttggaaccagtgtaactggctgctccctgctcccagggactgacacggggatcatctctgtgaccgccctccgtcgggcccctgcctgccttctcccctccacgcaaggctgtgctcttcctctggtttctgtgtgtccgtttgagtgtctgcgccccgcctccccatacttcctgggatgatgtgtgaaacctgacacctagatttatttggaaatattctatgaccactttacagatgaggaaactgaggcctcaagcgtggaggggtagagtgaagagtagaacccaggtctgatgccaaagctgctttcttctctgcctcctcctcacgcaactcacacctccttttcttctagctttgttgtcctcccaggaaccaaaaaaccccagctattttctgaccaaaatgtgtttcataacaaaccatctggtgcctttccacacagaactggcaggagcctcgtgtcctgctagctgtctctcttgttgatttccgtgaaaatgcaagtgtttgaagtctgctcattccgagggtgaaacaaaatccaaccctgtcagaatcatgctgttctctttgctgacactgtgaccctgggtcgggacagaccagcagcaatctgtctttagaatctctttccttcctccccttttgcccccgtggggctcccggcatcctgaaagccagcaaagcctccagcatcttttccatcctgaggtgcctcccagtggcctggcttgtcggagcaagtttcatcagccctagggaaaacacggccctcctgggaacctccttacctggagtaaccggacaccttagacggaggtgcctgagggtggggtgggatttgcagggtcattatcagaacatgaggataacttccttgcccctgctctgtagccacctccttggcaccggcctctatttgtcataaggcggcgtgggcgaggcctgacacaggccagccttggcacgaggggggccaggggttctgagaagcgctgccctgtgagagccatgctggccttcgtctccatctctggttgacgggctgtccgtgtgcctcctgtgtgtctgcagacaagtcttgctgtgctttatttgtgaaactttaatgaggaaaaaacaaataataaatgttctcgttttgaaactcaa

SEQ ID NO: 42477 - DNA, 2883 bp, Homo sapiens
ggaaagtttttcctgacggagttttggctgcggcagcggcggcggcggccggagcgggccatggacgcgctcaagtcggcggggcgggcgctgatccggagccccagcttggccaagcagagctgggggggcggtggccggcaccgcaagctgcctgagaactggacagacacgcgggagacgctgctggaggggatgctgttcagcctcaagtacctgggcatgacgctagtggagcagcccaagggtgaggagctgtcggccgccgccatcaagaggatcgtggctacagctaaggccagtgggaagaagctgcagaaggtgactctgaaggtgtcgccacggggaattatcctgacagacaacctcaccaaccagctcattgagaacgtgtccatatacaggatctcctattgcacagcagacaagatgcacgacaaggtgtttgcatacatcgcccagagccagcacaaccagagcctcgagtgccacgccttcctctgcaccaagcggaagatggcacaggctgttaccctcaccgtagcccaggccttcaaagtcgcctttgagttttggcaggtgtccaaggaagagaaagagaagagggacaaagccagccaagagggaggggacgtcctgggggcccgccaagactgcaccccccccttgaagagcttggtcgccactgggaacctgctggacttagaggagacggctaaggccccgctgtccacggtcagcgccaacaccaccaacatggacgaggtgccgcggccacaagccttgagtggcagcagtgttgtctgggagctggatgatggcctggatgaagcgttttcgaggcttgcccagtctcggacaaaccctcaggtcctggacactggcctgacagcccaggacatgcattacgcccagtgcctctcgcctgtcgactgggacaagcctgacagcagcggcacagagcaggatgacctcttcagcttctgagggcccggggccagccggacacaagcggccctgacacgtgatggaccaaagccacctgctgcgggggagccagttctggggcccgcctgccacctctcccagccctcagcattgtcagcctgaagatcagagctgcagccagtcaggcaggggagagatttttcttttaagccctgctctttctctgagaaccaaaagatgccttgaatatttattcagtgacttctggcttatgctcagaagccagtctgcgtcaggcacgtctcctgctgcgtgacatgtgcagtgctgtaatcggctcccgcttgctctcctggagcaagctctgccctggctgtgggtatcaggactgtgaccaaagcatttctagtcccttctctctttctaaggacccaaatttccctgggggcatcctgcttcctgaaagctgttggatttcagtgatttttccccccaccccccagcacaggagagcacccacagccgcagaaggggaatgtgtcctcctgctctgcttcctcagggcccagcaggcgggggtttgagccctggaccccaggctcttagagactaaggggcagctcctgaccaaagacgatacagcttggcactttaaagcattaacagcaggtgtgaccctgagggctcctccatggtgctgcattgagtccagctttccttctgcccttcctccaggagaaggggcccaaggtccccgtggatggtctccacctgtgcttggaaccagtgtaactggctgctccctgctcccagggactgacacggggatcatctctgtgaccgccctccgtcgggcccctgcctgccttctcccctccacgcaaggctgtgctcttcctctggtttctgtgtgtccgtttgagtgtctgcgccccgcctccccatacttcctgggatgatgtgtgaaacctgacacctagatttatttggaaatattctatgaccactttacagatgaggaaactgaggcctcaagcgtggaggggtagagtgaagagtagaacccaggtctgatgccaaagctgctttcttctctgcctcctcctcacgcaactcacacctccttttcttctagctttgttgtcctcccaggaaccaaaaaaccccagctattttctgaccaaaatgtgtttcataacaaaccatctggtgcctttccacacagaactggcaggagcctcgtgtcctgctagctgtctctcttgttgatttccgtgaaaatgcaagtgtttgaagtctgctcattccgagggtgaaacaaaatccaaccctgtcagaatcatgctgttctctttgctgacactgtgaccctgggtcgggacagaccagcagcaatctgtctttagaatctctttccttcctccccttttgcccccgtggggctcccggcatcctgaaagccagcaaagcctccagcatcttttccatcctgaggtgcctcccagtggcctggcttgtcggagcaagtttcatcagccctagggaaaacacggccctcctgggaacctccttacctggagtaaccggacaccttagacggaggtgcctgagggtggggtgggatttgcagggtcattatcagaacatgaggataacttccttgcccctgctctgtagccacctccttggcaccggcctctatttgtcataaggcggcgtgggcgaggcctgacacaggccagccttggcacgaggggggccaggggttctgagaagcgctgccctgtgagagccatgctggccttcgtctccatctctggttgacgggctgtccgtgtgcctcctgtgtgtctgcagacaagtcttgctgtgctttatttgtgaaactttaatgaggaaaaaacaaataataaatgttctcgttttgaaactcaa

SEQ ID NO: 42478 - DNA, 2558 bp, Homo sapiens
  misc_feature (476)..(476): n is a, c, g, or t
acttctgggtctggacctgtgctattttggctattattgattcagtggacttgccaggctaagaataggtcctgtcctcttttatttgccccacctcttccttttggaatttgaaagccatagaagtcatcaggtccaatgccctcctcttattgaaggaaaagctgagtttcaacgtggagcagtgacttgcccaaggtctcacgggcaggtagcatggaccagggcactgaacccacctgggtctccagacaccctgggacatggcctttctcctctcccacgtctccagctttgggtccttgggctgagatgctggcgatgcacccaggcaggaggcctgcctgaggccgtgcctccaggcgcccaccctgagcttgtgtcctgagtccctgtagcttacccagggctgggacaagccccagctgtgagcatgggctcccccaaacatagttcttatctcctgctttgttttncccaaggagctggatgatggcctggatgaagcgttttcgaggcttgcccagtctcggacaaaccctcaggtcctggacactggcctgacagcccaggacatgcattacgcccagtgcctctcgcctgtcgactgggacaagcctgacagcagcggcacagagcaggatgacctcttcagcttctgagggcccggggccagccggacacaagcggccctgacacgtgatggaccaaagccacctgctgcgggggagccagttctggggcccgcctgccacctctcccagccctcagcattgtcagcctgaagatcagagctgcagccagtcaggcaggggagagatttttcttttaagccctgctctttctctgagaaccaaaagatgccttgaatatttattcagtgacttctggcttatgctcagaagccagtctgcgtcaggcacgtctcctgctgcgtgacatgtgcagtgctgtaatcggctcccgcttgctctcctggagcaagctctgccctggctgtgggtatcaggactgtgaccaaagcatttctagtcccttctctctttctaaggacccaaatttccctgggggcatcctgcttcctgaaagctgttggatttcagtgatttttccccccaccccccagcacaggagagcacccacagccgcagaaggggaatgtgtcctcctgctctgcttcctcagggcccagcaggcgggggtttgagccctggaccccaggctcttagagactaaggggcagctcctgaccaaagacgatacagcttggcactttaaagcattaacagcaggtgtgaccctgagggctcctccatggtgctgcattgagtccagctttccttctgcccttcctccaggagaaggggcccaaggtccccgtggatggtctccacctgtgcttggaaccagtgtaactggctgctccctgctcccagggactgacacggggatcatctctgtgaccgccctccgtcgggcccctgcctgccttctcccctccacgcaaggctgtgctcttcctctggtttctgtgtgtccgtttgagtgtctgcgccccgcctccccatacttcctgggatgatgtgtgaaacctgacacctagatttatttggaaatattctatgaccactttacagatgaggaaactgaggcctcaagcgtggaggggtagagtgaagagtagaacccaggtctgatgccaaagctgctttcttctctgcctcctcctcacgcaactcacacctccttttcttctagctttgttgtcctcccaggaaccaaaaaaccccagctattttctgaccaaaatgtgtttcataacaaaccatctggtgcctttccacacagaactggcaggagcctcgtgtcctgctagctgtctctcttgttgatttccgtgaaaatgcaagtgtttgaagtctgctcattccgagggtgaaacaaaatccaaccctgtcagaatcatgctgttctctttgctgacactgtgaccctgggtcgggacagaccagcagcaatctgtctttagaatctctttccttcctccccttttgcccccgtggggctcccggcatcctgaaagccagcaaagcctccagcatcttttccatcctgaggtgcctcccagtggcctggcttgtcggagcaagtttcatcagccctagggaaaacacggccctcctgggaacctccttacctggagtaaccggacaccttagacggaggtgcctgagggtggggtgggatttgcagggtcattatcagaacatgaggataacttccttgcccctgctctgtagccacctccttggcaccggcctctatttgtcataaggcggcgtgggcgaggcctgacacaggccagccttggcacgaggggggccaggggttctgagaagcgctgccctgtgagagccatgctggccttcgtctccatctctggttgacgggctgtccgtgtgcctcctgtgtgtctgcagacaagtcttgctgtgctttatttgtgaaactttaatgaggaaaaaacaaataataaatgttctcgttttgaaactcaa

SEQ ID NO: 42479 - DNA, 2535 bp, Homo sapiens
ctggcttgtgactgtgagcaggtcccttcaccgctcagtctcggttttcccatctgaaaaatgggaacagccgtctccctccccaaaggtgcttgtgaggattaactgacatctgaaaggtttctttcctcccggctggaaacctgaaactgccccttgaggttggccaccgctaatcacccctgcccggtgattgctggggacagagtgctggggtctgaggctccaacatgttgtgccttggtcctgcagagaaagagaagagggacaaagccagccaagagggaggggacgtcctgggggcccgccaagactgcaccccccccttgaagagcttggtcgccactgggaacctgctggacttagaggagacggctaaggccccgctgtccacggtcagcgccaacaccaccaacatggacgaggtgccgcggccacaagccttgagtggcagcagtgttgtctgggtgagtggttgtgtggccagcagatcggcttgcccagtctcggacaaaccctcaggtcctggacactggcctgacagcccaggacatgcattacgcccagtgcctctcgcctgtcgactgggacaagcctgacagcagcggcacagagcaggatgacctcttcagcttctgagggcccggggccagccggacacaagcggccctgacacgtgatggaccaaagccacctgctgcgggggagccagttctggggcccgcctgccacctctcccagccctcagcattgtcagcctgaagatcagagctgcagccagtcaggcaggggagagatttttcttttaagccctgctctttctctgagaaccaaaagatgccttgaatatttattcagtgacttctggcttatgctcagaagccagtctgcgtcaggcacgtctcctgctgcgtgacatgtgcagtgctgtaatcggctcccgcttgctctcctggagcaagctctgccctggctgtgggtatcaggactgtgaccaaagcatttctagtcccttctctctttctaaggacccaaatttccctgggggcatcctgcttcctgaaagctgttggatttcagtgatttttccccccaccccccagcacaggagagcacccacagccgcagaaggggaatgtgtcctcctgctctgcttcctcagggcccagcaggcgggggtttgagccctggaccccaggctcttagagactaaggggcagctcctgaccaaagacgatacagcttggcactttaaagcattaacagcaggtgtgaccctgagggctcctccatggtgctgcattgagtccagctttccttctgcccttcctccaggagaaggggcccaaggtccccgtggatggtctccacctgtgcttggaaccagtgtaactggctgctccctgctcccagggactgacacggggatcatctctgtgaccgccctccgtcgggcccctgcctgccttctcccctccacgcaaggctgtgctcttcctctggtttctgtgtgtccgtttgagtgtctgcgccccgcctccccatacttcctgggatgatgtgtgaaacctgacacctagatttatttggaaatattctatgaccactttacagatgaggaaactgaggcctcaagcgtggaggggtagagtgaagagtagaacccaggtctgatgccaaagctgctttcttctctgcctcctcctcacgcaactcacacctccttttcttctagctttgttgtcctcccaggaaccaaaaaaccccagctattttctgaccaaaatgtgtttcataacaaaccatctggtgcctttccacacagaactggcaggagcctcgtgtcctgctagctgtctctcttgttgatttccgtgaaaatgcaagtgtttgaagtctgctcattccgagggtgaaacaaaatccaaccctgtcagaatcatgctgttctctttgctgacactgtgaccctgggtcgggacagaccagcagcaatctgtctttagaatctctttccttcctccccttttgcccccgtggggctcccggcatcctgaaagccagcaaagcctccagcatcttttccatcctgaggtgcctcccagtggcctggcttgtcggagcaagtttcatcagccctagggaaaacacggccctcctgggaacctccttacctggagtaaccggacaccttagacggaggtgcctgagggtggggtgggatttgcagggtcattatcagaacatgaggataacttccttgcccctgctctgtagccacctccttggcaccggcctctatttgtcataaggcggcgtgggcgaggcctgacacaggccagccttggcacgaggggggccaggggttctgagaagcgctgccctgtgagagccatgctggccttcgtctccatctctggttgacgggctgtccgtgtgcctcctgtgtgtctgcagacaagtcttgctgtgctttatttgtgaaactttaatgaggaaaaaacaaataataaatgttctcgttttgaaactcaa

SEQ ID NO: 42480 - DNA, 2910 bp, Homo sapiens
ggaaagtttttcctgacggagttttggctgcggcagcggcggcggcggccggagcgggccatggacgcgctcaagtcggcggggcgggcgctgatccggagccccagcttggccaagcagagctgggggggcggtggccggcaccgcaagctgcctgagaactggacagacacgcgggagacgctgctggaggggatgctgttcagcctcaagtacctgggcatgacgctagtggagcagcccaagggtgaggagctgtcggccgccgccatcaagaggatcgtggctacagctaaggccagtgggaagaagctgcagaaggtgactctgaaggtgtcgccacggggaattatcctgacagacaacctcaccaaccagctcattgagaacgtgtccatatacaggatctcctattgcacagcagacaagatgcacgacaaggtgtttgcatacatcgcccagagccagcacaaccagagcctcgagtgccacgccttcctctgcaccaagcggaagatggcacaggctgttaccctcaccgtagcccaggccttcaaagtcgcctttgagttttggcaggtgtccaaggaagagaaagagaagagggacaaagccagccaagagggaggggacgtcctgggggcccgccaagactgcaccccccccttgaagagcttggtcgccactgggaacctgctggacttagaggagacggctaaggccccgctgtccacggtcagcgccaacaccaccaacatggacgaggtgccgcggccacaagccttgagtggcagcagtgttgtctgggagctggatgatggcctggatgaagcgttttcgaggcttgcccagtctcggacaaaccctcaggtcctggacactggcctgacagcccaggacatgcattacgcccagtgcctctcgcctgtcgactgggacaagcctgacagcagcggcacagagcaggatgacctcttcagcttctgagggcccggggccagccggacacaagcggccctgacacgtgatggaccaaagccacctgctgcgggggagccagttctggggcccgcctgccacctctcccagccctcagcattgtcagcctgaagatcagagctgcagccagtcaggcaggggagagatttttcttttaagccctgctctttctctgagaaccaaaagatgccttgaatatttattcagtgacttctggcttatgctcagaagccagtctgcgtcaggcacgtctcctgctgcgtgacatgtgcagtgctgtaatcggctcccgcttgctctcctggagcaagctctgccctggctgtgggtatcaggactgtgaccaaagcatttctagtcccttctctctttctaaggacccaaatttccctgggggcatcctgcttcctgaaagctgttggatttcagtgatttttccccccaccccccagcacaggagagcacccacagccgcagaaggggaatgtgtcctcctgctctgcttcctcagggcccagcaggcgggggtttgagccctggaccccaggctcttagagactaaggggcagctcctgaccaaagacgatacagcttggcactttaaagcattaacagcaggtgtgaccctgagggctcctccatggtgctgcattgagtccagctttccttctgcccttcctccaggagaaggggcccaaggtccccgtggatggtctccacctgtgcttggaaccagtgtaactggctgctccctgctcccagggactgacacggggatcatctctgtgaccgccctccgtcgggcccctgcctgccttctcccctccacgcaaggctgtgctcttcctctggtttctgtgtgtccgtttgagtgtctgcgccccgcctccccatacttcctgggatgatgtgtgaaacctgacacctagatttatttggaaatattctatgaccactttacagatgaggaaactgaggcctcaagcgtggaggggtagagtgaagagtagaacccaggtctgatgccaaagctgctttcttctctgcctcctcctcacgcaactcacacctccttttcttctagctttgttgtcctcccaggaaccaaaaaaccccagctattttctgaccaaaatgtgtttcataacaaaccatctggtgcctttccacacagaactggcaggagcctcgtgtcctgctagctgtctctcttgttgatttccgtgaaaatgcaagtgtttgaagtctgctcattccgagggtgaaacaaaatccaaccctgtcagaatcatgctgttctctttgctgacactgtgaccctgggtcgggacagaccagcagcaatctgtctttagaatctctttccttcctccccttttgcccccgtggggctcccggcatcctgaaagccagcaaagcctccagcatcttttccatcctgaggtgcctcccagtggcctggcttgtcggagcaagtttcatcagccctagggaaaacacggccctcctgggaacctccttacctggagtaaccggacaccttagacggaggtgcctgagggtggggtgggatttgcagggtcattatcagaacatgaggataacttccttgcccctgctctgtagccacctccttggcaccggcctctatttgtcataaggcggcgtgggcgaggcctgacacaggccagccttggcacgaggggggccaggggttctgagaagcgctgccctgtgagagccatgctggccttcgtctccatctctggttgacgggctgtccgtgtgcctcctgtgtgtctgcagacaagtcttgctgtgctttatttgtgaaactttaatgaggaaaaaacaaataataaatgttctcgttttgaaactcaaaaaacagaccaacaccacgccaaccaa

SEQ ID NO: 42481 - DNA, 3257 bp, Homo sapiens
ggaaagtttttcctgacggagttttggctgcggcagcggcggcggcggccggagcgggccatggacgcgctcaagtcggcggggcgggcgctgatccggagccccagcttggccaagcagagctgggggggcggtggccggcaccgcaagctgcctgagaactggacagacacgcgggagacgctgctggaggggatgctgttcagcctcaagtacctgggcatgacgctagtggagcagcccaagggtgaggagctgtcggccgccgccatcaagaggatcgtggctacagctaaggccagtgggaagaagctgcagaaggtgactctgaaggtgtcgccacggggaattatcctgacagacaacctcaccaaccagctcattgagaacgtgtccatatacaggatctcctattgcacagcagacaagatgcacgacaaggtgtttgcatacatcgcccagagccagcacaaccagagcctcgagtgccacgccttcctctgcaccaagcggaagatggcacaggctgttaccctcaccgtagcccaggccttcaaagtcgcctttgagttttggcaggtgtccaaggaagagaaagagaagagggacaaagccagccaagagggaggggacgtcctgggggcccgccaagactgcaccccccccttgaagagcttggtcgccactgggaacctgctggacttagaggagacggctaaggccccgctgtccacggtcagcgccaacaccaccaacatggacgaggtgccgcggccacaagccttgagtggcagcagtgttgtctgggagctggatgatggcctggatgaagcgttttcgaggcttgcccagtctcggacaaaccctcaggtcctggacactggcctgacagcccaggacatgcattacgcccagtgcctctcgcctgtcgactgggacaagcctgacagcagcggcacagagcaggatgacctcttcagcttctgagggcccggggccagccggacacaagcggccctgacacgtgatggaccaaagccacctgctgcgggggagccagttctggggcccgcctgccacctctcccagccctcagcattgtcagcctgaagatcagagctgcagccagtcaggcaggggagagatttttcttttaagccctgctctttctctgagaaccaaaagatgccttgaatatttattcagtgacttctggcttatgctcagaagccagtctgcgtcaggcacgtctcctgctgcgtgacatgtgcagtgctgtaatcggctcccgcttgctctcctggagcaagctctgccctggctgtgggtatcaggactgtgaccaaagcatttctagtcccttctctctttctaaggacccaaatttccctgggggcatcctgcttcctgaaagctgttggatttcagtgatttttccccccaccccccagcacaggagagcacccacagccgcagaaggggaatgtgtcctcctgctctgcttcctcagggcccagcaggcgggggtttgagccctggaccccaggctcttagagactaaggggcagctcctgaccaaagacgatacagcttggcactttaaagcattaacagcaggtgtgaccctgagggctcctccatggtgctgcattgagtccagctttccttctgcccttcctccaggagaaggggcccaaggtccccgtggatggtctccacctgtgcttggaaccagtgtaactggctgctccctgctcccagggactgacacggggatcatctctgtgaccgccctccgtcgggcccctgcctgccttctcccctccacgcaaggctgtgctcttcctctggtttctgtgtgtccgtttgagtgtctgcgccccgcctccccatacttcctgggatgatgtgtgaaacctgacacctagatttatttggaaatattctatgaccactttacagatgaggaaactgaggcctcaagcgtggaggggtagagtgaagagtagaacccaggtctgatgccaaagctgctttcttctctgcctcctcctcacgcaactcacacctccttttcttctagctttgttgtcctcccaggaaccaaaaaaccccagctattttctgaccaaaatgtgtttcataacaaaccatctggtgcctttccacacagaactggcaggagcctcgtgtcctgctagctgtctctcttgttgatttccgtgaaaatgcaagtgtttgaagtctgctcattccgagggtgaaacaaaatccaaccctgtcagaatcatgctgttctctttgctgacactgtgaccctgggtcgggacagaccagcagcaatctgtctttagaatctctttccttcctccccttttgcccccgtggggctcccggcatcctgaaagccagcaaagcctccagcatcttttccatcctgaggtgcctcccagtggcctggcttgtcggagcaagtttcatcagccctagggaaaacacggccctcctgggaacctccttacctggagtaaccggacaccttagacggaggtgcctgagggtggggtgggatttgcagggtcattatcagaacatgaggataacttccttgcccctgctctgtagccacctccttggcaccggcctctatttgtcataaggcggcgtgggcgaggcctgacacaggccagccttggcacgaggggggccaggggttctgagaagcgctgccctgtgagagccatgctggccttcgtctccatctctggttgacgggctgtccgtgtgcctcctgtgtgtctgcagacaagtcttgctgtgctttatttgtgaaactttaatgaggaaaaaacaaataataaatgttctcgttttgaaactcaaaaaaaaaaaaaaaagaaagaaaaaaaaaaaaaaaaaagaggaaaaaagaagaaaagaaaaaagaagaaaaaaaaaaagaggggggcgggcgctgcccacagaaagagtcccccccaggggggggcaccgccaatgaggcacgcaccaccgttgtctgagaaagaagagggcgcgccccaacaagggagggggcagctcaataaatcaccacggcaacgaccgggccgcgatataacaaacggcgccgccgaggagcaaaacgcgagcccgaggcgcgctcggccgggcgggagaccccccatctcggggggggagctacaactgtggcgggacacccgaccccgagagagtcggccgcgcgccgggcatagtac

SEQ ID NO: 42482 - DNA, 4265 bp, Homo sapiens
  misc_feature (1300)..(1300): n is a, c, g, or t
ggttggctcttgcacttcctggctctctggacttggttatgtgattgagcctccatggcctccgtgtctttgtctgtcaatgggtttgattaaagcgttgacctcataggttcttaggaggattaatgagaacattttatgtaaagctgcttacatggagccttggtatgtgccggaaagctttagccctttattaaaagtgacagcagacccagcacggtggctcatgcctgtaatcccagcactttgggaggctgaggcgggcagatcacttggggtcaggagttcgagaccagctactcgggaggcagaggcaggagaatcgcttgaacctggggtgcagaggttgcagtaagctgagctcgcaccactgcactccagcctgagtgacagagtgaaactcagtctcaaaaaaaaaaaaaaaaaaagagtggcagtagtggtgggggagacccccatcccccttgctggggtttcctaggaaagaaggctggtgagagctgttgctggtggtgggccctgagccgcagggtctgagggcctaccctgtgctaccccagagctgcctgagaactggacagacacgcgggagacgctgctggaggggatgctgttcagcctcaagtacctgggcatgacgctagtggagcagcccaagggtgaggagctgtcggccgccgccatcaagaggatcgtggctacagctaaggccagtgggaagaagctgcagaaggtgactctgaaggtgtcgccacggggaattatcctgacagacaacctcaccaaccagctcattgagaacgtgtccatatacaggatctcctattgcacagcagacaagatgcacgacaaggtgtttgcatacatcgcccagagccagcacaaccagagcctcgagtgccacgccttcctctgcaccaagcggaagatggcacaggctgttaccctcaccgtagcccaggccttcaaagtcgcctttgagttttggcaggtgtccaaggaagagaaagagaagagggacaaagccagccaagagggaggggacgtcctgggggcccgccaagactgcaccccccccttgaagagcttggtcgccactgggaacctgctggacttagaggagacggctaaggccccgctgtccacggtcagcgccaacaccaccaacatggacgaggtgccgcggccacaagccttgagtggcagcagtgttgtctgggtgagtggttgtgtggccagcagatcggtgatcctcagcctgacctctgggtgagcctggggctgctccagggaccaggcnctgggacccgtgacttgtgggcctctgggaggaccagacccagcccggtagtgcccaggcgcaggataggggatgaacaatgtcccttttgaacctgaggctgcatccccaacaggcttggctcccagcacagctgtctcctcacaatgcttggcctcttggcctgagcgtccacggctctgcccaccacaagaccagccaaaggcgcccttgttcttggtgtggcagagctcgctcctaccacccctccccctcagccgcctgaatgaggacccagagacttgggcagtcaccagcttggtccctgactccctcagggactcagggcaagccccctgacctctctgtctcagctttttcatctcagtaagggtgatgacctctgccaacggaatctccccgaggaacctgaaatttaattttaatttttcatttggaaataatttcagactgtgttacaaaattagtacagagaattcctgttcacccgtcatccagattccccaattgttaacatcttgcatgaccacattacactggtcagaatcaggaaacaaacacgatactgtgctgttatataatctatagaacttacacatttctccaggtgccccttcagtgtcctgtttctggcccaggatccattgcagaatcacatgttaacttgtcgtctctttaatttttaaaaatctgggtactgggggctcccctggtgtccctcgagcctgttctctgctgtttgggaaccacccttgccacttgcccatcctcaccagaaggccatggagggacctcacctgtcgcttttctgctgaggctgtgggactcctggcatcagttatccctcatgaacttggaattttggcttggcttttggaagtaaatgaaggagctggatgatggcctggatgaagcgttttcgaggcttgcccagtctcggacaaaccctcaggtcctggacactggcctgacagcccaggacatgcattacgcccagtgcctctcgcctgtcgactgggacaagcctgacagcagcggcacagagcaggatgacctcttcagcttctgagggcccggggccagccggacacaagcggccctgacacgtgatggaccaaagccacctgctgcgggggagccagttctggggcccgcctgccacctctcccagccctcagcattgtcagcctgaagatcagagctgcagccagtcaggcaggggagagatttttcttttaagccctgctctttctctgagaaccaaaagatgccttgaatatttattcagtgacttctggcttatgctcagaagccagtctgcgtcaggcacgtctcctgctgcgtgacatgtgcagtgctgtaatcggctcccgcttgctctcctggagcaagctctgccctggctgtgggtatcaggactgtgaccaaagcatttctagtcccttctctctttctaaggacccaaatttccctgggggcatcctgcttcctgaaagctgttggatttcagtgatttttccccccaccccccagcacaggagagcacccacagccgcagaaggggaatgtgtcctcctgctctgcttcctcagggcccagcaggcgggggtttgagccctggaccccaggctcttagagactaaggggcagctcctgaccaaagacgatacagcttggcactttaaagcattaacagcaggtgtgaccctgagggctcctccatggtgctgcattgagtccagctttccttctgcccttcctccaggagaaggggcccaaggtccccgtggatggtctccacctgtgcttggaaccagtgtaactggctgctccctgctcccagggactgacacggggatcatctctgtgaccgccctccgtcgggcccctgcctgccttctcccctccacgcaaggctgtgctcttcctctggtttctgtgtgtccgtttgagtgtctgcgccccgcctccccatacttcctgggatgatgtgtgaaacctgacacctagatttatttggaaatattctatgaccactttacagatgaggaaactgaggcctcaagcgtggaggggtagagtgaagagtagaacccaggtctgatgccaaagctgctttcttctctgcctcctcctcacgcaactcacacctccttttcttctagctttgttgtcctcccaggaaccaaaaaaccccagctattttctgaccaaaatgtgtttcataacaaaccatctggtgcctttccacacagaactggcaggagcctcgtgtcctgctagctgtctctcttgttgatttccgtgaaaatgcaagtgtttgaagtctgctcattccgagggtgaaacaaaatccaaccctgtcagaatcatgctgttctctttgctgacactgtgaccctgggtcgggacagaccagcagcaatctgtctttagaatctctttccttcctccccttttgcccccgtggggctcccggcatcctgaaagccagcaaagcctccagcatcttttccatcctgaggtgcctcccagtggcctggcttgtcggagcaagtttcatcagccctagggaaaacacggccctcctgggaacctccttacctggagtaaccggacaccttagacggaggtgcctgagggtggggtgggatttgcagggtcattatcagaacatgaggataacttccttgcccctgctctgtagccacctccttggcaccggcctctatttgtcataaggcggcgtgggcgaggcctgacacaggccagccttggcacgaggggggccaggggttctgagaagcgctgccctgtgagagccatgctggccttcgtctccatctctggttgacgggctgtccgtgtgcctcctgtgtgtctgcagacaagtcttgctgtgctttatttgtgaaactttaatgaggaaaaaacaaataataaatgttctcgttttgaaactcaa

SEQ ID NO: 42483 - DNA, 3073 bp, Homo sapiens
ggaaagtttttcctgacggagttttggctgcggcagcggcggcggcggccggagcgggccatggacgcgctcaagtcggcggggcgggcgctgatccggagccccagcttggccaagcagagctgggggggcggtggccggcaccgcaagctgcctgagaactggacagacacgcgggagacgctgctggaggggatgctgttcagcctcaagtacctgggcatgacgctagtggagcagcccaagggtgaggagctgtcggccgccgccatcaagaggatcgtggctacagctaaggccagtgggaagaagctgcagaaggtgactctgaaggtgtcgccacggggaattatcctgacagacaacctcaccaaccagctcattgagaacgtgtccatatacaggatctcctattgcacagcagacaagatgcacgacaaggtgtttgcatacatcgcccagagccagcacaaccagagcctcgagtgccacgccttcctctgcaccaagcggaagatggcacaggctgttaccctcaccgtagcccaggccttcaaagtcgcctttgagttttggcaggtgtccaaggaagagaaagagaagagggacaaagccagccaagagggaggggacgtcctgggggcccgccaagactgcaccccccccttgaagagcttggtcgccactgggaacctgctggacttagaggagacggctaaggccccgctgtccacggtcagcgccaacaccaccaacatggacgaggtgccgcggccacaagccttgagtggcagcagtgttgtctgggagctggatgatggcctggatgaagcgttttcgaggcttgcccagtctcggacaaaccctcaggtcctggacactggcctgacagcccaggacatgcattacgcccagtgcctctcgcctgtcgactgggacaagcctgacagcagcggcacagagcaggatgacctcttcagcttctgagggcccggggccagccggacacaagcggccctgacacgtgatggaccaaagccacctgctgcgggggagccagttctggggcccgcctgccacctctcccagccctcagcattgtcagcctgaagatcagagctgcagccagtcaggcaggggagagatttttcttttaagccctgctctttctctgagaaccaaaagatgccttgaatatttattcagtgacttctggcttatgctcagaagccagtctgcgtcaggcacgtctcctgctgcgtgacatgtgcagtgctgtaatcggctcccgcttgctctcctggagcaagctctgccctggctgtgggtatcaggactgtgaccaaagcatttctagtcccttctctctttctaaggacccaaatttccctgggggcatcctgcttcctgaaagctgttggatttcagtgatttttccccccaccccccagcacaggagagcacccacagccgcagaaggggaatgtgtcctcctgctctgcttcctcagggcccagcaggcgggggtttgagccctggaccccaggctcttagagactaaggggcagctcctgaccaaagacgatacagcttggcactttaaagcattaacagcaggtgtgaccctgagggctcctccatggtgctgcattgagtccagctttccttctgcccttcctccaggagaaggggcccaaggtccccgtggatggtctccacctgtgcttggaaccagtgtaactggctgctccctgctcccagggactgacacggggatcatctctgtgaccgccctccgtcgggcccctgcctgccttctcccctccacgcaaggctgtgctcttcctctggtttctgtgtgtccgtttgagtgtctgcgccccgcctccccatacttcctgggatgatgtgtgaaacctgacacctagatttatttggaaatattctatgaccactttacagatgaggaaactgaggcctcaagcgtggaggggtagagtgaagagtagaacccaggtctgatgccaaagctgctttcttctctgcctcctcctcacgcaactcacacctccttttcttctagctttgttgtcctcccaggaaccaaaaaaccccagctattttctgaccaaaatgtgtttcataacaaaccatctggtgcctttccacacagaactggcaggagcctcgtgtcctgctagctgtctctcttgttgatttccgtgaaaatgcaagtgtttgaagtctgctcattccgagggtgaaacaaaatccaaccctgtcagaatcatgctgttctctttgctgacactgtgaccctgggtcgggacagaccagcagcaatctgtctttagaatctctttccttcctccccttttgcccccgtggggctcccggcatcctgaaagccagcaaagcctccagcatcttttccatcctgaggtgcctcccagtggcctggcttgtcggagcaagtttcatcagccctagggaaaacacggccctcctgggaacctccttacctggagtaaccggacaccttagacggaggtgcctgagggtggggtgggatttgcagggtcattatcagaacatgaggataacttccttgcccctgctctgtagccacctccttggcaccggcctctatttgtcataaggcggcgtgggcgaggcctgacacaggccagccttggcacgaggggggccaggggttctgagaagcgctgccctgtgagagccatgctggccttcgtctccatctctggttgacgggctgtccgtgtgcctcctgtgtgtctgcagacaagtcttgctgtgctttatttgtgaaactttaatgaggaaaaaacaaataataaatgttctcgttttgaaactcaagaaaaaaaaaaaaaaaaaaaaaaaatttgggggcgcttgggacgaaaaagttttaaacacattgtggggggggggcccgggtttagggaatggcctagggtctagggactctggtgctgggtgggtctaccaaaaaagccgggggggcgcgttggaaccagggggtgggctgggttaaggggaggcatag

SEQ ID NO: 42484 - DNA, 588 bp, Homo sapiens
atatatactgaacatcatatgaaaaaaaaagcagaaaaagatggtgatcaccattccacaagacaaacaatttaagagaaaatagtcaacaaactgcattagaatgatctcatcatcatctcagcaagatgaaaatgagtcagtcaaattaaaagctatatatcctaacactccttatacagtttctacatctacaatttagccacaaaatgggaccacagccataaagctgcctcaaagtgggaaatcccagacaatttcctattccatacaaagcataagccagaaaaatacctgcctcacatttctaccctatcccaagctccaactacaggaaacccatcactattacagagacccaaaatcacagagatcatgtcaacatattttgatatataatctccaaaatactatcttaactgtgcaacttcattatcatattcctttagggacagaacacatatttaactcattttcaattcttttaaattgcaaacaataaatcctattaattctttcttaaattcctccaacttttcataactaagcagctgtttaaatctaatcaatgtcttgcccaatggatgc

SEQ ID NO: 42485 - DNA, 410 bp, Homo sapiens
aggcaactctcctctgtagagtgaaagactataatggtggccatgtagaaactaatattccagaaggagagagctccaagaaggggattccagtgaaccatatgtacactgtgtttgagagacattagttccccacggagaagggatggatagtctgtgcttcgggggtctaaggaaggcttcctgcaggtgctggtacctccttaggtctggggtggttccttctaagtttccttaccctgcctgcatcacctctgcctcttatgacctctgtgcaaagactgggaagggtcacccccaatggctgtgaacgaacctgtttgtgattctaaacagggcacgggaccatcctacaataaaaattacccagcctaaaatgccagtagtgccagtagtccctgtttagaaaa

SEQ ID NO: 42486 - DNA, 437 bp, Homo sapiens
atcgattgagcaggcagggggctgcatgcactggtaattagaatggaacagaacaggacagggattttcacagtgcttttccatacaatgtctgtaatctatagataacataaccgattaggtcaggggttgatctttaactaccaggcccagggtgtggcaccaggctgtctgcctgtgaatttcatttctgccttttaattttcatttcttctttctttggaggcagaaattgggcataagacaatatgaggggtggtctcctcccttactaaaaatataaaaattagccaggtgcagtggactgcacctgaagccccagctagtcccgaggctgaggcaggagaatcacttgcacctgtgaggaggttgcagtgagccgagatcatgccactgcactccagcctgggcaacagagcaagactccatctaaagca

SEQ ID NO: 42487 - DNA, 440 bp, Homo sapiens
gaatcgacaaagctaccaattcaagcagcctatttcagcacattctaaattattgcttaccctgcctatgccaggtcatacaccaggtggtttacacactttatctatcttaatcctcacttcaagatcatgagggaggtagaataaataagtcacttacccaggggtctggaagtaagcattctaattgttcaaaaagattttaaaagattatatgtagtccgggagtggtggctcatgtctgtaatcccagcactttgggaggccgaggcaggtggatcatgaggtcaggagatcaagaccatcctggctaacacagtgaaaccccaactctactaaaaatacaaaaaaattagccaggagtggtggtgggcacctgtagtcccagctactcaggaggctgaggcaggagaatggcatgaacccaggaggtggaggtt

SEQ ID NO: 42488 - DNA, 441 bp, Homo sapiens
aacccttcccagtccagcttcatccctaccatgctgctaaaaccaccctctcaaaggtcacttaagctttggccttgccagatccgccgctgctctgtcctcctgtgctgcatcctcagcacggctccctgccctctgttttgaagcattcttctcccttgtagggatccaatttcagtctttccccaaatagataaccaccgttccctgtaccatttattgagaaatacatcatctcgtctctccccagcagcactagcgccctcaagtagtcctgaggtatgtgttggtctgtttctggactcaccattctgtccctgggtctatccctctgccgataacacattgaatccattactacagatgtgtaagtcctgctgttggacagggcaaattccttcttcaagagtctcttagctgttttttttgttgttggttttt

SEQ ID NO: 42489 - DNA, 551 bp, Homo sapiens
gtctctgatccaacttgacttctgaatgaagaatatagtgactctttaaagggacaaaggtagaatgatagggcaaggtcagccatttgataaatcccagtagaggaggaagtgaactcaagagtgacgtcacaaatatggtctacacaagcctgacacaggttatccatgtggttttctggggaccctaggaggcaaagagcagaagcagctcactggatggcagagaaaggttctggcctccgtctctcataagaatattagctctcagcccaggcacggcagttcacacctgtaatcccaggactttgggagactgaagcaggcagatcacttgaggtcaggagtttgataccagcctggccaacatgacaaaactccgtctctgctaaaaatacaaaaattagccaggtgtgttagcacacgcctgtagtcccagctactcaggaggctgaggcacaagaatagcttgaacccaggaggtggaggttgcaatgacctgagatggcaccattgcactccagcctgggcaacagagcaagactgtcaaa

SEQ ID NO: 42490 - DNA, 340 bp, Homo sapiens
ctctacccaggcctttccccaggcctgaaggctggattgtcttattgaagggaagggagtagccctagctaaaaagtagatcctcaagtccaaaacgacggaggggctcatctccagaccttagctcctctccgtcgatgattttatccagtcttccggctcctggtgtagaataacgcgcacaccctcatcactctcaaatttctatttccatctcggactactccccaggactggacatccctgtgtgggtatctcacaggcatctcaaacctagcgtgtccaaacccaaactcctgactgaccctctctaatccacctcccacctgcacctgtcctc

SEQ ID NO: 42491 - DNA, 413 bp, Homo sapiens
acagcatagcatagtggtgctgtgcatgcacgttaggtcctaggaccttagttccaattctgtctgtgacaattactagctgtgcacatctagtaagttacttaacctctctatgcctcagtttcctcctctgtgaaatggggataataattgcatctacttaatttgtggtaaggtttgcatagggatttcatcatattgggactggaggagttgagtaagaagaaagggcaaaaccttggtctagcttccgccaatttctgggcaaaagctgaagttagcacaaagtcagcccaagcatgctccactgcactcaaagtacagttctgctgccagaacccagccagggggaggggatgggaactgtataagagtaggacggatgccaagactagtgaggcattttaacaaca

SEQ ID NO: 42492 - DNA, 378 bp, Homo sapiens
aaagacatagatctgcattaatctgtaaggtagcctagccacatgtggctatacaaatataaatataatttaaattacataaaattaaaagttcagcttttcagtctcactatccacatttcaagcaagatgtgactagtggctcccaaatataattgtccattatgaaagaaaccctctgttggacagtaaatgacgaaactggtgcatctagtgttctctttcattcaaataactggcatgggctggccgaggtggctcatgcctgtaatcccagcactttgggaggccgaggcaggcggatcatttgaagtcaggagttcaagaccagcctggcctacatggtgaaacctcatctctactaaaaatacaaaaaaa

SEQ ID NO: 42493 - DNA, 711 bp, Homo sapiens
cctggtgaaaactgagttagccagttgttcctaagatactcctgatgctgagagtgtgagcaggaggcgctgccccatccgcaagtcagtgtcccccaccccctgcggggtccacagcccaggcatctccggtccagtgtttcccaaacattcgcgtgccgaattgtaaaaagtgcacgttaatgcgagcctgtcggtgtgacatgaatctcagccatgctggttgccatcagtcagcacggagagagaaaccttttgtgcctaattagcacgcagaacagaacacagggttcgatttatggacttttcaaaacgagaatttcagtgggagactgtggcaaatgacacagtgttgacactggaattttgactacatgttggtctagaccccagttgaaattaaacagctcttttaataaaagctctttggctttcctcactgttccaaatcccacagcccccttctccttcttcctttttgagcaggatgggattacaggtcggaatgtacggattgtttcattttggggtaatgatggatcagccacagccaagccttacccgtgctgacgaatctccatgtgatcgtgtcctttctccatgtgctgcccacagaaagcagcgagactgctgtctcagctggaaagctgagcctgagagatttctggttaaaaaaaaataaaaaataaaaatctcctgcctaaggaaata

SEQ ID NO: 42494 - DNA, 632 bp, Homo sapiens
cctcattctcccctatggaagaccttgtgtagcccttcatcaggcgtgtgttgtggctttgtcacactgttttgtaatgatcgctttgcatgtcttttccagctgactccgccaccatctcctgcctggatgactgcagcagcatccttgctggcctctctgcttcctgcattgcctcctctgaatcttcaggatgccaagtttgtggaggaacggagaaagcagctccagaattacctgcgcagcgtcatgaacaaagtcatccagatggtccccgagttcgctgccagccccaagaaggagaccctcatccagctgatgcccttcttcgtcgacatcaccccgcccggagagcctgtgaacagccggcccaaagcagcttcccgcttccccaaactgtcccggggtcagccccgggagacccgcaacgtggagccccagagcggtgacctctgacctcgacaaaaccgcagccacgggccctgtgcgtggcaccagctgcgtccaccccagccactgccgctggcccctcacctcagcgtgacaaccacgtccacctggtgatcctgagagcacacgattcccaacagttacacaacaccccgattaaactaatcagtcttcgagccgca

SEQ ID NO: 42495 - DNA, 441 bp, Homo sapiens
aagctgcagctgctcacacttgcctggctaccgaacaggatgggctcaagaatgctctgcagggacagccttactgagccccagattccaaactggagtttagcaaaatgagccacttccttcagcagcagttctagggctgtataggagctgctcttaggggttcagggatacctcaattcccagtctgccctcaaggtgctcagtcttttgggagacaccccgggagacccgcaacgtggagccccagagcggtgacctctgacctcgacaaaaccgcagccacgggccctgtgcgtggcaccagctgcgtccaccccagccactgccgctggcccctcacctcagcgtgacaaccacgtccacctggtgatcctgagagcacacgattcccaacagttacacaacaccccgattaaactaatcagtcttcgagccgca

SEQ ID NO: 42496 - DNA, 820 bp, Homo sapiens
cctcattctcccctatggaagaccttgtgtagcccttcatcaggcgtgtgttgtggctttgtcacactgttttgtaatgatcgctttgcatgtcttttccagctgactccgccaccatctcctgcctggatgactgcagcagcatccttgctggcctctctgcttcctgcattgcctcctctgaatcttcaggatgccaagtttgtggaggaacggagaaagcagctccagaattacctgcgcagcgtcatgaacaaagtcatccagatggtccccgagttcgctgccagccccaagaaggagaccctcatccagctgatgcccttcttcgtgtaagtactgctcccacggacatgggccgccagccctgccagcatttttttctcggtcgttttggaaggtcagggagcacagcggctctccgtgatgccctgatcgccatgggacccaggcgaactccaggggctgttccaggtgccaaagtggaggttgggtctcagcgctttggagcttctaaagggatgggaagagagcaggcctgcaaatgagcattgttgacttgaggctcacaaagaaacttggggctctgtgattttgtactttcacacatttcgatcaagggaagattaattttctgtacagcccacgggtgctccaaaactgaaacaaattgtgtcagtgtttctcaagcttgggtaatgaacccaaggaaagttctcccagactcctaccagtattgacttaaattatttttatatgagttttacttaaaaatgaacattaatattatttaaatgccttcttctctcttgaaaaaagt

SEQ ID NO: 42497 - DNA, 537 bp, Homo sapiens
gtatacagagttcaggagtttgcaccacaagttacaaaacaagtaccctcaagtgagggcctacaacttcccacccaaaaaggccattggaaacaaggatgccaagtttgtggaggaacggagaaagcagctccagaattacctgcgcagcgtcatgaacaaagtcatccagatggtccccgagttcgctgccagccccaagaaggagaccctcatccagctgatgcccttcttcgtcgacatcaccccgcccggagagcctgtgaacagccggcccaaagcagcttcccgcttccccaaactgtcccggggtcagccccgggagacccgcaacgtggagccccagagcggtgacctctgacctcgacaaaaccgcagccacgggccctgtgcgtggcaccagctgcgtccaccccagccactgccgctggcccctcacctcagcgtgacaaccacgtccacctggtgatcctgagagcacacgattcccaacagttacacaacaccccgattaaactaatcagtcttcgagccgca

SEQ ID NO: 42498 - DNA, 557 bp, Homo sapiens
cctcattctcccctatggaagaccttgtgtagcccttcatcaggcgtgtgttgtggctttgtcacactgttttgtaatgatcgctttgcatgtcttttccagctgactccgccaccatctcctgcctggatgactgcagcagcatccttgctggcctctctgcttcctgcattgcctcctctgaatcttcaggatgccaagtttgtggaggaacggagaaagcagctccagaattacctgcgcagcgtcatgaacaaagtcatccagatggtccccgagttcgctgccagccccaagaaggagaccctcatccagctgatgcccttcttcgtgatgggattacaggtcggaatgtacggattgtttcattttggggtaatgatggatcagccacagccaagccttacccgtgctgacgaatctccatgtgatcgtgtcctttctccatgtgctgcccacagaaagcagcgagactgctgtctcagctggaaagctgagcctgagagatttctggttaaaaaaaaataaaaaataaaaatctcctgcctaaggaaata

SEQ ID NO: 42499 - DNA, 1423 bp, Homo sapiens
caaaatgtcagtggtgccaatgttgagaagccctggactcacctagtctctgccctgtcaaagaggctaataaagaaaaaggcactcctttgagctctttagttcatcttctataacaagtgtcttaaaatttgcctttgtggcattgaagagttaaaagttgttttcagagatactgactaaatagtggatattgactcagaggtcagcaaagaatttatgtaacttaagttacagacttgtagaatttgagctgctataattgctgtttctccatttcttttgaaagagagctcagcggaagttttactccagagatagtgccctgcttctactggaagaactacacactttttctccaagggtctttttctttttctttttaataaaccttcatagtcatgtgtaccaaatgacttttcatgtcatctaacaaacatttataataccggtaataataggcaccatttattgagcacttacacattgcttgccacattgtggtaggtattcatgcattatttcatttaatccccacaacaagcctgtgaggtaggtgttacagatgaaaaaaaaaaaagaggctcagagaggataagtaaattgcccaaatcttacagacaggatttaaactcaggtcctcctgaatatagtacccgttacattctgctgattctgccagcctacaaggcactaagtgtgcaaaattgaatatttcagtttcctttccctgcctttagagggctcccagtttctaggtgaaaaaaaaaatttttttgccaccaaaaaagcaaaggcagtcttttagacaaactctaggtaaacagtaccaacaccggctgggtgcggtggctcacatctgtaatcccaacagggaggctgaggcaggcggatcaccagaggtcaggagttcgagaccagcctagccaacatggtgaaacctcgtctctactaaaaatacaaaagttagccgggcatggtggcaggcacctataatctcagctactcgggaggctgaggcaggagaattgcttgaacctgggagccggaggttgcagtgagccgagatcacaccattgcactccagcctgggtgacaagagcgagaccccatctcaaaaaaaaaaaaaaaaaaaaaaaatagtaccaacaccataggcatggctgtccagtcctaaaaaggatataattatattgtaggtcaggggagggtgcttgtctacaccaaactgaatgttattgagagctgggctaaggagaagaaactaatataggtatctggagtaaaaggaacaagggttagcagattttaacaaggggagatgaggaaagaatagtaggtatgttgtgatattgtaaacatcatagagggggaaaaaaatctttgttaaaaaatgttctgtgagttaccaggagagttaaaa

SEQ ID NO: 42500 - DNA, 441 bp, Homo sapiens
  misc_feature (26)..(26): n is a, c, g, or t
ccagttttccagcctcctccacccantgccatctcccagccagcatcacctttccaagggaatgcattcctcacctctcagcctgtgccagtgggtgtggtccagcctgggtgacaagagcgagaccccatctcaaaaaaaaaaaaaaaaaaaaaaaatagtaccaacaccataggcatggctgtccagtcctaaaaaggatataattatattgtaggtcaggggagggtgcttgtctacaccaaactgaatgttattgagagctgggctaaggagaagaaactaatataggtatctggagtaaaaggaacaagggttagcagattttaacaaggggagatgaggaaagaatagtaggtatgttgtgatattgtaaacatcatagagggggaaaaaaatctttgttaaaaaatgttctgtgagttaccaggagagttaaaa

SEQ ID NO: 42501 - DNA, 1094 bp, Homo sapiens
aatcctaaacataatacagatttcactcctggtctcatcaccagtatatgaattgttcttactgcattttaaaaaaaacatgttttaatataagcaaacaggtcattctttgatattgcatagctaacccaaggcatggttattattcctttgttgtgttttttttttccaacaacctttgtaaattgcgcaaaatacggaacaatgcacaaatttgcgtgtaatctttgcataggggccatgctaatctatatcatccaatttttagtatatgtgctgctgaagggggcaccgttattcctttgggacatgggctggcacaaactcacaaaccactggaataggtactaatgggtggcagctctaggctgtattgcaacagtgctaggtaaaatattctcaccggggtcttcagacaacagtgagaggtaagcaagtactatctctattctcaggtgaggaagctaaggaactaaaaggactataaaaagaggaatgctacaaatggatttggcactatttttaaatatactatttattctcaaaaagcatcctctggaaagtgaaataacagcaactttcgagccaaaatccaagtatttagcacttgggtttctaaaatgaacactttagtggacactccagttcagcagcagggtatctcaaagagggggctttggagttattttggaagtcaaatcccacctctgctatccattttctttggacactaactcccttgggttgtttgatctaactggacttttagataagttactgatatggtttggctctgtgtccccatccaaatctcaccttgaatataatccccataattcccacgggtcaagggcgggaccaggtggaggtaattggatcatgggggcagttcccccatgctgttcttgtgataatgcgtgagtctcacgagatctgatggtttcataagcatctggcatttctcttgcttgcactcattctctctcctgccaccctgagaagaggtgccttccaacatgattgtaagtttcctgtggcctccccagccatgcagaactgtgagtcaattaaacctcttttctttataaattacc

SEQ ID NO: 42502 - DNA, 744 bp, Homo sapiens
tgtgttactttttatgcaaacttgttcattgtgttcccagagtggccagtcataagtctgtaagcaacaccttcccttttagtgtcttccatgtcatcaccatctgtaataaataagtaaatgtgtatttattttgtaaaacataatacttggaagtatatatacattgtcaaatgcttaattctaggtagttacctcacatagttaacatttttgtggcaagagcatgtgacattgtcagcatttttcaaaactacaaatacattattttgatctatagtcactatgctgtacaaaacaatctcttgaacttattctattaactataattatgtattttttgatcaacatcttttcaaaccctcctttctcctaaataacttgtgtctggtggccaccactttacttcaatgagattaagttttttagaatccctttgtaagtgaaatcatgaaataataatctttgtgcctggctcatttcgacaaatacaatgttttcctccaggttaattcgtgtgattgaaaataataaaatttccttctttaaatatgaatagtattccattgtgtgtatataccacattgtctttatttactcattaaatgttgaaaccactgattttatattttggtaattgtgaagagtgttgtaaaaaacaggcacatgtttcttcattctgatttcgtttgttttggatgtataaccaataataaaattgctgtatttggtggtttaatttta

SEQ ID NO: 42503 - DNA, 285 bp, Homo sapiens
ggacccagcattgctgatctgttgtagatttctgatctcccaaactgtaagatggtacatgtgtgctgtttaaaccactcaaaatgtgagaattttttaaaggagcaataggaaaccaatacataatataaaatgataagataacatagcacactcaaaattaaaacaagttatgtcatttttaaaagcatgcaaagaaacatacaaagagctcttagaagtcatacacatacataagcacctgcacacatatatacaggtccacacatacacatgtatactagc

SEQ ID NO: 42504 - DNA, 710 bp, Homo sapiens
gcccattccagttggagaacgtagtgagtctttcagtggagccagggtctggtttgtcgtgaggagctccgcgatgtcctctcaacagagcgccgtttccgccaaaggcttttccaaggggtcgtcccagggccccgctccgtgtcccgccccggcgcccaccccggcgcccgcctcctcctcctcctgctgtggctccggcaggggctgctgcggcgactcaggctgctgcggctccagctccaccagttgctgctgcttcccaaggagacgccgtcgacagcggagtagtggttgctgctgctgcgggggcggcagccagaggtcccagcgctccaacaaccggagctcaggatgctgctccggctgctgagaggcccgcaacccccagcgctgcgctagagaaacccgcccagcccagagcgggcccgccccgctgcggctcccacgcggggctgggcctcggagtttgccccgtaaagcgaattgcactttgatgttcagaaacccactttgttctcagccacgcaaaactccctgaccccgatgtgatttttctccccggggattcgagagccatgcgtgggacactggaccctactgtctacacgggcttgcacacagcaggtgctcagcaaatgtctattgatttgattgtcttttgaagatgtcataataaagcttctacctcctgagaacaaaaaatattt

SEQ ID NO: 42505 - DNA, 673 bp, Homo sapiens
gtggcccattccagttggagaacgtagtgagtctttcagtggagccagggtctggtaagtctcctagcagggtctgggggagagggtgggatgagttgagggcacaggggaggagcaaacagaacacaggcagcagatagatgtggaaggggtgtcccgcaaggcacctacgcttctagtgagccaacctcttaaggtactaatgaggacataaaggcaacataggaggtggtttttgcaagggtacacagcaagtccgcagaagagctgtgactagaacccaggtctttcagctccctggatggggttatttatattggcacaactctcctttcccacatggttgtggggcatgagaggcgtaggcaagaaagaatgatcaggacatgcttctggcctgtggattatttagacccagcaggtgggaccgcctgttggacttgggtgttttctaactgatgggggtgtagtaactaggaagatacagtcgaaggtcggtaggaaagtaaaatgagggacaagaaaaaagccaagtggagattttggactggatcatacagataagttgccgcagtgtgctgtttattttccactgtggagaacttgagcagtcttcttctagtcagagaaaatggaaatgcattgattcattgcatggattgtgtcctgctct

SEQ ID NO: 42506 - DNA, 3667 bp, Homo sapiens
tgtttgtccagcccgccagtttctgcagtggaggtcgcgactgagggacgggacagagaagtcgcgaaagtgggccagaggttctgcgacaccacctcgggtgagctgcgccaggcccgggatagggactgttgtgttcgaatgcccgccccggtcggccgccgctccccgcctagtccacggagctcaatggcggcagtcgcgctgagggactcggctcagggtatgacctttgaggatgtggccatttatttctcccaagaagagtgggagctccttgatgagtctcagaggttcctgtactgcgatgtgatgctggagaactttgcacatgtaacatccctgggttattgccatggaatggagaatgaggcgatagcttctgagcagagtgtatctatacaggtcaggacttctaagggcaatacacccacccagaaaactcacctcagtgagattaagatgtgtgtcccagtcttgaaagacattttgcctgcggctgagcaccaaaccacatcccctgtgcaaaagtcatacttgggtagcacaagcatgagaggcttctgcttcagtgctgaccttcaccagcatcaaaagcattacaatgaagaagagccctggaaaaggaaggtggatgaggctacatttgtgaccggctgcagattccatgtgttgaattatttcacctgtggggaggccttcccagcccccacggacctactccaacacgaagccactcccagtggtgaggagccacacagtagcagcagcaagcatatacaggcatttttcaatgcaaaaagttattacaagtggggtgaatacagaaaagcttcaagccacaaacacacacttgttcagcatcagagtgtctgttctgaaggagggctttatgagtgtagcaaatgtgagaaagccttcacttgcaagaacacacttgttcagcaccagcaaattcacactggacaaaagatgtttgagtgtagtgaatgtgaggaatcctttagcaaaaagtgccacctaatcttacacaagataattcacactggagaaaggccttatgaatgcagtgatcgtgagaaagcctttatccataaatctgaattcattcaccaccagagacgtcacactggaggagtgcgtcatgagtgtggtgaatgtaggaaaacctttagctacaaatctaacctcattgaacaccagagagttcacactggagaaaggccttatgaatgtggcgagtgcgggaaatcctttagacaaagctctagcctttttcgacaccagagagttcactctggagaaaggccttatcagtgctgtgagtgtgggaaatcctttagacaaatcttcaatctcattcgacatagaagagttcacactggagaaatgccttatcagtgcagtgattgtgggaaatcttttagctgcaaatcggaactcattcaacaccagagaattcacagtggagaaagaccttatgaatgcagagaatgtgggaaatcctttagacaattctctaacctcattcgacaccgcagcattcacactggtgataggccttatgagtgcagtgaatgtgagaaatcctttagccgcaaatttatcctgattcaacaccaaagagttcacactggagaaagaccttatgaatgcagtgaatgtggaaaatcctttacccgcaaatctgacctcattcaacaccggagaattcatactggcacaagaccttatgagtgcagtgaatgtggcaaatcttttagacagcgctctggcctcattcagcaccggagacttcatactggagaaaggccttatgaatgtagtgaatgtggaaagtcttttagccaaagtgctagcctcattcaacaccagagagttcacactggagaaaggccttatgaatgtagtgaatgtgggaaatcctttagccagagctctagcctcattcaacaccagagaggtcacactggagaaagaccttatgagtgcagtcaatgtgggaaaccctttacccacaaatcagaccttattcagcaccaaagagttcacactggagaaaggccttatgaatgcagtgaatgtgggaaatcctttagccgcaaatctaacctcattcgacatcggagagttcacactgaagaaaggccttaaatgtgaagggaatgtgctatttctttattcagtataatagcactggaggagactgtggtagccatcttcgtaaatttaaactttgagcacccacagtggggtattcttcataagtttcaggtatgtgggaagctctgaggaggttcattgtaatttctaatctgccgaggcctatagcctgatttatgtcactgccaatttctgaggctgaagccatttcacatttcacccctaccacctggcaggtgcacaccatgtgcatgagtcacttccccacagtgctcagagaagcaaacctctgtactctcccatttgcttggggaaattattaatagcccaagcatgtagggtcttcatgtcttttctctgactttagagtatacacctgacccagttgtggtccagagaatctgagttgtgctgtcagctttctaaggattacttttttaaggaacattgtcggtctcacatgatgcttgtaatgaatttttccacattctgattcaccagcctggaaactgcttggtgcacattgctttaatttataatgtttttataaaggttttaaaaaaatttacgcacctttaatcttgggtgttctattcattgcatagaatgacttgtaagcagaatagtgatgtcagcatgaaggggtgaatagattttgtggagatctcaaactttctgtactcagaagggacaatgtgatggcagaagacagctctttgttctgtattgctctaattggcctgctgcccaaggcctcaaagtaaagactgccaggctttgtgttcctgtattgtggcctggtgccatttttgtcaggtcagaggtcaccatgaaaaggaggcagttgtgacaatccccagtgcttctgtgaacgtgaattttgttcagttgtccacaggagatccacataattcctagcactggtgaggggaatctgttgcccaggtcctgcaaaggagccatgtgccatggcatataagtcagtgtagactggtgccatttgttgtcagactataggtgtggaggtgaaattacaggttcaacagtaattgggacagaaactccaggtaaatggggagtggagaagactgcagtaaattagatggaatgactcttctaaaagttcatctacaaattttccagtgaatatggttgtgtaggatcagtgcatacagaaattctcaggatcttctgtttactatcgctgagatcattatcagaaaatagtctggccgggcatggtgtaatcctaacactttgggaggccaaggcgggcggattgcctgagctcaggagttcaagaccagcctgggcaacatggtgaaatcccatgtctactaaaatacaaaaaattagccaggcgtggcagcatgcgcctatagtcccagccacttgggaggctgaggcaggagaatcgcttgaacccagaaggcggaagttgcagtgagctgagattgcaccactgcactccagcccaggcaacagagtgagactccgtctccaa

SEQ ID NO: 42507 - DNA, 580 bp, Homo sapiens
tgtttgtccagcccgccagtttctgcagtggaggtcgcgactgagggacgggacagagaagtcgcgaaagtgggccagaggttctgcgacaccacctcgggtgagctgcgccaggcccgggatagggactgttgtgttcgaatgcccgccccggtcggccgccgctccccgcctagtccacggagctcaatggcggcagtcgcgctgagggactcggctcagggtatgacctttgaggatgtggccatttatttctcccaagaagagtgggagctccttgatgagtctcagaggttcctgtactgcgatgtgatgctggagaactttgcacatgtaacatccctggatcaagccaccaatatctgagagagaaatgctggcttcaggagagctcaagtcagaggatcccagcagggattttatacccttctggggtaacacagttgagccagagtgcctacctaatcacgtatgccaaccagaaaccatcagcagtcaaacttgccctccatattgtcatgggatcttccagatgttaaacaataataataaagctcactgcatttaaatgtcaaaatga

SEQ ID NO: 42508 - DNA, 512 bp, Homo sapiens
accatatttcattctgcccaataactccttagccattattatttaaaatggactcagagatcatagcaaatatcccattttcatcaccaaatgaaaaaatttcaaaaatgtaattgaaaatactcacaaaactccacagagaatactcgtgtgaggttttgttaaggcaaaggatatggtgcagcaagagaaagaatgcgtgcccatatgctatgtcagacacaaatccaggcagttttccagactcccattcatacactgatatgattcacttccagatcaagccaccaatatctgagagagaaatgctggcttcaggagagctcaagtcagaggatcccagcagggattttatacccttctggggtaacacagttgagccagagtgcctacctaatcacgtatgccaaccagaaaccatcagcagtcaaacttgccctccatattgtcatgggatcttccagatgttaaacaataataataaagctcactgcatttaaatgtcaaaatga

SEQ ID NO: 42509 - DNA, 443 bp, Homo sapiens
tgtttgtccagcccgccagtttctgcagtggaggtcgcgactgagggacgggacagagaagtcgcgaaagtgggccagaggttctgcgacaccacctcgggtgagctgcgccaggcccgggatagggactgttgtgttcgaatgcccgccccggtcggccgccgctccccgcctagtccacggagctcaatggcggcagtcgcgctgagggactcggctcagtgagagaccgcggagtgttgggtcgtgtagaagtgactgaacccagaaggtggagacgagacgttgtcccgactgcacagaggctgctctgcagctccttaaaggcgctaggcgtgacccgcaccaaggccgggatcgggaccaccgtgcccgggtacctgcactgctcgccccctcctttcgaccccgctttccccacccagtcggatggcggcggccgc

SEQ ID NO: 42510 - DNA, 3326 bp, Homo sapiens
gcgaggaactaggctggttagaagtactgggtgttataagattgtacgacgtgtatctatacaggtcaggacttctaagggcaatacacccacccagaaaactcacctcagtgagattaagatgtgtgtcccagtcttgaaagacattttgcctgcggctgagcaccaaaccacatcccctgtgcaaaagtcatacttgggtagcacaagcatgagaggcttctgcttcagtgctgaccttcaccagcatcaaaagcattacaatgaagaagagccctggaaaaggaaggtggatgaggctacatttgtgaccggctgcagattccatgtgttgaattatttcacctgtggggaggccttcccagcccccacggacctactccaacacgaagccactcccagtggtgaggagccacacagtagcagcagcaagcatatacaggcatttttcaatgcaaaaagttattacaagtggggtgaatacagaaaagcttcaagccacaaacacacacttgttcagcatcagagtgtctgttctgaaggagggctttatgagtgtagcaaatgtgagaaagccttcacttgcaagaacacacttgttcagcaccagcaaattcacactggacaaaagatgtttgagtgtagtgaatgtgaggaatcctttagcaaaaagtgccacctaatcttacacaagataattcacactggagaaaggccttatgaatgcagtgatcgtgagaaagcctttatccataaatctgaattcattcaccaccagagacgtcacactggaggagtgcgtcatgagtgtggtgaatgtaggaaaacctttagctacaaatctaacctcattgaacaccagagagttcacactggagaaaggccttatgaatgtggcgagtgcgggaaatcctttagacaaagctctagcctttttcgacaccagagagttcactctggagaaaggccttatcagtgctgtgagtgtgggaaatcctttagacaaatcttcaatctcattcgacatagaagagttcacactggagaaatgccttatcagtgcagtgattgtgggaaatcttttagctgcaaatcggaactcattcaacaccagagaattcacagtggagaaagaccttatgaatgcagagaatgtgggaaatcctttagacaattctctaacctcattcgacaccgcagcattcacactggtgataggccttatgagtgcagtgaatgtgagaaatcctttagccgcaaatttatcctgattcaacaccaaagagttcacactggagaaagaccttatgaatgcagtgaatgtggaaaatcctttacccgcaaatctgacctcattcaacaccggagaattcatactggcacaagaccttatgagtgcagtgaatgtggcaaatcttttagacagcgctctggcctcattcagcaccggagacttcatactggagaaaggccttatgaatgtagtgaatgtggaaagtcttttagccaaagtgctagcctcattcaacaccagagagttcacactggagaaaggccttatgaatgtagtgaatgtgggaaatcctttagccagagctctagcctcattcaacaccagagaggtcacactggagaaagaccttatgagtgcagtcaatgtgggaaaccctttacccacaaatcagaccttattcagcaccaaagagttcacactggagaaaggccttatgaatgcagtgaatgtgggaaatcctttagccgcaaatctaacctcattcgacatcggagagttcacactgaagaaaggccttaaatgtgaagggaatgtgctatttctttattcagtataatagcactggaggagactgtggtagccatcttcgtaaatttaaactttgagcacccacagtggggtattcttcataagtttcaggtatgtgggaagctctgaggaggttcattgtaatttctaatctgccgaggcctatagcctgatttatgtcactgccaatttctgaggctgaagccatttcacatttcacccctaccacctggcaggtgcacaccatgtgcatgagtcacttccccacagtgctcagagaagcaaacctctgtactctcccatttgcttggggaaattattaatagcccaagcatgtagggtcttcatgtcttttctctgactttagagtatacacctgacccagttgtggtccagagaatctgagttgtgctgtcagctttctaaggattacttttttaaggaacattgtcggtctcacatgatgcttgtaatgaatttttccacattctgattcaccagcctggaaactgcttggtgcacattgctttaatttataatgtttttataaaggttttaaaaaaatttacgcacctttaatcttgggtgttctattcattgcatagaatgacttgtaagcagaatagtgatgtcagcatgaaggggtgaatagattttgtggagatctcaaactttctgtactcagaagggacaatgtgatggcagaagacagctctttgttctgtattgctctaattggcctgctgcccaaggcctcaaagtaaagactgccaggctttgtgttcctgtattgtggcctggtgccatttttgtcaggtcagaggtcaccatgaaaaggaggcagttgtgacaatccccagtgcttctgtgaacgtgaattttgttcagttgtccacaggagatccacataattcctagcactggtgaggggaatctgttgcccaggtcctgcaaaggagccatgtgccatggcatataagtcagtgtagactggtgccatttgttgtcagactataggtgtggaggtgaaattacaggttcaacagtaattgggacagaaactccaggtaaatggggagtggagaagactgcagtaaattagatggaatgactcttctaaaagttcatctacaaattttccagtgaatatggttgtgtaggatcagtgcatacagaaattctcaggatcttctgtttactatcgctgagatcattatcagaaaatagtctggccgggcatggtgtaatcctaacactttgggaggccaaggcgggcggattgcctgagctcaggagttcaagaccagcctgggcaacatggtgaaatcccatgtctactaaaatacaaaaaattagccaggcgtggcagcatgcgcctatagtcccagccacttgggaggctgaggcaggagaatcgcttgaacccagaaggcggaagttgcagtgagctgagattgcaccactgcactccagcccaggcaacagagtgagactccgtctccaa

SEQ ID NO: 42511 - DNA, 3543 bp, Homo sapiens
tgtttgtccagcccgccagtttctgcagtggaggtcgcgactgagggacgggacagagaagtcgcgaaagtgggccagaggttctgcgacaccacctcgggtgagctgcgccaggcccgggatagggactgttgtgttcgaatgcccgccccggtcggccgccgctccccgcctagtccacggagctcaatggcggcagtcgcgctgagggactcggctcaggttattgccatggaatggagaatgaggcgatagcttctgagcagagtgtatctatacaggtcaggacttctaagggcaatacacccacccagaaaactcacctcagtgagattaagatgtgtgtcccagtcttgaaagacattttgcctgcggctgagcaccaaaccacatcccctgtgcaaaagtcatacttgggtagcacaagcatgagaggcttctgcttcagtgctgaccttcaccagcatcaaaagcattacaatgaagaagagccctggaaaaggaaggtggatgaggctacatttgtgaccggctgcagattccatgtgttgaattatttcacctgtggggaggccttcccagcccccacggacctactccaacacgaagccactcccagtggtgaggagccacacagtagcagcagcaagcatatacaggcatttttcaatgcaaaaagttattacaagtggggtgaatacagaaaagcttcaagccacaaacacacacttgttcagcatcagagtgtctgttctgaaggagggctttatgagtgtagcaaatgtgagaaagccttcacttgcaagaacacacttgttcagcaccagcaaattcacactggacaaaagatgtttgagtgtagtgaatgtgaggaatcctttagcaaaaagtgccacctaatcttacacaagataattcacactggagaaaggccttatgaatgcagtgatcgtgagaaagcctttatccataaatctgaattcattcaccaccagagacgtcacactggaggagtgcgtcatgagtgtggtgaatgtaggaaaacctttagctacaaatctaacctcattgaacaccagagagttcacactggagaaaggccttatgaatgtggcgagtgcgggaaatcctttagacaaagctctagcctttttcgacaccagagagttcactctggagaaaggccttatcagtgctgtgagtgtgggaaatcctttagacaaatcttcaatctcattcgacatagaagagttcacactggagaaatgccttatcagtgcagtgattgtgggaaatcttttagctgcaaatcggaactcattcaacaccagagaattcacagtggagaaagaccttatgaatgcagagaatgtgggaaatcctttagacaattctctaacctcattcgacaccgcagcattcacactggtgataggccttatgagtgcagtgaatgtgagaaatcctttagccgcaaatttatcctgattcaacaccaaagagttcacactggagaaagaccttatgaatgcagtgaatgtggaaaatcctttacccgcaaatctgacctcattcaacaccggagaattcatactggcacaagaccttatgagtgcagtgaatgtggcaaatcttttagacagcgctctggcctcattcagcaccggagacttcatactggagaaaggccttatgaatgtagtgaatgtggaaagtcttttagccaaagtgctagcctcattcaacaccagagagttcacactggagaaaggccttatgaatgtagtgaatgtgggaaatcctttagccagagctctagcctcattcaacaccagagaggtcacactggagaaagaccttatgagtgcagtcaatgtgggaaaccctttacccacaaatcagaccttattcagcaccaaagagttcacactggagaaaggccttatgaatgcagtgaatgtgggaaatcctttagccgcaaatctaacctcattcgacatcggagagttcacactgaagaaaggccttaaatgtgaagggaatgtgctatttctttattcagtataatagcactggaggagactgtggtagccatcttcgtaaatttaaactttgagcacccacagtggggtattcttcataagtttcaggtatgtgggaagctctgaggaggttcattgtaatttctaatctgccgaggcctatagcctgatttatgtcactgccaatttctgaggctgaagccatttcacatttcacccctaccacctggcaggtgcacaccatgtgcatgagtcacttccccacagtgctcagagaagcaaacctctgtactctcccatttgcttggggaaattattaatagcccaagcatgtagggtcttcatgtcttttctctgactttagagtatacacctgacccagttgtggtccagagaatctgagttgtgctgtcagctttctaaggattacttttttaaggaacattgtcggtctcacatgatgcttgtaatgaatttttccacattctgattcaccagcctggaaactgcttggtgcacattgctttaatttataatgtttttataaaggttttaaaaaaatttacgcacctttaatcttgggtgttctattcattgcatagaatgacttgtaagcagaatagtgatgtcagcatgaaggggtgaatagattttgtggagatctcaaactttctgtactcagaagggacaatgtgatggcagaagacagctctttgttctgtattgctctaattggcctgctgcccaaggcctcaaagtaaagactgccaggctttgtgttcctgtattgtggcctggtgccatttttgtcaggtcagaggtcaccatgaaaaggaggcagttgtgacaatccccagtgcttctgtgaacgtgaattttgttcagttgtccacaggagatccacataattcctagcactggtgaggggaatctgttgcccaggtcctgcaaaggagccatgtgccatggcatataagtcagtgtagactggtgccatttgttgtcagactataggtgtggaggtgaaattacaggttcaacagtaattgggacagaaactccaggtaaatggggagtggagaagactgcagtaaattagatggaatgactcttctaaaagttcatctacaaattttccagtgaatatggttgtgtaggatcagtgcatacagaaattctcaggatcttctgtttactatcgctgagatcattatcagaaaatagtctggccgggcatggtgtaatcctaacactttgggaggccaaggcgggcggattgcctgagctcaggagttcaagaccagcctgggcaacatggtgaaatcccatgtctactaaaatacaaaaaattagccaggcgtggcagcatgcgcctatagtcccagccacttgggaggctgaggcaggagaatcgcttgaacccagaaggcggaagttgcagtgagctgagattgcaccactgcactccagcccaggcaacagagtgagactccgtctccaa

SEQ ID NO: 42512 - DNA, 567 bp, Homo sapiens
tcacatatacaatctctttattcagtgtttctcctcttagaaattatatttttcttccagcgaaggttggtgggaatctttgtgctgataatacccacagctcttctcccatagcaggatttgagggaaacttggcaagaaacactgcctctgaatccagcctccctgccgcagccccaggtcgagcaggtggaccggaaccacggtcactgaccagggtatctgatcctctcagtctgaaggaaagtgagaactcagcacaaacgccatggacggtacagtgtgggagggagcagcctagagagagaagcacgaagcactcgctcatgtcggaggaggaggaagagcgatccatgggcaggcaagccttttccatggcacaaaaaagaattttagaagcatccagttgcataaagacaggaaaagggcatctgtttcagccagtgtaccacaacaaaccacccactcgcagatgaaatgcactttcacagctgcctctgaaaatgggtttgaaaaaccaaatccaaaataaaaatagggactctcatttattgagagcttactatg

SEQ ID NO: 42513 - DNA, 353 bp, Homo sapiens
ttctatctggatctgccagacttcatctggacaacagatgcatcagctacactaaggcccgatccgagacttctgatgcataaagcatgcaacttcgcgcacggatgtactttccatttgaagtactgctagagatttgtgccctcaaacacgggaattttgcaaatgccagcccagacggaccaattgtcccagagaaggtaggggacatcttagccttctaattcaaatggaaaatttcctgctcccctgttgtcaattcctgcccggcactacgtgcagcggagatgagaaaagccacttcctttgcattcatctggactgctgtgcttggagaacagaggagcatgcat

SEQ ID NO: 42514 - DNA, 532 bp, Homo sapiens
ttctatctggatctgccagacttcatctggacaacagatgcatcagctacactaaggcccgatccgagacttctgatgcataaagcatgcaacttcgcgcacggatgtactttccatttgaagtactgctagagatttgtgccctcaaacacgggaattttggatttgagggaaacttggcaagaaacactgcctctgaatccagcctccctgccgcagccccaggtcgagcaggtggaccggaaccacggtcactgaccagggtatctgatcctctcagtctgaaggaaagtgagaactcagcacaaacgccatggacggtacagtgtgggagggagcagcctagagagagaagcacgaagcactcgctcatgtcggaggaggaggaagagcgatccatgggcaggggaatttgagagagagacctccttcagacccggttagcgcactgttttcaaaaaacctgaatggaacaacctgttgagagagcaaagagcgcttgtgtttgtggcacacgggagcctggcggccg

SEQ ID NO: 42515 - DNA, 355 bp, Homo sapiens
tcccaagtcaaacagcaagcaaacgtattctttctgcaccttttttgctctatgtagaccctcaaggtattgcatgatgtccactcacattaatgagggtggatcttccctagtcagtctactgataacaaatatcaatcttgcagacacaactagcaacaatgttatgccagcctgggtaactcttagcccagtcaagttaacacaacattaaccatcacaggacctctggcagagaccgataactgtctcccaatattttttgcctccttattctatagcaatagaattatatagttagttttgtgttgcaacccaacaataggaactttggatcttgtttttctttgtgtaa

SEQ ID NO: 42516 - DNA, 383 bp, Homo sapiens
tcctaagacgttcccagaagatgacaatgaggcagccatggtcctgctgagtcttcagaaacggcctttctaggataagtgctccttacacacttctccctggggcatcactgtcacagggatggtggtcaccacctgattctgaaacacgaagatcttgattctttcaaacacccagaggaagataagcaggatgctgacatactgcacccaggcgaactttaccatcgcccagaatcctggctgataaggacagacagttaaagagttggggaccacatggtataagtcaaagtaaactaaggtttaggccagacaggatatggcaagaatatttcaaatactcttaagatgaaaggaataataaaagattattaaaaaat

SEQ ID NO: 42517 - DNA, 1384 bp, Homo sapiens
tttcgtgataatttttaaaagatgggccttaaaccaatacagtcatatcatttaactcaattccatgaatttacaatgcaatccacagtgcccacaaccccatgtttctggaaaatcaggagtattgggtacaatggaataaaatgcaagaaggcaaataagagatcaggcttttaggacctaggaaacaaataaagaggaatttgttgctgaaagtaatgtgtagctgacactctcattacctgacacaatgggagacattatgtctgggaataagacatctatttccatagcactgtagtcctgcaaaggagttggaagttacgaatttttaaagattttagaacattatatctttagtctctcataagccaattatttatatctccacatagcccattattaccattgaaaaggcatgcaattcttctatttgaagcttgttccctttttacaaaagtactagtaaaaatctgagtcatacaaaagagcaggtcaggtgtcactaataacagtttacctcagcttcatctccatgaaggttttacttctaatcccagagtctcatgtttatgtattacaagagtgtatgaaagctgggcatggtggcacacaccagtagtcccagctactcggtcgggggttgaggtgagaggatcgcttgaactcaggagtttgaatccagcctggtcaatgtagcgagatcctatctcttaaaaaaaaaaagggggggaaacagtgtatgatcctattatttgggtttgtgtgtgatcgaatacatggtatatagttcatggaaaatttaagctcagcaaggaaagaaaatggccagcttcctgtcttaggaagacaatttactttttggcatctgtttggttgaaagtttgcctttgatccagattctttcggatgtcagggatattcacattgacatgtctttttagtgttccaggagattttagtttgaatagtacaattttttcttcttacaacaaaacttagaacggcttctaacttatttcttcatggccaagaaactaccctaacttatctcgataaatatttagttctgtcttatttctaatgtgtaaaacaggttttaaaaataatatatagattttgcatttataaaaaaagatttaatttatagaaccaaacttgaacatatgtttaatttagcctaatcagaaggttacagaaaaagttgctgtaaagatagaataaaagtattgtactggtctgtttttactgaagttccagaatgtgaggttattagagtcttggcttattgtgtcatgttttcctgaatgcttcctttgaagatgagcacacaccaaagcatcctttgatattatgtatggattaaattaacactgctttccaa

SEQ ID NO: 42518 - DNA, 972 bp, Homo sapiens
aaaaagggacagaaggagaaggaccttagaaatctgtagaaatctcagtggcctcctggagtctaacgaactgaagttcaaggaagactagaagtgtatgcgccctgatctcatggctccctgccttgatgaagccatttgtattcacagaggggctcctccctgcactgctgtatttaattctggatatggtataaataggacttggctgactgtcaaagcacaccacccgccacaatgttccagttttttggggacatcagacgaatctgagcctttgattccctctagtggcttaaattggcaactttcatagctggctcttggcatttgttattgaatgtttaagtatctattgtatgcactaaattggtgctgggttctctagctctgcctggaatgtagggcactggtttcatttgagcatttttgtgtccggtggaaagtgatcagggttaagccagagctccttcttacaaagctccttcttaacaaagcttagcttagtacagtgcaaaccagtgaatttcccagctattctaaagctgctttatagtaattctgggaggatgggttattatatgggttatttctgccgctaaatgagttgtaggaccttgggctgtctcttttacccctgggtcttagtttgctcattggtaaaaatgagcgtgtgggttacactcagataaattcaacaaatattaattgaacacctgcagtgtgagaccctgggctgagtactatgagaaggcagcaatgaatggtacttgatgtcaaagagcttacaggataatgggagaaccagacatcctggaagccacataaaattgggcaggaggaggctgggcgtggtagctcacacctgtaattccagcactttgggaggctgaggcgggtggatcacttgaggccaagagttcgagaccagcctgaccaacatggtgaaatcctgtctctactaaaaataca

SEQ ID NO: 42519 - DNA, 1471 bp, Homo sapiens
gggcgcctccgggcctctgcggagccctgggcagctctgagctcgcggaggcgtggccggtgcgcggggcccgcggcgcgcggggatgggggtctcggtggatgtgcaccaggtgtacaagtaccccttcgagcaggtggtcgccagctttctccgaaaggtttccacgctttgagaaggactgaatgagatcatgcgcatggcagcttctctaggatagcaccctgcgtgaacacagtagctgctcagttaagtctttgatgggtgtgatcctgattcagcttgatcaattctgcagtcatactggattgtgtttgaaaaggtgtccagaaaaacctggccatctgcctcctgtcttcccagtaccccaaccccatggataaaaatgtcatctcagtaaaaatcatggaggaaaaaagagatgaatcaacaggggtcatctacagaaagaggattgcaatctgtcagaacgtggttccagaaattttaaggaaggtgagcattttgaaagtacctaatatccaattagaagaggagtcatggctcaatcctcgggaaagaaacatggccatacggagtcactgccttacgtggacacagtatgcatccatgaaggaagagtctgtcttccgggaaagtatggaaaacccaaattggacagagttcattcaaagaggcaggatttcaatcacaggggttggatttctcaactgtgttttagaaacttttgccagcacattcttacgacagggagcccagaagggaattagaatcatggagatgctgctaaaggaacagtgtggtgcccccttagctgaataaagaatcatcagagagctgtatccatgtctacttttttatttatttattttttttttgagaatcacttcttggccacagcacatcacagacacagtttctggaatacaggtttgaggatacagtgttggcagcttcaagaagagaagaccttcttgccaggacataaaatgataccctcctctgggagcctgcttcgaatagtgggactcagggagataagaccttcttgctggatttttatgacacaatctctttataattttacaaataaaggaaaaaagacccatgtaagatatgtgtgcccttcctcagggtgttctgctggttgtctgatgatggtgtcagggcagctaaggacaggataaaggcctggagagggtgcttgtgcccttatgttatcagcaccgttgttcctaggattcgtgaggggattctggaaccaataagggagttgaactggtacctgattcacgggtggactggaacaaacaggaatgtaccagacctatgttgaagctaagccgtatttataacaatgtttaagattctcagaaatcaggagatttttatcctatccataagtaatatgtaactgccataagtatagcttttagaatgtaatatgtaaactgtgatttggtcctctgga

SEQ ID NO: 42520 - DNA, 1063 bp, Homo sapiens
attgtggcttctcttcaacatatctgaattgtcagcatcactacttttgcactttggtgcccttatgaagtaaaataagagttacttgaacacaggcacagtgatactgcaacggttgatctgagagctcagagggctacagagtgactaataggccagcagtgtctacagtgtggatatcctggacaaagagatgattcatgtgccaggacagaagatttcatcacacgtctcagaatgtcatgcactaaaaacttatgaattttttatttctggaattttccacttaatatttttggaccacagttgactgtgggtaactgaaactgtggaaaacaaaactacagataagagggaattagaatcatggagatgctgctaaaggaacagtgtggtgcccccttagctgaataaagaatcatcagagagctgtatccatgtctacttttttatttatttattttttttttgagaatcacttcttggccacagcacatcacagacacagtttctggaatacaggtttgaggatacagtgttggcagcttcaagaagagaagaccttcttgccaggacataaaatgataccctcctctgggagcctgcttcgaatagtgggactcagggagataagaccttcttgctggatttttatgacacaatctctttataattttacaaataaaggaaaaaagacccatgtaagatatgtgtgcccttcctcagggtgttctgctggttgtctgatgatggtgtcagggcagctaaggacaggataaaggcctggagagggtgcttgtgcccttatgttatcagcaccgttgttcctaggattcgtgaggggattctggaaccaataagggagttgaactggtacctgattcacgggtggactggaacaaacaggaatgtaccagacctatgttgaagctaagccgtatttataacaatgtttaagattctcagaaatcaggagatttttatcctatccataagtaatatgtaactgccataagtatagcttttagaatgtaatatgtaaactgtgatttggtcctctgga

SEQ ID NO: 42521 - DNA, 459 bp, Homo sapiens
gggcgcctccgggcctctgcggagccctgggcagctctgagctcgcggaggcgtggccggtgcgcggggcccgcggcgcgcggggatgggggtctcggtggatgtgcaccaggtgtacaagtaccccttcgagcaggtggtcgccagctttctccgaaaggaagagcctccgggaatcccagctcgtgagctccgtggagttgcagatgaccgacgtgtggagctttccggttcatcactgaccccttaaaagcgaggggaggccattgggcagtcatcctggtttactcagcatgatggttctgctgccccatccgctgctccttattaaacagctgtgggacatcgtgcaggttgcttactctctttgtgccttagtttgctaatctgtaaaatggggaaaataatagtaccgactcatagagttgttgtgaggatccaaatgaggtaacttgtgta

SEQ ID NO: 42522 - DNA, 1281 bp, Homo sapiens
gggcgcctccgggcctctgcggagccctgggcagctctgagctcgcggaggcgtggccggtgcgcggggcccgcggcgcgcggggatgggggtctcggtggatgtgcaccaggtgtacaagtaccccttcgagcaggtggtcgccagctttctccgaaaggtttccacgctttgagaaggactgaatgagatcatgcgcatggcagcttctctaggatagcaccctgcgtgaacacagtagctgctcagttaagtctttgatgggtgtgatcctgattcagcttgatcaattctgcagtcatactggattgtgtttgaaaaggtgtccagaaaaacctggccatctgcctcctgtcttcccagtaccccaaccccatggataaaaatgtcatctcagtaaaaatcatggaggaaaaaagagatgaatcaacaggggtcatctacagaaagaggattgcaatctgtcagaacgtggttccagaaattttaaggaagtccttaagcactctggtgattctttgttggaaaaagaaacttttgccagcacattcttacgacagggagcccagaagggaattagaatcatggagatgctgctaaaggaacagtgtggtgcccccttagctgaataaagaatcatcagagagctgtatccatgtctacttttttatttatttattttttttttgagaatcacttcttggccacagcacatcacagacacagtttctggaatacaggtttgaggatacagtgttggcagcttcaagaagagaagaccttcttgccaggacataaaatgataccctcctctgggagcctgcttcgaatagtgggactcagggagataagaccttcttgctggatttttatgacacaatctctttataattttacaaataaaggaaaaaagacccatgtaagatatgtgtgcccttcctcagggtgttctgctggttgtctgatgatggtgtcagggcagctaaggacaggataaaggcctggagagggtgcttgtgcccttatgttatcagcaccgttgttcctaggattcgtgaggggattctggaaccaataagggagttgaactggtacctgattcacgggtggactggaacaaacaggaatgtaccagacctatgttgaagctaagccgtatttataacaatgtttaagattctcagaaatcaggagatttttatcctatccataagtaatatgtaactgccataagtatagcttttagaatgtaatatgtaaactgtgatttggtcctctgga

SEQ ID NO: 42523 - DNA, 1771 bp, Homo sapiens
gggcgcctccgggcctctgcggagccctgggcagctctgagctcgcggaggcgtggccggtgcgcggggcccgcggcgcgcggggatgggggtctcggtggatgtgcaccaggtgtacaagtaccccttcgagcaggtggtcgccagctttctccgaaaggtttccacgctttgagaaggactgaatgagatcatgcgcatggcagcttctctaggatagcaccctgcgtgaacacagtagctgctcagttaagtctttgatgggtgtgatcctgattcagcttgatcaattctgcagtcatactggattgtgtttgaaaaggtgtccagaaaaacctggccatctgcctcctgtcttcccagtaccccaaccccatggataaaaatgtcatctcagtaaaaatcatggaggaaaaaagagatgaatcaacaggggtcatctacagaaagaggattgcaatctgtcagaacgtggttccagaaattttaaggaaggtgagcattttgaaagtacctaatatccaattagaagaggagtcatggctcaatcctcgggaaagaaacatggccatacggagtcactgccttacgtggacacagtatgcatccatgaaggaagagtctgtcttccgggaaagtatggaaaacccaaattggacagagttcattcaaagaggcaggatttcaatcacaggggttggatttctcaactgtgttttagaaacttttgccagcacattcttacgacagggagcccagaagggaattagaatcatggagatgctgctaaaggaacagtgtggtgcccccttagctgaataaagaatcatcacttataaatggggaaataaagactggaaaatgtatgtgatttgctcaacatcaaacagtcatcaagagcctgtgttaacatctggcgtggatccaaaacccatgttctttaccgtgtcgtcaaaaatgttctggaggccattgcaagcttctccctccacacccctcctcaccctctggcatagtcacagggcaaacactggatctaagccaatcagatgggctctttcttctggaactgaatcctcagcagaatgacaaagaaagactaaacaatgatgactcaaatgaactgatcctttgattccacatcagctccttcatgagactgggaagcagttcctttaccttctttgttgtcccattgtggagctggctcctccagctctcccagcaattctatgggaatcattctccagtgatttctctttttggatggcctaagttggattatgttgattgcaatcacagaattgtattacatatgtcagtttttaacgtatttccttaaccttaaaatgccacaaatttaatatgcatcattaagtttttcagggaaaaaggaagaagcagtcacactatattcaatatatacaccgataggcaagaggcatactggtttgagaaatgtgaaacctcgtgccgaattcggcacgagtcgccttacaagttccagataccgcccagatgaattttttttttatcacagctgtcattctcatttctacaggcatgaaaagtgcgactcaagttcagtgtcttgcctcgggtagcttggggattcccagtcagctcctcgcgccttcgtcgccgctccccttccaccccgcgccttcgccggccgtcccctgctccatccaggccacgggggtgacggtggggtctggggcattcaggcctggctgggcatgagggcttcaggcccaattccacctcgtgc

SEQ ID NO: 42524 - DNA, 1215 bp, Homo sapiens
tagtttttccttttgtgagtcatgcttttggtgttgagtctgagaactcattgcctagccctaggtcctgaaaattttctcctgtgtcttgttctaagagtttatagttgtatgttttaaatgtaggtctgtgatgcatattacttgtgagggaacccattgtcatgattctgtgattttctttacaagaaggttattgggtttattcatattttgacagttgttatggcttggtcgtaggagtctaagttgggaaagtgacagggtgaagctggaggggctggtaggccatgaggcatgctgttcagaggctctggtgcatgtaggagaggaggcaggacaggaggctctggtcatgcatgggagaggcagcactgagattagagatggaaagatttcaggggatgagtttcgaggtgtggccacaaatacggtcaactgatgtgaatgtgggcgatggacatgggagatgaggaagcaaggcactgtgaagctcatccacagtgacttgattaatcacttagatgctgaacttcacagtggtaaagtgtgcatttttaaagaaggtaccgaagtaaaccaggtgctgagggatttctttgaggagtacatggccccatggatatgcatggaaagatgttgatagagtgtaagtggtgtctaaaagcagagagcagaacagtggggcaggaggtatatcaaggtcagaagaaaatgccaacatttctaccttcctcttcccaaattcttcagttggtccaaaactatacctgtttgtgatgtatagttatagttacatgggccagccatacaagctctttgagccttgttgccatcaccagtagaatggggctggtaagtcagcatgtttctttctacctctcagcaatgttgagagaaaatgtaattatgtatgaagaagttctttgaattcttaaaattaatggtttaattaatttaaacagaaaaccaaatatcgcatgttctcacttgtaagagagagctaaataaggagaacacatggacaccgacacatagatgagagcaatagacacggggcctgatggagggtaggaggagggagaggattgggaaaaataacgaatgggtaccaggcttaatacctgggcaacaaaataatctgtacaacaaactcccatcacacgactttacccatataacaaacctgcacatgtacccctgaacttaaaagtc

SEQ ID NO: 42525 - DNA, 546 bp, Homo sapiens
ggcaggtcatcattgccaccagcatttcaaagacacatggtccttccaaatggactgcaccaatttctcaatgttaatagatcatctaaaaaaaaaagctgtattatatactttccagaccctttgtttaaatgagaccttacaacagaggcccagtatgtaaaacagataggaacacttgtgatgtagagcaggttatatactgattaatagcacagattctggagaaacaaaagctggattcaggtcctggcttctgtgacttatcatagcgctgtgggaccttgaacaaaatgcctaacctctctgtgccttccttatcagggaaatgggggaaatggggataataagaggccttatctgtgataaggttagtagaaggattaaatgattcaaagtgtgtaaaatgttaagcacagttcctggcatataataaatgctcaataagtgttttattactataccaataaccataataattatcattagtaatattatcccccaggtggaaaaaaaataaaaactagggaccccaatttattaagc

SEQ ID NO: 42526 - DNA, 638 bp, Homo sapiens
ttgatctgtcaaattccaggtgacaagatctatgcaccccatgcgtccttgaggggcctcttccccgcaggctctggctggccgcaggctggttctggtgtgaaaggttatactgccttttctttgtttgtttgtttttttctctaaaaacaaacagcaaaagacagctgaaaacaagaacttcaccggtgggcaggcaagaattctcttctggaaaatgacgtttgtggctctttcccaagttggccttcaaagagcctgcctgctgttgagccagaagatgtctcgtgtgaaggctggggtggcggctgtcttggaacctctgtgagcaggaggccctaagccgcagcagtggatagaggtgcagctctctgcctctctgccctttggtctgtgttcacaggtgacccgtgtcagcctgcatcgcaagcacacaccctgcgggccttcaagtctcactgttccgtatgaggaaacagacagcggactgaggaagcgatggccccagagaaagggcccctgtagcctggctctcacacagtattttatctttgattctgaataaatattttttgtggggttttttttttttttttggtggcagttgtttgttttaaactgaccacttggaagaaaca

SEQ ID NO: 42527 - DNA, 550 bp, Homo sapiens
tagggggttgcatccatctttaccacattttgtactagaatcccaccctttcatccaacttacaccttccttgtacagtaagcctgggtcaccagtcttttctcaagctgttattttgtgccttaatctggtccactcttatccattccaaaagactttggaccattggacaccaggacctaggggctggagtctttcccagaagacactagctcctatgtaagtaggcccacctcctcatataattagctttgcattcaggagattcagggcaagtctcagaaggttctggagcactttaaatccataaaatataatgagtgcttactctgtttctgcataactaagagggatgctcaagtgggtttttcaagggaagaaattagcttatctcaatttaaaaataaaataaaataaaactgaagtcagctatatttacattccttctgtatgtttggtccattctgtctgcttggggcctgtggtctccctttagagatcttttatttactctgtatgttccattaaagagtttattgcctaagccaaa

SEQ ID NO: 42528 - DNA, 444 bp, Homo sapiens
gcatttttagtagagatggggaatttcaccatgttggccaggatggtctctatctcttgacctcatgatctgcctgccttaggctcccaaagtgctgggattacaggcgtgagccactgcaccgggccctagcatagaaatttctaaagtggatataaattaatcatatcaattctaaattacagtttagttaacattttttaacctgttcttcagttattacactgtatttttagtccaaaaaaagatgaaaggatttatcaggatgttttgaggggatagatttttaaataggtcattttgaagatacttttgagtagacatagtcattacatagtcattaaaaaaccagagctttacatatttttataaaataatttttaaattctaaaagtaataaatgaccttagggaagatttggaaaatacaaacaagtatgaagaa

SEQ ID NO: 42529 - DNA, 400 bp, Homo sapiens
aaaagctcgaatattgtgtcttttgtagcttttcttatatcatgggtagtattacatctctctctctctctcttttttttctttttgagagatttttgctctgtcccccaggctgggcaacagagcaagattccatccaaaaacaaaagaatcagagagcttctttaggacacccctgaaataaagttatttcttatgttctcagggctgaaattgttataattaatgaggctcatatgccagagcttccctggcataatgtgaaggagggaatcctagagagacaggagtgttgcactggatttactatgtgtcatctgtatagcccactcccccgccctttgttgacagagcagaagacactctcttcacaaaggttattaagagagtagtggcggga

SEQ ID NO: 42530 - DNA, 388 bp, Homo sapiens
tgcctcagcctcccgagtagctgggactacaggtgcccgccaccacgcccagctaatttttgtatttttagtagagacggggtttcaccgtgttagccagaatggtttcgatctcctgacctcgtgatccgccccgcctcagcctcccaaaggcatgagccaccgtactcggcctgcccaggctggtcttaaactcctggcctcaggtgatcctactgcctcagcctcctgagtagctgggattacagacacagcccccgttcccagctctagcatttcttaaggacaaaattggtgtgtaagtaacaggaaattcacattatgctgtactcattctctaatatcacagccatgttagaacaaatttgggttttcaaaacaagcgtaa

SEQ ID NO: 42531 - DNA, 279 bp, Homo sapiens
agtaacaaaagattttttcagtattaattatcatgaggtcttaaactctgtaatctatataaaactcagagagaacctgtcttgagtagtttaaatctctaattaaatcagtatttctacctagcaacagagtagcaaaagtattaattcagtggttctcaataggggtaggggagcagattttgaccgccagcccagggcacatttggcaatgtcaagatgtttttcgctgtcataacttacggaggggataggtgctactggcatctagtgggtaga

SEQ ID NO: 42532 - DNA, 472 bp, Homo sapiens
cagagtcttgctctgtcgcccaggttggagttgagtgatgcaatctcagctcactgcaacctccacctccctgactcaagccattctcctgcctcaacctcccaagtagctgggactgcaggcatctgccgccacgctccgctaattttcgaatttttagtagagacgggatttcaccatgttggccaggtcttgaactcctgacctcaagtgatccgcctgcctcagcctcccaaagtgctgggattacaggcatgagccactgcacctggccgggagatttcttaaagaaggatttgcgtgcatggaagtgccaggtcatagggagtgaacatttttgaagttactgatgcctcttgctaaacagctttctggagtggcagcaccaatttcacccccaccagacccttgcaatcagtgtttcttgaagtcctctgcacctgtccctgctggaaaggcaggagaaacagtt

SEQ ID NO: 42533 - DNA, 397 bp, Homo sapiens
cagcttcctcctctggggagcaggagagcccgtggcagtgccgtctctgaggatgcctcagggtgtgtgtggctcctgcctgccagcggcttgatgccagcttccacatctgtaaaaaccccttgtccctgcattctcccacaacctggcctgtcagtgcacgaacgcaggagggagggcggggctgtggcaggaggcagtgccgagtccccactggccaccatgtggggcacgcaggagcagacaccagccactcacagagcaccggtatcgcagcacaggccatgtgcatggctgcaacacagctccacagtgagcctgccgagccactgcatgcgcaggccaaggccaggtgtctgctttcccctcgggacatcctggggagggaacgcggggc

SEQ ID NO: 42534 - DNA, 418 bp, Homo sapiens
gaccaactcgtgcaaaagcaaggccagacctaaattcccaaggctaaatcaactagggtttcatctcaagaaagaatcacagatatgtcagggagagtctaattgtcaaacagaaattgccagactcaggtatcagaaagggaggaatgttagtaccacagaaagaccagaggcttaggagccagacagatctggtccactcaccagctgggcaggttacttgactcctgaggctcagtttcagaaggcatcagcatccacttcctgaggtggttgtgagaatctaagatattatatgtaaacacctggcacatggctcatgataaatagtagctattactactccatataggagaaatacaatgtaacatcatgggcccactgcagtggctcacgcctgtaatctcaacactttggg

SEQ ID NO: 42535 - DNA, 718 bp, Homo sapiens
tcggtagagatggggccttctcaagtgatcctcccccctcagcctcccaaagtgctaggcatgagccaccatatccagcctaggtattcttcatatacctggatgtaagtcttttctcacacgttatcaatattttctggcagtctgtgacctatcttttaattttcttaacagagtctcggagcagaattttaaaattttagtgtagtctgagttatcaacttctgttttatgaattgggttttggcaatgtatctaaacaatctgtacatgactctgagacaaagattttctcctgtttgcttctagaactactagttttatgtctagttctatcatccattttgagttaatttttgcataatctgcaaaatatatatcaaagtccaacgttctgcatagaatacctaaccattcaggacgatttactgaaaacgctgtcctttctccgctgaactgcccccatgcctctgttaaaaaccgcctgatcatgggggatgggtctacttctggactctgctctgtcccagtgatctgtatgtctattctttcaccacactgtcctgattgctgtcgctttgtattaagtctcaaaatcagagtgtgagtccttttctcttgcaaaattgttttggctactgtactttgattcttgtgcaagttttagaattcacttgatttctaaaaaatcctgcttagattttgttcggaattgcat

SEQ ID NO: 42536 - DNA, 394 bp, Homo sapiens
tataatcctttgggtatatacccagtaataaaattgctgggtcaaatgatatttctggttctagatccttgaggaatcgccacagtgtcttccacaatggttgaactaatttacactcccaccaacaatgtaaaagtacaacttctgttcttaatacaactgcttccaaagggattcaccagagcatggactctgaggctagagttcctgggcttatatcttgccctagctcatcctggctgtgtgcctcagacaagttgctctctatgagcttatcctgtcataaatggagataatagcaccaactttgattttaaatggctgttttggagattatatgagttcatggtcagagcttaactcagtgcgttggcatatagtcagctgttagtaa

SEQ ID NO: 42537 - DNA, 2359 bp, Homo sapiens
attttatcagttcgcaaatctgaagtctcatactgttttctgtctctttaaaacacattcttctggtggcttgggttcattgtgcattcattggccactcttcttgcagcaaattttaaatcaatttaaaattaggtaaactttttatgatactataatatatatgacgttgaaatgacattggttctgagtctattaatttaaattttgggatcattacattcagaatgaaatgaaattgaccttgatactaactttgagagccaaaaaaatgaatgggtaaacaaagcctaagggtcatgttaattaatttaacaaaacacactattttcagtcctttgggcttgtacattttatagacaaaattagtatttattgatttggaagtgttcaattgagagtaaatgactctgtgttttgaaactaatacctttgcatttaaaatactgaagtattattttgttagttgaagtagatcttttcctgtgtagcatgatttaatgcagagcagttattcacttatacttctgaaaagccataatattgaaatttaaaatgaatagtcttactttaaggtcacttttactttacattttactttaaaggtcgtttttagactttatgcactagtggtattgaaactaacctttaatatttgactaaattgcttgtgaatttttggaaactatgtttaatttttaaagacattgttatgtgaattatcttactaaattatcacttaagaactctctcatagcagtaatttcattaacacatatatatactaaccaatttgctaaatgaattgtcggttgtcctgcttaagtactagggccaagctttgaaatgacttaaagtgatctgaattttgattgagaaaaataatctgtcttctatcgaatgtttgaacttttagtgatgagcctcagcaaagtttcaccctgcatgaagcagaacaggtgggggaaaattacaagaggggtctgtaccaaaaatggccccaggatattccattgaacaagtattgaccattatcttcctaggtgctacaactccatactagtcattacagttagtctttggtttcacaaaaatgttactgcttcaaaggcttggcattaacagtgatgtcagcattcatactgccaacaatctgctggtcatacatggaagactgttaaagtgtggtctgtgcatcattgagcaattgttatgtagacacaaggcctgcttcactcaggatagcttgctcctctcgctgagaagagatacctgaagtctactaagtctactaaatgagatatatatgtgtatgtatatgcctatatatattattatatttactagtgtttgtgataatgttataaaaattaataagattgttttgttttgtatgaatgtacgacaaatcgagttgttcaatgtattgaatgaatgtcttactgtaagcatcagagctgtccaaccatgtgtaaatgtacctggtcttttgatcactgacactactttgctgttcaatctggaatcaactgacctggctctgccattgagaaataactaatttagaacaaaattgttaaattttaaaattgcatttctactagaaatagctttggagagttaattttaggtgcgaataacaggataaatgctatctgatcaagcattcatccgaaaaatgtttttgagaattcactttgtgcaaggcacagcttgttggggctggtatatgtgtggacatgtttgatttgaaaaccttcgtggtgtctctgtgtgttattgatcatctgtgtcttttgcttaaaatggcattatttgtaacacaaacctaatatcatatatacaaatatactgtatgtagccaagaacactaaattggtaagacgctttagaaaatatgcatttgaatttgaatatctaatgcctcaagcaaatttattagagtttcagatgaatatatatttttgtaactggcaagtaaatgagtagaacagagctttttgcctaaaaatatttttataagtactcatttacatagtattcattattttaaatgacaaaatatcaaattggttctataaatagtaattgttttgaatatatccatacttaacatcatatgaaatccaaaatttaatgataaatttcatctggatgtgttattataaaagtcatctttttttcctttgtaaaatatccatgtaacatagcttccattactccatattttatgtatggttaaaattatcaaagtgcattatgtattttatattgtttatttttgtctgcatgaaagattggaatagtaaccgtgtatgataaatgttaataataataaagtgaaatgtagtatgaccaa

SEQ ID NO: 42538 - DNA, 2382 bp, Homo sapiens
attttatcagttcgcaaatctgaagtctcatactgttttctgtctctttaaaacacattcttctggtggcttgggttcattgtgcattcattggccactcttcttgcagcaaattttaaatcaatttaaaattaggtaaactttttatgatactataatatatatgacgttgaaatgacattggttctgagtctattaatttaaattttgggatcattacattcagaatgaaatgaaattgaccttgatactaactttgagagccaaaaaaatgaatgggtaaacaaagcctaagggtcatgttaattaatttaacaaaacacactattttcagtcctttgggcttgtacattttatagacaaaattagtatttattgatttggaagtgttcaattgagagtaaatgactctgtgttttgaaactaatacctttgcatttaaaatactgaagtattattttgttagttgaagtagatcttttcctgtgtagcatgatttaatgcagagcagttattcacttatacttctgaaaagccataatattgaaatttaaaatgaatagtcttactttaaggtcacttttactttacattttactttaaaggtcgtttttagactttatgcactagtggtattgaaactaacctttaatatttgactaaattgcttgtgaatttttggaaactatgtttaatttttaaagacattgttatgtgaattatcttactaaattatcacttaagaactctctcatagcagtaatttcattaacacatatatatactaaccaatttgctaaatgaattgtcggttgtcctgcttaagtactagggccaagctttgaaatgacttaaagtgatctgaattttgattgagaaaaataatctgtcttctatcgaatgtttgaacttttagtgatgagcctcagcaaagtttcaccctgcatgaagcagaacaggtgggggaaaattacaagaggggtctgtaccaaaaatggccccaggatattccattgaacaagtattgaccattatcttcctaggtgctacaactccatactagtcattacagttagtctttggtttcacaaaaatgttactgcttcaaaggcttggcattaacagtgatgtcagcattcatactgccaacaatctgctggtcatacatggaagactgttaaagtgtggtctgtgcatcattgagcaattgttatgtagacacaaggcctgcttcactcaggatagcttgctcctctcgctgagaagagatacctgaagtctactaagtctactaaatgagatatatatgtgtatgtatatgcctatatatattattatatttactagtgtttgtgataatgttataaaaattaataagattgttttgttttgtatgaatgtacgacaaatcgagttgttcaatgtattgaatgaatgtcttactgtaagcatcagagctgtccaaccatgtgtaaatgtacctggtcttttgatcactgacactactttgctgttcaatctggaatcaactgacctggctctgccattgagaaataactaatttagaacaaaattgttaaattttaaaattgcatttctactagaaatagctttggagagttaattttaggtgcgaataacaggataaatgctatctgatcaagcattcatccgaaaaatgtttttgagaattcactttgtgcaaggcacagcttgttggggctggtatatgtgtggacatgtttgatttgaaaaccttcgtggtgtctctgtgtgttattgatcatctgtgtcttttgcttaaaatggcattatttgtaacacaaacctaatatcatatatacaaatatactgtatgtagccaagaacactaaattggtaagacgctttagaaaatatgcatttgaatttgaatatctaatgcctcaagcaaatttattagagtttcagatgaatatatatttttgtaactggcaagtaaatgagtagaacagagctttttgcctaaaaatatttttataagtactcatttacatagtattcattattttaaatgacaaaatatcaaattggttctataaatagtaattgttttgaatatatccatacttaacatcatatgaaatccaaaatttaatgataaatttcatctggatgtgttattataaaagtcatctttttttcctttgtaaaatatccatgtaacatagcttccattactccatattttatgtatggttaaaattatcaaagtgcattatgtattttatattgtttatttttgtctgcatgaaagattggaatagtaaccgtgtatgataaatgttaataataataaagtgaaatgtagtatgaccaaaaaaaaaaaactcactaaaagaa

SEQ ID NO: 42539 - DNA, 363 bp, Homo sapiens
ggagtttttaaatgttgaacacctccaacaaaatatgcttcctggacttccaactcaatgcatggaaagtgacatcttcatgatctccttaccccttgcccaaccacccttgccttcttgaattgcctttttatgttagtaaaactagtgggttctgtctcaaacttgcttatacatggagttacttttgagtcctctcctccatcctagcttgcataaatccaactcatgctttgaattcgtattgacactgtcctagctcagacctagttagctttcacgaggattattgcattagcttgttagccgtcctccttcccctgccacctttccacctccaatactttctactttctgttgtag

SEQ ID NO: 42540 - DNA, 532 bp, Homo sapiens
tcccaaactaatatagaccagaaactagctaatcaaatcaatgatctccaacaaactataatgtggctaggagattgagtagttagtctagaatatagaatgcagttacaatgtgattgagatacttctgatttttgcattactcctcatctgtataaagaaacagagcatgagtgggaaagagttaagagacatttaaagggtcatactggaaatttatctttggatattgcaaaactgaaggaacaagcatttcaagcctctcaggcatatctgacgctaatgccaggaactgaagtgcttgaaggagctgcagacggattagcagctattaacccgttaaaatggatcaagacacttggagggtctgtgatttcaatggtgattgtgcctttaatctgtgttgtttgtctttgtgcagtctgcagatggggatccccaatcctgtgagaaggagcccaccatgacaaagctgcctttgcctttattgctttgcaaaaaaacaataaataaataaataaagagggacatg

SEQ ID NO: 42541 - DNA, 255 bp, Homo sapiens
tagggaggaaaaagagcccttaactgatgaggccctaattttgacatgtgtagtgactggactggctttttactaacagtggtttttaggtcagggctctggctctggcgatgtggttgtttggggagaacatgaaccatgtttaatcttctgtggggtgtttgttcagttggtaaatgaggctgtcagctctggtccgcatgccagcaaatgcatctgatttttcacgtacagcattagtaacatatatattat

SEQ ID NO: 42542 - DNA, 455 bp, Homo sapiens
aatgattggaaccccagtcattcttaaatgagagttcttgtttgtgtgggtaatagtcatcaatattgaccatattagaaattaaaatagtattaaaatatttctatagttaattagcaataaaaacccattacatttttgcaaatatcttaatgtctggcttgataaaagataggctctcgaatctcgcgttcattcctgtgatatcacaggccttgcagcccacggaggcctctgctgtgcactctgtgagaatgagagtgagcaaggctggtggcggcttaggacgctcgggaaggtagttctgtgggactcctgaaaggcctcaggacccaggatcccagatgcacacgggagagtatgtatctggacagcgttatcttaatgcctctgcagaatcgtcctctggtattttggcatcagcatgctttttgattgcctgtctcaaaaaaaaa

SEQ ID NO: 42543 - DNA, 630 bp, Homo sapiens
acaaccgcaagcagaactcggctacagggcttgcctaaacttggttggaaaaagatgtctacttttaaaggctacaggtttcattgattttgaaaagaaggcaccgcggctaaacaaaaaggtagtgagttagacacctgcccctggggtcccccaccctcccaggaggcgcagctgcctagcaaccgaatgctctgcctgccctgcaggtccggaagagtccctggagttgatctctgtctggtgtctgtcctacttcttccatttgctcgtttccatccctttcgctttaccttccgattctagaaatacaaacaagtaaacagcttccacagtaccatccacccatcaagacctaaagtcctaaatcctgaaattgtccgctgtttctcgaggtccttcccaccgaatctcaacatctgaactgcaagtggtttgcttttactcattttacagatgagaaactgagatagactcagagaagagaaattattaaaattgcattgagttagggagctggaactgcaatctggttgactacaagttgctaatacatttgttaattcgactcacatggtgattccggattgtaaattggtgacagttttaccaaactagataatgtgtgca

SEQ ID NO: 42544 - DNA, 377 bp, Homo sapiens
aaatactcccttttgcttgaggaataatcagacatcatcaaaataaggacattacgttgaaaataatatcttggggaaaactatttatttctaatacggccagtgaggagttgtcttagggaatgaatgggctgaccaagaggattagaaaagagattcagcacttccacctggtttggctctagccctggtttgcagtgactaagagttgtcacctagacatctgtttgtagggcagagtgagacaagtctgtgacctcagctcagttcctgtggacagatgcccaccccttgaagttaacactcttgttaacagttttagtcacagagccaaggactgatagcaaagaagcaatgatgtgttgtttgtgttcact

SEQ ID NO: 42545 - DNA, 387 bp, Homo sapiens
gttgcttatgagcatagcatagtgtagtgattaggaattggaagacctgattttaatgtagttccatcagtaactagctctgatctttagtacattctctctgttgctcctttacctataaacttggaataagttttttccaattatctcatttggttttgaggtaaaatgagactatatatgaaagtgctttgaaaagtacagaagcatcaatttgaagacattgggtggggggtgtttaatgaaattgataaaataccatgacatttgggtgggtgaagttcattgccaaggtctccctttatctctttttcattcaggatttaatacttagttattatcttagagaaagcaaagtaacataacccattaactcatatttgtctt

SEQ ID NO: 42546 - DNA, 430 bp, Homo sapiens
gccagtaaaggctgcatatgaagcaaatcactattgtgggcagctagagcttattcctcttgggagccctaggtggtagtaaagaatatgcctcctaggggatagggagctggggtatttatccaccaactgccatcagatatgagctaaggggctgcttctgaggggtaaggagatattaatttctgaggcttcttacctccctcttctaactgctctctctctctatatatatatgtgtgcgtgtgagagagagagaaagagagaaagtgctactctgcatttgactgtgtcaaccactatatatatagatatttgcttatttatttcttccaaccccatcttacaaacaagaaaacaaacttctgagaggtcagcagcttgttgaagtcatatagctgttaagtgacaaaatttggattggatccca

SEQ ID NO: 42547 - DNA, 2087 bp, Homo sapiens
ggaaaacgtcacccagcagatgggtagtcctctgcaaagttacactgtcagccagtggcactggttcttttatttatgttgggtttttgttttttttttagaggagagtgaagaattgacatcagacaacatggagtgcaaaaataataacccatcaatatttgccttctaaatgtaaaatgtaaaagtttaactgatctgtgtacacattagagaccactttcacacgccacaatatgttcagttgcaggttaacactgagaggttgagacttccctcatctgatgaccagcttggttaatttgacttctgaaggcactaaattaccaagtatttgcagtaatggggaccggattaattttcctcacaattctctatagctgtctgatataagggctgtgtttttattgaatcacagatcctcaaattacagtgaaagcatgtcttgctagtaagactcatttgaaaacctctttattcttggaataattgggccagtacaagtggccagatgtatcctggccacattggaaaactatttgggcccgttcagaaccacttaactgcaacaacagtagtaactatagttaatatctatctattgagttattgtgtgacagttacttggataagtactttaatgcattctcattttaatcctcacagctaccctatgaggctgttactgttcttatccccattgtattgataaggaaactgcccagggtactcagctaagaagaggattgctttgggcataggaagcagaatgacgagttcagtcttcctcagtagttggagcacagttctcaaagcccatcaacactttggaatggatttgttgttttatttatgccatcaagggagagttgatatttgtgtattgctaaaaactactaaagtatgtcgatgcttaggtaggaacatacaaaccatatatcctctgggatctgcccaggtttctgtataaggcttgacctacgtaagatcctatgatgaagaccagaaaactttttttaaaagtaggtaaattaaaattaaaatcacgagtttgttcacatttgtcccataggttcctagtgcaaaaatgcagggagataaaagcaaacatttgaactcagtgaagtgagagtctttgggaactcctagatgttagaaatagcaccggggcatcaggtagccaacgttcaattcacttttcacgtttgtgtctttgtagctttagagctgatgagtctgattggtttggaagagagagttttaatttatgatgtcactgtgagaactgttgtgaaaattttgtaagaaaatacagtaatctgttgattttttcctgtagttttggctttcacatccctttggctgtgtttaagttcaagagcatgccaaggccatgagggtcctggcttgcacttcttgggaacagggcatgctagaggtgggtcatgaagctttcaaggtcactgttccagcccgaccctgcgcaatttaggcattgcctttatgtctctcctctctggaacttcatgtagcagcctaacaccggggccgagttgcctttactctattttctatgatgaatacttgtggagaaactgtgacaaatccattgatcctgatatttttattgttggagtcttgttgattctctatgaataatttctatttgattgtactgtgtagagttaatacccactagggatatgttaataaagctacaaatgcatagtgtaatatagaatagcaagatttttttgtgaacaatttatatagaagagtaagttgttttttaagtgttaggctcatttcttttagaaacttaaaatgttataaaagttttttaaacattcaatatttttaattataagagacatttgttactagagccaattatttcaggtgttctaattggagtgttgattttattacctcatatacctctagaatgccacgtgttctgttggggataaaattgcacaataaatgtcaagtctctgttaagtgttttaacttggtttttgcatctttctaattcattgtaaatacttttctgtttctttgaatacataacttttctctccctgaag

SEQ ID NO: 42548 - DNA, 272 bp, Homo sapiens
gctgctgcgggtgagacgggaggagggtagtcacgggcttagggctggaggctggcgggctagggctgagtgcagcgcctgcttagagaccttcgggagaacttctgccggaacctcgacggctcagaggcgccctggtgcttcacactgcggcccggcatgcgcgtgggcttttgctaccagatccggcgttgtacagacgacgtgcggccccagggtgaggcccaagcttgggggctacagagccggggctggaagcctggaaccggagg

SEQ ID NO: 42549 - DNA, 319 bp, Homo sapiens
agactccatctcaaaaaaaaaaaaaaaaaaaaaaggaatcagggaagtggaggatgaaagatgggccaaaacttttgatgctgcaaatggagagtcatggaacccttggcccttcatgtgaagtcacctggagaagaagcaactgggatggaacacaggtgattaaggtggaaacaggctaattaagtggaattgttttaatatttttgttgcatacgttactgatactaaatgcatgtctcattcccatgccgcccctcacccatcctgcactccttgagacatgcatttagtatcagtaacgtatgcaacaaaaaaa

SEQ ID NO: 42550 - DNA, 8971 bp, Homo sapiens
gcagcctccaggggacacgccatgactctggagggtctgtatttggcaaggggccccctggcccggctcctgctggcctggtcggccctgttgtgcatggcaggtggccaaggccgctgggacggggccttggaggctgcaggtcctggacgtgtgcggaggcggggcagcccaggcatcttgcaggggccgaatgtgtgcggctcccggttccatgcctactgctgtccaggctggaggacattccctggcaggagccagtgtgtcgtacccatctgtaggcgcgcctgcggtgaaggcttctgctcccagcccaacctgtgcacctgtgcggatgggacgctggctcccagctgcggggtgagccgagggtcagggtgcagtgtgagctgtatgaatgggggcacctgccggggggcgtcctgtctgtgtcagaagggctacacaggcaccgtgtgtgggcagcccatctgtgaccgcggctgccacaatgggggtcgctgcattgggcccaaccgctgcgcctgtgtgtatggcttcatgggacctcaatgtgagagagattaccggacgggaccctgctttggccaagtaggccccgaggggtgccagcatcagctgacgggcctcgtgtgcaccaaggcactttgctgtgccactgtgggccgtgcctggggccttccatgtgaactttgccctgcacagccacacccctgccgccgcggcttcatccccaatatccacacgggggcctgccaagatgtggatgagtgccaggctgtgccaggcctgtgccagggaggcagctgcgtcaacatggtgggctccttccattgccgctgtccagttggacaccggctcagtgacagcagcgccgcatgtgaagactaccgggccggcgcctgcttctcagtgcttttcgggggccgctgtgctggagacctcgccggccactacactcgcaggcagtgctgctgtgacaggggcaggtgctgggcagctggcccggtccctgagctgtgtcctcctcggggctccaatgaattccagcaactgtgcgcccagcggctgccgctgctacccggccaccctggcctcttccctggcctcctgggcttcggatccaatggcatgggtccccctcttgggccagcgcgactcaacccccatggctctgatgcgcgtgggatccccagcctgggccctggcaactctaatattggcactgctaccctgaaccagaccattgacatctgccgacacttcaccaacctgtgtctgaatggccgctgcctgcccacgccttccagctaccgctgcgagtgtaacgtgggctacacccaggacgtgcgcggcgagtgcattgatgtagacgaatgcaccagcagcccctgccaccacggtgactgcgtcaacatccccggcacctaccactgccggtgctacccgggcttccaggccacgcccaccaggcaggcatgcgtggatgtggacgagtgcattgtcagtggtggcctttgtcacctgggccgctgtgtcaacacagagggcagcttccagtgtgtctgcaatgcaggcttcgagctcagccctgacggcaagaactgtgtggaccacaacgagtgtgccaccagcaccatgtgcgtcaacggcgtgtgtctcaacgaggatggcagcttctcctgcctctgcaaacccggcttcctgctggcgcctggcggccactactgcatggacattgacgagtgccagacgcccggcatctgcgtgaacggccactgtaccaacaccgagggctccttccgctgccagtgcctgggggggctggcggtaggcacggatggccgcgtgtgcgtggacacccacgtgcgcagcacctgctatggggccatcgagaagggctcctgtgcccgccccttccctggcactgtcaccaagtccgagtgctgctgtgccaatccggaccacggttttggggagccctgccagctttgtcctgccaaaaactccgctgagttccaggcactgtgcagcagtgggcttggcattaccacggatggtcgagacatcaacgagtgtgctctggatcctgaggtttgtgccaatggcgtgtgcgagaaccttcggggcagctaccgctgtgtctgcaacctgggttatgaggcaggtgcctcaggcaaggactgcacagacgtggatgagtgtgccctcaacagcctcctgtgtgacaacgggtggtgccagaatagtcctggcagctacagctgctcctgcccccccggcttccacttctggcaggacacggagatctgcaaagatgtcgacgaatgcctgtccagcccgtgtgtgagtggcgtctgtcggaacctggccggctcctacacctgcaaatgtggccctggcagccggctggacccctctggtaccttctgtctagacagcaccaagggcacctgctggctgaagatccaggagagccgctgtgaggtgaaccttcagggagccagcctgcggtctgagtgctgcgccaccctcggggcagcctgggggagcccctgcgaacgctgcgagatcgaccctgcctgtgcccggggctttgcccggatgacgggtgtcacctgcgatgatgtgaacgagtgtgagtccttcccgggagtctgtcccaacgggcgttgcgtcaacactgctgggtctttccgctgtgagtgtccagagggcctgatgctggacgcctcaggccggctgtgcgtggatgtgagattggaaccatgtttcctgcgatgggatgaggatgagtgtggggtcaccctgcctggcaagtaccggatggacgtctgctgctgctccatcggggccgtgtggggagtcgagtgcgaggcctgcccggatcccgagtctctggagttcgccagcctgtgcccgcgggggctgggcttcgccagccgggacttcctgtctggccgaccattctataaagatgtgaatgaatgcaaggtgttccctggcctctgcacgcacggtacctgcagaaacacggtgggcagcttccactgcgcctgtgcggggggcttcgccctggatgcccaggaacggaactgcacagatatcgacgagtgtcgcatctctcctgacctctgcggccagggcacctgtgtcaacacgccgggcagctttgagtgcgagtgttttcccggctacgagagtggcttcatgctgatgaagaactgcatggacgtggacgagtgtgcaagggacccgctgctctgccggggaggcacttgcaccaacacggatgggagctacaagtgccagtgtccccctgggcatgagctgacggccaagggcactgcctgtgaggacatcgatgagtgctccctgagtgatggcctgtgtccccatggccagtgtgtcaatgtcatcggtgccttccagtgctcctgccatgccggcttccagagcacacctgaccgccagggctgcgtggacatcaacgaatgccgggtccagaatggtgggtgtgacgtgcactgtattaacactgagggcagctaccggtgcagctgtgggcagggctactcgctgatgcccgacggaagggcatgtgcagacgtggacgagtgtgaagagaacccccgcgtttgtgaccaaggccactgcaccaacatgccagggggtcaccgctgcctgtgctatgatggcttcatggccacgccagacatgaggacatgtgttgatgtggatgagtgtgacctgaaccctcacatctgcctccatggggactgcgagaacacgaagggttcctttgtctgccactgtcagctgggctacatggtcaggaagggggccacaggctgctctgatgtggatgaatgcgaggttggaggacacaactgtgacagtcacgcctcctgtctcaacatcccagggagtttcagctgtaggtgcctgccaggctgggtgggggatggcttcgaatgtcacgacctggatgaatgcatctcccaggagcaccggtgcagcccaagaggtgactgtctcaatgtccctggctcctaccgctgcacctgtcgccagggctttgccggggatggcttcttctgcgaagacagggatgaatgtgccgagaacgtggacctctgtgacaacgggcagtgcctcaatgcgcccggcgggtaccgctgtgaatgtgagatgggctttgaccccaccgaggaccaccgggcctgccaggatgtggacgagtgtgcgcaagggaacctctgtgcatttgggagctgtgagaacctgcctggaatgttccgctgcatctgcaatggtggctacgaactggaccgagggggtggcaactgcacagacatcaacgagtgtgcagacccagtaaactgcatcaacggcgtgtgcattaacacccccggcagctacctctgcagctgcccccaggattttgagctgaaccccagcggagtgggctgcgtggacactcgggccgggaactgtttcctggagacgcatgaccgaggggacagtggcatttcctgcagtgccgagatcggagttggtgtcacccgagcttcctgctgttgctccctgggccgggcttggggcaatccctgtgagctgtgccctatggccaacaccactgagtacagaaccctgtgcccgggtggtgagggcttccagcctaaccgcatcactgtcattctggaagacatcgacgagtgccaagagctgccagggctgtgtcaggggggtgactgcgtcaacacgtttggcagtttccagtgtgagtgcccacctggctaccacctcagtgagcacacccgcatctgtgaggatattgacgaatgctccacacactccggcatctgtggccctggcacctgctacaacaccctggggaactacacctgtgtctgccctgcagagtacctccaagtcaatggtggcaacaactgcatggatatgaggaagagtgtctgcttccggcactataacggcacatgtcaaaatgagctggccttcaacgtgacccggaaaatgtgttgctgctcctacaacattggccaggcctggaatagaccctgtgaggcctgccccactcccatcagtcctgactaccagatcctgtgtggaaatcaggccccgggattcctcactgacatccacacggggaagccccttgacattgatgagtgtggggagatccccgccatctgtgccaatggcatctgcataaaccagatcgggagtttccgctgcgagtgccccgcaggcttcaactacaacagcatcctgctggcttgtgaagatgtcgatgagtgtggcagcagggagagtccctgccagcagaatgctgactgcatcaacatccccggtagctaccgctgcaagtgcacccgagggtacaaactgtcgccaggcggggcttgtgtgggacagaatgagtgtcgggagatcccgaatgtctgtagccatggtgactgcatggacacagaaggcagctacatgtgtctgtgtcaccgtggattccaggcctctgcagaccagaccctgtgcatggacattgacgagtgtgaccggcagccttgtggaaatgggacctgcaagaacatcattggctcctacaactgcctctgcttccctggctttgtggtgacacacaatggggattgtgtggattttgatgagtgtactaccctggtggggcaggtgtgccgatttggccattgcctcaacacagctggttccttccactgcctctgccaggatggctttgagctcacagctgatgggaagaactgtgtggacaccaatgagtgcctcagccttgcaggaacctgcctaccaggcacttgccagaacctcgagggctccttccgctgcatctgtccccctggcttccaggtgcagagtgaccactgcattgatatcgacgagtgctcagaggagcccaacctctgcctctttggcacctgtaccaacagccctgggagcttccagtgcctctgcccacctggctttgtcctctctgacaatgggcaccgttgctttgacacacggcagagtttctgcttcacccgttttgaggctgggaagtgctcggtgcccaaagctttcaacaccaccaagacccgctgctgctgcagtaagaggcctggggagggctggggagacccctgcgaactgtgtccccaggagggcagcgctgcctttcaggagctctgcccctttggccacggggcagtcccaggcccggatgactcccgagaagacgtgaatgagtgtgcagagaaccctggcgtctgcactaacggcgtctgtgtcaacaccgatggatccttccgctgtgagtgtccctttggctacagcctggacttcactggcatcaactgtgtggacacagacgagtgctctgtcggccacccctgtgggcaagggacatgcaccaatgtcatcggaggcttcgaatgtgcctgtgctgacggctttgagcctggcctcatgatgacctgcgaggacatcgacgaatgctccctgaacccgctgctctgtgccttccgctgccacaataccgagggctcctacctgtgcacctgtccagccggctacaccctgcgggaggacggggccatgtgtcgagatgtggacgagtgtgcagatggtcagcaggactgccacgcccggggcatggagtgcaagaacctcatcggtaccttcgcgtgcgtctgtcccccaggcatgcggcccctgcctggctctggggagggctgcacagatgacaatgaatgccacgctcagcctgacctctgtgtcaacggccgctgtgtcaacaccgcgggcagcttccggtgcgactgtgatgagggattccagcccagccccacccttaccgagtgccacgacatccggcaggggccctgctttgccgaggtgctgcagaccatgtgccggtctctgtccagcagcagtgaggctgtcaccagggccgagtgctgctgtgggggtggccggggctgggggccccgctgcgagctctgtcccctgcccggcacctctgcctacaggaagctgtgcccccatggctcaggctacactgctgagggccgagatgtagatgaatgccgtatgcttgctcacctgtgtgctcatggggagtgcatcaacagccttggctccttccgctgccactgtcaggccgggtacacaccggatgctactgctactacctgcctggatatggatgagtgcagccaggtccccaagccatgtaccttcctctgcaaaaacacgaagggcagtttcctgtgcagctgtccccgaggctacctgctggaggaggatggcaggacctgcaaagacctggacgaatgcacctcccggcagcacaactgtcagttcctctgtgtcaacactgtgggcgccttcacctgccgctgtccacccggcttcacccagcaccaccaggcctgcttcgacaatgatgagtgctcagcccagcctggcccatgtggtgcccacgggcactgccacaacaccccgggcagcttccgctgtgaatgccaccaaggcttcaccctggtcagctcaggccatggctgtgaagatgtgaatgaatgtgatgggccccaccgctgccagcatggctgtcagaaccagctagggggctaccgctgcagctgcccccagggtttcacccagcactcccagtgggcccagtgtgtggatgagaatgagtgtgccctgtcgccccccacctgcgggagcgcctcctgtcgcaacactcttggtggcttccgctgcgtctgcccctctggctttgactttgatcaggccctcgggggctgccaggatgtggatgagtgcgccggacggcgtggcccctgtagctacagctgtgccaacacgcctggtggcttcctgtgcggctgtcctcaaggctacttccgggctgggcaagggcactgtgtctccggcctgggcttcagccccggaccccaggacaccccggacaaagaggagctgctctcgtctgaagcctgctacgaatgcaagatcaatggcctctcccctcgggaccggccacgacgcagtgcccacagggaccaccaggtgaacctggccacccttgactccgaggccctgctgaccttgggcctgaacctctcacacctgggccgggccgagcgcatcctggagctccggccggccctggagggtctagagggccggatccgctacgtcatcgtccgcggaaacgagcaaggtttctttcgcatgcatcacctccgtggcgtcagctccctgcagctggggcggaggcggccggggcctggaacctaccggctggaggtggtgagccacatggcaggaccctggggtgtccagccagaggggcagccagggccatggggccaggccttgaggctgaaggtgcagctgcagttgctttagttgggaggagcctcagtgggccccagctgtccagagaagggggattctggaactgggaaggactgatccccagaagcgatggctgaccagattgaaccccgaaactcaggaagagtgaaatgctacacgacaacctcaggcaagcccggcctctgcctgggcctctgtgccagccccgggggccccccagttactcagtctttcctggagacagcaagaagctgcaatgtgcaatccccctgcccccacagccaaggtcaggaagaggccctgtggtcaccgtgtctggccaatctcaggctttcacttctgtactgcactgtggcttgccctggcggggggcagggggttggcaggacatggcaatgggcaactggggtgggcacagggcttattcctcggagtagaagggtgtacagggggcccagactccacagtgacttgccacatttgccccccatttggagaatgcttttatatcaaaagtggagacgataataaagttattttgggttaagtc

SEQ ID NO: 42551 - DNA, 451 bp, Homo sapiens
cgggacgaggagctggggccactgaggtcctcccaactaaagcaactgcagtgcaccttcagcctcaaggcctgccccggcctctgcctgggcctctgtgccagccccgggggccccccagttactcagtctttcctggagacagcaagaagctgcaatgtgcaatccccctgcccccacagccaaggtcaggaagaggccctgtggtcaccgtgtctggccaatctcaggctttcacttctgtactgcactgtggcttgccctggcggggggcagggggttggcaggacatggcaatgggcaactggggtgggcacagggcttattcctcggagtagaagggtgtacagggggcccagactccacagtgacttgccacatttgccccccatttggagaatgcttttatatcaaaagtggagacgataataaagttattttgggttaagtc

SEQ ID NO: 42552 - DNA, 535 bp, Homo sapiens
gtgtgtatttttaattgagaaaaacacacacagtctctctgctcttgtctttcctcccactcctcacctctttctggtgtgagcggatgtattttggtcacagcaagattttcttgagtgtgtgctggtttgtggccacaacagcctcaaccagattgcagggctagtgggtcccttcgctcagcatcgctggaagtcccagggggctgggctgcccctgatggcagatgccttctgcagacattgatgagtgtggggagatccccgccatctgtgccaatggcatctgcataaaccagatcgggagtttccgctgcgagtgccccgcaggcttcaactacaacagcatcctgctggcttgtgaaggtgccacctctccctgttcccagccctggggcctgggtgggatgcatgtccgccactgtgcaatctgggcgagtaactaaaactctgtaagcctccatttccctgtatgtataatgggctaacacctttccaagggcctccatctcatataaccacccttactccagct

SEQ ID NO: 42553 - DNA, 2541 bp, Homo sapiens
gcaacagggaaagatcctatctcaaaataaataaataaataaaataattataaaatcagcacatcaaacctatgtttctatgtatggggtttgttgtgtagggtgaggctgtcttgaaaatgtaactttccagaagcaaagaatagtagaagcgctaaatagataccatggaaggaatctgctggtggtgccagattaggaatcttgctacctctttccactggacaccatctgccccacctataaccccacgagagtcagataatccttccccagctgtccctgtcgtcctgagtctcagcccttgccctggagccagaattgccactgggagggcttgtcctggggccctcagtgatcacacagtgattgcaggtgttggtcccagtcccaagtgagccccctgcatcctggctggcacaaggacctttcttcctccttttcacagacaccaatgagtgcctcagccttgcaggaacctgcctaccaggcacttgccagaacctcgagggctccttccgctgcatctgtccccctggcttccaggtgcagagtgaccactgcattgatatcgacgagtgctcagaggagcccaacctctgcctctttggcacctgtaccaacagccctgggagcttccagtgcctctgcccacctggctttgtcctctctgacaatgggcaccgttgctttgacacacggcagagtttctgcttcacccgttttgaggctgggaagtgctcggtgcccaaagctttcaacaccaccaagacccgctgctgctgcagtaagaggcctggggagggctggggagacccctgcgaactgtgtccccaggagggcagcgctgcctttcaggagctctgcccctttggccacggggcagtcccaggcccggatgactcccgagaagacgtgaatgagtgtgcagagaaccctggcgtctgcactaacggcgtctgtgtcaacaccgatggatccttccgctgtgagtgtccctttggctacagcctggacttcactggcatcaactgtgtggacacagacgagtgctctgtcggccacccctgtgggcaagggacatgcaccaatgtcatcggaggcttcgaatgtgcctgtgctgacggctttgagcctggcctcatgatgacctgcgaggacatcgacgaatgctccctgaacccgctgctctgtgccttccgctgccacaataccgagggctcctacctgtgcacctgtccagccggctacaccctgcgggaggacggggccatgtgtcgagatgtggacgagtgtgcagatggtcagcaggactgccacgcccggggcatggagtgcaagaacctcatcggtaccttcgcgtgcgtctgtcccccaggcatgcggcccctgcctggctctggggagggctgcacagatgacaatgaatgccacgctcagcctgacctctgtgtcaacggccgctgtgtcaacaccgcgggcagcttccggtgcgactgtgatgagggattccagcccagccccacccttaccgagtgccacgacatccggcaggggccctgctttgccgaggtgctgcagaccatgtgccggtctctgtccagcagcagtgaggctgtcaccagggccgagtgctgctgtgggggtggccggggctgggggccccgctgcgagctctgtcccctgcccggcacctctgcctacaggaagctgtgcccccatggctcaggctacactgctgagggccgagatgtagatgaatgccgtatgcttgctcacctgtgtgctcatggggagtgcatcaacagccttggctccttccgctgccactgtcaggccgggtacacaccggatgctactgctactacctgcctggatatggatgagtgcagccaggtccccaagccatgtaccttcctctgcaaaaacacgaagggcagtttcctgtgcagctgtccccgaggctacctgctggaggaggatggcaggacctgcaaagacctggacgaatgcacctcccggcagcacaactgtcagttcctctgtgtcaacactgtgggcgccttcacctgccgctgtccacccggcttcacccagcaccaccaggcctgcttcgatgtgaatgaatgtgatgggccccaccgctgccagcatggctgtcagaaccagctagggggctaccgctgcagctgcccccagggtttcacccagcactcccagtgggcccagtgtgtgggtgagtgaaaagggctgggaagaagctgggccctccaccagaatctgctcagagcaggcgactaacagacgccaccctgcaagatgatgtgacaagcacaattatctaaagattgaacaggccagcccagaaggtagtgagttccccactgctggggagtcaaggtgcagcagaataagcatcaaaaagtgtctgagttcattccttagggcatggtggcctggaggactcagttgagaaagattctgagacctgaagtctgcaattttgtgatcacagggaaagagtgctgtgattgattagtg

SEQ ID NO: 42554 - DNA, 262 bp, Homo sapiens
tccaaatgaattttagaatcagtttaccaagtcttttgaaaaaccattttgagattttaatttggaattacatgaaacctatagaccaatttggggagacttgacatttttataattttaagtcttatccaaggatatggtgtatctcttcatttattttggcctttaatgtctttcaatagaatgttgtattttttatcataaagaatttatacatctcttgagatttaatgctaggtacactataattttgtttctatta

SEQ ID NO: 42555 - DNA, 448 bp, Homo sapiens
aaaactgttttcttgaaaacaggcttggacacaattgaaagctggcttcctgcaaacacaccaagagtctgtaatctagcctatccattatatgtcctttattattcatgatatcctattcttctaccttgttgcctggtaactttttctgaggactgagtttctgcagcgatgtggtgcactcttcctgtgatgaggaaacatctgggcccccttctgcaggctttggaagatgatgtgtcttgtcaaggggtaaagggcaaatggatttaatttctgcttaaaactatcatagacgttccaaatagaatatgtaaaatttctctgtattagaaaaagaaacgtgataccaattgtatattttcttttctttatttattctctgtaagtctgtcagatgataaattgtaaataacaatgattaaagagtcatgctactgaaaaatct

SEQ ID NO: 42556 - DNA, 507 bp, Homo sapiens
ctcagccatctcagaggacggcacttgttgcccccagtgccactggccaaagaccttttcaattacaccagacgcattggctctaggcagcctcagcttcctgtcaccacggactctgtttaatgtctcagctggacttggctgcatcagagattgcagggaatatggctggtccacttgggtggatttgcacatggccatcctgtacatgtgcccttctgccagcctggcagcctctcccttcgtctgccttttccttggaagtgcatcagcagggggagctggatctatcctcaacctaatggaaagcagacgtccccgcacgcagaggagcaggctgccttgcagggtttttctggaatagctcagatggttgttattttattcattggaatggagatgaattgctaaatgtaccagttaaatgtgatttaaattgtatatctttgtcaagtttttcacataaattcactcattaaaaaaaaattctttgcacagaaaaaaaac

SEQ ID NO: 42557 - DNA, 658 bp, Homo sapiens
tgtagagacagggtttcaccatgttggccaggatggtctcgattgtttgacctcgtgatccgcccgcctcggcctcccaaagtgctggaattacaggcatgagccactgcacccagccggttctaaaattcttttatttatttgtatatgccaaattctgtagtgaaatacgtaattctgttgtaaattgtagttcagtacaatttgattttcactattcaaatctataccaaaagctgtttttattgttgggctgattcttctacactgttacttggaaataataatataccaggattctttctcttagacttaggagtctttctctttgcttgctttttcagaggctaacagtactgggtattctttaactgtcttgatatgctgatgaaagcacagtgttctgtttttgaatcttctcaaatgtccttgtctttgattcacaactttttgtcttaagaggccttcagcatcccatacaaggaaacaagtctttttttagctgctacctttggagttgattttgtttatgtctaggagcactaaattatttatacttatactattgaaatattcctctgttataaattcaaaaattgactttggaagataaaattttagttgaatttaatacatagcactctggaaagagtattgg

SEQ ID NO: 42558 - DNA, 410 bp, Homo sapiens
ctatatggattcttctttaagataaagggactcaaacatgatactacctcttatagtttttacatgcagagaataaagcacacagacctggaatctccctctgcggtctacgagcacaaccacgtcagcctgcgagcggcacgcctggtgaagtatgagatcagagcagaggccctggttgacggcaagtggcaggagttcaggacaaaccagatcaagcagaagtttgggttgaccacgtcatcctgcaaaagccataccttgaaaatccaaactgtgggcatcccaatctatgtaagttttgcattcatcttcccagcatcttgacagtttccagaagaatctatgggattttccccccactggtctgcataaaagaaaataaaatgacataaaagggagcactcaag

SEQ ID NO: 42559 - DNA, 463 bp, Homo sapiens
tacaaaatcaatgtacatagatcactagcactgttatataccaacaatgaccaagctgagaatcaaatcaaaaactcaatcacttctacaatagctacaaaaaaaaataataaaatacctaggaatatacttaaccaaggaggttaaagatctctacaaggagaactacaaaacactgatgaaagaaatcatagatgacacaaacaaatggaaaagcatccatttggaagaatggatagcagaatcatggattggaagaatcaatatcctgaaaatgaccatagtgcccaaagcaatctacagattcaatgcaattcctatcaaaacatcaacctcggccagacacggtggctcacacctgtaatcctagcactttgggaggccgaggtgggtggatcacctgaggtcaggagttcgagaccagcctgaccaacatggagacaccccatctctactaaaaata

SEQ ID NO: 42560 - DNA, 439 bp, Homo sapiens
gtttgcattgagttacaacatactcctttagctgatcatagttttttattgcccatcttctgaagcctctttctgtcaagtcatccctctgatcctccacacagttctgtgcccttgatggagagatgttgcaatcgtttggaggggaagaggcactctggccttttgggctttcagcattttttcattgattctttctcatctttgtgagtttgtctagatttggtctttgaggctgctgacccttaagtggggtttttgtgggggccttttgttgttttgttgatgctgttgtgtcactttctgcttgtttgtttttctttcaatagtcaggtccctcttctatagggctaccacagtttgctgagggttcacttcaggcccgattcatgattcactcccttgcctggatatgtcactcaaggaggctggagagcag

SEQ ID NO: 42561 - DNA, 506 bp, Homo sapiens
gcgtcgacgttacagtcatctcaggggcccttccctcagcaggtcaagagacattctctgctgggcaggacccctcagaaatcttaaaggtgctctactttcaaacagaagcaaacattttaaatctcatgttttctctatcagcttaagatgctggcccaaaaggatctcccttagaccctatcccaagtaatctttatttccatttggaagttgggaaatattctttatttccatgtgagaggtaatgtaggggttatagatgccagcccctgttctcagggtccttatcctatgtgcctacagacaagccatgaatacttggaaagtgaagtactagcattcacaaaagtgaggtgtatgttttgatattgtagcatgtgtgcacatgtaccaatctacagtctatagttagagtctgtatgtatagatgtatatttacaatatacatacatgcgcctgtagacaggcacgtcatgtctctttggtacaacacgtggtcgagc

SEQ ID NO: 42562 - DNA, 321 bp, Homo sapiens
aaatacatccagcactttccttgccccttgcctcggcttaattgtttcttccacctggaatgggacttttcaagggtccccatcaaataccactgtcctcctccatcaagtcattccctattctccaagctggcaattagcctcctctgagttcctatagcatttgtttctgtctgtcttctggaaccaatcatagtacatattatggaattatcctttgtataactcttttttttttgagacggagtctggctctgtctcccaggctggagtgcagtggcacgatcttggctcactggaagctccgcctcccgggtccac

SEQ ID NO: 42563 - DNA, 410 bp, Homo sapiens
ggttcacgccattctcctgcctcagcctcccgagtagctgggactacaggtgcctgccaccacgcccagctaattttttgtatttttagtagagacagggtttcactgtgttagccaggatggtctcgatctcctgatcttgtgatccgccttggcctcccaaagtgctgggatcacaggtgggagccactgcgcccggccgccacaagccttatttatttaaatcacctttgtcttaggacactaaactcccaaaaggtgaggcctgggaccagcatcaggctggacaagtgctgcagaggccacgccaaccctgtgcggccactgctgccccgcccagtcactaagcacctgcaggtcaccgagcacagggcagggggcagcctccaccaagcacagggcaggggcca

SEQ ID NO: 42564 - DNA, 442 bp, Homo sapiens
ctcaaatatacatcaataggtgaatggattttaaaatgcagtatatctatacaatggaatattattcagccccaaaaagcaatgaaggacggatacactgatacatgctataacactgatgaacctctaaaatttcctgctaagtgaaaaagtcatgaaagaccacatgctatgatcccatccatataaaagtccagaatagggaaatctatagaaacaggaagtaggttagtggttgcttaaagaaagagtggtaagtaggttgcttaaagggtcataagtggggacaatagttaaaaagttgggggtttggaggtgatttttaggttttcagatgatgaaaatgtaaaattgaggtggtgatggttgcatgtatctttgagtatactaaaagctactgaattgtactactgaaataaatgagttatatggtatatgaatt

SEQ ID NO: 42565 - DNA, 241 bp, Homo sapiens
  misc_feature (227)..(227): n is a, c, g, or t
ttgccccttggtagcagtgatgggactggttctgggacccctatggatacccaaatatgcagatgtttaagtctcttatataaatgccctagtatttgcatataacctatgtacatcctctcctatactttaaatcatctctagattacttataatgcataatacaatgtaaatgctttgcaaataattgttatattgtttgaaaccctgtctctactaaaaatacnaaaataagcgtctc

SEQ ID NO: 42566 - DNA, 666 bp, Homo sapiens
aaataaatagattttataaaatttttttaaaaagtgagacaatagtcatgagtaacaagggggtaagtttcctagagccacaaatttcatggcttaaaacaacatcaatttattctcttacagttctggaggccagaaatttgaaatgagtcttatggagctgaaatcaagcacaaaccaaagctgggcttcatctggatgctctatgaaagattcctttgctcgcctcttccaattcctgggtggttgctggcattccttgcattgtagactcgtcatcccaacgtcttcctccttggcccccattgccttctcctctcctgtgtggggcatcatcaactctccctttccctccctcttaaaaggatatgaatgtgactgctttaggacctaccctggataattcagaataatctccccatctcaagacccttaacataatcacatatgcaaagaacttctcttttctttaatcatatgagttaacatgtacaaatttcagagatgagaacatggatatctttagggtgccattttttcagtccattggaaatggtagatgtggaagaagaggagctaaaattcaatcagactaggggtctgcaatctgtagcctgcaagtcagtgcctgtttttgtaaataaagttttattggagcacagccat

SEQ ID NO: 42567 - DNA, 744 bp, Homo sapiens
atttataacgaggattcccagtatctaataatggcactgtccacggatgaacgggacagtcttgctattactatctattggggtaaaattgaagggacaaggcaaaatataactgaaaactataaagttttgtctttctcataaccatatctttgacacatgctgaggaataacatttctctgaaaacaaaaacactttcaggtctcgaagtcatagtggttttatatttaagctttgccttgatcaaggaaatatctgatgtgtgggataaagacagcaaaaaggttgtagtcagcagacccagggttcgagtcccaattttaaatattaaattagctttgccttgtggtgttgaattgtgctgttttgatccctcttgaggcacaatttattatctataaaatatggtaattgtgaagatcagctgacatttaggaagcttaagttagggacaatgatggaaaaatttattactgtgtaaaagttaaaataggatttagggatgtggcttatgcatttgtcttagcttagtaaaacaaatatgattaatggaaacggtattgtttcgacaaatcactggaattttcaattcagaaatgtataaagtgggaagagaagggttggctcacacctgtaattccaacactttgggagaccaagcagggaggattgcttgagctcaggagttcaagaccagcctgggcaacatggcaagacctcatctctactaaaaattagaaaca

SEQ ID NO: 42568 - DNA, 469 bp, Homo sapiens
tttctcattgcatcactagaaaggccatctggctatacagcgttccttcctccagggccagccgcctgatccttcaggctgcagctgcagtactccaagcacacccttttttcaaggtcctcctttgatagcctctggctcatactctacttctctgctcctttcccaatccaatccaatccaatccaatccaatccaatccaatccaatcagagcagtctctgatcactccatatcaaatagctcttcctaccctggcacttctgatccacttcaccctgtttcttttttacttcagagcacactattagttttatatatttaacctgttatctccctaaaatataagctccatgaggtcaggaatttgttttgtgcctggtgtgtagtgggtgctcaataaacatttgttgaaggcagggatccatctactctgtagttcctggaaagtagtctgaaaagagtctgt

SEQ ID NO: 42569 - DNA, 412 bp, Homo sapiens
gctagttcagtcggttcccatgttggtctcagttccaactcagcaagagaaggcaagacacaatgtacaagaacctttcttccagtgaagtatttgctgtagttccattggtcaaatcaagtcatattacctagctctcagcttcaaggggaaggagaaatggccttcacagccatttttataagctctcattttattctaccagacagaattgagaacaggttaatggtctttttcacctatgtaaaaaaaagttgaaaattcctttctagaacatgacaagttgtaaatcttgaaacatctctgataagagccaacgtacatgagttgtgtttgcctgtgaaattaaaaaataatggagaaaaccaacatgttcttatcttgtatttcttcaagaacactcaatcattgt

SEQ ID NO: 42570 - DNA, 761 bp, Homo sapiens
caaagctgcagccctctcctaaggaggctaggccttggggcgctgactgggagtctccagaaagagggttttggggaggcaggagtgagcttttactctgggcaaagacctggagtgagccaccctgtctatgagagcagagatgactccatggagcttgtgggcaggaggctggggatgagcccccatctaggctgaacagagcagggctgtttctcaatatgtatctgaagagtgaaggaggggtgggaaggtgcagagagggcaggagggacagagggctgtacctaaacctcacgcacggtggactcctgtgtgcagaaagggatgcgcaccagcagacagggccaagaatctccatgctgtctccactcaaaacctcagggctgtgactcccgctttctcagaagggatgcgcaggctcaccccttccccctaggaatcaccagggcacccccacccccagctcatctcctttagccatttgacagggaggggccagcagtgagctgcaggcttagaggggtgaccagggcccttcctaactcgaccgcatgtggtttggtggctgccttgggagggaggctgtccgatgctgacattccccttagcatggccctgaccgtggctgtcaggggccaccttgcctcaccaggccagccccactgggaatggggtcagtcacagcagaaccgtcgaaaggtggacctgatgtgggccctgccgggggcgcttggcctcagcgggccatgggagaccca

SEQ ID NO: 42571 - DNA, 375 bp, Homo sapiens
ggctgctgccctgttacacccacaggctcagaggctgcagagtgacttgtcaggccctgaaatgctgcgactgcactgctgtcccatgcgcagatgcctttaactcccttagagtcctaggacttctctcctttatatctggtctgcccttattgctgtgtcttaacctctagagaacagggccttctaatctatcactaagaattttctggccttcacctcataacaccatacaggaatattggttgtattcagttaaaaaaaatgttttatattttgaattatgagtaacatatacctacttttctatcagcttttgatgctcagcataggaaagggatctgttcttgtaatgatttttttaaaggtgatatt

SEQ ID NO: 42572 - DNA, 575 bp, Homo sapiens
ctcaggttagaaatgcaattgtttgacataagccagtcttgaattactatcagctgttgtatttatatttttccacttcaacttctagaatcatttaaaactatctgatagtttggaacatcaatttgagattgaatcctcattttagcttggtggaaagaactgaatgagaaaactggatttttttccctacttgtcaggaggcttactctgaagtagtttgaatttcataaatccattaatgattagtaagcttcacccagaactaatctgtggccagctacaggcttttggaaagaggcatactttctacagcttaaacattacattcaacttaatcatcaatcctagaaacctaaaatttagagaaatttgcctctgcctgtctgaaaatttgtctctgagttagaagtcctgaacagaggaagacttcagattgatttcttttctttgtgtgtgtgtgtgtgagacagtgttttgttcttgttgcccggctggaggttgcagtgagccgagatcacgccactgcactctagcctcagtgacagagtgagactccgtctcaaaaaaaaaaa

SEQ ID NO: 42573 - DNA, 268 bp, Homo sapiens
aataggtctggccaggctcctgttggttcagggctagattggtttgaatctagtagtcctcacaaccgagtgagcaggatagatggggcctaacaggaaagtcttcagacaaagcaaagtttgaatggctgacatctgtctaaaatgccattgttttaaaaagtgaattgtgcacgagttgtgcaaagcttggaaacctattgtcatacatttagaccctcatttagaaataggaaagttacaacaattttaggtattgttgatcagc

SEQ ID NO: 42574 - DNA, 523 bp, Homo sapiens
gaggacactgggtttcaggaatatgagtttcaggaggacactgggtttcaggaatatgagtttcctgtccacactgtatccccagcaccctacacagggcctagtgcaaacagcatccctggtagatagcatgggatgaataaatgttatacaaatggtctgacccatatgaagaaagaattgcaatgaggatttattatagccccaatgtcaacttgcttttctaacttgagttaagttcccattgccagagtcctcattgcaggctgatcgggggttatttatcctggggaacttggctgtgatgactttgagaggcccaggaactggttctttcttgagcaagattcaaagaaggcctctgcctccacctgggaacggagacttttgggctaatcccagaggctgatgttcccgtttgaggaagggcttttgttcataaccccccaaaatgaaaatccagtagagcaaccagtttctttttttaaattttttaaaattattattttaatttcttctttaa

SEQ ID NO: 42575 - DNA, 974 bp, Homo sapiens
ctttccaggggagacactgcagaggagctgggtgtccaggttaaatttggaaaaaagaggcggaaaccccacacagttttattttagctggaacgcaaggctgagcgaacgacatccttctagactgttcttccaccttcctgtacattctgagggccaggtatggaaaggtcctacttgatgccaacagggaggcatggaaatttctctggtttcaatgggtacgattattgtaagcaggatccattcaataatcggacccatttaaaccggagattttaaaagacaggaatagaatcccagccttatttcagtgcagggtagggtgtcaaatatgaaatgtaattctacagggcaattctattttggtaaaagaagtggggagaaaagcatcaccagccagctttttaaatttttaccacaacctattttgtgatccctacgtgtcatttcttcagtatattttttaaatgttttaaaatatacgaacatggtgagattttttaaatgtgtctttttaaagtgtacagtgaaaagtctccctcatgccctcaatttcccagccactgttccttctggactcttctacaaatagtccctgtttctacaaatgtattggaggtagggaggctattttgatttctacccttaaaagcttcaaaaaaaagagaaaaagaggctaccaactgaaaaatattttgccattaggaaaaggctgcattcttgttttaagttatgaacattacattatttaaacggcagacttaaaatatgcatcaaagcaaaatgaacctgctatatattttctatggtaacccatgtttctgtgtatttatgaaaatccaagatctgtgcattgttcaaaacagactttgacatctccaatttttaacattttaaagagaatgaattcatgtgttactgggaaattaaaacgaataataaaagtgtcattttccaggaaaggcaggata

SEQ ID NO: 42576 - DNA, 388 bp, Homo sapiens
atacacacctttaaagagaccagcgccaagtgttagggacaatttcccgtaggaaatgacactagcaggggtcttcagggtcacacctcaaggccacatttctcaaattcatcaagtactgtgtcacacactcacatgcacacacgtcttacaacccactgaaggggccagcccccaagaaataggacacaatacaaactgcactggtattacaatgaggggttcaggatacatcccactctgactaccctcccagatataaagcaaactgccttgtaccaaagtcacctgacagagggtctgttgtagtagcaagtctaacctgtactgctagggtctagatgtttgcgtcccaccttccatgaaattaacatgttgaatcctcacc

SEQ ID NO: 42577 - DNA, 371 bp, Homo sapiens
attgggttaaaaattagttttcgttccccacacatgacaacatagaaatctacaagtaattcaaatagagacatggtttagaatcacagattaaattgtctcagggagagacataattttctaaagaatgaagataaaattaaagttgttttattttgttttgttttgtttttgtttttgtttttttagtagagacaggatgtctctctgtcacccaggctggagcacagtggcatgatcatagcccactgcagcctcaaacttctgagctcaagtgagtctcccacctcagcctcctgagtagctgggaatacaggtgcacaccaccatacccagctaattttttacattgtaaaaattttcgtagagat

SEQ ID NO: 42578 - DNA, 295 bp, Homo sapiens
tactggaaacaatctatatgcccatataaaggcaagtggttgaatcaactatggtacatccaaataatggatacagcatatcttttgtgtaaggaaaaaagggaaatatgaaaacagacatgtatctgctcatttgttcaaggaaaaaaatcaggatggataaacgagagagtaatggttttagctatttactggggatgggtaggaaagaaatgaaaacgacagaaggaatggggaggcactactgagtatactttttttgtgcaattctgacttttggtacagtgttaaatgt

SEQ ID NO: 42579 - DNA, 203 bp, Homo sapiens
gttatgtttagttcatcttattcctctctatgtcagtgggaaatttgttggatctgatggttttgtacctgaatttttcataggcaatagcttggatttctttaggagtaattaagaatgaataatggtatattgaaattcaagatccagagtaatgtgggttcaatgttaatattgaatatggttaaaagtcttattatttt

SEQ ID NO: 42580 - DNA, 616 bp, Homo sapiens
  misc_feature (613)..(616): n is a, c, g, or t
tgaaagcaaaaagaaaatactgtatcatctcacattatcataactgagtgcattcatgtgcttttggtcttaaaattttactttaacgcacttaggatttgtcgtcagtaatttgttatgcactatctagactaagaataggtattaatttactagaattgtcaaatgaaatatttcaagcaaagtttgcataatgaatgcaagtttaaaccaattaaatgtgttcactttttagcaagctaagctgctccttatttctcctgtagtagacacaatcacagttaatctttgcacaatgcatcgcattctccatgcaacctaacagagcggtctgggatagagcctgaactttgggtcccttggggcccaacaggcaaggttcagatctgggctctaccacaaaccatctgtgtaacctgaacctccctagtcttcagtttcctcatctgctttaaaaaattgctagaacatagttctatgtaaatgttcggtgttaaaatttatttggtatctactgtatgtaagatatggcctctgctctcaaaaatatgtagtcccagaagtgatataatatgttcacggagatgtactattaaaaagtgccacaaaaaannnn

SEQ ID NO: 42581 - DNA, 2718 bp, Homo sapiens
  misc_feature (233)..(233): n is a, c, g, or t
gcctagcgtgcactgactctcttaactaccaccgctacacggcagacacgccgctactttgtagcgggtttcgggcgggccacgcgtgcggcgacaggaacccaaccccggccgaccttgggctccaggaattcgttgtctacgtctgcggaggtgcggcagcctcagttttaagcgcaggaaggcaatagaggctgtgctctgaacctttccctcacgatgatcttctgtcngtcgaccatcctggtgtctttcccatgtggccctgtatggttggcatggttcctgtctttaggacttgtgatcaagtatatctgaaagtttttagaagaaaagatgtgttgtaacctccctggaaaaagaagagaccttatgaagtactgctaaccacctacatagtcatcaaaataaaattcctgaatttgtacaagccacaggaagctagattgagatcattatatgacaactggaaggccaaggctatgggttacctcaaattgaggaattttggcacctactcacaggctccatgagcagatgaagtagacagctttactcagtatctcagaccaagaacttcatctccatctccaactagctgaaacatcttccctcctcaacctggaaaattctctgacttagaaatttaaacaaaaccctcccctttcattgaatctccattgtctggagtttgcttgttttaatctagcctgttcctccactatgggctccctttcaaactatgccctgcttcaactaacccttactgcttttttgacaattctagtacaacctcagcacctgcttgctccagttttccggacactatctatcttgactaatcagtctaattgctggttatgtgaacatctagataatgcagaacaacccgaactagtttttgttcctgccagtgcaagcacctggtggacctattctggacaatggatgtatgaaagggtgtggtatccacaagcagaagtacagaatcactctacttcctcctatcgtaaagtgacttggcactgggaagcctccatggaagctcaaggtctatcctttgctcaagtaaggttattggagggaaatttttctctttgcgtagaaaataaaaatggcagtggacccttcctaggtaatatacctaaacaatactgtaatcaaatactatggtttgattctacagatggcaccttcatgccctctatagatgttacaaatgaatccaggaacgatgatgatgatacaagtgtttgcctaggcactagacaatgttcctggtttgcaggttgcacaaaccggacctggaacagctcagctgttcccttgattggtctgcccaatacccaagactacaaatgggtagatcgaaattctggattgacctggtcaggtaatgacacctgtctctatagctgccaaaaccaaaccaaaggccttctgtaccagctatttcgcaacctattttgctcttatggcctgacagaggcacatgggaaatggagatgtgcagatgccagcataactaatgacaaaggtcatgatggacaccggacccccacctggtggctcacaggttccaatctgaccttgtctgtgaacaactctggcctcttttttttgtgcggcaatggggtgtacaaagggtttccacctaaatggtctgggcgatgtggacttgggtatcttgtaccttccctcaccagatacctcaccttaaatgctagccaaattacaaacctgagatccttcattcataaagtaacaccgcatagatgcacccaaggagacacagacaatccacctctgtattgcaaccccaaggacaattcaacaataagggccctttttccaagtttgggaacttatgatttagaaaaggcaattctaaacatttccaaagcaatggaacaggaattcagtgccactaagcagaccttggaagcacaccaatcaaaagttagcagtttagcctctgcatcccgaaaggatcatgtcttggatataccgaccacccaacgacaaacggcttgtggaactgttggcaaacagtgttgcctctatataaattattcggaagaaataaagtctaatatacagcgtctccacgaagcatccgagaacctgaagaatgtaccgttacttgattggcaaggcatatttgcaaaagtgggagactggttcagatcatggggctatgtgcttttaattgttcttttctgcttattcatctttgttttaatctatgttcgtgtctttcgcaaatctcgcagatcccttaactcccaacctctgaacctagccttatctccacagcaatcagcacagctccttgtcagtgaaacttcatgtcaagtttcaaatagggcaatgaagggactaacaacccatcaatatgatacaagtctactttgagaatatctgaacaaacagcagctgcagacaaaaagccttagctaaactttgatgagtaaagcaggtcttaccgagaattcagctgccaaaaccctcctctgagtgttcctcttataagggcacttagcactaggacctcccaaggtattgtaaataagccttatcagaactttttgtagtttcattctgaagccttaagacacacaccataaagctgatctgtaaacccttaccccttgctgttcagagagctactctttgtagtgttcttgcatgcatatataataaatgttttttctattg

SEQ ID NO: 42582 - DNA, 433 bp, Homo sapiens
ctgcaattattattaattataaggtacctgacaaggtgctcagcagtatactaaacatgtgctttccctgatgggtttacaatctataaaaatatgctcatctcactttcccaacactgacttcatcaacccctcccctctttaccttcactcttgtccctttatcttcacatatatatttctattccaaaaataactctatccagcctcctacacaggggtcacatctgtcttggtccccactctctcaaacagctttgcttgctcctcttcccttgacatttcccctcctttttctcctccattttccgtcttctaccccctttctcctcgtgtctcccctctctgcagacaaagttcctatgttccatatctatctttgcttaattatctaatatttttatacaaacacttgaagaaattcccagaaccc

SEQ ID NO: 42583 - DNA, 1791 bp, Homo sapiens
cggttcaggcgcgggcggagagctctggctcagagtttgcgatccgagagcgggatccgcgctccctcggtccttcctccctcccctcttgcggcctcccgctgtcatctggagccgctcctgccgccccctggcggcgaccgcgggaagggccggcccccatccgcacccctgaccccggaggtcaacaacgggatggtccctgggtcccaggggaagagacatcacccagtaggagggagtacggtctagacagaggccacgagggcgggagggggcgagagtggagagtggcccagctggccaggtcgtctaagtgagaggaaaagggagagggcggttgagaccaggccctgaattccgcgttcatcttatcctgaggtattcagtgccgagtgtggccttggtgctaggattcaaagaggaaaggaagaaaactttccattctaaaagaaactccacgtgaggcgaagaagatgaaatatagtcagaaaaccataccagtaggtggtaggtaaatgcagaagtatttaagagctcatacaggagtacctgcctcaggacagggaatctgagatgctctgcagagctggatcttaaagaacggagaactctggaatgctgacctacagtctgagttcctgtgcccttgcctggggctgactctctacttgacctgtaacccacaactgggcaagagaaaattctgcagccacagctctgaggacatgagcaaaatggtttccagacggaatgtcaaggattcccatgaagtgtcagggagtcttcaggccacacttcaggttatctccttctctttcccttttctgcttcacacttgctctcatcctctttctcaccccacatctggtcagaggagataggaaggttcttgttacctggtacaagacaacttttggaatcccagatattcagattatttccccttttcctctttgcaaatgataatactcacagccaagaggcatcacccggatccgaggctgcttctccttaggacatgcagacagaaggagaaggcggggctggcagcctccagtccacagcctccctttcttcttccggcgatgattaactaggcctagacaatggagatctacggcatacgcccagggcctcctcttctcaagcatggctgatcagtcactttcccgtctatccttcatttattgaagccaactatgaacgactaaaggaaggatgagaaaagtcacccaaagtcaaaggggacagcgtgggagactgttctagacagaaggaaacacctttgcaaagaccctgaggaaggcaggggactctccaggagcagaagggctgtgtggcttcagaatccacaaaagagagcagatacaggacactggctagagcaggccctggagcccgctgctgtcctggaggccttggggaggcccagtgttcccagggtggaagaagtaggggacagcttgacgtagtggctgttgatcagctgatatggaagtatgtcattttattaacaattgagaaaggagtgctgtgcaattccattcaatgccagtgatgcttatggccgtttttatgagttctgtcattttcaaatgagcaagaggaagcctctaagggggtttaagcagggactgacgtaatcagatctgtgtttttccaaagggagagggagaaaaagaacatttcttatttttcaaaaaaggtaatgcaaaagcatcattccacaattctcttgtaatgaaaaaaataaatgcaaacttaagcaaatccatcattctgaaagaa

SEQ ID NO: 42584 - DNA, 1902 bp, Homo sapiens
cggttcaggcgcgggcggagagctctggctcagagtttgcgatccgagagcgggatccgcgctccctcggtccttcctccctcccctcttgcggcctcccgctgtcatctggagccgctcctgccgccccctggcggcgaccgcgggaagggccggcccccatccgcacccctgaccccggaggtcaacaacgggatggtccctgggtcccaggggaagagacatcacccagtaggagggagtacggtctagacagaggccacgagggcgggagggggcgagagtggagagtggcccagctggccaggtcgtctaagtgagaggaaaagggagagggcggttgagaccaggccctgaattccgcgttcatcttatcctgaggtctgtggggacctgttgaaggactggggcaggggacggacgcgggcatccttccatttggaacagccattccggcagcatcaggatggggcggaggcaaagcggggagtgggcgaggcaagtggtgctgtaaacctgtgcgagaagggggcggtgactctaagggcaggaaggagccctggtcacacacacactcccacgcaaggtattcagtgccgagtgtggccttggtgctaggattcaaagaggaaaggaagaaaactttccattctaaaagaaactccacgtgaggcgaagaagatgaaatatagtcagaaaaccataccagtaggtggtaggaactctggaatgctgacctacagtctgagttcctgtgcccttgcctggggctgactctctacttgacctgtaacccacaactgggcaagagaaaattctgcagccacagctctgaggacatgagcaaaatggtttccagacggaatgtcaaggattcccatgaagtgtcagggagtcttcaggccacacttcaggttatctccttctctttcccttttctgcttcacacttgctctcatcctctttctcaccccacatctggtcagaggagataggaaggttcttgttacctggtacaagacaacttttggaatcccagatattcagattatttccccttttcctctttgcaaatgataatactcacagccaagaggcatcacccggatccgaggctgcttctccttaggacatgcagacagaaggagaaggcggggctggcagcctccagtccacagcctccctttcttcttccggcgatgattaactaggcctagacaatggagatctacggcatacgcccagggcctcctcttctcaagcatggctgatcagtcactttcccgtctatccttcatttattgaagccaactatgaacgactaaaggaaggatgagaaaagtcacccaaagtcaaaggggacagcgtgggagactgttctagacagaaggaaacacctttgcaaagaccctgaggaaggcaggggactctccaggagcagaagggctgtgtggcttcagaatccacaaaagagagcagatacaggacactggctagagcaggccctggagcccgctgctgtcctggaggccttggggaggcccagtgttcccagggtggaagaagtaggggacagcttgacgtagtggctgttgatcagctgatatggaagtatgtcattttattaacaattgagaaaggagtgctgtgcaattccattcaatgccagtgatgcttatggccgtttttatgagttctgtcattttcaaatgagcaagaggaagcctctaagggggtttaagcagggactgacgtaatcagatctgtgtttttccaaagggagagggagaaaaagaacatttcttatttttcaaaaaaggtaatgcaaaagcatcattccacaattctcttgtaatgaaaaaaataaatgcaaacttaagcaaatccatcattctgaaagaa

SEQ ID NO: 42585 - DNA, 1727 bp, Homo sapiens
cggttcaggcgcgggcggagagctctggctcagagtttgcgatccgagagcgggatccgcgctccctcggtccttcctccctcccctcttgcggcctcccgctgtcatctggagccgctcctgccgccccctggcggcgaccgcgggaagggccggcccccatccgcacccctgaccccggaggtcaacaacgggatggtccctgggtcccaggggaagagacatcacccagtaggagggagtacggtctagacagaggccacgagggcgggagggggcgagagtggagagtggcccagctggccaggtcgtctaagtgagaggaaaagggagagggcggttgagaccaggccctgaattccgcgttcatcttatcctgaggtctgtggggacctgttgaaggactggggcaggggacggacgcgggcatccttccatttggaacagccattccggcagcatcaggatggggcggaggcaaagcggggagtgggcgaggcaagtggtgctgtaaacctgtgcgagaagggggcggtgactctaagggcaggaaggagccctggtcacacacacactcccacgcaaggtattcagtgccgagtgtggccttggtgctaggattcaaagaggaaaggaagaaaactttccattctaaaagaaactccacgtgaggcgaagaagatgaaatatagtcagaaaaccataccagtaggtggtaggaactctggaatgctgacctacagtctgagttcctgtgcccttgcctggggctgactctctacttgacctgtaacccacaactgggcaagagaaaattctgcagccacagctctgaggacatgagcaaaatggtttccagacggaatgtcaaggattcccatgaagtgtcagggagtcttcaggccacacttcagccaagaggcatcacccggatccgaggctgcttctccttaggacatgcagacagaaggagaaggcggggctggcagcctccagtccacagcctccctttcttcttccggcgatgattaactaggcctagacaatggagatctacggcatacgcccagggcctcctcttctcaagcatggctgatcagtcactttcccgtctatccttcatttattgaagccaactatgaacgactaaaggaaggatgagaaaagtcacccaaagtcaaaggggacagcgtgggagactgttctagacagaaggaaacacctttgcaaagaccctgaggaaggcaggggactctccaggagcagaagggctgtgtggcttcagaatccacaaaagagagcagatacaggacactggctagagcaggccctggagcccgctgctgtcctggaggccttggggaggcccagtgttcccagggtggaagaagtaggggacagcttgacgtagtggctgttgatcagctgatatggaagtatgtcattttattaacaattgagaaaggagtgctgtgcaattccattcaatgccagtgatgcttatggccgtttttatgagttctgtcattttcaaatgagcaagaggaagcctctaagggggtttaagcagggactgacgtaatcagatctgtgtttttccaaagggagagggagaaaaagaacatttcttatttttcaaaaaaggtaatgcaaaagcatcattccacaattctcttgtaatgaaaaaaataaatgcaaacttaagcaaatccatcattctgaaagaa

SEQ ID NO: 42586 - DNA, 2864 bp, Homo sapiens
cggttcaggcgcgggcggagagctctggctcagagtttgcgatccgagagcgggatccgcgctccctcggtccttcctccctcccctcttgcggcctcccgctgtcatctggagccgctcctgccgccccctggcggcgaccgcgggaagggccggcccccatccgcacccctgaccccggaggtcaacaacgggatggtccctgggtcccaggggaagagacatcacccagtaggagggagtacggtctagacagaggccacgagggcgggagggggcgagagtggagagtggcccagctggccaggtcgtctaagtgagaggaaaagggagagggcggttgagaccaggccctgaattccgcgttcatcttatcctgaggtctgtggggacctgttgaaggactggggcaggggacggacgcgggcatccttccatttggaacagccattccggcagcatcaggatggggcggaggcaaagcggggagtgggcgaggcaagtggtgctgtaaacctgtgcgagaagggggcggtgactctaagggcaggaaggagccctggtcacacacacactcccacgcaaggtattcagtgccgagtgtggccttggtgctaggattcaaagaggaaaggaagaaaactttccattctaaaagaaactccacgtgaggcgaagaagatgaaatatagtcagaaaaccataccagtaggtggtaggtaaatgcagaagtatttaagagctcatacaggagtacctgcctcaggacagggaatctgagatgctctgcagagctggatcttaaagaacggattaagttgataaatgatgcatacgacatcctatagaagactgtcaccaccccacctcactgatcagccctctgcctacagccacacccacagaacattcagccatttctcctgtggttcccagcctgcagcacagcgtctgcacgtggtgagggctcccaaatctctgaggaatgaatggctcactgctgagagcaaccttctgggagttcagggcatgtggaactggaataagagcaacgtgtgaacagattacaggaaggcaatgcaggacagctggaccctttggggggaaacttatggggaacacagttttcttacttataagcactgagattgcctgagaggggagagatgatgcagagtgtcccaaatgtatttgacgtggaatccttttaccagcgaaacatctcttgggcctagagttctgaaaattgcactttgaaaaacactgctctcagctcttacaaacctcgtgttttcatcctaactgtgcttcagagaattgtgtcccagcaggaaaggaaacccccgtataattccctacgttgctagcatttggaagtgggatgaaaatggacctacattcaaacccctaatttcaagctctgaaggaggtaccaggatccatcacgatgcttgtaaaattgttcctttcattttcctggttgtaaacttatgcagactgtaaagtcaaggcaagcctgtgcccagcaaataataagaaaataagggaggcatggtaaacaaaacaaaacactttgagagttggtcaacttgctgttattttgagctgtttctaaaaatctcagggtagattccctcccctgcttgcctccttaacccagtcctttttcttcctcctccaggaactctggaatgctgacctacagtctgagttcctgtgcccttgcctggggctgactctctacttgacctgtaacccacaactgggcaagagaaaattctgcagccacagctctgaggacatgagcaaaatggtttccagacggaatgtcaaggattcccatgaagtgtcagggagtcttcaggccacacttcaggttatctccttctctttcccttttctgcttcacacttgctctcatcctctttctcaccccacatctggtcagaggagataggaaggttcttgttacctggtacaagacaacttttggaatcccagatattcagattatttccccttttcctctttgcaaatgataatactcacagccaagaggcatcacccggatccgaggctgcttctccttaggacatgcagacagaaggagaaggcggggctggcagcctccagtccacagcctccctttcttcttccggcgatgattaactaggcctagacaatggagatctacggcatacgcccagggcctcctcttctcaagcatggctgatcagtcactttcccgtctatccttcatttattgaagccaactatgaacgactaaaggaaggatgagaaaagtcacccaaagtcaaaggggacagcgtgggagactgttctagacagaaggaaacacctttgcaaagaccctgaggaaggcaggggactctccaggagcagaagggctgtgtggcttcagaatccacaaaagagagcagatacaggacactggctagagcaggccctggagcccgctgctgtcctggaggccttggggaggcccagtgttcccagggtggaagaagtaggggacagcttgacgtagtggctgttgatcagctgatatggaagtatgtcattttattaacaattgagaaaggagtgctgtgcaattccattcaatgccagtgatgcttatggccgtttttatgagttctgtcattttcaaatgagcaagaggaagcctctaagggggtttaagcagggactgacgtaatcagatctgtgtttttccaaagggagagggagaaaaagaacatttcttatttttcaaaaaaggtaatgcaaaagcatcattccacaattctcttgtaatgaaaaaaataaatgcaaacttaagcaaatccatcattctgaaagaa

SEQ ID NO: 42587 - DNA, 1844 bp, Homo sapiens
cggttcaggcgcgggcggagagctctggctcagagtttgcgatccgagagcgggatccgcgctccctcggtccttcctccctcccctcttgcggcctcccgctgtcatctggagccgctcctgccgccccctggcggcgaccgcgggaagggccggcccccatccgcacccctgaccccggaggtcaacaacgggatggtccctgggtcccaggggaagagacatcacccagtaggagggagtacggtctagacagaggccacgagggcgggagggggcgagagtggagagtggcccagctggccaggtcgtctaagtgagaggaaaagggagagggcggttgagaccaggccctgaattccgcgttcatcttatcctgaggtattcagtgccgagtgtggccttggtgctaggattcaaagaggaaaggaagaaaactttccattctaaaagaaactccacgtgaggcgaagaagatgaaatatagtcagaaaaccataccagtaggtggtagttaagttgataaatgatgcatacgacatcctatagaagactgtcaccaccccacctcactgatcagccctctgcctacagccacacccacagaacattcagccatttctcctgtggttcccagcctgcagcacagcgtctgcacgtggaactctggaatgctgacctacagtctgagttcctgtgcccttgcctggggctgactctctacttgacctgtaacccacaactgggcaagagaaaattctgcagccacagctctgaggacatgagcaaaatggtttccagacggaatgtcaaggattcccatgaagtgtcagggagtcttcaggccacacttcaggttatctccttctctttcccttttctgcttcacacttgctctcatcctctttctcaccccacatctggtcagaggagataggaaggttcttgttacctggtacaagacaacttttggaatcccagatattcagattatttccccttttcctctttgcaaatgataatactcacagccaagaggcatcacccggatccgaggctgcttctccttaggacatgcagacagaaggagaaggcggggctggcagcctccagtccacagcctccctttcttcttccggcgatgattaactaggcctagacaatggagatctacggcatacgcccagggcctcctcttctcaagcatggctgatcagtcactttcccgtctatccttcatttattgaagccaactatgaacgactaaaggaaggatgagaaaagtcacccaaagtcaaaggggacagcgtgggagactgttctagacagaaggaaacacctttgcaaagaccctgaggaaggcaggggactctccaggagcagaagggctgtgtggcttcagaatccacaaaagagagcagatacaggacactggctagagcaggccctggagcccgctgctgtcctggaggccttggggaggcccagtgttcccagggtggaagaagtaggggacagcttgacgtagtggctgttgatcagctgatatggaagtatgtcattttattaacaattgagaaaggagtgctgtgcaattccattcaatgccagtgatgcttatggccgtttttatgagttctgtcattttcaaatgagcaagaggaagcctctaagggggtttaagcagggactgacgtaatcagatctgtgtttttccaaagggagagggagaaaaagaacatttcttatttttcaaaaaaggtaatgcaaaagcatcattccacaattctcttgtaatgaaaaaaataaatgcaaacttaagcaaatccatcattctgaaagaa

SEQ ID NO: 42588 - DNA, 374 bp, Homo sapiens
tataaaggaaagaagtttaactgactcagttgagcctggctggggaggcctcaggaaattacagtcatggcagaaggggaagcaaacatgtccttcttcacatggtggcaggaaggagaatgagtgagagcaaagtgggggaaagccctttacaaaaccatcagatctcgtgagaactcactatgatgagaacctcccccatgattcaattacctcccactgggtctctcccatggcacatggggattatgggaactacgattcaagatgagatttgggtggggacacaagccatatcactacttttctttcaaaaaaagtcttagggttattcttatacatttttcttcccattgaactttagaattatccaa

SEQ ID NO: 42589 - DNA, 870 bp, Homo sapiens
agctcaatgatgtatacctgtttaggtattaaatagttgtgtttatatgcccaaaaatttgactttaggtatatgtgatatgctttggttccgatcaagcaggaggtcataagtttactcagaagtatccaaaatatgacattcaagatttaacttgcatatgtgtgtatatgcatatatttatacatgtatatgtagattgaatgtgacattatgtatttctaacataatatttggcctgccagcttataaatatgtatttaagcttttcattgattgacattactgtaaaaaatgaattatgattgagaagttctggatatttgctgtttttttcattttatatttttactaaattattgaatttgttaaattaaaatgtgctatcactgtattgccaaattatggcaatacactatgcagtattatttcaatactttaagaggcatctattacttcattgaacacataagcagctagcctcctttcctctgtaaataaggactttttggcatcctgatgttcctcgctgttcatttggtatcatcctggagttccatcaagactgaggattttctccatggccaataaactattgtcagcatcagctcacgtttggctgtatgacagggatatgtgagaagcccagaaataaatcacaaaaataataaggcatcttctgagtctctctgaagaagccagtgatccaaaaactaacttcatatctgagtgagtcttggtattcttgatttgcttgaagaggctgtgacatattacaaggtgtgtaatttcccaggcatatcacactgcttctgtttcatgaattgatcaaattgtccagaagtaaacatttacaagattgagatttga

SEQ ID NO: 42590 - DNA, 384 bp, Homo sapiens
tgtgctctacagtctccttgtgttttctggcaaaaggtagttgtctaatcccttgtcatatgagtcctggccaatccaccccattggtcctctttgtgcctctaaactattgtcagcatcagctcacgtttggctgtatgacagggatatgtgagaagcccagaaataaatcacaaaaataataaggcatcttctgagtctctctgaagaagccagtgatccaaaaactaacttcatatctgagtgagtcttggtattcttgatttgcttgaagaggctgtgacatattacaaggtgtgtaatttcccaggcatatcacactgcttctgtttcatgaattgatcaaattgtccagaagtaaacatttacaagattgagatttga

SEQ ID NO: 42591 - DNA, 394 bp, Homo sapiens
gccaacatggcgaatccccgtctctactaaaactacgtaaactagctgggcgtggtggcacgtgcctgtaatcccagccactcaggaggctgagacaggagaatctcttgaacccaggaggtggaggttgcagtcagccgagatcacgacactgcattccagcttgtgggacagagcgagactctgtctccaaaaaaaaaaaacaacaaacaaaaaaacaaaacaaacaaaagcaaaacaaacaaaaaacttccctattgagcacaggtttccccatactctttcttgtatcctgcaccatgcctggtttacacatgtatgtcacttgttcagcccccaatgggcatttatcattacacccttggaaatacgagtggtcatttctttaaggctg

SEQ ID NO: 42592 - DNA, 285 bp, Homo sapiens
ttaaaatatatgaatgaaagcccctgtagaaaaggagaaaaaaaaaaacaatgaagtgaattaaaatgccaaataatttttccacataagagaaacttaatgaggctatcaactctaacacacccaatatatacaatgattgcaactgtcccactatatatccccaaacataagataaggttttcttccctaaagttatctttcagaaagaaggaattgctttacaattaaatccttacttttgaggcagacaccaattattttatactaaatactaacaagggc

SEQ ID NO: 42593 - DNA, 352 bp, Homo sapiens
cgcagaacgcaccctgtcattacaaatgactcctggaggcagtccccgggggcctggcaggagcacctgtgtttctgtggggtctgaaaatgacagaccaatcgcttgaacccgggaggcggaagttgcagtgagccgagatcgagacattgccctccagcctgggcaacaagagcaaaactccatctcaaaaaaaaaaaaaaaatcttcacaaatataatttgtaatggctgcagaaaatttcagctctgaatgtactgcatcctaatcagtttcctattgttgagcattagtatagtttccaggtgttttgtttttgttttgctattaataagtaaaactgagatgaata

SEQ ID NO: 42594 - DNA, 451 bp, Homo sapiens
gctatgtttctgctacagcttgaatatggtttgtccccaccgagacaccaaaactcatgttgatgcttggtctccaatggagtggtgttgggaggtggtgcctttaagaggcaaaaagaggagtcaagagggactttatcacaggagtgagttctcactcttgtggggctggattagttactacaagagaacaggttgttacaaagcgaggctgcctcttgtgtttggtctttttgcacgtggctgcttccattcctgtttctccaccatgttatgacccaagcgcaaggccctcaccagaagctgaacagctgcagccaccctatcttggccctcccagcctccagaatcatgagctaaataatccaccttttttttttttcaaattgtctagtcttgggtattttgttatagcaacagaaactcaactaggataagtatatttagtcaa

SEQ ID NO: 42595 - DNA, 348 bp, Homo sapiens
actatctggatagaattctcactctctggatagatctcttactgtctatctggatagaattctcactctggggacagaactctcactatctatctggatggaattctctccctctgcataggactgtcactctctggatagaattctcaccatctggatagaactcccactatctggaaagaattctcagtctttagatagaactctcgctatctttgtggatacagttctcaccctccagagagaactctcactatctatctagatagaattatcactctctggatagaaatctcactatctgtctggatagaattctcaccatcaggatagaactctcactgtctg

SEQ ID NO: 42596 - DNA, 409 bp, Homo sapiens
tgacaccaaaaaatatgacagtgctatgcttccagggtcctttagactgtgttgatttaaaaacagcttgctcactaaatataaagaaagttttaaaattttaaataatcatcctataaagaagttgtcagactcacttgctgcaccactcaaaggagagagaacgttgggtagattcatatgaatgtgaaaataacttcagctaaagcaaacaatgtgtcagattgaaagaacagtgacttgacaagcctaattttactttccaggtagtgtttaccttccgtaagtgaacttagggaatgagtccaagaatactgcctggaattccaggagactgaatgtatgtgctccggaaaaatcaatttgcaaatatattgagagtttttatagtcatgctggctgcctcttt

SEQ ID NO: 42597 - DNA, 459 bp, Homo sapiens
gaaaaagaagacgacagacacttcctaaacagaacatttaaactcaatgaatattacttttctgttttgcaaaggggtattttcaatcgattcccaaatgtatttctgaaactccttgtaccgactaagaaacactaacatgagcaatcatagtattttagagctcgtaatggcctccaggagcctctgtcctagtagttctcaatgttagctgaataatcaactggggagctttttaaatgccaattcctgagtcctaccctttaagagattctttctgtaattggtccagggtatgacttgggcatctgaatttttgaaaaatgtcccaaagtggttctaatatggaaccaagttctgaaaaatgctggtctagcccggtggctctcaaactatgcacttcagaccagcagcctccgtgtcactggtacttgatagaaatgcagattcatgtccttc

SEQ ID NO: 42598 - DNA, 564 bp, Homo sapiens
gagaaaccattcatcttccattcattcatcttccgttcccagatcttggaagaatagtcactgtaatgtgggggctagaagcattggcttatgaagtggacaggcaaaggtaggttttcagctccaccacatcctagctaggtaaacttggacaagttgcttaaactctccactactccaagaggttacagatcactgaaagtacagacattggcaagtattttttggaaacacattatgggtcctaaggactataatatagtctataaatctggaattttatgctggaaaatacaacttgttttcaaatggaaaatgattgtgttttgtataaaacaacagagtcacattttaagaccaggctggataacataacaagaccccttctctacaaaaaataataaaaataagccagttataaagagagctgaataataacaaaagaaaaaagaaaaaaattagctaggtgtggtggtgtgtttgggaggctgaggcaggaggatcactagggatcaggaaatcatgaccagcctgggcaacatagcaagactcccatctctacca

SEQ ID NO: 42599 - DNA, 507 bp, Homo sapiens
tcttcctatactttagacatggaagtgggatggtgtctcttgtgcaactgctaagaagaagtgacctttggatcgaaggaagtagaaagattaaatcagaaagaatcaaggttcagagtctgcaaagccacaagccctctgtctgggccagcaagttcagtcttttgttttttgttttgagacagggtctcactgtgtcaccaaggctggagtacagtggtacagtcacagctcgttgtagcctcaacgtcctaggctcaagtgatcctcccagcttagcctcccagctgagcctcgcacgtagctgaaaccacaggtgtgctccaccatgcctggctaattgttttatttttatttttatttattgattgattgatttttttgagacagagtctcgctcttgttgcccaggctggcgtgcaatggtgcaatctcggcttactaaaacaatgccactcacggttacaaacacaactcctgtatcagaaaacacaacggcgccacgta

SEQ ID NO: 42600 - DNA, 362 bp, Homo sapiens
gagtcagagaacttgtatctgcaccagccctgctgcttattagccaagtaatcttgtgcaaatcagttaaactctgtgagtaccactcacttattaattcagtattcaatatttactgacgacgtactgtgtttcaaaccctgtgttgggctctgaaagatatgtagctcttgccctcaaagtgctcataatctaggagacacggtgcttatttcacagtgaccaatctgagaggtgctgcgtgagtatctggaagattcctgggctccatctcctggtgggacaattgcagttggtggtggtgagcactatgatgctatgatgcatgatgaggcagctaaaccatcacgtttgagaggcat

SEQ ID NO: 42601 - DNA, 779 bp, Homo sapiens
attgaatatagaggttctcccttggccactgtcagcttttcttgactggccaaaactgcccattcttcctggaatggtatgaaagcttcagcaaaataaataaaagtcagaatctttgctggtccctttaatgctgatttgatagtaaatcaatttcagctgagacataagggctgtcagtctatcatataaacatctttaactatagcctagagaaaagagggttgaagagcaaagcagattttttttttccttttctatatcttgttctgaacaacacactgtgataaaggggactagagtggaagattccctatttaaacacatgaagctctgggtcctagccttttttggttataagccctttgagaatctgataaaagctgtggatcatctcctaggaaaatagaacaaaacatacatattcacattacacagttccagagtatgtggaccccccaaagtccagagattgcccctaggggatctttagattcttgtttagaactgttgattttgaacacaacatacactgtcaaactttacatcagggatccaacataactcagacatagcccaggtagcctgtttctaacacaactgtcataatcctgaaatccaaaattgcactgtgtttgacatgagatagtttaagttccacaaaatccaaatttaccatattattgtttttaaaaaagcagtttagagcaaactgtcactaaacttggataaatgggtcagaaagtacagatttaataaagtcgtacctctaatgttca

SEQ ID NO: 42602 - DNA, 1174 bp, Homo sapiens
attgaatatagaggttctcccttggccactgtcagcttttcttgactggccaaaactgcccattcttcctggaatggtatgaaagcttcagcaaaataaataaaagtcagaatctttgctggtccctttaatgctgatttgatagtaaatcaatttcagctgagacataagggctgtcagtctatcatataaacatctttaactatagcctagagaaaagagggttgaagagcaaagcagattttttttttccttttctatatcttgttctgaacaacacactgtgataaaggggactagagtggaagattccctatttaaacacatgaagctctgggtcctagccttttttggttataagccctttgagaatctgataaaagctgtggatcatctcctaggaaaatagaacaaaacatacatattcacattacacagttccagagtatgtggaccccccaaagtccagagattgcccctaggggatctttagattcttgtttagaactgttgattttgaacacaacatacactgtcaaactttacatcagggatccaacataactcagacatagcccaggtagcctgtttctaacacaactgtcataatcctgaaatccaaaattgcactgtgtttgacatgagatagtttaagttccacaaaatccaaatttaccatattattgtttttaaaaaagcagtttagagcaaactgtcactaaacttggataaatgggtcagaaagtacagatttaataaagtcgtacctctaatgttcagaatttggttgtctatttgttcaaaagctatagctcactcctatttttgctattaaatttatttacctatttctagaaaaggaaaagaattaaaccatagatattcctgaaatgctatacctatatcaactatgaatctgatcagttaagtctcaggaaaaacagaatcaaaagcataaaggtttaacacttttctgtttctttagagaaagttttcaaagccagaggcattgttgcagttgattttatctctagccgagatgctttagagaattctgagttttatcatgccacgcctttctttttatccaaaggacgaaagaagccggactaagaatatttttatgctatattcgaaggtaaacattagttaagatgttatctcatatattgtt

SEQ ID NO: 42603 - DNA, 665 bp, Homo sapiens
gctcgggaagatcaagtcactaaacccaagaccacacagataccaagtggcagatcatacagccaagccttcagaccctgacatctgactccaagaccattctgagcccatcacttcctcactttgatggtgcaatggactgtgtgtttgtgtccctctaaaatatacatgttgaaacactaatcctgatgtgatggtatatggagatggaactttggggaggtaattaggtcatgagagtggaccctttatcaatgggattagtgcccttacaaaaaggggccagagacctagctagttctcttctgccatgtgaggatacaatgagaagtagacagttggtgatatggtttggctgtgtcccaatccaagtctcatcttgaattgtagttcccacaatccccacgtgtggtgggaaggacccagcgggaggtaactgaatcaagggggcagtttccctcatgctattcttgtgatagtaagttctcacgagatctgatggttttagaaggggcttcccccttcagtcggctctcattctccttcctgctgccctgtgaagaagaacatatttgcttccccttctgccatgaatgtaagtttcttgaggcgtccccagccatgccaaactgtgagccaattaaacctctttcctgtacaaatta

SEQ ID NO: 42604 - DNA, 466 bp, Homo sapiens
cctcccctttcccatagagcccccttccgggagcccacccgctcctaaacgctggcgtccgtttctgctgagagcatggggctttctctgcaagtggggggtgggagatgagggtttggatgagggtgtgggaggaccctaaactgattcccatgctagttggagaaagaaaggtgtggatgaggataaagttttcatggtgaccagggtgaccctccgctcagagggacgagcggagcccggcaaaaccagtcactgccttgtagttccaagctttggggatgatcagctcccaagaaattgctgtggggtgcgggggctgtgggtgacccaaattgggcagagggcctacaggtctgaggctgcctgcacagagccgccaggaaggagctagcgaagaaatacatctttgtcctggctttttcccaggaggggctgggtgggtgcacagacagaggtaaagagc

SEQ ID NO: 42605 - DNA, 439 bp, Homo sapiens
agtcgtgtctgcccaaggtcacccgggcggatagcggccggtggccgcctggctgggctgggcctctgccgccctctgtgcgggttgtcctgaggagcagcccgcagcccgtgggtggggccggcggggcgggtgagaccgcccgggtgggtgcgaggagtggccgggctcggcccggtgggcgtccggtgggaagcgtggcgcgcccgagcttaggcttgcagttcgcctttccagaaagcgcaaatctgtccatgtccacttcgagaccttgtaagttaagggcttctactttgggtcgtgtttggtggtccttatgccaccaaaaatgtgccagtgtttaaaagcagctgtgccagtttttaaaactcaggcggagagctcagcgcactgaccgggcgaggacgccgggacctgtgcttgcctgtgcgctgagtgc

SEQ ID NO: 42606 - DNA, 311 bp, Homo sapiens
tctccatgttggtctggctggtctcgaactcccaacctcaggtggtccacctgcctcagccttccaaagcgttgggattacaggcatgagccatcgcacccgcctctttaggtgttcttttaggagctggtagcggaggaaggtggttacccatctgtgacagagccttggatgtcacgaggccacaggctggcctttcctcctgtttacaggaggtgagttttcctgagttcccagcctcagtgttctctgcacagtctgtcactgactcccgctcccagtgctcactgcctcttgttctcactgcctcc

SEQ ID NO: 42607 - DNA, 492 bp, Homo sapiens
tcagtggctgggcctgagtttctcatacctggggtggaatttcacaggccctagcagagcagttgagagtgccacagtgtgcagagttaagcatcccacggagattgtagggatcacacagtatttggaaacagactttcagctcatctagagtagagagagcttgtccacaccacaggatagagtatcagcaaagccatatcgtgggtatggaccacactgtggaacaaagacaatacttgattctcctaaccaaagcgtaaactcaaacttccacaggattggggagatccactagtgaagtaacagcctggcagaaataaactcaaaagggagacatcatgacccagatttctcataatggactgtcagaaataggggttggcactctaaagcctcaggccacatctggtgtgccctgtctgtgtgcacagcccacaaactgggatgagtttacgtttgtaatgcactggtaaacaaaaaagaacagaa

SEQ ID NO: 42608 - DNA, 904 bp, Homo sapiens
gaatatttaatcttctttatcatatcagctttaaatatcagatttatgatacaggatgttattgttcttgtggtttttgcaatgtaaaaatatatcttggtctctgcatgatgatatattaacatctataccatggaacttttaaaaggaaaattgtgtggtataattaaaagaatattgcatgttatagagaaacttcacctgttgatttagcaggtgccattgtgtagatgctaagcaaatcttaatatgtttccttggatttttgaaatttgaatttgttgtgtaactttgctagttaaaagatttagagggatttggctgggcgcatggctcacgcttgtaatcccagcactttgggaggccgaggtaggcagatcacgaggtcaggagttcgagaccagcctggccaatacagtgaaaccctgtctcttctaaaaatacaaaaattagctgggcctcgtggcgggcgcctgtaatcccagctacttgggaggctggcaggagaatcacttgaaccagggaggtggaggttgcaatgagccgagatggcgccactgcaccccagcctgggtggcagagctagactctgtctcaaaaaaaaaaaaaagagtgggatttatcatagtttttttttcttaactgttattgactatttttaatttttattttttaattcagtggcctctcaggattattacctgcatttttttttcaggaaaatcccaattctgcaactaactctgtggccttagacaagtctcttgccttatccagggctgtttccttgtctgtaaaataaagagttggactagatgatctctaaggtcccttttacatctatagtttccttggtactatattagtgtttgagacaaaacaatttaatatatctaagccagtt

SEQ ID NO: 42609 - DNA, 1508 bp, Homo sapiens
ggtagaatggaagttagtctgtttctggccataagacattcaggtcctctcatcactggaagctttcctgtagagggcagggagttgtgacgtctggacaccccaaaaccccagacttcagtaaatgttcaggtaaaagagctctggatgtcaggaattgagtattccagtccctggatgcagctggaatagactccaaagaccaaagaaaatgtgtgggaaatccagaagtcctaaatgaacatgtcactcactgtgccccctcaaaaaagcgaaattatttttccaggaaaatataaaagcactacgctacttttggattcattccactcccattgctaccccaggtgaatgaccgtggttgcaggttaaatgcaaactttgctataccaaagagtcctaggacattttcacatgagctataaaggcatattccctaagaaaggtcctcccttctttgtacataaaggatgaaaactatgcatttagcaaacaaagagaaagcacttctttttctatctagttgtttagggtgcattcaaacaccagaggctgttttgagacatgtttggccttctgggttattactgtggtgtggttagctttacagtacatttggtaactatttcctaaatagtaaggacaaagaagcagaaggtaagaaatagcgacttccacgtgtaaaaaaaaaaaagaaaaagaaaaaaagaaaaaaaagtgtaaagatctactatttatagtgtgaaccaaagacgctacctcactcaatttccattggtgattttaatcacattgatgataccaaagaataccaaagatattttcatgcacggtctcagtctgcagagggaactccgccccttcccttcccccacccctcccccttcctaactcttcactcagtgtgtaaacttgtcttcattcttaataatgatacaataatgacaacaacaacattaggaaatactactcttattactgctagttctacttgtaaatctctaggcaaacatgttgcaaactttgtaaactcctaggacgagtgccttgcttgaaccaaagtgttaaaccgctgttgacctctttcaccttatactctttgaatacctcagcctcttagaaaggccactaatgaaaaaaaaaggaataattattcaccgtggtgctttttccgtgcaaccatgcaatgaaactttctttgataccaaaggatgacttttttttttcccaatttcttgctgataaaccaaagctcctcctccttgttccctctcaagttccccccacctgacttcacctgtccctccaccaggcaggccgtgcataacttttaccaattcctccaaatacctcatagtaataaagttttagggttatgttgtatagagagtctatgtgataaggcagaacttactagtttgataattgttaaggttactttaaaaccctctttgatttggggtttattttcttggcagaactgctctattgctcaaggaagacttagt

SEQ ID NO: 42610 - DNA, 1454 bp, Homo sapiens
ggtagaatggaagttagtctgtttctggccataagacattcaggtcctctcatcactggaagctttcctgtagagggcagggagttgtgacgtctggacaccccaaaaccccagacttcagtaaatgttcaggtaaaagagctctggatgtcaggaattgagtattccagtccctggatgcagctggaatagactccaaagaccaaagaaaatgtgtgggaaatccagaagtcctaaatgaacatgtcactcactgtgccccctcaaaaaagcgaaattatttttccaggaaaatataaaagcactacgctacttttggattcattccactcccattgctaccccaggtgaatgaccgtggttgcaggttaaatgcaaactttgctataccaaagagtcctaggacattttcacatgagctataaaggcatattccctaagaaaggtcctcccttctttgtacataaaggatgaaaaggtgcattcaaacaccagaggctgttttgagacatgtttggccttctgggttattactgtggtgtggttagctttacagtacatttggtaactatttcctaaatagtaaggacaaagaagcagaaggtaagaaatagcgacttccacgtgtaaaaaaaaaaaagaaaaagaaaaaaagaaaaaaaagtgtaaagatctactatttatagtgtgaaccaaagacgctacctcactcaatttccattggtgattttaatcacattgatgataccaaagaataccaaagatattttcatgcacggtctcagtctgcagagggaactccgccccttcccttcccccacccctcccccttcctaactcttcactcagtgtgtaaacttgtcttcattcttaataatgatacaataatgacaacaacaacattaggaaatactactcttattactgctagttctacttgtaaatctctaggcaaacatgttgcaaactttgtaaactcctaggacgagtgccttgcttgaaccaaagtgttaaaccgctgttgacctctttcaccttatactctttgaatacctcagcctcttagaaaggccactaatgaaaaaaaaaggaataattattcaccgtggtgctttttccgtgcaaccatgcaatgaaactttctttgataccaaaggatgacttttttttttcccaatttcttgctgataaaccaaagctcctcctccttgttccctctcaagttccccccacctgacttcacctgtccctccaccaggcaggccgtgcataacttttaccaattcctccaaatacctcatagtaataaagttttagggttatgttgtatagagagtctatgtgataaggcagaacttactagtttgataattgttaaggttactttaaaaccctctttgatttggggtttattttcttggcagaactgctctattgctcaaggaagacttagt

SEQ ID NO: 42611 - DNA, 272 bp, Homo sapiens
aaaactttataattcttatttattttgtagtttgtatgtttgggatgtcccccccccctctttgatttggggtttattttcttggcagaactgctctattgctcaaggaagacttagtttctggaaatattccccgggtgagttaagggttgtgtaaaaatgcaagaatggaatacgaaatgattttcattttgatggttacttatgaagtttttgtgttccgtagaaaatttgtttccacagggtaaaaaaatatatatatataaaatctc

SEQ ID NO: 42612 - DNA, 660 bp, Homo sapiens
tgctacataataggtaaatgcataatggcatgaaaaaaacatagcataaactaaaaaattatttgtctttgtcagtgcagtaacaattattccattggattaatagattatattgaaaaagaaagagaaccactactttttctaaaccttcggtgggaattggattccttgttcaggcaatcttttgagtttcctttgttggaagttttagagcatgagaaggtctattttctgccttaaataaataaatattttatggttagcctacaggtattgccaaaaggttaaagaatattaccaaatataccaataaaataattttgaaatactcgtttatgtctatataaagaaaataaaaacagggtttagcctcaagaatgattcctcatatgtctaaacactaccccaacataagcattaaagtatattaaagagtatcggtttctgcagtcagaagttggtttaaatcctagctccttcctttactaactttataaatctgcctaagttataggaccttcttgtgtctctatttctgcataagaaatgggtactaggcttaatacctgggtgatgaaataatctgtacaataaaccccgatgacataagtttacctgtgtaacaaaccagcacatgtacccctgaactgaaaataagtt

SEQ ID NO: 42613 - DNA, 2244 bp, Homo sapiens
ctctctctctttttagcagcaacatacaagccggccatattagagagatggaaataaagcttccttaatgttgtatatgtctttgaagtacatccgtgcatttttttttagcatccaaccattcctcccttgtagttctcgccccctcaaatcaccctctcccgtagcccacccgactaacatctcagtctctgaaaatgcacagagatgcctggctacctcgccctgccttcagcctcacggggctcagtctctttttctctttggtgccaccaggacggagcatggaggtcacagtacctgccaccctcaacgtcctcaatggctctgacgcccgcctgccctgcaccttcaactcctgctacacagtgaaccacaaacagttctccctgaactggacttaccaggagtgcaacaactgctctgaggagatgttcctccagttccgcatgaagatcattaacctgaagctggagcggtttcaagaccgcgtggagttctcagggaaccccagcaagtacgatgtgtcggtgatgctgagaaacgtgcagccggaggatgaggggatttacaactgctacatcatgaacccccctgaccgccaccgtggccatggcaagatccatctgcaggtcctcatggaagagccccctgagcgggactccacggtggccgtgattgtgggtgcctccgtcgggggcttcctggctgtggtcatcttggtgctgatggtggtcaagtgtgtgaggagaaaaaaagagcagaagctgagcacagatgacctgaagaccgaggaggagggcaagacggacggtgaaggcaacccggatgatggcgccaagtagtgggtggccggccctgcagcctcccgtgtcccgtctcctcccctctccgccctgtacagtgaccctgcctgctcgctcttggtgtgcttcccgtgacctaggaccccagggcccacctggggcctcctgaacccccgacttcgtatctcccaccctgcaccaagagtgacccactctcttccatccgagaaacctgccatgctctgggacgtgtgggccctggggagaggagagaaagggctcccacctgccagtccctggggggaggcaggaggcacatgtgagggtccagagagaagggagtgggtgggcaggggtagaggagggggccgctgtccacctgcccagtgcttggcctggcagtggcttcagagaggacctggtggggagggagggctttcctgtgctgacagcgctccctcaggagggccttggcctggcacggctgtgctcctcccctgctcccagcccagagcagccatcaggctggaggtgacgatgagttcctgaaacttggaggggcatgttaaagggatgactgtgcattccagggcactgacggaaagccagggctgcaggcaaagctggacatgtgccctggcccaggaggccatgttgggccctcgtttccattgctagtggcctccttggggctcctgttggctcctaatcccttaggactgtggatgaggccagactggaagagcagctccaggtagggggccatgtttcccagcggggacccaccaacagaggccagtttcaaagtcagctgaggggctgaggggtggggctccatggtgaatgcaggttgctgcagctctgccttctccatggggtaaccaccctcgcctgggcaggggcagccaaggctgggaaatgaggaggccatgcacagggtggggcagctttctttggggcttcagtgagaactctcccagttgcccttggtggggtttccacctggcttttggctacagagagggaagggaaagcctgaggccggcataaggggaggccttggaacctgagctgccaatgccagccctgtcccatctgcggccacgctactcgctcctctcccaacaactcccttcgtggggacaaaagtgacaattgtaggccaggcacagtggctcacgcctgtaatcccagcactttgggaggccaaggcgggtggattacctccatctgtttagtagaaatgggcaaaaccccatctctactaaaaatacaagaattagctgggcgtggtggcgtgtgcctgtaatcccagctatttgggaggctgaggcaggagaatcgcttgagcccgggaagcagaggttgcagtgaactgagatagtgatagtgccactgcaattcagcctgggtgacatagagagactccatctcaaaa

SEQ ID NO: 42614 - DNA, 444 bp, Homo sapiens
tctcatgtccaacttgttctgaacctgcatggggaagaggtgctcttagtattaagcactctcaaaggccctcagttcctggagtgaggaactttgagaaataagaggtgatggggtgaggagggcagaacacacagtgagagggcttcactgggcgcgacgtgtggctttgggcctttcggcttagattccaaacagcacgtttgaccttgaggtctgcaatggttctcctgggtgaggcctggacccctgtggcccgggcatgagaccttgagctcaggccatgccatgcctgaccttgaaccttgctgatcaaggcttcgcccacaggcgaggggtattccagggaagcaggaagtgtgcagcaggcactgaccaaagatgtgccgccctctgcagagggacgaggggccaggctgggccttaaggaagccctgacgtatg

SEQ ID NO: 42615 - DNA, 280 bp, Homo sapiens
ttgaaaaccgtttataggactgaacgacaaccccaaatgcaagtgaccatgagcaactacaaataggtatacatatgcatttgagctgaacagactttctgacatataatttagtcaaaattgctgtatttcttccccttaaatttatacataatcagcttcttgtatggacccaaattggagaaatgtaattcagtagttggtgagaaataaaggattgtgacctctgtgtaattatcaggaaggatgctgtatgatgcctgctgttttattactgctc

SEQ ID NO: 42616 - DNA, 447 bp, Homo sapiens
  misc_feature (441)..(442): n is a, c, g, or t
  misc_feature (446)..(447): n is a, c, g, or t
ctgagatcgcaccactgcactccagcttgggcaacagagtgagactctgtctcaaaaaaaaaaagaaaggaaaagaaaggaccacttgttatagaaagcctgtcttttaaggtagctctggaccttttcagaggcagccaaattgcccctcatggttcgtcccccacatccccgcctgcctggcctaagtcctccttccccctccccaacagttaaataagtctttgtctccattacaaaacaaatctcagagctaccttcaaagaagagccagccctcagttggtgaatgaagatactttgacattttcctatgagcatggtgaaacaggtttaatttgtattaaatagcttgaagcaatccttattgggaattacaaggtggaattttagtcacaggaaaataaagcatttcacaagctacttactttcatgaacaaannaaann

SEQ ID NO: 42617 - DNA, 1223 bp, Homo sapiens
ccatctctactaaaaaatacaaaaattagccgggcatggtggtgggtgcctgtaattccagctactttggaggctgaggcaggagaatcgcttgaacctgcgggggaggaggttgcagcgagctgagatcacgttacttcactccagcccgtttataagagcgaaactccgtcttgggaggcggggggggggggcatgtgggaagaagccacccgaggagcctggtagggtgatgaaagtgagagcagaggtgtagctcagggccgtgcagcacctcggctttggctctttgcaggctgtagaagcagaatcgtaagacttctcctggcttgtttctttccatttctcgatttgactcctcagcctgctcttctggctccctgctgtctaatggaattccagagcttgaccttgagaatgcagattctcccgattgacaacttctagagaagggaatctcagaaagacaaaggagatgttccttcttccgctgcaagagtggaaaagcagacactctcctgagagcctcataaagctggtgaaagcctgttctgataaagcacccaggagatcattccttccgccccctgctcccaggacaggcacttaggtgagaatgtgtgactcatccagttctgatacctgctgcaaatggtatatgaaacaaaggaatcttttaagccacctgggcttcaaagaaatgtaactgtgtactttttttttttaatctgcttttaaattggtaaccttgcttaattgcatgttgccctggtaataaccttgcaattgacatctctttttaaaaaatgaaggtctacaatgtctgtattggccagaagagctttgcaagtttctttgttcatctttctcctatgactatgattttcttcgaacaaagagtttgagaggccttgcttcgttttaaattaacaatacatactttgcatatttgacttgagaattgtgtgtatgttatacactactacaaaacaaaccaatttcaataaaaataaaagcacaatccttaaaatcaaagcaaagtgaaacaattgaacctcattatatatcaagttggtggtttactcacacggagaggacttattttaagtgactttaattaggtgactttattttaagtgactttccatggtagttggaaaaaaagaaaccacagtagttgaatgtatatctttagtgggatatattctaagaacaaaaaaaaa

SEQ ID NO: 42618 - DNA, 161 bp, Homo sapiens
caggtctgaatatgcttgtgtctcctagaaggggtgaagaatactcctcttagcccattttgcatgtatgagtgggggccacccacttggcaaagcagcctttgagaaacaccagtaacatgtaaccagggtagggatgtggcaatgggcaggagggtccc

SEQ ID NO: 42619 - DNA, 4223 bp, Homo sapiens
gggggcagacggccgaagagccaggtgtgccagggacctatggcagcagggctgaacgtgcccgctccagcctctccagtgctgggagagacctctagatggtgcaggtgagtttgcaatgagggaaagcccctcggcaaggactgagtttccaaacttgcagacagggcagggagcggtcaaggaagagttcccgggaagccctttaaacggaaaggaagcggggctagtgtcagagaggtgtgccaggtcccaggcagccctgctgacccctaaggacatagagtacctgcttctgagagggctgccacggtggccacctgtgaagcctgtcacccagaactggatggtacctgactttcttcatagacccatcttctgctgggactgaagctgacctccaacagaagccaggtgagcccttgggagaggatggcccatgtgggggactgcacgcagacgccctggctccccgtcctggtggtgtctctgatgtgctcagcccgagcggaatactcaaactgcggtgagaacgagtactacaaccagactacggggctgtgccaggagtgccccccgtgtgggccgggagaggagccctacctgtcctgtggctacggcaccaaagacgaggactacggctgcgtcccctgcccggcggagaagttttccaaaggaggctaccagatatgcaggcgtcacaaagactgtgagggcttcttccgggccaccgtgctgacaccaggggacatggagaatgacgctgagtgtggcccttgcctccctggctactacatgctggagaacagaccgaggaacatctatggcatggtctgctactcctgcctcctggcaccccccaacaccaaggaatgtgtgggagccacttcaggagcttctgccaacttccctggcacctcgggcagcagcaccctgtctcccttccagcacgcccacaaagaactctcaggccaaggacacctggccactgccctgatcattgcaatgtccaccatcttcatcatggccatcgccatcgtcctcatcatcatgttctacatcctgaagacaaagccctctgccccagcctgttgcaccagccacccggggaagagcgtggaggcccaagtgagcaaggacgaggagaagaaagaggccccagacaacgtggtgatgttctccgagaaggatgaatttgagaagctgacagcaactccagcaaagcccaccaagagcgagaacgatgcctcatccgagaatgagcagctgctgagccggagcgtcgacagtgatgaggagcccgcccctgacaagcagggctccccggagctgtgcctgctgtcgctggttcacctggccagggagaagtctgccaccagcaacaagtcagccgggattcaaagccggaggaaaaagatcctcgatgtgtatgccaacgtgtgtggagtcgtggaaggtcttagccccacggagctgccatttgattgcctcgagaagactagccgaatgctcagctccacgtacaactctgagaaggctgttgtgaaaacgtggcgccacctcgccgagagcttcggcctgaagagggatgagattgggggcatgacagacggcatgcaactctttgaccgcatcagcacggcaggctacagcatccctgagctactcacaaaactggtgcagattgagcggctggatgctgtggagtccttgtgtgcagacatactggagtgggcgggggttgtgccacctgcctcccagccacatgctgcatcctgaaaagcatgcctgtgggctgtcctcccaggacaagccaaggatccaacgagggctctggagctgtgagtggtgccaaaagactgccaagaatcaaggcttttgtgatatgtcaccgtatgccttaggatgttcaaggagccagacgaaataaggcctgtcttccaatttaaccaaagataaaggactagagccgggatactttcagatgctcgcctgtacctcaccaggcagagtaaatatctactcactcatacagccagcccaccagcccaccattaactcactgaacaatgagacaatgttgaggactcaaatgaatcaaaccccgtgggaatgacagaagtgaagaatctggtccctgtctttaaggagtttgcactccagtagaagacagaaggaacgtatgtttacaaaccacttcactggaagacgtcaaacaagctgaatgaaggggcgcttagaaaacgttaatagaagttctaagcgggagatgactccctactgggatgatgaaggatggcatcctagtgaagaagcagctcaaacattttgataaaatggcaacaaaatgcagacaccctgctccaggtattatttcaggtttagtacaagtctgttaataccctatgtggtttcattaggataactttttacctatccttgaggtcatccatattcttacaggccttccagtcaataatggaagagctcactctatacaaaaccaatatgcaaggcatgtgtttgtccaagcaattggatgtgtgcagtagccaatttcatttactgcattactctttggcctgggaaccctgtggtctgcactacatgtgaatggccttccacttcagtcttaggcagatttgaccttttaggggcagcaatgctgaaggacacagcaatttaaattataatgtgtcaggctgtgttttcacttcaaacatgtatgagtagtcagctgtaattagagaaatgatgacttcctaagagttcagccacgcataattctagatttcaagagcatctaagacttgtggattagcctcatggcatgagagtttcagactcagccttctgagccagtcagggaaagtggagttctgcagcgcaaatgagagcctgggcttggtgtcgagggagctggcttctagttgtgccaccttgggccttgtcttttcctctctctgcctcagtttctcgtctgccaatgagatgttagttagtgattctataattggggcaggtagggttcaggtgagcaaaaagaaagtggagctataggaaatgccaggcctttgaggtgctctatggaagtcaacacagtgtggtttgtccatttaaatgggaataaaaacagaaaaactcagacttggcattttcacaataactgcaatggtttgacataacatttataggcagaaagttaataaactggcattgttcttggcatattattgtactatccctgtaactgccaagagctcaggagccaggctagtgatcacaccaggggttagagttcactgctgaactccctgatggcaggtctgtgtttattactacattaaaacaaagtctctgacttataaagcgaggtcgtaaaaattacaagttgcatgactgaaaaaatgctttagggggaaaatcagtcatatctttaacaccaacaagcaatttcccaccaacgaatgtagtacatactgtgagaggatcataatgaggtcctgaatatttaatatcatcatttactgtgtctgtttgctgctgtttttcgaacctatttggtttaccctgcaagctaaatactccacggcagagcttaattatccttttaattcctctttgaaatcctgtggtgcccccttccccctgccttgtgatgatgatgagtgagtctccccttaattagactgcaaatgtcacttgtgatgagtgtgccattccaggataacagcttgcaccctcctcagaatgttttcagcgaaagagtggggtggctgttctctgctcctggtgctttggcctcatttcacactattagaattctggggctgtaaggccagccagtgtcagctcatgttccattggctctccacctgccatttttagggagctattccttatatagttacaaattcccttgtcatttacttatttggaaacatgggatttactctgacaagctttagcctatgttatgggattcagaacaatgagatcataataattctcactgaccaaagctgggactccatcctgccatttttgtgtggagatattcataattctgcaatactttaaaacatttagaaaacaccccagggtaggtctgtggcccttagacagtgaagtcttaattgtcaatattatttttgtctaattctgtatatatataacttattatattttataatctcaataaacatattaataagatttataga

SEQ ID NO: 42620 - DNA, 1071 bp, Homo sapiens
  misc_feature (162)..(162): n is a, c, g, or t
ggaatactagtatatcgctcacacctcatatcctccaagctatgcctaaaaggaataacactatcgctgttcattatagctcctctaataaccctcaacaccccctcccttttagccaatattgtgcctattgcactccgacctgggcaacagagcgaaacnctgtctcaaaaaaaaaaaaaaaaagtaacagaaaaaagagtgaaatatattagctatcttttattctgagccaaaacttgacagatgtgggaaatcttcatatagtgtatgaaaatttcattgtacagggaaattattttcctctgtgtcttttcttttactataaagtgattcagaattttactgttactataaaattatgcaaagtattgtgacaaaactgcatcaatttgttgactattaaagtgctccttgaacattaaaaaaaaacaaaaaaaaaagaaaaacaaaaaaacaaaaaaaaaaaaaaaaaaaaaagaaaaaaagaagaaaaaaaaaaagaaagaagaaaaaaagaaagaaaacagagaagaaaagaacagaagaagaagaagaaagaaaatacaaaagagagaggaggagaggaagcgagagaaggagagaagaacggagcaaacacgaggaagacaggagacacggaaagaagcagcaccagagaagacagaacaaagtgacgtaagaggatacaggacagggaaagagcagagagacagagaaaagagaagaagaagaagaagagaaaagaagcagagagaaatcagaagaccacgacaagaagcaggagcgaagaccagcagacaagagagccaagacgaagacaagaaacgacataaagaaacttagaataggggacaaataacagaacacagagcaaacaagagaggcgaaacgagcagagaggagaagacagaaacgagcgcacgaaaggaaggtacagaagtgagagacgacagtagcaaatgcacatacgaagaggacgctctgaggtcgagcacgacgaggaagcgaagaacaaataaactatagacggcggagaggagaacacagatggagcacgacgaggcgggg

SEQ ID NO: 42621 - DNA, 424 bp, Homo sapiens
  misc_feature (162)..(162): n is a, c, g, or t
ggaatactagtatatcgctcacacctcatatcctccaagctatgcctaaaaggaataacactatcgctgttcattatagctcctctaataaccctcaacaccccctcccttttagccaatattgtgcctattgcactccgacctgggcaacagagcgaaacnctgtctcaaaaaaaaaaaaaaaaagtaacagaaaaaagagtgaaatatattagctatcttttattctgagccaaaacttgacagatgtgggaaatcttcatatagtgtatgaaaatttcattgtacagggaaattattttcctctgtgtcttttcttttactataaagtgattcagaattttactgttactataaaattatgcaaagtattgtgacaaaactgcatcaatttgttgactattaaagtgctccttgaacatta

SEQ ID NO: 42622 - DNA, 211 bp, Homo sapiens
cgcctgcaatcccagtattttgggagactgacgcaggccgatcgcttgagtcaggagttcaagaccagcctgagcaacagggcgaaaccctgtctctacaaaaaatacaaaacttggcaaggcattgtggcccatgcctgtaatcctagctacttgggaggctgaactgggaggaacacttcagcttgggaagttgaggctgcagtgagcc

SEQ ID NO: 42623 - DNA, 369 bp, Homo sapiens
  misc_feature (341)..(341): n is a, c, g, or t
  misc_feature (358)..(358): n is a, c, g, or t
aagctcagaggggcagtccgtgttctgagagtcacagtggcacttgtatctcaattttaaccagaggtttacctggtagcctgagccatgtccagggcaggcctacccttgggcaggacagggggctggccttgccagtgtggacatcgctgcttcccaggtggcctgggattcctgaggatacatccatgaacacactgcagattgctcaagtgatggacccttgtacattaaaagatggcctaatagggccgggcacggtggctggggatgacaggcatgaatcactgtggttcagccaccatctgggagtttttaaaaggctcccatgttgagttccntgttgattgggccaggncaggggggacc

SEQ ID NO: 42624 - DNA, 4324 bp, Homo sapiens
ccggcgacccgttcgcctacccgggcgccggcggcctctacaagcgcggctcggtgcgctcgctcagcacctactcggccgccgcgctgcagtccgatctggaggactccctgtacaaggcggcgggcggcggcggcccgctgtacggcgacggctacggcttccgcctgccgccttcgtcaccgcagaagctggccgacgtggcagcaccccccggaggtcccccgccaccgcacagcccctactcggggccgcccagccgcggctcgccagtgcgccagtccttccgcaaggactcgggctcctcgtccgtctttgccgagagtcctggagggaagacccgcagcgcggggagcgcctcgacggccggagctcccccttcggagctcttccctgggcctggggaacgctcgctggttgggttcgggccgccagtgccagccaaggacacggagaccagggagcgcatggaggccatggagaagcagattgccagcctcacaggcctggtgcagagcgccttactgcgaggctctgagcctgagacccccagcgagaagattgaaggctccaatggagcagccaccccctcagcaccctgtgggtcaggcggccggagcagcggggccaccccggtgtccggcccgcccccgccctcggccagcagcacccccgcaggtcagcctaccgccgttagccggctgcagatgcagcttcacctgcgaggcctgcagaacagcgccagtgacttgcgcggccagctccagcagttgcgcaagctccagctacagaaccaggagtcggtgcgcgcgctgctgaagcgcacggaggcagagctgagcatgcgcgtgtcggaggcggcgcggcggcaggaggacccgctgcagcggcagcgcaccctggtggaagaggaacggctgcgctatctcaacgacgaggagcttattacccagcagctcaatgacctggagaaatcggtggagaagatccagagagacgtgtcccacaaccaccggctggtgcccggccctgagctggaggagaaggcactggtgctgaagcagctcggggagacgctgacagagctcaaggctcacttcccgggcctgcagagcaagatgcgggtggtgctgcgcgtggaggtggaggcggtgaagttcctgaaggaggagccccagcgcctggatgggctcctcaagcgctgccgcggggtcacggacacgctggcccagatccgaaggcaagtggatgagggtgtgtggccaccccccaacaatctcctgagtcagtcccccaagaaggtgacggcagagactgacttcaacaagagcgtggacttcgaaatgccaccccccagccccccgctgaacctgcatgagctgagcgggccagctgaaggagcctctcttacccccaaggggggcaaccccaccaaaggcctggacactcctggcaagagaagcgtggacaaagctgtgtctgttgaggctgcagagcgagactgggaggagaagcgggcagccctgacccagtacagtgccaaggacatcaaccggctgctggaagagacacaggcagagctgctcaaggccatccctgacctggactgtgccagcaaggcccatccaggcccggcccccactccagatcacaagccccccaaggccccccacggccagaaggcagccccccgaacggagcccagtgggaggaggggctcagatgagttgaccgtgccccgataccgcacagagaagccctccaagtcgcccccaccgccccctccccgccggagcttcccctcctcccatggcctgaccaccacacgtaccggagaggtggtggtcaccagcaagaaggactcggccttcatcaagaaggctgagtccgaggagctggaggtgcagaagccccaggtgaagctgcgccgggctgtgtctgaggtggcccgcccagcctccacaccacccatcatggcctcggccatcaaggacgaggatgacgaggatcgcatcatcgcagagctagagagtggcggaggcagtgtaccacccatgaaggtggtgactccgggggcctctcggctgaaggcggcccagggccaggcgggcagccccgacaaaagcaaacatggcaagcagagggccgagtacatgcggatccaggcccagcagcaggccactaaaccatctaaagagatgagcgggtcgaatgagacctcgagcccagtctcagaaaagccctcggcttccagaacctctatccctgtattgacttcctttggggcaaggaattcttccatctccttctagaagcccctcaccccgctgccccgcctgtccccctccctcactcctgccatttctcccctctcttccttcatctccaccccaccccaccctactctccagacgccctgaggggtgtgccctgaagaggagggtgcggccctcctcagcgacccctacccatcatctgttggtgtttttggttttgttttttttttttttttaacaattaacttttaattatctttttttaaacagtaaaactaaaaaccaaacacaccaccttccttgatcccagctggcctctcgctggccgcacctgtcacgtctctccctcttctctttcaccactctttcccccagtccatcctgaagctcctgcacccccttcccgccttcccctcacttcccaagaatactccaaacaaactctgaaccacggagacttggagcagtgggagacccctctcccgtttctcgataccttcctggaggaacgcggggacatcggaccaacccatacatcaagccagagggcggggcttagggagactggccttggagatgccccactccctgtctaagctccgacaagactgtgacttcctctgtggctgctctgcctcctcccactcacacccaagtgggcctggagtagagacggacaggctggagacgaggccggagtttgagaggcctcagggtgggtgtgaggccatggagtctgtatccctggggaggcgctggcctcctgggccttgccgtccagtggggagtggagggcagaggccctttggtctgctggctgtggagggtgggttgcacggacagccggatatcggggacactgccttgggagagggcggcccggacgggtatttggtacttttagtttcctgatttagcactttaaatggcattaacttattgaatggggatggggtgggcaagagtgaggggcctagaaaaccaggttttgtggcttgcagttgggggaagggtctggtttgagggaaatgggagggtcgagaggggcttgacggggagcactgaagacacctgggacccgcaggtggggtgacttgaacttcagtcatcctcttggcaatttgagggttttcccaggaaaggatgagacgtagtttttcaatggggctctggtgaccctggtgagatgtctgaaggtccctgaggcctgaccatccagccagcgcccctggcctgtggacgccctgcctgccctgcagaggcggttggcagtgccgcctggcttttggccgggtcctggggaggcagagagaggccaattttggttctcactcctggccccccagagggcacagtgaggagccggtagggagaggataggagaagaggaggaggaggagcggggtccccggccgcaggattcccacttggagcacaaagtgaagtaagcacaggggagggggactagaatcagtcccccatagcaagcacagaaaggaggagctgcgcagaaggcagagccccccagaccctggggcctggctggggaaggtccgcacctggggagagctgggagctgttgaaggtttggggggaggggaaacgggttgtgtttcttcatttctttttttgtttttgcctttgttggttcatccttgttttctagctttggatcatttttgtaccaaggcgagcaagcctttttgaaaaataacaaaagaggaaaaaaaaaatccctcctggaaaaaaaaaaaaaccctggaaaatagaaaaaaaaaaaaggacctcataaatgatgcaattacttttaattgcaggcaactctttacatttaagtgaagtgtcttaacattttatattgttttaaaaatatatttacatattatatatataatatacgtaatataaatatatataaatatttaaaaaagaaaaaaaaaagaaaaccacggcactctccctggccactgttttggcgggggaggggggctggggggcgggcacgtcggcctggcttctgtggtcccagtgaaatggtctggtttgat

SEQ ID NO: 42625 - DNA, 206 bp, Homo sapiens
tatgagctggctccgcaccaggcgcacttctcctccagctcaatgacctggagaaatcggtggagaagatccagagagacgtgtcccacaaccaccggctggtgcccggccctgagctggaggagaaggcactggtgctgaagcagctcggggagacgctgacagagctcaagggtgggtctggggcctgcgaatgcagcacgttg

SEQ ID NO: 42626 - DNA, 3377 bp, Homo sapiens
taagaatcgagctcggctacctgtaacattcgtgtcccattcgtgtcattcgtgtcccacaaccaccggctggtgcccggccctgagctggaggagaaggcactggtgctgaagcagctcggggagacgctgacagagctcaaggctcacttcccgggcctgcagagcaagatgcgggtggtgctgcgcgtggaggtggaggcggtgaagttcctgaaggaggagccccagcgcctggatgggctcctcaagcgctgccgcggggtcacggacacgctggcccagatccgaaggcaagtggatgagggtgtgtggccaccccccaacaatctcctgagtcagtcccccaagaaggtgacggcagagactgacttcaacaagagcgtggacttcgaaatgccaccccccagccccccgctgaacctgcatgagctgagcgggccagctgaaggagcctctcttacccccaaggggggcaaccccaccaaaggcctggacactcctggcaagagaagcgtggacaaagctgtgtctgttgaggctgcagagcgagactgggaggagaagcgggcagccctgacccagtacagtgccaaggacatcaaccggctgctggaagagacacaggcagagctgctcaaggccatccctgacctggactgtgccagcaaggcccatccaggcccggcccccactccagatcacaagccccccaaggccccccacggccagaaggcagccccccgaacggagcccagtgggaggaggggctcagatgagttgaccgtgccccgataccgcacagagaagccctccaagtcgcccccaccgccccctccccgccggagcttcccctcctcccatggcctgaccaccacacgtaccggagaggtggtggtcaccagcaagaaggactcggccttcatcaagaaggctgagtccgaggagctggaggtgcagaagccccaggtgaagctgcgccgggctgtgtctgaggtggcccgcccagcctccacaccacccatcatggcctcggccatcaaggacgaggatgacgaggatcgcatcatcgcagagctagagagtggcggaggcagtgtaccacccatgaaggtggtgactccgggggcctctcggctgaaggcggcccagggccaggcgggcagccccgacaaaagcaaacatggcaagcagagggccgagtacatgcggatccaggcccagcagcaggccactaaaccatctaaagagatgagcgggtcgaatgagacctcgagcccagtctcagaaaagccctcggcttccagaacctctatccctgtattgacttcctttggggcaaggaattcttccatctccttctagaagcccctcaccccgctgccccgcctgtccccctccctcactcctgccatttctcccctctcttccttcatctccaccccaccccaccctactctccagacgccctgaggggtgtgccctgaagaggagggtgcggccctcctcagcgacccctacccatcatctgttggtgtttttggttttgttttttttttttttttaacaattaacttttaattatctttttttaaacagtaaaactaaaaaccaaacacaccaccttccttgatcccagctggcctctcgctggccgcacctgtcacgtctctccctcttctctttcaccactctttcccccagtccatcctgaagctcctgcacccccttcccgccttcccctcacttcccaagaatactccaaacaaactctgaaccacggagacttggagcagtgggagacccctctcccgtttctcgataccttcctggaggaacgcggggacatcggaccaacccatacatcaagccagagggcggggcttagggagactggccttggagatgccccactccctgtctaagctccgacaagactgtgacttcctctgtggctgctctgcctcctcccactcacacccaagtgggcctggagtagagacggacaggctggagacgaggccggagtttgagaggcctcagggtgggtgtgaggccatggagtctgtatccctggggaggcgctggcctcctgggccttgccgtccagtggggagtggagggcagaggccctttggtctgctggctgtggagggtgggttgcacggacagccggatatcggggacactgccttgggagagggcggcccggacgggtatttggtacttttagtttcctgatttagcactttaaatggcattaacttattgaatggggatggggtgggcaagagtgaggggcctagaaaaccaggttttgtggcttgcagttgggggaagggtctggtttgagggaaatgggagggtcgagaggggcttgacggggagcactgaagacacctgggacccgcaggtggggtgacttgaacttcagtcatcctcttggcaatttgagggttttcccaggaaaggatgagacgtagtttttcaatggggctctggtgaccctggtgagatgtctgaaggtccctgaggcctgaccatccagccagcgcccctggcctgtggacgccctgcctgccctgcagaggcggttggcagtgccgcctggcttttggccgggtcctggggaggcagagagaggccaattttggttctcactcctggccccccagagggcacagtgaggagccggtagggagaggataggagaagaggaggaggaggagcggggtccccggccgcaggattcccacttggagcacaaagtgaagtaagcacaggggagggggactagaatcagtcccccatagcaagcacagaaaggaggagctgcgcagaaggcagagccccccagaccctggggcctggctggggaaggtccgcacctggggagagctgggagctgttgaaggtttggggggaggggaaacgggttgtgtttcttcatttctttttttgtttttgcctttgttggttcatccttgttttctagctttggatcatttttgtaccaaggcgagcaagcctttttgaaaaataacaaaagaggaaaaaaaaaatccctcctggaaaaaaaaaaaaaccctggaaaatagaaaaaaaaaaaaggacctcataaatgatgcaattacttttaattgcaggcaactctttacatttaagtgaagtgtcttaacattttatattgttttaaaaatatatttacatattatatatataatatacgtaatataaatatatataaatatttaaaaaagaaaaaaaaaagaaaaccacggcactctccctggccactgttttggcgggggaggggggctggggggcgggcacgtcggcctggcttctgtggtcccagtgaaatggtctggtttgat

SEQ ID NO: 42627 - DNA, 537 bp, Homo sapiens
ccggcgacccgttcgcctacccgggcgccggcggcctctacaagcgcggctcggtgcgctcgctcagcacctactcggccgccgcgctgcagtccgatctggaggactccctgtacaaggcggcgggcggcggcggcccgctgtacggcgacggctacggcttccgcctgccgccttcgtcaccgcagaagctggccgacgtggcagcaccccccggaggtcccccgccaccgcacagcccctactcggggccgcccagccgcggctcgccagtgcgccagtccttccgcaaggactcgggctcctcgtccgtctttgccgagagtcctggagggaagacccgcagcgcggggagcgcctcgacggccggagctcccccttcggagctcttccctgggcctggggaacgctcgctggttgggttcgggccgccagtgccagccaaggacacggagaccaggagcgcatggagcctgagaacagatgccactacagcctgtccgagtccctgcattggatcatctagatcacgagaac

SEQ ID NO: 42628 - DNA, 3153 bp, Homo sapiens
ccggcgacccgttcgcctacccgggcgccggcggcctctacaagcgcggctcggtgcgctcgctcagcacctactcggccgccgcgctgcagtccgatctggaggactccctgtacaaggcggcgggcggcggcggcccgctgtacggcgacggctacggcttccgcctgccgccttcgtcaccgcagaagctggccgacgtggcagcaccccccggaggtcccccgccaccgcacagcccctactcggggccgcccagccgcggctcgccagtgcgccagtccttccgcaaggactcgggctcctcgtccgtctttgccgagagtcctggagggaagacccgcagcgcggggagcgcctcgacggccggagctcccccttcggagctcttccctgggcctggggaacgctcgctggttgggttcgggccgccagtgccagccaaggacacggagaccagggagcgcatggaggccatggagaagcagattgccagcctcacaggcctggtgcagagcgccttactgcgaggctctgagcctgagacccccagcgagaagattgaaggctccaatggagcagccaccccctcagcaccctgtgggtcaggcggccggagcagcggggccaccccggtgtccggcccgcccccgccctcggccagcagcacccccgcaggtcagcctaccgccgttagccggctgcagatgcagcttcacctgcgaggcctgcagaacagcgccagtgacttgcgcggccagctccagcagttgcgcaagctccagctacagaaccaggagtcggtgcgcgcgctgctgaagcgcacggaggcagagctgagcatgcgcgtgtcggaggcggcgcggcggcaggaggacccgctgcagcggcagcgcaccctggtggaagaggaacggctgcgctatctcaacgacgaggagcttattacccagcagctcaatgacctggagaaatcggtggagaagatccagagagacgtgtcccacaaccaccggctggtgcccggccctgagctggaggagaaggcactggtgctgaagcagctcggggagacgctgacagagctcaaggctcacttcccgggcctgcagagcaagatgcgggtggtgctgcgcgtggaggtggaggcggtgaagttcctgaaggaggagccccagcgcctggatgggctcctcaagcgctgccgcggggtcacggacacgctggcccagatccgaaggcaagtggatgagggtgtgtggccaccccccaacaatctcctgagtcagtcccccaagaaggtgacggcagagactgacttcaacaagagcgtggacttcgaaatgccaccccccagccccccgctgaacctgcatgagctgagcgggccagctgaaggagcctctcttacccccaaggggggcaaccccaccaaaggcctggacactcctggcaagagaagcgtggacaaagctgtgtctgttgaggctgcagagcgagactgggaggagaagcgggcagccctgacccagtacagtgccaaggacatcaaccggctgctggaagagacacaggcagagctgctcaaggccatccctgacctggactgtgccagcaaggcccatccaggcccggcccccactccagatcacaagccccccaaggccccccacggccagaaggcagccccccgaacggagcccagtgggaggaggggctcagatgagttgaccgtgccccgataccgcacagagaagccctccaagtcgcccccaccgccccctccccgccggagcttcccctcctcccatggcctgaccaccacacgtaccggagaggtggtggtcaccagcaagaaggactcggccttcatcaagaaggctgagtccgaggagctggaggtgcagaagccccaggtgaagctgcgccgggctgtgtctgaggtggcccgcccagcctccacaccacccatcatggcctcggccatcaaggacgaggatgacgaggatcgcatcatcgcagagctagagagtggcggaggcagtgtaccacccatgaaggtggtgactccgggggcctctcggctgaaggcggcccagggccaggcgggcagccccgacaaaagcaaacatggcaagcagagggccgagtacatgcggatccaggcccagcagcaggccactaaaccatctaaagagatgagcgggtcgaatgagacctcgagcccagtctcagaaaagccctcggcttccagaacctctatccctgtattgacttcctttggggcaaggaattcttccatctccttctagaagcccctcaccccgctgccccgcctgtccccctccctcactcctgccatttctcccctctcttccttcatctccaccccaccccaccctactctccagacgccctgaggggtgtgccctgaagaggagggtgcggccctcctcagcgacccctacccatcatctgttggtgtttttggttttgttttttttttttttttaacaattaacttttaattatctttttttaaacagtaaaactaaaaaccaaacacaccaccttccttgatcccagctggcctctcgctggccgcacctgtcacgtctctccctcttctctttcaccactctttcccccagtccatcctgaagctcctgcacccccttcccgccttcccctcacttcccaagaatactccaaacaaactctgaaccacggagacttggagcagtgggagacccctctcccgtttctcgataccttcctggaggaacgcggggacatcggaccaacccatacatcaagccagagggcggggcttagggagactggccttggagatgccccactccctgtctaagctccgacaagactgtgacttcctctgtggctgctctgcctcctcccactcacacccaagtgggcctggagtagagacggacaggctggagacgaggccggagtttgagaggcctcagggtgggtgtgaggccatggagtctgtatccctggggaggcgctggcctcctgggccttgccgtccagtggggagtggagggcagaggccctttggtccgttatctgactttgtttgtattcttttctgttttgattcctgatccatctctttttcattttttt

SEQ ID NO: 42629 - DNA, 340 bp, Homo sapiens
aagcagaattctaaaatattttccaatcctccaaggttttcccctcccccacctttcctagtatgcatgcctttcataatttccaggctgaatatgattcattatttaatatggcagagttaactttaagatagagaaattattctgggtggtagagaaattatcctggggaactggaggtaacacacaagccctttaaagacagaatttctctggctggttgtaggggaggacattagatgtcaaagcataagagggtttaaatgtaccattgctggattacagagggagaggccaacatgggaagaaactgagagcaaccttgactgatagccagcaa

SEQ ID NO: 42630 - DNA, 655 bp, Homo sapiens
gttatggaagcctgagttagtgaaacctggcctgccacaacgtgttgaagaaagcaaaagaaaataactgggaaagaggtataaaacctagccccataaaacgtttttttgttcgtttgtttgttttttccaaacagaatctttcagaatcctgttgttctggcaggtattttttaatatttccttcttacaaatttcctttttacagatgatatgcattatattgacattaacaatcaatcttaggacacaagtggattgtttttataaatagggatctcctcaatattagtgatccctatattaaggaaaggataggtacatgtggaaccaatgggtaaccaaaaagaatttgaaaagcaataatttagtgggagctcacttggaatataactctatgtcatcatgtatttatttaagtcatattctatgaaatatcctatttgaaagcaaggacaccctttggttgcaaccccaagttactcatgcagtacttcgtaaaaaagaggtgttggctgggcgtggcgcctgtaatcccaacactttgggaggccaaggcaggcagatcacttgagatcaggagtttgagatcagactggccaacatggtgaaaccctgtctctactaaaaatacgaaaattagccagagcaagat

SEQ ID NO: 42631 - DNA, 484 bp, Homo sapiens
gttattgaaattaacatttcccccaagttttataatgtctaggcatgcatatttcagtgtttgcctcaaaagctcatcctaataaccagatggtgcatttaatttcctttttttgttctctaagcaacatgcagcgtcctgcacagccctccttgcaggcaagtgcgctgaggtggcagtcctcctgactgccagcacagatccccagggcctctgagagccctgtattctgggggcagcctttcccccttctattcagccccagctggaaggggacaggttacccacagcccagcacagggctcctgccttagcttagcttagctcctgcctaagcacagggctcctgcctcagctgctctagggagtctggctccctctgaccctctagacctcaccagctgaggatcagagccccagggcaggagccagggccagggggcattggggggtggtttgagagtgcagctctggaagggggaat

SEQ ID NO: 42632 - DNA, 1063 bp, Homo sapiens
aaaatttagagaatatctcttcaaaagaagctatctaggccgggcgtggtggcccacgcctgtaatcccagcactttgggaggctaaggcaggcagatcacctgaggtcaggagttcaagaccaacctggtcaacatggtgaaaccctgcccctactaaaaaacaaaacaatacaaaaaaaaactggccaggcatagtggcagacgcctgtagtcccagctactcaggaggctgaggcaggagaatcacttgaacccgggaggcagaggttgcagtgagccaagattgtgccactgcactccagcctgggtgacagccaatctcaaaacaaaaaaaaaagtgctacgtattggtagttatgcatattcttacatatattaacagtattttacatgcttaaaaccttaaaaataattgaaaatgtcaaaattatatgccatatacatttctgtgggcttgaaaatgatacaatataggttgtttctttaaagcagtcactaaaatgtgtaaacttctagatagagtaatcactaaaaaggaaagttcataccaaaagtagtaatactaggaataaaagagggctcaacactgcctttgggagtcctcctcccatgaaacatggctggatttttctccttgtcctgtgtaacctcccttactttatcatagtttactgccttagttactctctcattcctccaaggagagcctcaagaaatttaggtaacaccagagtgtggccccagccagttgccctcagttaccaaggagcaattaggtaggaaatggccactgaaagactgaaaacaagaaaaaaactcaggtccctcacccaaactgggcagtggtggtcaggcttccacacggaaacctttcactgtcaccagagtgtccccagccagagacctgcagttgcctctgtgcttagatgctgtccaccaagggtcccgagttggaaaagggaaaggggggggagttcccctatgtagagcagagggatccccacatggagatagctccagctcatgcctgcaaatgaaggctctctagagagggaaaaggg

SEQ ID NO: 42633 - DNA, 398 bp, Homo sapiens
actttattttttactcaagagagaaacagatacctcatatttgggccttatttactgaaattaaccatagccaacactttgcactatcatttatgaaatcaaattgggggaaaataaaaacgaagaaataccaggacacataaatacacctgtgggctaagagaaaaagaaattccatgggaaacaatgctgactcagccaagagtccacagagccagcactccattgtttgcttagtggctgacacacctcacgcacactcctccagactgaccacagagatcacacacccccaaatccatattttatgtagattaagtttacttcctcatgtagggttaaatcattgaacctgctctgagcacctatgtgtaactacaccccatcccccaccttta

SEQ ID NO: 42634 - DNA, 850 bp, Homo sapiens
ttctaagttttttggggggttggccacagatatcaggcatataggaaaaatgccaagaagcccaaattagggccaagagaaggaataatctcttggtgccaaacaagtgggataagaagaccatagacagttcaggttatttcagaagaggagattggggggaaaggaagtatgaaagcaaaagaggccatgaatggaagaagcaagagtcaagaattccaggtgttctaaatcttgctaagaacccggtgggaataaaggttgcatgtacagagtaaggaggcttcaaaagaaatagcctgctccaatgaacaacatgcattacttcagagatgaagctccacttctagtctgtctctgcacacccaactttgtttcaatttagaaaatgcagcactttggtggttaccagagtaaccaaacagtgcaagccattcccacccctcttaatagtaaattagtagtcctacctctataccacatttaaatccttttctgggaagttagatacatacaattatcagcactacaaaggttcacctgacaagagtcttaagcaaccaaagcagtttttaaaatgtaaatcagggccaggcctggtgggtcatgcctgtaatcccaacacttggggaggccacttgagtgtgggagttgaagatcaccctaggcaacatagcaaaacactgtctctacaaaaaattagccgggcatagtggtgtgcccctgtagtcccagctactctggaggctaaggtgggaggatcagctgaggctggcaggtcaatgctgcagtgagccgtgacagtgccactgcactccagcctaggtgacagtgagactctgtctcaaaa

SEQ ID NO: 42635 - DNA, 417 bp, Homo sapiens
aaggcctaggacattaccacacactactgttgactttataaacactggacacttaggccacactaacttaataaaaaaaagtttctttcttcaataatgtaaaccgtagcttacttttattttacaaacttttaagtttattgaaactcttgactcttaaaacacttagcttaaaacaaacatattgtatagctgttccaaaatattttctttatatctttatttcataagttttttcctatttttgaagtttttatttttttactttttaaacttttttgttaaaaaccaagacaggctggacccagtagctcacacctgtaatatcagtgctttgggaggccagggcaagaggattgcttcaagccaggagtttgaaactagccagggcaacatagtgggacccctgtttctaca

SEQ ID NO: 42636 - DNA, 299 bp, Homo sapiens
cacagaaatctgataaatgtatcctatatacgccacttagctgactctgaatgaaatgcaactgtccattcccttttgtgccctcagcatactgagtacctgcagctagcctgttgacacacatgagcagtgtggtgtgtgtgtgtttgcagtatggcatgtgcatgtgtaagtgcatgcatgtgcatgtgtatgcacacaacactgtcttgatagcaaatagatatggaatagttgagactttctataataactctctggttctacagtagtgctcttaccaaaagcatgaacacaaa

SEQ ID NO: 42637 - DNA, 828 bp, Homo sapiens
gtcacttggaaattaaatatattcttttgagcctagacagaaataaaaattatgctaatagactttttttccacaaaagtaagattactgctttatcaaaacttaaggactggcagctaaatctgtaccttaagtaaattcattgccttaacctattctgttacttttttcaaaagagggaaaagataaggtggaaattcaattcagaggtttaaaagaatagcacaaaggaagatgtaggaagaaaataaataagacagtatcccaaactgggttttataagaagaataaacaaatacaagttgagcatccctaatccaaaactccaaagtccaaaatgctccaaattctgagtgccagcatgacacttcaaaggaaatgttcactggaggattttggcttttcagatttggaatggatgctcacccagtaagtataatgcagatattccaaaatctaaaaaaatttgaaatcccgaacacttttggtcccaagcatttcagatacaggatactcaaaacgtagtgaaatacagaaagagctaatcatggtggctcatgcctttgatcccagcactttagaaggctgaggtgggtggattgtttgagctctgtagttcaagactagcctgggcaacatggcagaaccccatttctacaaaaaatacaaaaattagctgggcatagtggtgcgtgcctgtggtcccagctgctcagaaggctgagatagtgcttgagcccaggaggtcaaggctgcagtgagccgtgatcacaccactgcactccaccctgagcaatagtaagaccctgtccccatcccctcccccgc

SEQ ID NO: 42638 - DNA, 1161 bp, Homo sapiens
ccttatttgaattgtcattataattttatatgcaaccttaatttgtcaagtaaatactttcatttaatttgaaagaattcatattcatttgctctttcatttgacaataataaaatttaaggtttattacctggaaagagtgcaagaaaatactaaacaactttatcaaactgattcacactgaggggaggttattttgtaacaaataatggaccacaagttcattttgtattcttctgtagtagaggctactgatatgaatttaagaaaaaaccttagaatcttaacttttcacatctgcagatgcagtgtgccattctgaatttttcaatctaagggatgtggatacatagaatgtttaaaaagataacaattagaatgaaaaattaaaattatgtatgcttttatatgggttactttttattgatcacatttctctggaaatttttctttatattttttcacagttgtctttctagctactgaaaaaattatacaaatatctttggccatttaaatgtttatcattgtgcagtgaactgttttagtaactttctgtttgacctttttagaaggttgcatccttaaaatgtgaaccagatacatggctttgcattgaagaggaaagcagtagaatgtcaggttactttaggcagtgtgacagtatataaatgaaatgtggaggatggtggtaacaatttgattttccacacagcaaaaccacagtcccgccacctaacaaagccctgtttatgccacacaccagcatctgagggaagaggaggcactgtgacaaagcagcgctgatgctgctcagcctgcgatgattacagctcatctgcacagccatctgaaagtttaatacatactcatcagagggaacatgccgggacaattttgggttccaatacaaaagttaagcatcaaacaggtttttctttccatttgattaaatgtgctgattttattttactgttgcattagaaacaaacaagttatctttcgctatttaattttccctctatgcaaattgtgttattacagctgaccgctatcagtaaatcttaattctgtcagtcccattgcttccttttttataaaaatactgtgtccccctttactgtcatgaagtgaaattcataaatatatttcctacacata

SEQ ID NO: 42639 - DNA, 1314 bp, Homo sapiens
ccttatttgaattgtcattataattttatatgcaaccttaatttgtcaagtaaatactttcatttaatttgaaagaattcatattcatttgctctttcatttgacaataataaaatttaaggtttattacctggaaagagtgcaagaaaatactaaacaactttatcaaactgattcacactgaggggaggttattttgtaacaaataatggaccacaagttcattttgtattcttctgtagtagaggctactgatatgaatttaagaaaaaaccttagaatcttaacttttcacatctgcagatgcagtgtgccattctgaatttttcaatctaagggatgtggatacatagaatgtttaaaaagataacaattagaatgaaaaattaaaattatgtatgcttttatatgggttactttttattgatcacatttctctggaaatttttctttatattttttcacagttgtctttctagctactgaaaaaattatacaaatatctttggccatttaaatgtttatcattgtgcagtgaactgttttagtaactttctgtttgacctttttagaaggttgcatccttaaaatgtgaaccagatacatggctttgcattgaagaggaaagcagtagaatgtcaggttactttaggcagtgtgacagtatataaatgaaatgtggaggatggtggtaacaatttgattttccacacagcaaaaccacagtcccgccacctaacaaagccctgtttatgccacacaccagcatctgagggaagaggaggcactgtgacaaagcagcgctgatgctgctcagcctgcgatgattacagctcatctgcacagccatctgaaagtttaatacatactcatcagagggaacatgccgggacaattttgggttccaatacaaaagttaagcatcaaacaggtttttctttccatttgattaaatgtgctgattttattttactgttgcattagaaacaaacaagttatctttcgctatttaattttcccaaagtgctagaattacaggcgtgagccatcacactgggccagcccttgttttttaaaaaagcatttaaagaataaaatattactgatttggctataaggaaaattagaattaaagtacaaatatattttaaattttaatctattttgtattgaacatttgaatagtacaacaaaatactgaaaaatgtttgcatggaagttcctgttttccatctttaagtcattccatttctgccatcattaggttttgttcagcaaaatatatcttacagggaaagtattttctttgcattt

SEQ ID NO: 42640 - DNA, 384 bp, Homo sapiens
taaggtcactggttctatataaaaaatagcatcagtaaaaagtaatttaatatttttagagtgcatagcatctttgaatttttggcttttgcctttttgagaatggatgttaagatagtcctcttcagttttgtttttgtttttgtttttgtttttgtttttgttttttttaactctttttggagacagagtcctgctctctcgcccaggctggagtgcagtagtacgatcttggctcactgcaacctccacctcctgggttcaagcgattcttctgcttcagcctctggagtaactgggtctacaggcatgtgccaccatgcccggctaagttttgtatttttagtagagacagggtttcaccacattggccaggctggtctc

SEQ ID NO: 42641 - DNA, 2017 bp, Homo sapiens
cctctctctggtgccatggcaacattatgccccaaacttcttccctggttggagtgagaggggctgtccacagccccatcctgtggggatctcaagccggagtccctggcctggcctccttgacgtaggtgttctcagcaagcagtttgcatcccaccgtctttctcacacttgcccccaagacttttgacagagcagacgtaaaacaggactcagaaaaccatttttctctgttcccatatgtagtaagttttgattcagttgtgcataaaccatagttttctgccctgctgtttgctttcaatggaagacagtaaagggaagatggtgctcacatctctccatgtgacatctcattaggaattaagatgcgatggattagaaatgtaaaacttcagaataaaattaaatttcagggctctataagtcccgttttcccaggtcctgttccgtttctacgtagataacccaatttgttttgtctatgaaataagcctctttagtgggttgttttagtctctccaacaaaagagcagattcctaaagccaggtgcagcactgtgaaaagtttctttcaatatggcaccaagactctaccatttatgtctctctcagcttacaaacatcagcgttttgtccttgtcatagtggaagaaagacacttactttaagctttggggacaaaggtgacaaaccccaggcttttatcttaaaagtgtctttggcacttcttttggcactgaaatggtatttgggaagcattatttgaatgtacagttgtttggttttgtatgtgcttatctttatctgagctttcacttgtagacatggccttttgttgtgaagttgctcatcatttaggagtgtttaattctaaaaagccttcagcctaagaaagcttcatctgtggggaccagagacttgttgctcagggagttagtgatgggacttgggcatctgatctgcaggtgacaagtttagttcaactgaagttgtagggaatttagacagttgcacatcattgccgttctaggggccttgtagaaagatgaaacagttgtttttcatttaccagcacctctcagttatagaggtaatggaacattcgcttacttttcatcatcattctttaaaaagggaacatacaaaaatctaaactatggcaataatttatttttataatagtttacggtaggctttaattaaatggcaaactcctctgggacccctaagttatggcgtgattagccaaatttgatttccaacagtcatttatggccataactattgcatagagtgcaggatgccagcaaagatgagggtgggggcagatactggctcagtgatttaactcacattatagatgaccccttcctcaacagaaatgctactgagagaaccagagaggcctgggccaggcaggtcttatttgagaggagattatttgataattgctttggttagaaggactttacatttcctgatttcaagtccagcaccaatttagaaagttcagagatgaaaccacctgtctttacctgacagagtcataacggtttgtgtaaaaatgtggtcagggaccttttttgttctttctgattagttaatactgtacattgtaaccaggaggggcagttttgccaaccagcctctgctcatggtcaccatatgtgtatgacaaggcctgagtgagttcctgcataaactgggtagtgggctcttttgacacatttgcaagcatgtaaatgaatgaatgacactaccagcaaccatctgtacaggtccatttacttacattcataaggtttatgctatgaaacttcttctcattgtgatgtcagtaacagagttagtgtctctgatggaatagtgtacctgtcacccaagttattttgttcctttttgggtcctccagtataatccccccctcatcccaattaactgtaaaatgttttacacatcacattttttatactgtaaacttggaaaataaactgaaatatcaaattgtgtcttg

SEQ ID NO: 42642 - DNA, 1024 bp, Homo sapiens
tggtattcagtgcagtagcgaaatgagatagtttagacactgttgaaataactgcattgagctttaaccaagtgtatgctcagaaaattcagttttggatcacattttgacaaaacatgttttggtcaaagaaaggaaaggctactaacacatttatcaggtaatgtatgtcacagtccgtgttccacccagccttgttatccccacattctttcaagataggagtcatcttggtttttcgggtgaaaaacggaaggtcagagaggaaggggcttgtccaaggtctcatgtctggttaacagaatttcaaactagatgtttgattctaacccctcagtccactgtaccttgaagtatggtctaaatgattcggcacttctggatgttgaggaaggacctagagacacatccttgaactagaacctggggtgagagttcattgggagattatttgataattgctttggttagaaggactttacatttcctgatttcaagtccagcaccaatttagaaagttcagagatgaaaccacctgtctttacctgacagagtcataacggtttgtgtaaaaatgtggtcagggaccttttttgttctttctgattagttaatactgtacattgtaaccaggaggggcagttttgccaaccagcctctgctcatggtcaccatatgtgtatgacaaggcctgagtgagttcctgcataaactgggtagtgggctcttttgacacatttgcaagcatgtaaatgaatgaatgacactaccagcaaccatctgtacaggtccatttacttacattcataaggtttatgctatgaaacttcttctcattgtgatgtcagtaacagagttagtgtctctgatggaatagtgtacctgtcacccaagttattttgttcctttttgggtcctccagtataatccccccctcatcccaattaactgtaaaatgttttacacatcacattttttatactgtaaacttggaaaataaactgaaatatcaaattgtgtcttg

SEQ ID NO: 42643 - DNA, 1412 bp, Homo sapiens
agttattgtcagagttcaccaggtttttaaatagaacaatgtgatttataaattaaataaaagggcatgggaaaattaggcttttgagtatataaatgtaataacaagaatcaattttaaaaatcaaagtaactgcaaatagtgcagttaccccctcaagtatagtctcacattgacaagaaaaggtttttaagctacaaagtgagaaaccaatgcacagaacatgaaccgagacatgtaaaccagaagaaagcaaaacagcatgtttctatttgtgcatgataatggatgtaagtgatagaaataggtctgagaaagtaaactccaagcacctaactgtgggttccttctaggcaaaggaatagaaactggaaaaagatgaagggaggctgtcattattagtgtatctaattatgtgttattttattttttaaaaaagtaaagaaaaatgtaaccttatgttaattagttaattatttgaaagcaaaagtaattttaaattttgagtgaatcgagtctgggacattaactgcatcacaggtgcaattgtagaaaatgtccggtaggtggagcactaatacaaacctgtgggtcagatttctttagcaaaaaagagaggaccagcattcaaatggagtcaggaacttttaaggacagggccactagtccagagccatgggatatatttccaagccaacattagatggtttcataattttaaaattcatcttttagttggtttaaaagaattcagtaatttctgtttttacaaacccagtggccagatactgtttactatgaatagggtccatattttgggcaggccctctgttgatgtcttcatgtcaggacaggtttttcttcaccacttaaactctgatcatgtaatagccatcagtaggaaacctggctaacactgtgttccatccgtacaataagaattcatccacaaggaagaatgagttaactccctgtgtaccaatatggaagcatgttcaaaatatgatgttaggtgaagaacgcacgttgcagattccatttgtgcttagataaaaggatatctaaagacatctaaggataatttgcagggcagcagcaggtcctgttgtctagagaagctttttgctcaggaaagaatgtcttgagatggtatttcaatgacgtgtgtgctcaggattgcagaaataggaattagttatattgagcaggttcagcatgcatgtgttcattgcattcctggaaagagaactcaaactatcaaagttggttttctatggaaagtgcaaatggggagactaagagacttttactttccactttataacttcctatatactatgtacatttctccacagtgtgcacaatttgctttttttttttttatactggtagcagtagaatttattcaaatg

SEQ ID NO: 42644 - DNA, 2511 bp, Homo sapiens
  misc_feature (2369)..(2369): n is a, c, g, or t
aggcaggcggatcacttgaggccaggagttcgagaccagcctggccaacatggtgatacccgtctctactaaaaacacaaaaattagccaggcatggtggcacacgcctgtaatcccaggtacttggaaggctgaggcaggagaatcatctgaacccaggagacaggttgcagtgagccgagatcatgccactgcactccagcctgggcatgagactctgtctcaaataaatagataaataaatgattttaaaaaaataaaagctgaggagtgacttggttagatccgtagtttaaagaagtcattttggggccaggcacggtggctcacgcctataatcccagcactttgggaggctgaggcaggtggatcgcctgaggtcaggagtttgagaccagcctggccaacatggtgaagctccgtctctactaaaaatacaaaaaattacccagccgtggtggcttacacctgtaatcccagctactcaggagggtgaggcaggagatttgcttgaacctgggaggtggaggttgcagcgagccaagatcatgccactgcactgcagcccgggcgacagagagactcaaaaaaaaaaaaaagtcgttttgggaaccagtcaccgcttctttttgatagcccctggttttgttaggggaagcaaggggttcagcaaaatgaatatacttcctggcttcctttgcagctaggggtggccgtgtcacagtctggccaaggaaatgaaattgggagttgctgtgtggaaactcaactctctggaacttcttccttcctcctgcctctgcacaaatgtgacggcagcagctgaagccaacatcttgcgaccatgagagaaaaacctggagaacggacgagtcctcaaccctgacttcagaccaacctacacccacctctggacgtggggctaagtgagagatggatacactgtttcatttaggccctgctcacttaggtttctgttattcacaccccaacgaaaccctccatggtccagggcaccgggcaaagtacagaagggcacgagtttacttcccgcttccctggagaccaccaaccctctcacccttccagcccagcctctgccacttcccagctgtcggtcctcctccaaacagacgtgcatgccaacacccggtgggtgtgaggcttgtaggcccaagtctagagaggctgagtctggcaaagcctgaaagcccctgtcctagcaagccaggccacaggtctagagtatccgagaccagtgaataaggggacggggggtgctactgaggctgtgagaagccccaggaccagcccagggtagttagaactgagtgaggttagccgggactaacctcactcagatccctcctccccagttcccctccatccactttggtttggaagcctccccagagctctcccaggctgtcatcagctctaaactctctgcctccacaaaaatgccctgggcaacctgtaactcacagccctgctgtcttcagagtataaactggagacagatgtacccagaattgaggacgggtgggaaatgaggagaaatgaaggctgaggaggggtcattctcacagtccctccctttcggtcacaggagggtgttgcccatgcttttgggtgggtcccaggcccatagctgcaaatattcatattggctactcttcagtgagcaaggggtatatgccaggcactggcattgtgcttgacatacatcatcatactgagtcctcacggaagatgtattattcccatttcacagaagatgaaactgaggcttgaggttaagtgatttgtccgtgaccacaaagagttttcgggactcaaacccagatctgtcactgggcaaggtggctcacacctataatcccagccctttgggagactgaggccagcagatctcctgtggccaggagttcaagcctggccaacaatggcaaaaccccgtctctaccaaaaatacaaaaattagctgggcgtggtggcacacacccgtaatcccagctactcaggtggctgaggcaggagaatcacttgaacccaggaggtggtggttgcagtgagcctagatcgtgccactgcattccagcctgagcgacagagtaagactctgtctccaaaaaaaacccagatctgtccgactctgacacccaacctttaatcactcactttctgtcaatgtcacctccgttttgaccagccaagctagacctccctggagcctgtggagaagccaaggtagaaaagggttggaaaagaatgataaaataggccaggtgcggtggctcaagcctgtactcccagcacttttggaggccgagacaggcagattgcttgagcccaggagttcaagaccngcctgggcaacataatgagaccctgtttcaacttaaaaaaaagaaatggtaatgaacaattgtcaattctgagcagctgggtatggtatgaccctgtgtactttttctgtattttaaaatgttctcaaaataaaacttgttt

SEQ ID NO: 42645 - DNA, 797 bp, Homo sapiens
tgatgtcgctatcatgaggcatcataaaaatatgtattttacaaggtgaaggcatttcaagtagatatagttcttgatgaagcaggaagaacatggatctgggatttggaagacctggcttctagctgctactaaccaactctgtgactctgggaaagggggactcagttcttacttctgtaacatgaggacaccggactatttgaattcagaacttagaaaattggaagggaccttaaagccctctaagaaagagttcgggaatgttctccattgctgtcagttttcctccaaaaataacctggcttggaagttattggtccagtgggaatttgattccccatagaaactggagaaaaggtaatgcaagtagagaggaacagctgtatttctgcttgagtaataaacccactaacagattctggtacgaattgtggagacataaagagaatgagtgtatgtactctaagtgtaccagtttcttcactctctcctggcagaagatgcaacacttttagtgattctgggattctgggatgtgttcctattaattctaatacagatgaagaagatgtggtagaggaaaagatggtagcagaaggagtgaataaagaggcaaaacagcccgctaaaaagaaaagaaagaagggtttgcgaattaaggggaaaaggcgtcgaaaaaaattgattcttgccaaaaagtttagtaaggatttgggatctgggaggcctgttgcagatgcccctgctttgttagcttccaatgaccctgagcaggatgaagaaagtctttttga

SEQ ID NO: 42646 - DNA, 368 bp, Homo sapiens
gattctcctgcctcagcctctcaagtagctgggattacaggcacccgccaccatgcccagctaatttttgtattttagtagagacagggttttgtcatgttagccaggctggtttcgaactcctgacctcaggtgatttcctcacctcagcctcccaaagtcctgggattacaggcgtgagccactgtgaccagcctccattttcccaaaaattatttttatgttttctctttttccctgtgtgttcacctgttagttctttagggatgcaattataacctttaccttctctctaccaggcactccctgcatggcatgtttatctaattatatgtttgcttagaaattctgaggaccaaatgttgaac

SEQ ID NO: 42647 - DNA, 760 bp, Homo sapiens
taaacgctatctctagaccaggaataattatttgctatataatacagcaaaaaatatgtatgtataaatggactcattcaaaatatataaagaactcctattacaaagaaattgacaaacagcccagtatatcaatgaatataaaaatttgagaagatattttccataagaagatatctaaatgaacattaggcatgagaaaaccaaattttaggatatcactacacacctggtgtagtttaaaagactgaaaatattaagtgtgtgggaatgtagagcaactgaaaatggcctacatctttcatagaaatgtaaaacaatacaaatactttgccaaaactctgtccaacattttctacccattcaccaagcaactccatccctagctatagataccccaggaaaataagtatgtatcttcacagaaataattgtatgagaatattcatagttacttatgcacagtagttaccaagtaaacctgtctcccatcagaaaaatggatatcaaattgtgtgataatcatacaatcaataggatattacttggccaaaacaaaatgaaacaagggaaaaacacaatcaaacaaattagtggcatatatacccacctgagtaaagagaagtcggccgggtgcggtggctcatgcctgtaatcccagcactttgggagccgaggcggcagatcacgaggtcaggagatcgagaccatcctggctaacacagtgaaaccccgtctctactaaaaatacaaaaaaaaa

SEQ ID NO: 42648 - DNA, 355 bp, Homo sapiens
cacactcagtctcatctatgggatatttagttggaaagtacaggctattcagacagtaagtacaaatctaattgtattttgtactccaaatagtcaggtaattgaagacatggcatgttacttaatccctacccagagcacaagacaatttctgcaaggagagagaaattccgaatgtgaaaatggattcaataactctatttccagaattttatcataaagaaagaagagcacatttggcaaaagtgcctgtctttcaagcacgcagtgagcactgcgctcctcaatgtatggccttcccaggttctttcacagatgggactcttcagctatgtgtactagttccaaggctata

SEQ ID NO: 42649 - DNA, 281 bp, Homo sapiens
ggaattgacacactttttctaaaaggccaggtagtaaatatttttggctttgtgggccataggatttctgttaactacctaactctgccattgccgtgtgaaagcagatgataagtaaacaaatgagtatggctgaattccagtaaaactttatttacaaaaacaggaagttgtggccaggcatggtggttcacacctataatcccagcattttgggaggctgaggtgggaggatcacttgtccccaggagttcgagaccagcctgggcaacatggtgaga

SEQ ID NO: 42650 - DNA, 523 bp, Homo sapiens
gatccatcttcttcaaaaaatttagagctgtgtgtttttactgcttggctaaaaccagtggatgtagaggaacctgatacagttttataacctagttgttcagaaatatccagattggcaaccactaaaggtaccctgtgaaaaagtcctctttgaggtttcaaggcatgtttcagtcgatgagtagcgcagctttctgttattatacttggtgttaatagcagaaaaataagttcttggtttgaaaaatgctcctgcaagtttttgtgaagcagcctctctctaaacgtcatgatctgatctgaatgacgacagaatttgtaccaacctatcacattctttttgacattggagaatattttcttcagtgcttgctcatttacttcacttgaggaattataaaagctaaaaaaagcatggaatatatttctgaatgtcaattgtataaacaacttcaacatcatccatttgggaatcagtaatgctattcttgccttcatcttttacttccttaagaagaaca

SEQ ID NO: 42651 - DNA, 825 bp, Homo sapiens
tatcggcgtggagtggtcgagctgtgccttcttgaataaaaataaggattagaataaatgaatagttcccaaaggtgacatctgagaactggctctggcacctggctctatctgtttagggaagttttagaacatgtgcaggattttcccctagatggtctggttccccttctccacaaatggctcccaaagggttaagccaaaaacctgagtcctgcctgcctcatcttctctcaaagtctttttggcaaattctatcagctttacctcaacatgtatcctgggtccatcaacttctcccccatctccattctcctgccctgatctaagccaccatctctccatctctcccctggggtgatggacctcctgtatactctcttgcttcccttcaacttttttcccatctgcagccagtgcaatagtttttctactgagaattcgatgaaatcactccattgcttaaaatcctccctatggcttccctattccaaacaataaaatccaagccctccaggagctggaccttgtcaaactttttgacattttcaagagccctatttcccccacaatcattgatttttaggtagtgacctccctttattttcttgaaaatattaagctagcttctacctcaggatttttgcatatgctattcctgtgcctgtagcgctgtgtgtccagatttatcaaggctgttttctttcttgttatttggatttcagctgaaatgtcagctcttcacattggtcttctctgaacccctctaactgctcccttcctcctcacttgtttcttcccacttctagaacagggcttgacaca

SEQ ID NO: 42652 - DNA, 227 bp, Homo sapiens
cgaggatgctgacggtgcctcacagccgcacaggaccgaggatgctgacggtgcctcacagccacacaggacgcgaggatgctgacggtgcctcacagccacacaggacgcgaggatgctgacggtgcctcacagccgcacaggacgcgaggatgctgacggtgcctcacagccacacaggacgcgaggatgctgacagtgcctcacagccgcacaggacgcgagga

SEQ ID NO: 42653 - DNA, 794 bp, Homo sapiens
taggaataaagctgtggaaaacatgtggtaatggattattatttgggaatttatcaaaaagaattaatgtgaaatttcaaaagttgacaataagctctcctgaaaaactccaaatctctaggatttctccatatatcataagagagcatcatatatgtttggagattagaatgagaatatcctgagtcagcagtctttaggaaaagcgtgtgcttctggagggtgcacaagacaaccaactggggtgtgggaagaaaatactataactgctactcaagaattactttttatgccatccttcacttcaatttttgtgtatttttttataacacacatattactttggtatagcggtatataatttaacatatacccatatgaatttttaatagggaaagtttttatgttcaataactcttactgatcaatttgtgtgttcaaaaaggctggacactccttttctgaaccactgcttcagaggtattgaggaagtgggtactgagtgggctctaaatgtgcttacattcaccaaaaacataaaaggacacctttaagaacttaagaatcatagtagaaagtcagatcaggatggaaacaatgttgtcagactggacgtcacacaatggcaggggtgaatggaactgaagtgatactatcaacagcctggagttacagctccagaattccaaacctctgatttacttaagtcagtcttgacttttaaaatctgtaatatagtatgtaaatcttcaaggaattttccagttaaaaaaaatccagtagcctaatagagg

SEQ ID NO: 42654 - DNA, 398 bp, Homo sapiens
aagatcccagtgccatgcttttttacaacctcgagaacaaagagctaaataaacctctattcattataaattccccagccttgggtgttttgatataacaatacaaaatggactaacaaaattggtactaattcttctttaaatatttgtagaattcagccctgaaggtacctgatcctggccttttctttgatgagagactttgtattactgattcaatttccttcctcattattggtagattttctattttttaaaaattttaaatctagggggtacatgtgcttgtttgttacatgggcactagatgaataatggtgggggtttggcttctagtgtgctcatcacccaaatattgaatattgtacctagtagttaatttttcgaccctcaccccc

SEQ ID NO: 42655 - DNA, 423 bp, Homo sapiens
agaatggtaaatgttgctttgattttaaaaagttggaaatgatgtttctcagaggaaatactaggtctcagttgagctgtgagagggggcaggttgctatgtttttttctctacaatagtgcacagtgtcttttgaatgggagaagttctgaataccctactgaagtagcccctgctgcagtgttctctaccatgacatgctctttttgctttcccagcacttttattaacttttaattaatttttattgttcatgttgctattgctattagtctactgtctgtctcattggactgtaagctctatgagagtggcaaatatatagtatcacttaatattgtatgtctagtagctaccagagtgcctgccgttataacgagcatggataaatttaatatttttgaattaaatgaatgaattaaa

SEQ ID NO: 42656 - DNA, 331 bp, Homo sapiens
gaagagtttggcctccaaaattacagctgaattgtcacttggattgattacccataaaagtcatataaggtttggcatgccagaaacctgtgaagacaaaatgtgatgatcttgtgacaaaaatgacaagtcaatgagtcaaaaatatgattaacttaataagagcgggaactcttaatggacatgtaaatgacaaactgattagagaatctcagtgaaaaagggtgccataaacaaaacaggaaggcttccagttggaccaatgcccacttgggagggtatataagagccctaacaaaagaggagacatttgtacctcagaatcctcatc

SEQ ID NO: 42657 - DNA, 337 bp, Homo sapiens
ggagaaaaagtaaattttaagaaaaaaatggtaataaatttgactacacttgaagcctgggttttaggaacaacacatgctggttatatgtggtacacatttctgtctgtgcatactttcagccattaaaacacaacagattcatgctattaacttgggctaaaaatccttccttttttggtatgcaaaacaacttttcaaggataaaagtattttttaaaaataggctgatttatatgccagatgtaagcaacatcttttctgactgctggttactttttgttgtttctttgttactataaccttctctcatggtaattcagtgtttacagcaact

SEQ ID NO: 42658 - DNA, 265 bp, Homo sapiens
tttgaggacattagtataaagcttcagtaattaagacacggtagtattgacatcatatggatagacaaagaaatcattggaagagaacagagtccagatatagttccacacatacatggtcagttgatttttttgttgtgattaaaaaacaacttcccttttctctctgccttctgataatcactattctacattctgtttctatgggtttaactactttcgatacctaatgtaagtagaatcatacaacatacctttctgtgcc

SEQ ID NO: 42659 - DNA, 3119 bp, Homo sapiens
  misc_feature (4)..(5): n is a, c, g, or t
  misc_feature (7)..(8): n is a, c, g, or t
  misc_feature (10)..(10): n is a, c, g, or t
  misc_feature (12)..(14): n is a, c, g, or t
gaanncnntngnnntcggcggagacctgctccccagaagacgcctcctgcttcccactgcgccctggaggacgcgggctggctgctgggcgagctcggcggaggcacgcccctcgcctccccgcggagtgcggactcgccccggtgcccaaactccgcccaccctctagggagctccgctctcccgcctaaccccggcactccggacagagctgggcctggggaaggggttcctgaactacgcggacgccgaacgggacgcgctgcagaagcgcacgagtctgcggccacgcgcgctccgatggctgccaggagctgagctcagggtgggcggaggaagcggttagacgccccgaaactgagctgcacgtttctaaggtagggaggaggaagatgcccccaattaagttgatctttgagccaaggaggctggggagcagcctccccaagctagagccctgcagagcgagtttcccttgacctcgctgcgcctctggcggctctgcagcgcggacccgcggcccctcgggaaagcgcagtcggaaagttatccgcggcggttccctgcgcgccctgttgtgtaagctcggcgttgccagcggacggagaagttgctggcttgcccgatagcccagttcggtggcggcccggggcggatttcatggcccgcggcgaacgcggggccagagctggcgtgggcgagcccctgcgcgccccctcccgcggggatccagttcgcctgctcccttccgctcgctggcttttccgatgcttgctgcgcccctggccgccgctgccctctcgccgcctcctacccctcggagccgccgcctaagtcgaggaggagagaatgaccgaggtgctgtggccggctgtccccaacgggacggacgctgccttcctggccggtccgggttcgtcctgggggaacagcacggtcgcctccactgccgccgtctcctcgtcgttcaaatgcgccttgaccaagacgggcttccagttttactacctgccggctgtctacatcttggtattcatcatcggcttcctgggcaacagcgtggccatctggatgttcgtcttccacatgaagccctggagcggcatctccgtgtacatgttcaatttggctctggccgacttcttgtacgtgctgactctgccagccctgatcttctactacttcaataaaacagactggatcttcggggatgccatgtgtaaactgcagaggttcatctttcatgtgaacctctatggcagcatcttgtttctgacatgcatcagtgcccaccggtacagcggtgtggtgtaccccctcaagtccctgggccggctcaaaaagaagaatgcgatctgtatcagcgtgctggtgtggctcattgtggtggtggcgatctcccccatcctcttctactcaggtaccggggtccgcaaaaacaaaaccatcacctgttacgacaccacctcagacgagtacctgcgaagttatttcatctacagcatgtgcacgaccgtggccatgttctgtgtccccttggtgctgattctgggctgttacggattaattgtgagagctttgatttacaaagatctggacaactctcctctgaggagaaaatcgatttacctggtaatcattgtactgactgtttttgctgtgtcttacatccctttccatgtgatgaaaacgatgaacttgagggcccggcttgattttcagaccccagcaatgtgtgctttcaatgacagggtttatgccacgtatcaggtgacaagaggtctagcaagtctcaacagttgtgtggaccccattctctatttcttggcgggagatactttcagaaggagactctcccgagccacaaggaaagcttctagaagaagtgaggcaaatttgcaatccaagagtgaagacatgaccctcaatattttacctgagttcaagcagaatggagatacaagcctgtgaaggcacaagaatctccaaacacctctctgttgtaatatggtaggatgcttaacagaatcaagtacttttcccctctttaactttctagtttagaaaaaaatcaaaccaagaaaatagtgagttaaaaaaataatagaagtagaaatgcccacatccacacttagcttgtttgggtttgctttcacagtctctcttccttctgactagaagtatgtataataaaacaatactacctagttaaacatttactttctcttttgcctttaaaatgtgcaggcttttctgtttaaagtgtgtgtgcacatgagtactggggctgtttttgatattagtaatttctctaagaaaactagccccctgcaacttgagtttgtggtttatctagcctttattgtttttttaaaatccacagtaggaataaaaaatctatattctcagaaatatctagcatggtatataacaaaacactaaactcatcagttcatccggcatcagatcaatggatctctgagcggggtgtttttttcagtgtcttataagcatagatgatagttgactgagtttctttagggcattgaatagacaagtaaagctaatgaatttaaaagcctgaaaagtgattgttttccagttatttctggaaaaggtctcattatatattgggtgctaaatgtttgatggggaaagcctgcatatattatcgtactggtaaaatgcattcaaaataattaaagtgcatgtattttccttgtaaacaccatgagctctcttagacatcttgtgataaagagcatttacttgccccactgctgtgcaatgccttaggactttgtttgtgttccaggacaagtgttcactcacatctgtaaaaacaattttaagaattgcaaataaattacagaccaaagattgagtaaagtcaaataactgttagtaagttgaaggatattggacaggaggacagtatttcagaaaaggagaggttgacagtcatccacaaggcatagcctccaagtatactctcaaatgtatgaagcaactggggtgggcagaagacattttagaatgagggcctttagtttaaattaaagtcatggtggagaagactcttgcttccaccaagtgtttgaaaacacaaaatacgatat

SEQ ID NO: 42660 - DNA, 2409 bp, Homo sapiens
  misc_feature (4)..(5): n is a, c, g, or t
  misc_feature (7)..(8): n is a, c, g, or t
  misc_feature (10)..(10): n is a, c, g, or t
  misc_feature (12)..(14): n is a, c, g, or t
gaanncnntngnnntcggcggagacctgctccccagaagacgcctcctgcttcccactgcgccctggaggacgcgggctggctgctgggcgagctcggcggaggcacgcccctcgcctccccgcggagtgcggactcgccccggtgcccaaactccgcccaccctctagggagctccgctctcccgcctaaccccggcactccggacagagctgggcctggggaaggggttcctgaactacgcggacgccgaacgggacgcgctgcagaagcgcacgagtctgcggccacgcgcgctccgatggctgccaggagctgagctcagggtgggcggaggaagcggttagacgccccgaaactgagctgcacgtttctaaggtagggaggaggaagatgcccccaattaagttgatctttgagccaaggaggctggggagcagcctccccaagctagagccctgcagagcgagtttcccttgacctcgctgcgcctctggcggctctgcagcgcggacccgcggcccctcgggaaagcgcagtcggaaagttatccgcggcggttccctgcgcgccctgttgtgtaagctcggcgttgccagcggacggagaagttgctggcttgcccgatagcccagttcggtggcggcccggggcggatttcatggcccgcggcgaacgcggggccagagctggcgtgggcgagcccctgcgcgccccctcccgcggggatccagttcgcctgctcccttccgctcgctggcttttccgatgcttgctgcgcccctggccgccgctgccctctcgccgcctcctacccctcggagccgccgcctaagtcgaggaggagagaatgaccgaggtgctgtggccggctgtccccaacgggacggacgctgccttcctggccggtccgggttcgtcctgggggaacagcacggtcgcctccactgccgccgtctcctcgtcgttcaaatgcgccttgaccaagacgggcttccagttttactacctgccggctgtctacatcttggtattcatcatcggcttcctgggcaacagcgtggccatctggatgttcgtcttccacatgaagccctggagcggcatctccgtgtacatgttcaatttggctctggccgacttcttgtacgtgctgactctgccagccctgatcttctactacttcaataaaacagactggatcttcggggatgccatgtgtaaactgcagaggttcatctttcatgtgaacctctatggcagcatcttgtttctgacatgcatcagtgcccaccggtacagcggtgtggtgtaccccctcaagtccctgggccggctcaaaaagaagaatgcgatctgtatcagcgtgctggtgtggctcattgtggtggtggcgatctcccccatcctcttctactcaggtaccggggtccgcaaaaacaaaaccatcacctgttacgacaccacctcagacgagtacctgcgaagttatttcatctacagcatgtgcacgaccgtggccatgttctgtgtccccttggtgctgattctgggctgttacggattaattgtgagagctttgatttacaaagatctggacaactctcctctgaggagaaaatcgatttacctggtaatcattgtactgactgtttttgctgtgtcttacatccctttccatgtgatgaaaacgatgaacttgagggcccggcttgattttcagaccccagcaatgtgtgctttcaatgacagggtttatgccacgtatcaggtgacaagaggtctagcaagtctcaacagttgtgtggaccccattctctatttcttggcgggagatactttcagaaggagactctcccgagccacaaggaaagcttctagaagaagtgaggcaaatttgcaatccaagagtgaagacatgaccctcaatattttacctgagttcaagcagaatggagatacaagcctgtgaaggcacaagaatctccaaacacctctctgttgtaatatggtaggatgcttaacagaatcaagtacttttcccctctttaactttctagtttagaaaaaaatcaaaccaagaaaatagtgagttaaaaaaataatagaagtagaaatgcccacatccacacttagcttgtttgggtttgctttcacagtctctcttccttctgactagaagtatgtataataaaacaatactacctagttaaacatttactttctcttttgcctttaaaatgtgcaggcttttctgtttaaagtgtgtgtgcacatgagtactggggctgtttttgatattagtaatttctctaagaaaactagccccctgcaacttgagtttgtggtttatctagcctttattgtttttttaaaatccacagtaggaataaaaaatctatattctcag

SEQ ID NO: 42661 - DNA, 2210 bp, Homo sapiens
  misc_feature (4)..(5): n is a, c, g, or t
  misc_feature (7)..(8): n is a, c, g, or t
  misc_feature (10)..(10): n is a, c, g, or t
  misc_feature (12)..(14): n is a, c, g, or t
gaanncnntngnnntcggcggagacctgctccccagaagacgcctcctgcttcccactgcgccctggaggacgcgggctggctgctgggcgagctcggcggaggcacgcccctcgcctccccgcggagtgcggactcgccccggtgcccaaactccgcccaccctctagggagctccgctctcccgcctaaccccggcactccggacagagctgggcctggggaaggggttcctgaactacgcggacgccgaacgggacgcgctgcagaagcgcacgagtctgcggccacgcgcgctccgatggctgccaggagctgagctcagggtgggcggaggaagcggttagacgccccgaaactgagctgcacgtttctaaggtagggaggaggaagatgcccccaattaagttgatctttgagccaaggaggctggggagcagcctccccaagctagagccctgcagagcgagtttcccttgacctcgctgcgcctctggcggctctgcagcgcggacccgcggcccctcgggaaagcgcagtcggaaagttatccgcggcggttccctgcgcgccctgttgtgtaagctcggcgttgccagcggacggagaagttgctggcttgcccgatagcccagttcggtggcggcccggggcggatttcatggcccgcggcgaacgcggggccagagctggcgtgggcgagcccctgcgcgccccctcccgcggggatccagttcgcctgctcccttccgctcgctggcttttccgatgcttgctgcgcccctggccgccgctgccctctcgccgcctcctacccctcggagccgccgcctaagtcgaggaggagagaatgaccgaggtgctgtggccggctgtccccaacgggacggacgctgccttcctggccggtccgggttcgtcctgggggaacagcacggtcgcctccactgccgccgtctcctcgtcgttcaaatgcgccttgaccaagacgggcttccagttttactacctgccggctgtctacatcttggtattcatcatcggcttcctgggcaacagcgtggccatctggatgttcgtcttccacatgaagccctggagcggcatctccgtgtacatgttcaatttggctctggccgacttcttgtacgtgctgactctgccagccctgatcttctactacttcaataaaacagactggatcttcggggatgccatgtgtaaactgcagaggttcatctttcatgtgaacctctatggcagcatcttgtttctgacatgcatcagtgcccaccggtacagcggtgtggtgtaccccctcaagtccctgggccggctcaaaaagaagaatgcgatctgtatcagcgtgctggtgtggctcattgtggtggtggcgatctcccccatcctcttctactcaggtaccggggtccgcaaaaacaaaaccatcacctgttacgacaccacctcagacgagtacctgcgaagttatttcatctacagcatgtgcacgaccgtggccatgttctgtgtccccttggtgctgattctgggctgttacggattaattgtgagagctttgatttacaaagatctggacaactctcctctgaggagaaaatcgatttacctggtaatcattgtactgactgtttttgctgtgtcttacatccctttccatgtgatgaaaacgatgaacttgagggcccggcttgattttcagaccccagcaatgtgtgctttcaatgacagggtttatgccacgtatcaggtgacaagaggtctagcaagtctcaacagttgtgtggaccccattctctatttcttggcgggagatactttcagaaggagactctcccgagccacaaggaaagcttctagaagaagtgaggcaaatttgcaatccaagagtgaagacatgaccctcaatattttacctgagttcaagcagaatggagatacaagcctgtgaaggcacaagaatctccaaacacctctctgttgtaatatggtaggatgcttaacagaatcaagtacttttcccctctttaactttctagtttagaaaaaaatcaaaccaagaaaatagtgagttaaaaaaataatagaagtagaaatgcccacatccacacttagcttgtttgggtttgctttcacagtctctcttccttctgactagaagtatgtataataaaacaatactacctagtt

SEQ ID NO: 42662 - DNA, 411 bp, Homo sapiens
tgcataaatgtctttttttgaaaattgaccagacacttttataaagactatcttgtgtcatcgttatgataatcctatgtggaagttatcttcagcttcattttaccaatgagataaatgaaactgtggtagtataaataaataacttgtctaaagatactgagtagcagaggaagcattccatcccagacccattgaattctcagatctaagatcctgccaggctgtttctggaatacagagcagaaaattccctcctgttcaagcgctaactagataagtccttcttcacaaatgccaagtaagcacagaaaaagagcaacagggaaaaagtttatgctccaaggaagaagtcaaccccagactgcagggatcgtggtgagattgtatcaggattggaccttggggaaa

SEQ ID NO: 42663 - DNA, 826 bp, Homo sapiens
cctcgaaccttcggagggtgttcctttgagatgtttcatcagtgacatcacagtgattgccagcttccacggactactttaggcgctgcccagagtccaggagtccagacagcctgggaggggagaaggagttggagctcaagttggagacagcgaggagaaacctgccatagccagggtgtgtctttgatcctcttcaggaggtgaggagaagccagaggtccttggtgtgccctcagaaatctgcctgcagttctcaccaagccgctgtgaaaatggggataaacacccgggagctgtttctcaacttcactattgtcttgattacggttattcttatgtggctccttgtgaggtcctatcagtactgagaggccatgccatggtcctgggattgactgagatgctccggagctgcctgctctatgccctgagaccccactgctgtcattgtcacaggatgccattctccatccgagggcacctgtgacctgcactcacaatatctgctatgctgtagtgctaggattgattatgtgttctccaaagatgctgctcccaagggctgccaagtgtttgccagggaacggtagatttattccccaactcttaactgaaaatgtgttagacaagccacaaagttaaaattaaactggattcatgatgatgtaggattgttacaagcccctgatctgtctcaccacacatcccttcaacccacacggtctgcaaccaaactctaattcaacctgccagaaggaatgttagaggaagtctttgtcagcccttatagctatcatgtgaataaagttaagtcaacttcaaa

SEQ ID NO: 42664 - DNA, 719 bp, Homo sapiens
aagaggcatgatcgagctcggactgttggagtgttgttggagacagcgaggagaaacctgccatagccagggtgtgtctttgatcctcttcaggaggtgaggagaagccagaggtccttggtgtgccctcagaaatctgcctgcagttctcaccaagccgctgtgaaaatggggataaacacccgggagctgtttctcaacttcactattgtcttgattacggttattcttatgtggctccttgtgaggtcctatcagtactgagaggccatgccatggtcctgggattgactgagatgctccggagctgcctgctctatgccctgagaccccactgctgtcattgtcacaggatgccattctccatccgagggcacctgtgacctgcactcacaatatctgctatgctgtagtgctaggattgattatgtgttctccaaagatgctgctcccaagggctgccaagtgtttgccagggaacggtagatttattccccaactcttaactgaaaatgtgttagacaagccacaaagttaaaattaaactggattcatgatgatgtaggattgttacaagcccctgatctgtctcaccacacatcccttcaacccacacggtctgcaaccaaactctaattcaacctgccagaaggaatgttagaggaagtctttgtcagcccttatagctatcatgtgaataaagttaagtcaacttcaaa

SEQ ID NO: 42665 - DNA, 683 bp, Homo sapiens
cggcggtataacgtcccttatgtctgcccgcccgtcgtccccctctccggtagagtagaggtgaggagaagccagaggtccttggtgtgccctcagaaatctgcctgcagttctcaccaagccgctgtgaaaatggggataaacacccgggagctgtttctcaacttcactattgtcttgattacggttattcttatgtggctccttgtgaggtcctatcagtactgagaggccatgccatggtcctgggattgactgagatgctccggagctgcctgctctatgccctgagaccccactgctgtcattgtcacaggatgccattctccatccgagggcacctgtgacctgcactcacaatatctgctatgctgtagtgctaggattgattatgtgttctccaaagatgctgctcccaagggctgccaagtgtttgccagggaacggtagatttattccccaactcttaactgaaaatgtgttagacaagccacaaagttaaaattaaactggattcatgatgatgtaggattgttacaagcccctgatctgtctcaccacacatcccttcaacccacacggtctgcaaccaaactctaattcaacctgccagaaggaatgttagaggaagtctttgtcagcccttatagctatcatgtgaataaagttaagtcaacttcaaa

SEQ ID NO: 42666 - DNA, 651 bp, Homo sapiens
  misc_feature (1)..(1): n is a, c, g, or t
nttgccctagctggccattgtgccagaggtgaggagaagccagaggtccttggtgtgccctcagaaatctgcctgcagttctcaccaagccgctgtgaaaatggggataaacacccgggagctgtttctcaacttcactattgtcttgattacggttattcttatgtggctccttgtgaggtcctatcagtactgagaggccatgccatggtcctgggattgactgagatgctccggagctgcctgctctatgccctgagaccccactgctgtcattgtcacaggatgccattctccatccgagggcacctgtgacctgcactcacaatatctgctatgctgtagtgctaggattgattatgtgttctccaaagatgctgctcccaagggctgccaagtgtttgccagggaacggtagatttattccccaactcttaactgaaaatgtgttagacaagccacaaagttaaaattaaactggattcatgatgatgtaggattgttacaagcccctgatctgtctcaccacacatcccttcaacccacacggtctgcaaccaaactctaattcaacctgccagaaggaatgttagaggaagtctttgtcagcccttatagctatcatgtgaataaagttaagtcaacttcaaa

SEQ ID NO: 42667 - DNA, 786 bp, Homo sapiens
  misc_feature (1)..(1): n is a, c, g, or t
nttgccctagctggccattgtgccagaggtgaggagaagccagaggtccttggtgtgccctcagaaatctgcctgcagttctcaccaagccgctgtgaaaatggggataaacacccgggagctgtttctcaacttcactattgtcttgattacggttattcttatgtggctccttgtgaggtcctatcagtactgagaggccatgccatggtcctgggattgactgagatgctccggagctgcctgctctatgccctgagaccccactgctgtcattgtcacaggatgccattctccatccgagggcacctgtgacctgcactcacaatatctgctatgctgtagtgctaggattgattatgtgttctccaaagatgctgctcccaagggctgccaagtgtttgccagggaacggtagatttattccccaactcttaactgaaaatgtgttagacaagccacaaagttaaaattaaactggattcatgatgatgtaggattgttacaagcccctgatctgtctcaccacacatcccttcaacccacacggtctgcaaccaaactctaattcaacctgccagaaggaatgttagaggaagtctttgtcagcccttatagctatcatgtgaataaagttaagtcaacttcaaaaaaaaaaaaatggcctcgtttgcctcagcgggggagctctggggccggtttcctttagaggggggtaattcatgatcctggtcactggctcctgggctgggccgtcgggtgcggcaacggttctaaccactcaag

SEQ ID NO: 42668 - DNA, 719 bp, Homo sapiens
tcgcgatatagtctcataagcccacccttccttccccctctccccttcggtggtgcagaacaggaggtgaggagaagccagaggtccttggtgtgccctcagaaatctgcctgcagttctcaccaagccgctgtgaaaatggggataaacacccgggagctgtttctcaacttcactattgtcttgattacggttattcttatgtggctccttgtgaggtcctatcagtactgagaggccatgccatggtcctgggattgactgagatgctccggagctgcctgctctatgccctgagaccccactgctgtcattgtcacaggatgccattctccatccgagggcacctgtgacctgcactcacaatatctgctatgctgtagtgctaggattgattatgtgttctccaaagatgctgctcccaagggctgccaagtgtttgccagggaacggtagatttattccccaactcttaactgaaaatgtgttagacaagccacaaagttaaaattaaactggattcatgatgatgtaggattgttacaagcccctgatctgtctcaccacacatcccttcaacccacacggtctgcaaccaaactctaattcaacctgccagaaggaatgttagaggaagtctttgtcagcccttatagctatcatgtgaataaagttaagtcaacttcaaaaacaacttctagaacttattttagcttcca

SEQ ID NO: 42669 - DNA, 675 bp, Homo sapiens
  misc_feature (35)..(35): n is a, c, g, or t
ttaaagtttgttatagcgtgctagtagcattatcntcttagtggtaccagaggtgaggagaagccagaggtccttggtgtgccctcagaaatctgcctgcagttctcaccaagccgctgtgaaaatggggataaacacccgggagctgtttctcaacttcactattgtcttgattacggttattcttatgtggctccttgtgaggtcctatcagtactgagaggccatgccatggtcctgggattgactgagatgctccggagctgcctgctctatgccctgagaccccactgctgtcattgtcacaggatgccattctccatccgagggcacctgtgacctgcactcacaatatctgctatgctgtagtgctaggattgattatgtgttctccaaagatgctgctcccaagggctgccaagtgtttgccagggaacggtagatttattccccaactcttaactgaaaatgtgttagacaagccacaaagttaaaattaaactggattcatgatgatgtaggattgttacaagcccctgatctgtctcaccacacatcccttcaacccacacggtctgcaaccaaactctaattcaacctgccagaaggaatgttagaggaagtctttgtcagcccttatagctatcatgtgaataaagttaagtcaacttcaaa

SEQ ID NO: 42670 - DNA, 668 bp, Homo sapiens
ctgtctgctgctgaggcctgcagagattaatataaacggcaggaggtgaggagaagccagaggtccttggtgtgccctcagaaatctgcctgcagttctcaccaagccgctgtgaaaatggggataaacacccgggagctgtttctcaacttcactattgtcttgattacggttattcttatgtggctccttgtgaggtcctatcagtactgagaggccatgccatggtcctgggattgactgagatgctccggagctgcctgctctatgccctgagaccccactgctgtcattgtcacaggatgccattctccatccgagggcacctgtgacctgcactcacaatatctgctatgctgtagtgctaggattgattatgtgttctccaaagatgctgctcccaagggctgccaagtgtttgccagggaacggtagatttattccccaactcttaactgaaaatgtgttagacaagccacaaagttaaaattaaactggattcatgatgatgtaggattgttacaagcccctgatctgtctcaccacacatcccttcaacccacacggtctgcaaccaaactctaattcaacctgccagaaggaatgttagaggaagtctttgtcagcccttatagctatcatgtgaataaagttaagtcaacttcaaa

SEQ ID NO: 42671 - DNA, 699 bp, Homo sapiens
ctctactcaaatctaacactctccctctttttctttataaaacattcaatctacgtagtcgaggacagccatagaggtgaggagaagccagaggtccttggtgtgccctcagaaatctgcctgcagttctcaccaagccgctgtgaaaatggggataaacacccgggagctgtttctcaacttcactattgtcttgattacggttattcttatgtggctccttgtgaggtcctatcagtactgagaggccatgccatggtcctgggattgactgagatgctccggagctgcctgctctatgccctgagaccccactgctgtcattgtcacaggatgccattctccatccgagggcacctgtgacctgcactcacaatatctgctatgctgtagtgctaggattgattatgtgttctccaaagatgctgctcccaagggctgccaagtgtttgccagggaacggtagatttattccccaactcttaactgaaaatgtgttagacaagccacaaagttaaaattaaactggattcatgatgatgtaggattgttacaagcccctgatctgtctcaccacacatcccttcaacccacacggtctgcaaccaaactctaattcaacctgccagaaggaatgttagaggaagtctttgtcagcccttatagctatcatgtgaataaagttaagtcaacttcaaa

SEQ ID NO: 42672 - DNA, 961 bp, Homo sapiens
cctcgaaccttcggagggtgttcctttgagatgtttcatcagtgacatcacagtgattgccagcttccacggactactttaggcgctgcccagagtccaggagtccagacagcctgggaggggagaaggagttggagctcaagttggagacagcgaggagaaacctgccatagccagggtgtgtctttgatcctcttcaggaggtgaggagaagccagaggtccttggtgtgccctcagaaatctgcctgcagttctcaccaagccgctgtgaaaatggggataaacacccgggagctgtttctcaacttcactattgtcttgattacggttattcttatgtggctccttgtgaggtcctatcagtactgagaggccatgccatggtcctgggattgactgagatgctccggagctgcctgctctatgccctgagaccccactgctgtcattgtcacaggatgccattctccatccgagggcacctgtgacctgcactcacaatatctgctatgctgtagtgctaggattgattatgtgttctccaaagatgctgctcccaagggctgccaagtgtttgccagggaacggtagatttattccccaactcttaactgaaaatgtgttagacaagccacaaagttaaaattaaactggattcatgatgatgtaggattgttacaagcccctgatctgtctcaccacacatcccttcaacccacacggtctgcaaccaaactctaattcaacctgccagaaggaatgttagaggaagtctttgtcagcccttatagctatcatgtgaataaagttaagtcaacttcaaaaaaaaaaaaatggcctcgtttgcctcagcgggggagctctggggccggtttcctttagaggggggtaattcatgatcctggtcactggctcctgggctgggccgtcgggtgcggcaacggttctaaccactcaag

SEQ ID NO: 42673 - DNA, 878 bp, Homo sapiens
cctcgaaccttcggagggtgttcctttgagatgtttcatcagtgacatcacagtgattgccagcttccacggactactttaggcgctgcccagagtccaggagtccagacagcctgggaggggagaaggagttggagctcaagttggagacagcgaggagaaacctgccatagccagggtgtgtctttgatcctcttcaggaggtgaggagaagccagaggtccttggtgtgccctcagaaatctgcctgcagttctcaccaagccgctgtgaaaatggggataaacacccgggagctgtttctcaacttcactattgtcttgattacggttattcttatgtggctccttgtgaggtcctatcagtactgagaggccatgccatggtcctgggattgactgagatgctccggagctgcctgctctatgccctgagaccccactgctgtcattgtcacaggatgccattctccatccgagggcacctgtgacctgcactcacaatatctgctatgctgtagtgctaggattgattatgtgttctccaaagatgctgctcccaagggctgccaagtgtttgccagggaacggtagatttattccccaactcttaactgaaaatgtgttagacaagccacaaagttaaaattaaactggattcatgatgatgtaggattgttacaagcccctgatctgtctcaccacacatcccttcaacccacacggtctgcaaccaaactctaattcaacctgccagaaggaatgttagaggaagtctttgtcagcccttatagctatcatgtgaataaagttaagtcaacttcaaaacacaaacctggatacagagaaaaaaataactaatgataactacctgagaca

SEQ ID NO: 42674 - DNA, 917 bp, Homo sapiens
  misc_feature (846)..(846): n is a, c, g, or t
  misc_feature (884)..(884): n is a, c, g, or t
cctcgaaccttcggagggtgttcctttgagatgtttcatcagtgacatcacagtgattgccagcttccacggactactttaggcgctgcccagagtccaggagtccagacagcctgggaggggagaaggagttggagctcaagttggagacagcgaggagaaacctgccatagccagggtgtgtctttgatcctcttcaggaggtgaggagaagccagaggtccttggtgtgccctcagaaatctgcctgcagttctcaccaagccgctgtgaaaatggggataaacacccgggagctgtttctcaacttcactattgtcttgattacggttattcttatgtggctccttgtgaggtcctatcagtactgagaggccatgccatggtcctgggattgactgagatgctccggagctgcctgctctatgccctgagaccccactgctgtcattgtcacaggatgccattctccatccgagggcacctgtgacctgcactcacaatatctgctatgctgtagtgctaggattgattatgtgttctccaaagatgctgctcccaagggctgccaagtgtttgccagggaacggtagatttattccccaactcttaactgaaaatgtgttagacaagccacaaagttaaaattaaactggattcatgatgatgtaggattgttacaagcccctgatctgtctcaccacacatcccttcaacccacacggtctgcaaccaaactctaattcaacctgccagaaggaatgttagaggaagtctttgtcagcccttatagctatcatgtgaataaagttaagtcaacttcaaaccaaaaaaggaccaaagatnccggtgccggcagagctggtaagcggaaaaataaaaanaaaagggccccttggccccagggggggagcctc

SEQ ID NO: 42675 - DNA, 529 bp, Homo sapiens
tccaagtcaaaaagtgtactctggggtaacgattccatccttgcatgcccatgatgaggagcaaggcctgaaggtaggagggcagagcctcgtaacaaaacaaagcctggatcaaggaagcagccacaccaggcacacacacacgtcaggacatgtgttcacttccctgtgtggttccccatgtgtgtgcacttgtagcagatgtcaaggccagcatgacagtgacagcggacccaaggaggaagggagttctggcagggctggggagattctgccctgctcagttttacttaggaaataggaaacagcgttggcatcctctgcctacatttctgctctcatttcaccatttccaatcttatgaaaacattacaggatactctcagcaggtatgtccgatcctcatcaagcctcccaatgacagagaaagagtctctcttcttattagatcacagaatttaaagaaaaattttaaaatctacttattgttattttacataaatataaacttcaacaaatgctaactctt

SEQ ID NO: 42676 - DNA, 912 bp, Homo sapiens
tttagtagagacgggatttcatcatgttgcccaggctggtcttgaactcctgggctcaagccatctgcctgcctccacctcccaaaatgctgagattacaggtgtgagccaccatgcctggcctaaactaatttttagatagttcctggtcactcaaatttaagaatgtcagcaatgtcaattttaaatgctcataggtctttccatatctgtaacatgaaaatgattattctgcattttattcagtagtccaaattaaagaaaatgtttttctcaatttaaaataatttctttttcttttgtttatgcaagtgcatacatgcttcactgaaagcaaaaccattataattacattaaagtttataaaatatgatattttaacctcatatctaataagtatgtacaaaggtaaccatcactccttaaatccacatgaaaactactgtaactgatcatgtattttggaattagacttgataataaaagattatcatgtatcacatatctcacaccaggggaacaattagctacataattgtcataccttaatatcttttaaaggtaacagtaattttcaacacattttattttaaaatattattttaacaaaagttacattcctctccacaatgaggctaaatgtcacccacgaaagaactttattcccttatattcctgaaaagaaatcagaattaacatttttatgttgaataaattttaaaatttaggaaatgttctatttaaagttaatttctttcataaagccattactctttacattgtcatttccaaaaagccacaatttcccatgctggatgtgatgaaagttaggcacacctttactgcattagcagcctttgacaatgacttcctcaaactgacaccatcttaattagatgcagggacagggat

SEQ ID NO: 42677 - DNA, 1444 bp, Homo sapiens
gtttgaaaatattctctgtgatgatttccttaattcactttgaaatcagtttcttactatgaagtcattaatgtaagaacttggccaacaaagcttttcttctcataggctggctctactaggggaactagtgtttggtaaactgctgggactaccacaatgggaggggtacaggtataaaattaagttatcttaaaatgtttcagcaatgatgcacgtaggagaccataataggtggtggtaaatgttttgcccacgtataggaatgattttaactaagatgtatgctattccctatgcaacaaattatcaaacaggatatgtcttgtgacctgttttttttttaaggacacatttttaatagctgaaaatctctgataatgaattagagtgtgtagtaaacatgagaattagttatattatcttatttttaaaattcaagactaagaacttcagagaatgaagagtctattaaaatgaggttcatcttaatgataggcaaaccaaactcatactgcttgacatgttttgaaaactggtaatattgagggtgtacagcacatgtacttaaaaatgacactggactatcttttgctctgagccatgccacttaccgaaattgtaaatacatttttcacaaatgcattgccaattattaccatccctcaaagcaataaattgtggacagttgctttaaatgtttgtcagcaactgttttcatttgttcagatattttgaatagcctacacctaataactgttattatttggtgaacataaaaaaataaatagatctgtatattgatggtagactctccatattgaaatgattattttccaaacattttcattttggtcaataattcaaactaccacttaggcaaagtattcgaacactgtgtcctttgtttaaggaaatataaaaaaaaatcacctttctttttgtgcaaaaaaaatattatttcaatcacatttcagaaccgccagggcaagaaagtataaagcaggatcatgttaagaaaaaagaaaaaaagatcatgagtcacttaaatatgtatttttatttgtaacaaacaagtattaaactgtaaagtatttttgtacaaatttaatactttaatagcatggtatttatcgtctatgtatggttttggggaattcaaaattgttcaaatatttgtatggaaaaaaataaaaccctctaccaaatggaataaacagtgattttaaaaagccaaataaagaggatatgcattattggtgttgttttgaatatatttcaatgttctagcctgagtcctacacaatttttttttgttttgttttgttttgagatgatgatggagtttcactctgttgcccagggccagattaatttaaagaagagttaataccaattcttcacaaactcttccaaaatagaagacaaggggacacttcacaac

SEQ ID NO: 42678 - DNA, 375 bp, Homo sapiens
tacaaattgggtccagtgtatactgcttgggtggtagtgctccaaaatctcacaaatcaccactaaagaacttaaccaattaccacctgtgccccaaaagcctatgaaaataaatttaaaaaaaattgggataaacagtaaagagcatatttaacagccatctactgggctgaaaaactacagactgcaggtgccatagaagttccacacccgtgataccactgccctttctggggatcccccatgcttgagccactttgttactggaaagcagtcccaagccagacgccaagagaaggttcttgaaactttcacaagaaagaattcagtgtgagtccataaagcaaagtgaaagatagttaattaagaaaataa

SEQ ID NO: 42679 - DNA, 465 bp, Homo sapiens
attcctttgcataccctgcaagtaggagtgggttggctggcagcaaagcatcaaagggctcctactcagttcattctggaatacttattaaaataataattcatgaagtgaagcatataacaaaattcatgtcaagctgtttttattttcctctagacaagtaaaatacatatttaggttgagtgcctaaagtccaggacaaggaacaatgaaaaatccaggcctaactcaagcaattccaaatttgtttcacctgttctggttgctcatgtccaagagaaaagaacagagcctgaagttctatagaactggttttagttcataacctgcccaacaacagtctataattagaaagcaagcaagtttccaagctggaaaaaaactaacgaagttactctgagcagaaattattttcttctgtatctgataaaatgtataccactccaatgccctggcacttacctg

SEQ ID NO: 42680 - DNA, 441 bp, Homo sapiens
tactactaaatcgcggcgtcgacttttttttttgagacggactcgctctgatgccaagggtggagtgcagtggcatcatctcggctcactgcaagctccgcctcccaggttcatgccattctcctgcctcagcctcccgagtagctgggactacaggcacccaccaccacgcccagctaattttttgtatttttagtagagatggggtttcaccgtgctagccaggatggtcttgatctccggaacctagtgatccacccccctcggcctcccaaagtgatgggatgacaggcatgagccaccacgcccggcccagaaattattttttaactctccatttggggattacaagtcaaaatgtaccactaatgctataaaatagcaattcctttgtaatttgaaagaaattatacaattaatttgcttcagattatcaaagta

SEQ ID NO: 42681 - DNA, 377 bp, Homo sapiens
tatccccattttacagatgaggagacaggttaagagaggtgaatcacctacccaagtacacacagccagtaagtgagtggaaagggatttgagcccacagagtctgatgacagagtccacaccaacaactgctttaatcaagagagtttgtgacttgcctaggtctcaagaaaggaaaaccaactgatttggctgggcagggccctggtggagagggagagaaaacactctgactccttctcccattttccttctttttctggaaggtaattgcttggggcagtgacaacctcctggcgaattacacagctggtttcccagtgagatttgtaacaacaaccctgccagcctggcagcccccagcaagttccggttta

SEQ ID NO: 42682 - DNA, 440 bp, Homo sapiens
gaaagataacagctctctgcagcagagagggattaaaagcgttgccattcagcagtgaaattcaagggtttttataagctagctagtggggaggtgaggtgttatcttacctacatagggtgtgaaaaaccccaggtgtgccatctgcgtagagcatgaatctctggcatcccccaccccacccttttattatacaggcaggtcttttgcctgagctactccacgttgctttcctactgtgtatgtgcttcaaagggggaggtggagcctccatggtggacacacctggcctcaggtacccctttctgtctgtgcagctgcaagcatcccccgatgcaaactccagcttccttatctgtttgcagccgggtcttccaggctgctttctgttagaagaggagtgatttcctgggctgctttttggtagaagggaagttctg

SEQ ID NO: 42683 - DNA, 494 bp, Homo sapiens
gcgtcgaccttcctgccagagcccagcaaggaggaaatcttggccatagttggtatgggaggcttggggacacagaagggctttgtttgaagccagcagcaggagggatgtggcaccatcatctgatgtgctgcatcattcattgtccccatcgggaaggtggttggcctggggaagcttccagcattcctggtagatcccagtgaaggatgaatctgatccctaggcaggcaggaggggaccctggccagatgcacaaacttgtttgctttttgctgtgtgtcttttagcatccttgagtcccagggcctgaagggttcttggacatgggccgattttcctgtcacctatgtcccctcaacctcatcaccactgggcagctcattatctctctggaaaaggggaaggaaaccagcatttgtctttccatttttttttttttaaactgtggaaacatacacacatcataaaatttgccatttaataggccgggc

SEQ ID NO: 42684 - DNA, 514 bp, Homo sapiens
tcctgctaaataactcctcctgtgtaagtcagggtcaggatgagccgcctttaacagatgacccaaaatggcagtggcttaaacactcaggattcattcttgcccatggaagaatctagaggtaggccatttggggcttattaagcagttccaggaagtcttccatcttcctgcctcaccatcctctgcacttggttccagtcaagaggacgccatgttccaagagggctgccagagctccagccttcccactcataacccaggcagcaggaagaaaggagttgccatgaggatgaaccccctcgagttggcttcctttaaacagtcattggaaatcctccatgcttctgcttatatctcattatctcattgactagaatgtaatcatatgatcacactctgcttcaggggaggctggcacattaaatgttttttaaaatttcataatttggaccatttttgccttaagaaaatgaggattcttctgttgggcaaaaggttgttgtaaaaataa

SEQ ID NO: 42685 - DNA, 426 bp, Homo sapiens
gtgccggaagcaaccttataaatcgctatctataaaagaggacggggatgagaatgggttactgtgatgatgtagttttactgtgtagactctgatatttggaatcacattagctatcttttgaggaaaatctgaaaatttccagaaaactctggtgtattaagttcttgtgtgattcagtggttgtgcttaggtgtttggagttttaaggtggttagctgatttattatttaacagttatcctcgaagtgagagtattttagtctttctgctaaactgtatgtgggtttgggaaccttagttatttgaaggttaagcattaggccctaattcagtaacaggaagagttgtaatggctaatttgtcagaaatatttgtctagtcatacatttattttaacattccactaacaaaaggaaaaagaaa

SEQ ID NO: 42686 - DNA, 320 bp, Homo sapiens
tgtcaccctggctggagtgcggtagtgcaatctcgacccactgcaacctcagcccccggaaatcacttgaacccaggaggcggaggttgcatgagccaagattgcatcactacattccagcctgggcgacagagcaagactccatctcaaaaataaataaataaaagaaattaaccacacacagtgacacacacctgtagtcccagctactcgggagactgaagtgggaggatcacttgagcctagggaggttgaggctgcagggagctatgattgtgccacttcactccagcttaggcgacagtgaggccctgtgtcca

SEQ ID NO: 42687 - DNA, 572 bp, Homo sapiens
aaccctctctccacactctgttatcaggtggtgccacatttcactggccataatctatctttgttctgccagcatcaaagctgtgtactctaggccatcctggctgccacaatgtaatcctgatctacacagaggaaagagagagttacctcccttcaaaaagcttctttatttatattagaaagaattggccccctgaccaaccagagatttttttaaatagtaaaaacatatacaaggcaagcccaaaatggccaggcacagtggttcatgcctgtaatcccagcactttgggaggctgaggtgggaggatcacttgagcccaggagtttgaaaccagtttgaaaatctaattcagattttcagcctgggcaacaaagtgagatctcatctctgtgaaaaatttgaaaacttagccaggcatggtaatgcacacctgtggtcccagctacttgggaggctgaggtaggaggattgcgattccttggggccgtgatgtagagggctgcagtgagctgtgatcatgccactgcactccagcctgggagatagagtgataccctatcaaaaaa

SEQ ID NO: 42688 - DNA, 974 bp, Homo sapiens
cttcaggtgactggccaacagggagccctaatgtaactatggacttcgggtgactggccaagagtaagccctaatgtaactatggactttgggtgactatgacccaaatgtcaatgtagcttcattaacagttaataaacatttcactgtggtgtgggatggtgactgtagtgggggtggcggtgtgtgtgcatgggtatgggctggggtatatgggaactcactgtactttctgtaattttgctgtgaacttaaaactgccctaaaaattgtctatttttaaaaaacaataattataaactggaaaaattctcttaggaaatcctaaaatatggaagataaaatatgaaatgttttctcagtattaaatgtttataacaaccactttctaaccctcagagagcaacacagcaaatacttattaacagtgccataaagaaataaaagctagtcaaccaaaacttcccattaaataggaactgtaaactttatatacagataaaacaaccacattttcacaaactgaaacttgaaaaattaagtaaattggtcattcactaaattggctgcttggcaaactaattttcaaagaattagcatgttcttggttggaaaagaaaaagaataagcaaagtcagaaagtaacaaaaaagatctctaaagctgggtgttgcccaaaagcagccgatggagccaaccagaggctggaacattacagacccgctttccccaccacccaagctggtgtatgccatgctcccacagcagaagctaaaaaagtacacttactatttctattaacgaatagactatctccttctaaactgtataacattatatgaaattggaagctaaaatgtttgtagtaattgtttctactatgttcttcttctgccttcattgttaagttttatgtttcattaatacctttttagagtcaaaaaattttcaaaatttcaattaaaaaaatttct

SEQ ID NO: 42689 - DNA, 681 bp, Homo sapiens
tgtatgcccggcgttctcccttcatttcctaattcatgttggccatcctgtggagttgacagtcacacgtgtaagtgtaacccacaataatacccatcagcctccttcaaagccacaacaaatcaacctgtactccaagtcagaccactttgcttgccttgttgacagcccaagacctgattcctaacctccttttcaatggataaccgctcctaagacccatcccccaacccctgacgccccagacattccgtaaaggtggagatggatattatctctagtttaccagtgagagaaatggaggcacagagattagcgagttttcctgaggttactgataaacataaattttatttgcaaattaaaactaaactgtttctttcttgcctactaatatgtacttaataaaagtttaaattgttcaggtaagtgtaaaaatattgcctatccaatcgcaagcacaatcaagtgtacattttgtgaaaaagttgtgtttttttctcaatattaaattctattattaaacaatgttagttcttttttttcttatatgtaaaaaaagaacatctgtgcaatatcaaataccaataaaaaaactttcttatatctgtaaatcccactctggacttagttgtcctgtcttttaaattaagagactaatacatattttttctacatttc

SEQ ID NO: 42690 - DNA, 338 bp, Homo sapiens
tattggatgagaaggatccaagatgagaaaatgaaggatgacatcaatgtagcagtagctagaatgaacccactcctatgcatgtcctactgctgaacctggtgaaagacttctccctatagcagatccacaaaatactaagcatgagtttgttatcttgaattcgtctatttatgcaattctaagtgaaaaatgaaacgaaagtagaaaagaggtcagtcatctgtagtatgcccctaaagtttagcagcttgttcaatcatattctcaggctcctagtggaaaagaaccaaaagggttacctacaccagctgagccattttctacaatgacatatt

SEQ ID NO: 42691 - DNA, 430 bp, Homo sapiens
aaggatagcaatggctgttggatgggcgatggttgcaaggagccctgccgtggatgtgtaggccacagagctctcatcagcactgttttcgtggccaggaacagaaattctactcaggataattaaaattaaggaacagagctttattataagactgggatcggtagttaatttcctacaggggaaattcagggcatgtaaatcagtgaaatggaaaaggtgtaaggacaagagaaacaccagccctgtctgcaggggggggctgcaactcccttccagctgatgttgttccaccatgggtccagtgtgaccagatcttacaatgttcaaaagaggagtctaggtttttctgtgaaatctccaaatattagtatattggatcaaaaatgttcaaatgatgtgtgagctcaataaaatgcatctgcagtgc

SEQ ID NO: 42692 - DNA, 433 bp, Homo sapiens
tcagacgctgaactatgtgcagtggcagagtggagattacaggcatgagccactgtacctgggttgttacgaaggatatttgaaaggatacaaataaacagcccagtgaggagatacttggggcctggtatggaaaggtcccaagtacaggagctcctgtaccttggagttggggtgtgccaccctcctggcacatggatgagttgttgcaccttcctgtcagcttccacatgttcagttatccagaagtcctcagaatccatccttctgggtgtttttttaagactgggttttggtcttaaccaggctagagtgcagtggcacaatctcattgctcactatagcctcaacctcctggactcaagcagtcttcctacctttgcctcccaaagtgagccactgtgcccagccccttttgggtttttcttttttt

SEQ ID NO: 42693 - DNA, 463 bp, Homo sapiens
ctctcaaataaaagattccggaaaaaggtcattagagatcactttaccctcaaagtcgagaggctagagatgacacaggtcaaatcaagactggcaatgggacctgagaacctagtgatttggcattttaaagtaaggatcctggtcttttatgagccgtgatttatctatctatgaaataacacccttttctcaggatgagtcactggaaataaggtgatacatttatagaataaagatgaggaacttgcttaacatcactaacaatcagggaaatgcaaatcaaaaccataatgaggtatcaccttacatctgttaggataaccattatcaaaaaaatcaaaacataataagtgttggcaaggttgtgaagaaaagtgaaccctggtacactgttggtgaaaatgtagattggtataaccattatggaaaacagtatggaagttcctttaaaaagctaaaa

SEQ ID NO: 42694 - DNA, 431 bp, Homo sapiens
ggggccaccctgggcacgcacactataggtgcctggacctgaggtgacaaggccattcagccggcacttactgtagggcacttcaaacacacataccagccttcctgtgatgttagataatcatcctctctgtgccagctgggaaactgaggcccagagaggtgaagggatagcccaagatccaaagcccacatgggaactttcttcctgtccattcagacacagtcacatcctccagcagaggcgtgggtgagtggtgagtggtgaggagggtgtctcctcaatccaggagaattacgtcaagaattccccaccaggcacagtagctcacccccataatcccagcactttgggaaaccgaggcaggaggatcccttgagcccaggagttcaagagcagcctggacaacatagcaagaccccatctctaca

SEQ ID NO: 42695 - DNA, 442 bp, Homo sapiens
tgttggaacagtcacagatgataaaaccacaaagaaataagggcctgtagtagagttatggaatgatccatagccaggaacacaaaggaaggaaataccatattaacctacctcctaggaggtccttggaaagccttccataaaggagatggtctttagtcctgattcctgggcggttggagcagcagtttgccatcgggtgaaaagaaagcaagggcattccctggcagagggaacagcctgagcaaagccatgcagagaatgaagacctacagaagaaaatgctaatttgaaaaaagatgcataaagcagtctatgttttagtctagtctttttaaacttacagaaatttattactatgtgtgtccatctaacttggcttattttctttatttggggatcaagggaatgccagaattatgatattagttttattactaat

SEQ ID NO: 42696 - DNA, 1035 bp, Homo sapiens
  misc_feature (504)..(504): n is a, c, g, or t
tggccttcccattccaagttgacagctcagatgcaaggagatgagacttacattgggaacctgtgggatgcatctggattagaaacttccacaggagctaatatgtcttatagcaactccatggacatagcttctagaatttctgtaagagacatgccaattacaagagtcactatactcagggaggcccaaagttatagtatccattagcatagtcaatatttatagttcatttataattcttttggtaatcaggaaacatttttaccataaacaatattgttgggtaacataattgacctattaataagttttcaataaaacagaatgagaaaattaaccaaaggttaattctcatgtacaaaggtaaagtgttttgttaaccttttacccaaaagtgatgatatgaatgtagatttttttgggtgtttgaccaaggaagccaaaccattctttcagattatgttagatttgtagctttgtggagtgttgccagagatgttnctttctgtgtgtgagtttgatgagctaacctggagtttgtttgttggactggccaaaacaaatctgagccaactatggtccataccagctgacactgaagaagttcctctcaatgaagtaaatggaattgaagggtttccagagagattaccagtgataatacaggcatgggaagtgatataaaattctcaagaatgaaactgataggccaccaccaatattctacctgaattctatttctcatttcacttgggggaaactaggtcaaactaacatgtgtactaatatatgtctaacttaggcatacgctctagagcagtgattctcaatctttttgagatagtaaatttatttgagaaaaggatgaaaactgcagacttcttcctcagataaatgaacataaagacctacatgtggacttttgcttatcatgtattgtattggaaattaattttctttgatacttagactgtgtaaacaattttcacaaggaagggatttcaatttaaaaatcaatttccagttctgggg

SEQ ID NO: 42697 - DNA, 597 bp, Homo sapiens
cgtggagcagggcgtgggacttgcaacccgccatgcctgagtccccccctccccctgccctgctccctcatggccagagcctcccggacgggcgccgccccctgctctgcaaccagtcccattgaccgcccaagggctgaggagtgcgggggcatggtgtgggactagcaggcagctccacccacggccccagcatgggatccagtaggcaaagctagctggactcctgagtcgggtggggacttggagaacttttatgtctactcaaggtttgtaaatgcaccaatcagtgctctatgtctagctaatctagtggggacttggagaacttttgtgtctagctaaaggattgtaaatgcaccaatcagcactctgtgtctagctgaaggtttgtaaacacatcaatcagtgctgtgtctagctaaatctagggacttggagaacttttgtgtctagctaaaggattgtaaatgcaccagtcagcactctgtgtctagctcaaggtttataaacgcaccaatcagcaccctgtcaaaacagaccaatcagctgtctgtaaaatgggccaatcagctctctgtaaaatggaccaatcag

SEQ ID NO: 42698 - DNA, 346 bp, Homo sapiens
ctgtgaaaatagcttcttataaaacccaatatatatttattataattaaaatacaaaaattaagttttaaagaagtgaaaataatcaataaaaatggtaaatgaatggaaacaaatgaacctgtctatcaaattggtgcaagagtcataaagaggaaaatattccaagtgaatttaggatatggtaatttgactgtacatctcagataatatattctaatgatgagaataactactaaaaaatctcaaatggcattcagtatctaattgttagtagtaatattgtcattgttgcttggaaactgttatatgaatgttcaaactgttactttgagactgttatatga

SEQ ID NO: 42699 - DNA, 341 bp, Homo sapiens
tcatgagaaaatgtgtcctctggaagatggactagggaggatgacagtgaagactggatattggacagaagctctagggaataccagggaagccatggaaattgctagttctctggagcttgttcaagttttgaaactatcacaagcagtattatttctgatgtttcaccttttattttttttttcttaaaatatatggtcaaaatgagaggactaaataataggtataatgaatcctatagctcttatactgccagatagctctccagagtggttgaactaattcattattttatatataattatgttaagtaaatttgtttaactaattcaatcaatat

SEQ ID NO: 42700 - DNA, 133 bp, Homo sapiens
cagggatttagtgctgggtaaggcaagaaggcttgtcaaagcagctcttctggggaggccagaatcctgtaccaatgtcctcagcacgttcttcagctgctgggggagtgccagacaggatgaaagcgtagga

SEQ ID NO: 42701 - DNA, 478 bp, Homo sapiens
tactctaaatacggatggggaaaacggtaatctggcctttaagattaccatatggacacttaggacccagaatccaagatggcccagtggtttgcatgttccttggcagttggcttcattggttacataaccttaaacatggctttctatttatttattattgcaggagaaagataacaacacttatgaaaacagaagagtactttccaactatgaaaggccatagaaacgttttaattttcaatgaagtcactgaaaatccaactccaggagctatggcagtgttaatgaacatatatcatcaggtcttaaaaaaaaataaaggtaaactgaaaagacaactggctacaaagaaggatgccagaatgtaaggaaactataactaatagtcattaccaaaatactaaaacccaacaaaatgcaactgaaaaataccttccaaatttgccaagaaaaaaaattctattttaaacttgaa

SEQ ID NO: 42702 - DNA, 992 bp, Homo sapiens
ccttctgaaaaaagaaagccaactttcctttcaaatacacaccccaacccgccccggcatacacagaaatggggactgcgagcagaagcaacatcgctcgccatctgcaaaccaatctcattctattttgtgtcggtgctgtgggcgcctgtactctctctgtcacacaaccgtggtacctagaagtggactacactcatgaggccgtcaccataaagtgtaccttctccgcaaccggatgcccttctgagcaaccaacatgcctgtggtttcgctacggtgctcaccagcctgagaacctgtgcttggacgggtgcaaaagtgaggcagacaagttcacagtgagggaggccctcaaagaaatctgtggaatagcattccccagtgtgccggaagcgagagctaaacagacaggaggagggaccacactggtggtaagagaaattaagctgctcagcaaggaactgcggagcttcctgacagctcttgtatcactgctctctgtctatgtgaccggtgtgtgcgtggccttcatactcctctccaaatcaaaatccaaccctctaagaaacaaagaaataaaagaagactcacaaaagaagaagagtgctcggcgtatttttcaggaaattgctcaagaactataccataagagacatgtggaaacaaatcagcaatctgagaaagataacaacacttatgaaaacagaagagtactttccaactatgaaaggccatagaaacgttttaattttcaatgaagtcactgaaaatccaactccaggagctatggcagtgttaatgaacatatatcatcaggtcttaaaaaaaaataaaggtaaactgaaaagacaactggctacaaagaaggatgccagaatgtaaggaaactataactaatagtcattaccaaaatactaaaacccaacaaaatgcaactgaaaaataccttccaaatttgccaagaaaaaaaattctattttaaacttgaa

SEQ ID NO: 42703 - DNA, 307 bp, Homo sapiens
taacacatttaaagaactgatgaactggctttaactattacatacttgagtaccttttgaggtctagtttttatacgaataggcaagcagagtaagttcacgtttcacctctaaaacgcagtgtgaaggatactttacacatgtatttgaaagaataggctttaatagtcaatgtgcttctttctgtttttgtcattaagaaattaagctgctcagcaaggaactgcggagcttcctgacagctcttgtatcactgctctctgtctatgtgaccggtgtgtgcgtggccttcatactcctctccaaa

SEQ ID NO: 42704 - DNA, 716 bp, Homo sapiens
gtacagaccaacacttgaaaaatattttttaaattgtggctggttgtaacgatttcaaaactgaaatattttttagcttttaaatatttaaatgttaagtttaaacagaatatcaaggtaactttcaactgcagacactatttcctattgttgagaaactcaatgacaaaataatctcaaggggtaaactgtgacttaaattggacagttctcaaccataaattatatttaaagttctcaaatacaaaagagttaactgtaggcacatatgtgttgggggagggggtagtttttgggaccggtggcaatagagcaagaaaagttctgatgatgcgtcgttatcatcgcttatattcccaaaagagaatttttttttctcatttgtctttatagaagaagagtgctcggcgtatttttcaggaaattgctcaagaactataccataagagacatgtggaaacaaatcagcaatctgtaagtgtaaaatgtcaaaaaaaaatgtaaatacagatataaagcacgtttgaaaaaactaagctgccaaggagctgtcaagaaccatgttttccttcagaagagtctgaaagagaactttcacaagaatgtatttttatatagaacctgttttaataaatacataacaaaagacatctgatacaatattaaatagccccaggctggcatcttagtgacatggaaactttcagaaacacatt

SEQ ID NO: 42705 - DNA, 1046 bp, Homo sapiens
ccttctgaaaaaagaaagccaactttcctttcaaatacacaccccaacccgccccggcatacacagaaatggggactgcgagcagaagcaacatcgctcgccatctgcaaaccaatctcattctattttgtgtcggtgctgtgggcgcctgtactctctctgtcacacaaccgtggtacctagaagtggactacactcatgaggccgtcaccataaagtgtaccttctccgcaaccggatgcccttctgagcaaccaacatgcctgtggtttcgctacggtgctcaccagcctgagaacctgtgcttggacgggtgcaaaagtgaggcagacaagttcacagtgagggaggccctcaaagaaaaccaagtttccctcactgtaaacagagtgacttcaaatgacagtgcaatttacatctgtggaatagcattccccagtgtgccggaagcgagagctaaacagacaggaggagggaccacactggtggtaagagaaattaagctgctcagcaaggaactgcggagcttcctgacagctcttgtatcactgctctctgtctatgtgaccggtgtgtgcgtggccttcatactcctctccaaatcaaaatccaaccctctaagaaacaaagaaataaaagaagactcacaaaagaagaagagtgctcggcgtatttttcaggaaattgctcaagaactataccataagagacatgtggaaacaaatcagcaatctgagaaagataacaacacttatgaaaacagaagagtactttccaactatgaaaggccatagaaacgttttaattttcaatgaagtcactgaaaatccaactccaggagctatggcagtgttaatgaacatatatcatcaggtcttaaaaaaaaataaaggtaaactgaaaagacaactggctacaaagaaggatgccagaatgtaaggaaactataactaatagtcattaccaaaatactaaaacccaacaaaatgcaactgaaaaataccttccaaatttgccaagaaaaaaaattctattttaaacttgaa

SEQ ID NO: 42706 - DNA, 679 bp, Homo sapiens
ccttctgaaaaaagaaagccaactttcctttcaaatacacaccccaacccgccccggcatacacagaaatggggactgcgagcagaagcaacatcgctcgccatctgcaaaccaatctcattctattttgtgtcggtgctgtgggcgcctgtactctctctgtcacacaaccgtggtacctagaagtggactacactcatgaggccgtcaccataaagtgtaccttctccgcaaccggatgcccttctgagcaaccaacatgcctgtggtttcgctacggtgctcaccagcctgagaacctgtgcttggacgggtgcaaaagtgaggcagacaagttcacagtgagggaggccctcaaagaaaaccaagtttccctcactgtaaacagagtgacttcaaatgacagtgcaatttacatctgtggaatagcattccccagtgtgccggaagcgagagctaaacagacaggaggagggaccacactggtggtaagagaaattaagctgctcagcaaggaactgcggagcttcctgacagctcttgtatcactgctctctgtctatgtgaccggtgtgtgcgtggccttcatactcctctccaaatcgagggctcggcggattttttaggaaattggctgaactattccataggagacatgttgaacccaattgacttttgg

SEQ ID NO: 42707 - DNA, 667 bp, Homo sapiens
tcatttgttcattcatttatttactttaaattgacagataaaattttatgcctttactttgtacaacatattgttttgaagtatatatgcattgtggaatgactaaatatagcaaattaacacatgcattacctcacatcgttttcatttgtatggtgagaacactttacatccattctcctagcatttttcaaaaatacaatatattgctaactacagtcaccagattgtaaaatagatctcttgaacttatccctcctattcaaccaaattttatgtcctttgaccaacatttccccaaccccctgtcaaccaccccagcccctggtaaccatgattcttttcaagtattttatgcatttttaaattggaatttttgtcattttattattgaaagcattctttaagaattctggatacaagtctcttgtgagacatatgtgtcgtggatattttctcccagttttatagctgtttatggtgagaaggaaagttcatttccagttactctgtcatggcgggaatcagagatcctcctcacattatctatgtagtgactctctccagaacttccaccctttaaagacgggcaaaatgaagaaagggccctgcatggcttgtatagcgatattagcaccatcaccccacgtgccacctgcaaaaagag

SEQ ID NO: 42708 - DNA, 837 bp, Homo sapiens
cttcctggtgtggcatgttagagaagagaccagaaaaacagacatttcacttgctgtcaggtagtgaaggagctgtggctgcttgggcacagtcattactgtttattccactgtgctgcacatcttgaagctgtaaagatataagaagtctcgcacagccggggttcagcttacaatccttcgcacctaattgtacgcctttgtgtgagggtttggaggagtctccaggaacacctggtgtttcctttctcacaggtatttccagtcctcacgggcaagtcagagagtcccagaggcaattgaacaagccctcagagatcacgtagtccgttcactctccatgggaacccgcacttccctagagacctgtagccaaatcatttggagagcttctgaagcttctctgccttcctctgtctcaaagaatcccatgtgcctctagttgagaaacattcctctggagattctaggttattctcatgagaatgttacgatactcaggtgggctggggcagaaaatggatgagaactagtatagtccaatggctttgctttggtaactgaacccacagaggaggaaaataacaacagctcagcttttctcagtgttatacaccaaccattacgctagttacatgatatacatactatttaattctcatcctttgaggtctggtatcactattgccactttacagataagaaaacaagggttggccgggtatggtggctcactcctgtaatcccaacactttgagaggccaacgcaggtagatcacctgagctgaggagttcaagaccagcctaggcatcatagtaagacctcctctcttaaaa

SEQ ID NO: 42709 - DNA, 393 bp, Homo sapiens
taaaaccctctcattccccaatcttacatctactaatatttcctactgattgcttgttacaagaataaccaaccataccaggcagatccctactcatggcgaagagatatacatatgtaatgagatgtgcatttgctcagggcatgttgcatgttccagcctgcatggcatcaccactgtggacaacacccactcatgacggacccctccttcctatctctggtcattgtcttccccagggtagtagcttttatcaacacaaactgtgtccaccaaattccaaaagtctaaagtaaaaacaacctagatatgagcccagctctgctactgactgacaatgtgatcttaacttatttaaattctttgaacctcaggttccatatctataaagat

SEQ ID NO: 42710 - DNA, 2191 bp, Homo sapiens
actctttcttcggctcgcgagctgagaggagcaggtagaggggcagaggcgggactgtcgtctgggggagccgcccaggaggctcctcaggccgaccccagaccctggctggccaggatgaagtatctccggcaccggcggcccaatgccaccctcattctggccatcggcgctttcaccctcctcctcttcagtctgctagtgtcaccacccacctgcaaggtccaggagcagccaccggcgatccccgaggccctggcctggcccactccacccacccgcccagccccggccccgtgccatgccaacacctctatggtcacccacccggacttcgccacgcagccgcagcacgttcagaacttcctcctgtacagacactgccgccactttcccctgctgcaggacgtgcccccctctaagtgcgcgcagccggtcttcctgctgctggtgatcaagtcctcccctagcaactatgtgcgccgcgagctgctgcggcgcacgtggggccgcgagcgcaaggtacggggtttgcagctgcgcctcctcttcctggtgggcacagcctccaacccgcacgaggcccgcaaggtcaaccggctgctggagctggaggcacagactcacggagacatcctgcagtgggacttccacgactccttcttcaacctcacgctcaagcaggtcctgttcttacagtggcaggagacaaggtgcgccaacgccagcttcgtgctcaacggggatgatgacgtctttgcacacacagacaacatggtcttctacctgcaggaccatgaccctggccgccacctcttcgtggggcaactgatccaaaacgtgggccccatccgggctttttggagcaagtactatgtgccagaggtggtgactcagaatgagcggtacccaccctattgtgggggtggtggcttcttgctgtcccgcttcacggccgctgccctgcgccgtgctgcccatgtcttggacatcttccccattgatgatgtcttcctgggtatgtgtctggagcttgagggactgaagcctgcctcccacagcggcatccgcacgtctggcgtgcgggctccatcgcaacacctgtcctcctttgacccctgcttctaccgagacctgctgctggtgcaccgcttcctaccttatgagatgctgctcatgtgggatgcgctgaaccagcccaacctcacctgcggcaatcagacacagatctactgagtcagcatcagggtccccagcctctgggctcctgtttccataggaaggggcgacaccttcctcccaggaagctgagacctttgtggtctgagcataagggagtgccagggaaggtttgaggtttgatgagtgaatattctggctggcgaactcctacacatccttcaaaacccacctggtactgttccagcatcttccctggatggctggaggaactccagaaaatatccatcttctttttgtggctgctaatggcagaagtgcctgtgctagagttccaactgtggatgcatccgtcccgtttgagtcaaagtcttacttccctgctctcacctactcacagacgggatgctaagcagtgcacctgcagtggtttaatggcagataagctccgtctgcagttccaggccagccagaaactcctgtgtccacatagagctgacgtgagaaatatctttcagcccaggagagaggggtcctgatcttaaccctttcctgggtctcagacaactcagaaggttggggggataccagagaggtggtggaataggaccgccccctccttacttgtgggatcaaatgctgtaatggtggaggtgtgggcagaggagggaggcaagtgtcctttgaaagttgtgagagctcagagtttctggggtcctcattaggagcccccatccctgtgttccccaagaattcagagaacagcactggggctggaatgatctttaatgggcccaaggccaacaggcatatgcctcactactgcctggagaagggagagattcaggtcctccagcagcctccctcacccagtatgttttacagattacggggggaccgggtgagccagtgaccccctgcagcccccagcttcaggcctcagtgtctgccagtcaagcttcacaggcattgtgatggggcagccttggggaatataaaattttgtgaagac

SEQ ID NO: 42711 - DNA, 2150 bp, Homo sapiens
ttccctagcagcgggccagacccaaggagccgcccaggaggctcctcaggccgaccccagaccctggctggccaggatgaagtatctccggcaccggcggcccaatgccaccctcattctggccatcggcgctttcaccctcctcctcttcagtctgctagtgtcaccacccacctgcaaggtccaggagcagccaccggcgatccccgaggccctggcctggcccactccacccacccgcccagccccggccccgtgccatgccaacacctctatggtcacccacccggacttcgccacgcagccgcagcacgttcagaacttcctcctgtacagacactgccgccactttcccctgctgcaggacgtgcccccctctaagtgcgcgcagccggtcttcctgctgctggtgatcaagtcctcccctagcaactatgtgcgccgcgagctgctgcggcgcacgtggggccgcgagcgcaaggtacggggtttgcagctgcgcctcctcttcctggtgggcacagcctccaacccgcacgaggcccgcaaggtcaaccggctgctggagctggaggcacagactcacggagacatcctgcagtgggacttccacgactccttcttcaacctcacgctcaagcaggtcctgttcttacagtggcaggagacaaggtgcgccaacgccagcttcgtgctcaacggggatgatgacgtctttgcacacacagacaacatggtcttctacctgcaggaccatgaccctggccgccacctcttcgtggggcaactgatccaaaacgtgggccccatccgggctttttggagcaagtactatgtgccagaggtggtgactcagaatgagcggtacccaccctattgtgggggtggtggcttcttgctgtcccgcttcacggccgctgccctgcgccgtgctgcccatgtcttggacatcttccccattgatgatgtcttcctgggtatgtgtctggagcttgagggactgaagcctgcctcccacagcggcatccgcacgtctggcgtgcgggctccatcgcaacacctgtcctcctttgacccctgcttctaccgagacctgctgctggtgcaccgcttcctaccttatgagatgctgctcatgtgggatgcgctgaaccagcccaacctcacctgcggcaatcagacacagatctactgagtcagcatcagggtccccagcctctgggctcctgtttccataggaaggggcgacaccttcctcccaggaagctgagacctttgtggtctgagcataagggagtgccagggaaggtttgaggtttgatgagtgaatattctggctggcgaactcctacacatccttcaaaacccacctggtactgttccagcatcttccctggatggctggaggaactccagaaaatatccatcttctttttgtggctgctaatggcagaagtgcctgtgctagagttccaactgtggatgcatccgtcccgtttgagtcaaagtcttacttccctgctctcacctactcacagacgggatgctaagcagtgcacctgcagtggtttaatggcagataagctccgtctgcagttccaggccagccagaaactcctgtgtccacatagagctgacgtgagaaatatctttcagcccaggagagaggggtcctgatcttaaccctttcctgggtctcagacaactcagaaggttggggggataccagagaggtggtggaataggaccgccccctccttacttgtgggatcaaatgctgtaatggtggaggtgtgggcagaggagggaggcaagtgtcctttgaaagttgtgagagctcagagtttctggggtcctcattaggagcccccatccctgtgttccccaagaattcagagaacagcactggggctggaatgatctttaatgggcccaaggccaacaggcatatgcctcactactgcctggagaagggagagattcaggtcctccagcagcctccctcacccagtatgttttacagattacggggggaccgggtgagccagtgaccccctgcagcccccagcttcaggcctcagtgtctgccagtcaagcttcacaggcattgtgatggggcagccttggggaatataaaattttgtgaagac

SEQ ID NO: 42712 - DNA, 2649 bp, Homo sapiens
ttccctagcagcgggccagacccaaggagccgcccaggaggctcctcaggccgaccccagaccctggctggccaggatgaagtatctccggcaccggcggcccaatgccaccctcattctggccatcggcgctttcaccctcctcctcttcagtctgctagtgtcaccacccacctgcaaggtccaggagcagccaccggcgatccccgaggccctggcctggcccactccacccacccgcccagccccggccccgtgccatgccaacacctctatggtcacccacccggacttcgccacgcagccgcagcacgttcagaacttcctcctgtacagacactgccgccactttcccctgctgcaggacgtgcccccctctaagtgcgcgcagccggtcttcctgctgctggtgatcaagtcctcccctagcaactatgtgcgccgcgagctgctgcggcgcacgtggggccgcgagcgcaaggtacggggtttgcagctgcgcctcctcttcctggtgggcacagcctccaacccgcacgaggcccgcaaggtcaaccggctgctggagctggaggcacagactcacggagacatcctgcagtgggacttccacgactccttcttcaacctcacgctcaagcaggtcctgttcttacagtggcaggagacaaggtgcgccaacgccagcttcgtgctcaacggggatgatgacgtctttgcacacacagacaacatggtcttctacctgcaggaccatgaccctggccgccacctcttcgtggggcaactgatccaaaacgtgggccccatccgggctttttggagcaagtactatgtgccagaggtggtgactcagaatgagcggtacccaccctattgtgggggtggtggcttcttgctgtcccgcttcacggccgctgccctgcgccgtgctgcccatgtcttggacatcttccccattgatgatgtcttcctgggtatgtgtctggagcttgagggactgaagcctgcctcccacagcggcatccgcacgtctggcgtgcgggctccatcgcaacacctgtcctcctttgacccctgcttctaccgagacctgctgctggtgcaccgcttcctaccttatgagatgctgctcatgtgggatgcgctgaaccagcccaacctcacctgcggcaatcagacacagatctactgagtcagcatcagggtccccagcctctgggctcctgtttccataggaaggggcgacaccttcctcccaggaagctgagacctttgtggtctgagcataagggagtgccagggaaggtttgaggtttgatgagtgaatattctggctggcgaactcctacacatccttcaaaacccacctggtactgttccagcatcttccctggatggctggaggaactccagaaaatatccatcttctttttgtggctgctaatggcagaagtgcctgtgctagagttccaactgtggatgcatccgtcccgtttgagtcaaagtcttacttccctgctctcacctactcacagacgggatgctaagcagtgcacctgcagtggtttaatggcagataagctccgtctgcagttccaggccagccagaaactcctgtgtccacatagagctgacgtgagaaatatctttcagcccaggagagaggggtcctgatcttaaccctttcctgggtctcagacaactcagaaggttggggggataccagagaggtggtggaataggaccgccccctccttacttgtgggatcaaatgctgtaatggtggaggtgtgggcagaggagggaggcaagtgtcctttgaaagttgtgagagctcagagtttctggggtcctcattaggagcccccatccctgtgttccccaagaattcagagaacagcactggggctggaatgatctttaatgggcccaaggccaacaggcatatgcctcactactgcctggagaagggagagattcaggtcctccagcagcctccctcacccagtatgttttacagattacggggggaccgggtgagccagtgaccccctgcagcccccagcttcaggcctcagtgtctgccagtcaagcttcacaggcattgtgatggggcagccttggggaatataaaattttgtgaagacttggagatctttttttttttttaagcaaatttacaagtttcaacagacaagtccacattcatccctaaaagtctcattttccagtagaaaatatacactggtaaaaacggggcatggggccgtggctcagggctgtaattctagcacattgggagaccaaagtgggaggatcacttgagcccaggagttctggatcctgtctctgcacaaaataaaaaattactcaggcgtggtggtgctcacatgcctgtagtcccagctatacttgggaggctgaggcgagaggatcgcttgagcccaggagttggaggctgcagtgaaccatgattgcgccactgtactccactgggcggcaataagaagacaaaaacataaaacaggacatgtgtgaggcaaaagctgcaggaatttctatcaggcagatctgacctcatcccacccaccccctgctcagatacccttcatagctccttattgctttcagctcataaccccacat

SEQ ID NO: 42713 - DNA, 2292 bp, Homo sapiens
ttccctagcagcgggccagacccaaggagccgcccaggaggctcctcaggccgaccccagaccctggctggccaggatgaagtatctccggcaccggcggcccaatgccaccctcattctggccatcggcgctttcaccctcctcctcttcagtctgctagtgtcaccacccacctgcaaggtccaggagcagccaccggcgatccccgaggccctggcctggcccactccacccacccgcccagccccggccccgtgccatgccaacacctctatggtcacccacccggacttcgccacgcagccgcagcacgttcagaacttcctcctgtacagacactgccgccactttcccctgctgcaggacgtgcccccctctaagtgcgcgcagccggtcttcctgctgctggtgatcaagtcctcccctagcaactatgtgcgccgcgagctgctgcggcgcacgtggggccgcgagcgcaaggtacggggtttgcagctgcgcctcctcttcctggtgggcacagcctccaacccgcacgaggcccgcaaggtcaaccggctgctggagctggaggcacagactcacggagacatcctgcagtgggacttccacgactccttcttcaacctcacgctcaagcaggtcctgttcttacagtggcaggagacaaggtgcgccaacgccagcttcgtgctcaacggggatgatgacgtctttgcacacacagacaacatggtcttctacctgcaggaccatgaccctggccgccacctcttcgtggggcaactgatccaaaacgtgggccccatccgggctttttggagcaagtactatgtgccagaggtggtgactcagaatgagcggtacccaccctattgtgggggtggtggcttcttgctgtcccgcttcacggccgctgccctgcgccgtgctgcccatgtcttggacatcttccccattgatgatgtcttcctgggtatgtgtctggagcttgagggactgaagcctgcctcccacagcggcatccgcacgtctggcgtgcgggctccatcgcaacacctgtcctcctttgacccctgcttctaccgagacctgctgctggtgcaccgcttcctaccttatgagatgctgctcatgtgggatgcgctgaaccagcccaacctcacctgcggcaatcagacacagatctactgagtcagcatcagggtccccagcctctgggctcctgtttccataggaaggggcgacaccttcctcccaggaagctgagacctttgtggtctgagcataagggagtgccagggaaggtttgaggtttgatgagtgaatattctggctggcgaactcctacacatccttcaaaacccacctggtactgttccagcatcttccctggatggctggaggaactccagaaaatatccatcttctttttgtggctgctaatggcagaagtgcctgtgctagagttccaactgtggatgcatccgtcccgtttgagtcaaagtcttacttccctgtgttccccaagaattcagagaacagcactggggctggaatgatctttaatgggcccaaggccaacaggcatatgcctcactactgcctggagaagggagagattcaggtcctccagcagcctccctcacccagtatgttttacagattacggggggaccgggtgagccagtgaccccctgcagcccccagcttcaggcctcagtgtctgccagtcaagcttcacaggcattgtgatggggcagccttggggaatataaaattttgtgaagacttggagatctttttttttttttaagcaaatttacaagtttcaacagacaagtccacattcatccctaaaagtctcattttccagtagaaaatatacactggtaaaaacggggcatggggccgtggctcagggctgtaattctagcacattgggagaccaaagtgggaggatcacttgagcccaggagttctggatcctgtctctgcacaaaataaaaaattactcaggcgtggtggtgctcacatgcctgtagtcccagctatacttgggaggctgaggcgagaggatcgcttgagcccaggagttggaggctgcagtgaaccatgattgcgccactgtactccactgggcggcaataagaagacaaaaacataaaacaggacatgtgtgaggcaaaagctgcaggaatttctatcaggcagatctgacctcatcccacccaccccctgctcagatacccttcatagctccttattgctttcagctcataaccccacat

SEQ ID NO: 42714 - DNA, 1735 bp, Homo sapiens
tccatggattccccaacactcctagaggcacatgataaggcctgtttggagagttgaaaccaaggcacagagagggtttcccaagtaaccccacagggcagggccttaacccaggctggattgtggacacttcctttcctgggcttagtgggctggagtggctaatagagacccaaggccaatttctccagccctcaagcaagcatgccctgtccaccctgcctgcaggtcctgttcttacagtggcaggagacaaggtgcgccaacgccagcttcgtgctcaacggggatgatgacgtctttgcacacacagacaacatggtcttctacctgcaggaccatgaccctggccgccacctcttcgtggggcaactgatccaaaacgtgggccccatccgggctttttggagcaagtactatgtgccagaggtggtgactcagaatgagcggtacccaccctattgtgggggtggtggcttcttgctgtcccgcttcacggccgctgccctgcgccgtgctgcccatgtcttggacatcttccccattgatgatgtcttcctgggtatgtgtctggagcttgagggactgaagcctgcctcccacagcggcatccgcacgtctggcgtgcgggctccatcgcaacacctgtcctcctttgacccctgcttctaccgagacctgctgctggtgcaccgcttcctaccttatgagatgctgctcatgtgggatgcgctgaaccagcccaacctcacctgcggcaatcagacacagatctactgagtcagcatcagggtccccagcctctgggctcctgtttccataggaaggggcgacaccttcctcccaggaagctgagacctttgtggtctgagcataagggagtgccagggaaggtttgaggtttgatgagtgaatattctggctggcgaactcctacacatccttcaaaacccacctggtactgttccagcatcttccctggatggctggaggaactccagaaaatatccatcttctttttgtggctgctaatggcagaagtgcctgtgctagagttccaactgtggatgcatccgtcccgtttgagtcaaagtcttacttccctgctctcacctactcacagacgggatgctaagcagtgcacctgcagtggtttaatggcagataagctccgtctgcagttccaggccagccagaaactcctgtgtccacatagagctgacgtgagaaatatctttcagcccaggagagaggggtcctgatcttaaccctttcctgggtctcagacaactcagaaggttggggggataccagagaggtggtggaataggaccgccccctccttacttgtgggatcaaatgctgtaatggtggaggtgtgggcagaggagggaggcaagtgtcctttgaaagttgtgagagctcagagtttctggggtcctcattaggagcccccatccctgtgttccccaagaattcagagaacagcactggggctggaatgatctttaatgggcccaaggccaacaggcatatgcctcactactgcctggagaagggagagattcaggtcctccagcagcctccctcacccagtatgttttacagattacggggggaccgggtgagccagtgaccccctgcagcccccagcttcaggcctcagtgtctgccagtcaagcttcacaggcattgtgatggggcagccttggggaatataaaattttgtgaagac

SEQ ID NO: 42715 - DNA, 1859 bp, Homo sapiens
ttccctagcagcgggccagacccaaggagccgcccaggaggctcctcaggccgaccccagaccctggctggccaggatgaagtatctccggcaccggcggcccaatgccaccctcattctggccatcggcgctttcaccctcctcctcttcagtctgctagtgtcaccacccacctgcaaggtccaggagcagccaccggcgatccccgaggccctggcctggcccactccacccacccgcccagccccggccccgtgccatgccaacacctctatggtcacccacccggacttcgccacgcagccgcagcacgttcagaacttcctcctgtacagacactgccgccactttcccctgctgcaggacgtgcccccctctaagtgcgcgcagccggtcttcctgctgctggtgatcaagtcctcccctagcaactatgtgcgccgcgagctgctgcggcgcacgtggggccgcgagcgcaaggtacggggtttgcagctgcgcctcctcttcctggtgggcacagcctccaacccgcacgaggcccgcaaggtcaaccggctgctggagctggaggcacagactcacggagacatcctgcagtgggacttccacgactccttcttcaacctcacgctcaagcaggtcctgttcttacagtggcaggagacaaggtgcgccaacgccagcttcgtgctcaacggggatgatgacgtctttgcacacacagacaacatggtcttctacctgcaggaccatgaccctggccgccacctcttcgtggggcaactgatccaaaacgtgggccccatccgggctttttggagcaagtactatgtgccagaggtggtgactcagaatgagcggtacccaccctattgtgggggtggtggcttcttgctgtcccgcttcacggccgctgccctgcgccgtgctgcccatgtcttggacatcttccccattgatgatgtcttcctgggtatgtgtctggagcttgagggactgaagcctgcctcccacagcggcatccgcacgtctggcgtgcgggctccatcgcaacacctgtcctcattaggagcccccatccctgtgttccccaagaattcagagaacagcactggggctggaatgatctttaatgggcccaaggccaacaggcatatgcctcactactgcctggagaagggagagattcaggtcctccagcagcctccctcacccagtatgttttacagattacggggggaccgggtgagccagtgaccccctgcagcccccagcttcaggcctcagtgtctgccagtcaagcttcacaggcattgtgatggggcagccttggggaatataaaattttgtgaagacttggagatctttttttttttttaagcaaatttacaagtttcaacagacaagtccacattcatccctaaaagtctcattttccagtagaaaatatacactggtaaaaacggggcatggggccgtggctcagggctgtaattctagcacattgggagaccaaagtgggaggatcacttgagcccaggagttctggatcctgtctctgcacaaaataaaaaattactcaggcgtggtggtgctcacatgcctgtagtcccagctatacttgggaggctgaggcgagaggatcgcttgagcccaggagttggaggctgcagtgaaccatgattgcgccactgtactccactgggcggcaataagaagacaaaaacataaaacaggacatgtgtgaggcaaaagctgcaggaatttctatcaggcagatctgacctcatcccacccaccccctgctcagatacccttcatagctccttattgctttcagctcataaccccacat

SEQ ID NO: 42716 - DNA, 974 bp, Homo sapiens
ttccctagcagcgggccagacccaaggagccgcccaggaggctcctcaggccgaccccagaccctggctggccaggatgaagtatctccggcaccggcggcccaatgccaccctcattctggccatcggcgctttcaccctcctcctcttcagtctgctagtgtcaccacccacctgcaaggtccaggagcagccaccggcgatccccgaggccctggcctggcccactccacccacccgcccagccccggccccgtgccatgccaacacctctatggtcacccacccggacttcgccacgcagccgcagcacgttcagaacttcctcctgtacagacactgccgccactttcccctgctgcaggacgtgcccccctctaagtgcgcgcagccggtcttcctgctgctggtgatcaagtcctcccctagcaactatgtgcgccgcgagctgctgcggcgcacgtggggccgcgagcgcaaggtacggggtttgcagctgcgcctcctcttcctggtgggcacagcctccaacccgcacgaggcccgcaaggtcaaccggctgctggagctggaggcacagactcacggagacatcctgcagtgggacttccacgactccttcttcaacctcacgctcaagcaggtgcgctggactggggtcacctgatcggggccacctgtccttcttgtccaaattaccacccactcctgagggacccaggggaccagaagtcctcgtcagtccatcacagcccattctgcccctctgctgtcctcaccagcctcgtggagacccaaaatggtcttcttctaggagaggctagggggaagggcagaggagctaggttactagcacagagctcaagcctgatgatgcggattcgaatccaagctctgcctcttacttggtgttcgaccttggaggagttcattcacctctctgtgcctcacttttctcacctggaaaatgggat

SEQ ID NO: 42717 - DNA, 2813 bp, Homo sapiens
  misc_feature (630)..(630): n is a, c, g, or t
gttgccctaactacctcgatgtgctgtaacaaacaagtcattgtcatagacaaaatcaaatctgcaagtattgcagacagatgtggcgcattgcatgtgggagatcacatcctctccatcgatggaaccagcatggagtactgtacacttgcagaagcaacccagttcctggccaacaccactgaccaggtcaagcttgagatccttccccatcatcagacccggctggccctaaaggggcccgaccatgtgaaaattcagaggagcgacaggcaacttacctgggattcctgggccagcaaccacagcagccttcacaccaaccatcactataacacgtaccaccctgaccattgcagagtaccagccctgacattcccgaaagcacctcctccaaacagccctccagctttggtgtcttcatccttctctcctacctccatgagtgcatacagcctgagttccctgaacatggggactctacctcgaagcctctactccaccagcccacgtggaaccatgatgaggaggagactgaaaaagaaagacttcaaaagctcattgtccttagcctccagcacagtaggattggctgggcaggttgttcacacagaaaccacagaggttgtnctgacggcagatcctgtcacaggatttgggatccaactgcagggcagtgtgtttgccacagaaactctctcttctccacctctgatttcctatatcgaagctgacagcccagcagagagatgtggggtgctacagattggagacagagtgatggccatcaatggaattccaacagaagacagcaccttcgaagaagccagtcagctcctccgagactcttcaatcacgagcaaggtcacactggaaatcgagtttgatgttgcagagtctgtcatcccaagtagtggaacatttcatgtaaagctgcctaagaagcacaatgtggaacttggaataaccataagttcaccatccagtagaaaaccaggagaccccctcgtcatttcagatatcaagaaagggagtgtggcacacagaactgggaccctggaacttggggataaattgctcgcaatagataatatccggctggacaactgttccatggaagatgcagttcagatcctccagcaatgtgaagacctggtgaagctcaaaatccgcaaagatgaagataattcagatgagcaagaaagttccggagcaattatttacaccgtggagcttaaacgctacggggggccccttggcatcacaatttcaggaactgaagagccgtttgatcctataatcatttcaagcctcactaaggggggattagctgaaagaactggcgcaatccacataggagaccgaatcctagccatcaatagcagcagcttgaaagggaagcctctgagtgaagccatccatttgttacagatggcaggagagactgtcaccttgaaaattaagaaacagacagatgcccagtcagcatcgagccccaagaagttccctatttctagccatttgagtgacctgggggatgtggaggaggactcctcaccagcacagaagccaggcaagctctccgacatgtacccctccacggtgcccagtgtggacagtgctgtggattcatgggatgggtctgcaatagacaccagctatggaactgaaggcactagttttcaggcctcaggatacaatttcaacacctatgactggaggagtccaaaacagagaggcagcttgtccccagtcactaagcctcgaagccagacttacccagatgtggggctgagttatgaagactgggaccggtccacagccagtggttttgcaggggctgccgatagtgcagagacagaacaagaggagaacttctggtctcaagcgctggaggatttggaaacctgcggacagtcaggaattctgagagaactggaggcaacaatcatgtcggggagcacgatgagtttgaatcatgaggctccaacacctcgcagtcagctggggcgacaggccagcttccaggagcgcagcagctcgcggccgcactacagccaaacaactcggagcaacaccctgccttcagatgtgggtaggaagtcagtaaccctgagaaaaatgaaacaagaaataaaggagatcatgtctccaactcctgtggagctgcacaaggtgaccttgtacaaggactctgacatggaggactttgggttcagtgtagcagatggcttactggagaaaggagtgtatgtcaaaaatattcgcccagctgggccaggagatcttggtggcttaaagccctatgacaggctcttacaggtgaatcatgtccgaaccagagactttgactgctgccttgttgtgcccctcatagcagaatccgggaataagctggacctggttattagtagaaacccactggcttcacagaagtctatagaccaacagagtctaccaggagattggagtgaacagaacagtgcttttttccagcagcctagccacggtggtaatttggagacacgagaacccactaatacattatagcaacgctttttataaagcaggacaaaagacaatatctacatggtgctaaaaatcctttaagatttctgtgacctttgaagcacagataatcaatcaacgtggcattaactgcaagcacaggggtcttttaaatctctctcatggctcatgttcacttcccttttcaagttgaagaggtttcttttttggtgaccactatggtatatggtgggcaatgccctgccagtcccaacggtagagaaaaataggccgtcccccacaac

SEQ ID NO: 42718 - DNA, 2858 bp, Homo sapiens
  misc_feature (630)..(630): n is a, c, g, or t
gttgccctaactacctcgatgtgctgtaacaaacaagtcattgtcatagacaaaatcaaatctgcaagtattgcagacagatgtggcgcattgcatgtgggagatcacatcctctccatcgatggaaccagcatggagtactgtacacttgcagaagcaacccagttcctggccaacaccactgaccaggtcaagcttgagatccttccccatcatcagacccggctggccctaaaggggcccgaccatgtgaaaattcagaggagcgacaggcaacttacctgggattcctgggccagcaaccacagcagccttcacaccaaccatcactataacacgtaccaccctgaccattgcagagtaccagccctgacattcccgaaagcacctcctccaaacagccctccagctttggtgtcttcatccttctctcctacctccatgagtgcatacagcctgagttccctgaacatggggactctacctcgaagcctctactccaccagcccacgtggaaccatgatgaggaggagactgaaaaagaaagacttcaaaagctcattgtccttagcctccagcacagtaggattggctgggcaggttgttcacacagaaaccacagaggttgtnctgacggcagatcctgtcacaggatttgggatccaactgcagggcagtgtgtttgccacagaaactctctcttctccacctctgatttcctatatcgaagctgacagcccagcagagagatgtggggtgctacagattggagacagagtgatggccatcaatggaattccaacagaagacagcaccttcgaagaagccagtcagctcctccgagactcttcaatcacgagcaaggtcacactggaaatcgagtttgatgttgcagagtctgtcatcccaagtagtggaacatttcatgtaaagctgcctaagaagcacaatgtggaacttggaataaccataagttcaccatccagtagaaaaccaggagaccccctcgtcatttcagatatcaagaaagggagtgtggcacacagaactgggaccctggaacttggggataaattgctcgcaatagataatatccggctggacaactgttccatggaagatgcagttcagatcctccagcaatgtgaagacctggtgaagctcaaaatccgcaaagatgaagataattcagatgagcaagaaagttccggagcaattatttacaccgtggagcttaaacgctacggggggccccttggcatcacaatttcaggaactgaagagccgtttgatcctataatcatttcaagcctcactaaggggggattagctgaaagaactggcgcaatccacataggagaccgaatcctagccatcaatagcagcagcttgaaagggaagcctctgagtgaagccatccatttgttacagatggcaggagagactgtcaccttgaaaattaagaaacagacagatgcccagtcagcatcgagccccaagaagttccctatttctagccatttgagtgacctgggggatgtggaggaggactcctcaccagcacagaagccaggcaagctctccgacatgtacccctccacggtgcccagtgtggacagtgctgtggattcatgggatgggtctgcaatagacaccagctatggaactgaaggcactagttttcaggcctcaggatacaatttcaacacctatgactggaggagtccaaaacagagaggcagcttgtccccagtcactaagcctcgaagccagacttacccagatgtggggctgagttatgaagactgggaccggtccacagccagtggttttgcaggggctgccgatagtgcagagacagaacaagaggagaacttctggtctcaagcgctggaggatttggaaacctgcggacagtcaggaattctgagagaactggaggagaaagctgacaggcgtgtgtctttgagaaacatgactctcttggcaacaatcatgtcggggagcacgatgagtttgaatcatgaggctccaacacctcgcagtcagctggggcgacaggccagcttccaggagcgcagcagctcgcggccgcactacagccaaacaactcggagcaacaccctgccttcagatgtgggtaggaagtcagtaaccctgagaaaaatgaaacaagaaataaaggagatcatgtctccaactcctgtggagctgcacaaggtgaccttgtacaaggactctgacatggaggactttgggttcagtgtagcagatggcttactggagaaaggagtgtatgtcaaaaatattcgcccagctgggccaggagatcttggtggcttaaagccctatgacaggctcttacaggtgaatcatgtccgaaccagagactttgactgctgccttgttgtgcccctcatagcagaatccgggaataagctggacctggttattagtagaaacccactggcttcacagaagtctatagaccaacagagtctaccaggagattggagtgaacagaacagtgcttttttccagcagcctagccacggtggtaatttggagacacgagaacccactaatacattatagcaacgctttttataaagcaggacaaaagacaatatctacatggtgctaaaaatcctttaagatttctgtgacctttgaagcacagataatcaatcaacgtggcattaactgcaagcacaggggtcttttaaatctctctcatggctcatgttcacttcccttttcaagttgaagaggtttcttttttggtgaccactatggtatatggtgggcaatgccctgccagtcccaacggtagagaaaaataggccgtcccccacaac

SEQ ID NO: 42719 - DNA, 597 bp, Homo sapiens
cagctttggtgtcttcatccttctctcctacctccatgagtgcatacagcctgagttccctgaacatggggactctacctcgaagcctctactccaccagcccacgtggaaccatgatgaggaggagactgaaaaagaaagacttcaaaagctcatgtaagtgaaatgacagccaatggcatttggcctggaaaaaacctgtgggcaatggagccttgaaaataccgaaattgtgggaagagtgtttcacagttgcttaagtgatcaggtagatgctgagcagctaacagctctgtgccaaagaccgttgacacgatacccagtatctgtttggcaatgactgcaccccaatttaacttcagactgaattcattcatactacctttgcctacaactttttatttgagatttgagatttttcttgctcttttgatgtcataacatacccaaagatatgatttttcctttaagactccttttattatattctgggtggctttggacatgaaacctttgttcttagtttcttactcattctaaagaaattttgtgaaaacgatgctccccttttgataaatataagattctcatgcattc

SEQ ID NO: 42720 - DNA, 1286 bp, Homo sapiens
ggtgtccattgagaagttcttaattcgtttctgtaagatatattcaaggtggcctcatgaatcccatctgttagagcccactcagtggaaagtgaatgcttaaaatgtagtttacagtaagcaaatgttagagcatttcaatttgcctcaaaactgccaggggtggtatttgattaaataaactcaatggcttaagtacttaaattggatttgagatgtgcattataaatgtcacttgcaaagcattttccagactttcatagttcaattagtacatccattttccagcctttggttttgccctgaagagactgtatttttacctcgcagaaggagaaatgtgcttactgttgagcaccaaatcctttccttagtccatggcttaattgtttctaaaaattgtcaatgccacaggcaacaatcatgtcggggagcacgatgagtttgaatcatgaggctccaacacctcgcagtcagctggggcgacaggccagcttccaggagcgcagcagctcgcggccgcactacagccaaacaactcggagcaacaccctgccttcagatgtgggtaggaagtcagtaaccctgagaaaaatgaaacaagaaataaaggagatcatgtctccaactcctgtggagctgcacaaggtgaccttgtacaaggactctgacatggaggactttgggttcagtgtagcagatggcttactggagaaaggagtgtatgtcaaaaatattcgcccagctgggccaggagatcttggtggcttaaagccctatgacaggctcttacaggtgaatcatgtccgaaccagagactttgactgctgccttgttgtgcccctcatagcagaatccgggaataagctggacctggttattagtagaaacccactggcttcacagaagtctatagaccaacagagtctaccaggagattggagtgaacagaacagtgcttttttccagcagcctagccacggtggtaatttggagacacgagaacccactaatacattatagcaacgctttttataaagcaggacaaaagacaatatctacatggtgctaaaaatcctttaagatttctgtgacctttgaagcacagataatcaatcaacgtggcattaactgcaagcacaggggtcttttaaatctctctcatggctcatgttcacttcccttttcaagttgaagaggtttcttttttggtgaccactatggtatatggtgggcaatgccctgccagtcccaacggtagagaaaaataggccgtcccccacaac

SEQ ID NO: 42721 - DNA, 1178 bp, Homo sapiens
taaagtgatagtgcagaaagaagactggatgtggaatgagaactgaagttagagttttaagtcctcacaaaaggatttgcctgatacctgtccttaggcaagaattcaagggctccacagtcgtcgagctgatgaagaaggaaggcactaccctgggtctgacggtatcgggaggaattgataaggatggcaagccaagagtatctaatctgcggcaaggaggaattgctgctagaagtgaccagctggatgtgggtgactacatcaaagcagtgaatggaatcaacctggccaaattccgccatgacgagatcatcagcttgctgaagaatgtgggagaaagagtggttcttgaagtagagtacgagcttccaccggtctctgtgcaaggatcaagtgttattttccgaacagtggaggtcacattacataaagaaggcaatacctttggttttgtaattcgagggggagcacatgatgatagaaataaatctcgtccagttgtgataacatgtgttcgtcctggagggcctgctgacagagagggcacgatcaaacccggtgacaggttgctcagtgtggatggaattcggcttcttggaactacgcatgctgaagccatgagtattcttaaacaatgtggacaagaagcagcactgctgatagaatatgatgtctcagtaatgggtgaatcatgtccgaaccagagactttgactgctgccttgttgtgcccctcatagcagaatccgggaataagctggacctggttattagtagaaacccactggcttcacagaagtctatagaccaacagagtctaccaggagattggagtgaacagaacagtgcttttttccagcagcctagccacggtggtaatttggagacacgagaacccactaatacattatagcaacgctttttataaagcaggacaaaagacaatatctacatggtgctaaaaatcctttaagatttctgtgacctttgaagcacagataatcaatcaacgtggcattaactgcaagcacaggggtcttttaaatctctctcatggctcatgttcacttcccttttcaagttgaagaggtttcttttttggtgaccactatggtatatggtgggcaatgccctgccagtcccaacggtagagaaaaataggccgtcccccacaac

SEQ ID NO: 42722 - DNA, 619 bp, Homo sapiens
  misc_feature (613)..(619): n is a, c, g, or t
cagggacgtgtctgtgctcctgcgtgtgaccagggttgactaaactctgccaggatgtcttgccagcaaaaccagcagcagtgccagccccctcccaagtgtcctcccaagtgtaccccaaaatgtccacctaagtgtccccctaaatgcctgccccagtgcccagctccatgttcccctgcagtctcttcttgctgtggtcccatctctgggggctgctgtggtcccagctctgggggctgctgcaactctggggctggtggctgctgcctgagccaccacaggccccgtctcttccaccggcgccggcaccagagccccgactgctgtgagagtgaaccttctgggggctctggctgctgccacagctctgggggctgctgctgacctgggctaagaagaactctttggacagaatgtttaagaacctcctacagcctgatgcttaaccctttccatttcctctcattccattcatgggtggacagcgaccacaaagactcatggggcttccctgggagaactttgcacttgatggaacacctcaattgcaggttttgttttcctcctttacctcatgttgtaataaagctctgatttctgactcacaaannnnnnn

SEQ ID NO: 42723 - DNA, 479 bp, Homo sapiens
ctgtcctgattagaattaattttcataaagagaacaagaatcttgactggttcacccttcaattccttgtgcccgcaacagtgaccggcacatggaaagcattcagggaataaaagcacaatggaaaattaaaacatactcactgcatgcctgccacctatagaaccaaattaaatcactgccaatatgcatggggaaaaccttcccatttttctggaataatgttacaaaggatggaaaataagtgcacatcacctggatggcatttaataaacgctgtgacccagtagtgtacatttcagtgaatattgccaaaggaagtaggccaacatcaggtaatctgagttaactttcctgtacattgtgtattcgtttcctgatgatcaaaactggattaattagtctacaatgtatctttcctgttagatacgaagattatctgctctatccaatttgtgttttcttagctgagaaatcac

SEQ ID NO: 42724 - DNA, 272 bp, Homo sapiens
tccaccatcgtcaaaatgtggcttccaaagtcaccatgcatgtttgcaccatgccacagaaggggaaagggcatgcagaattgtgtgtcttttctgaggtaaaaggcttccactcacattccactagctagaacccagtcactcggccattacaaagaaggcttaaaatgtcgtagaaccatctgtcctggaagaagaggaaattctagccagtctagtcagtctttgctacgctttttcagcaactgtttttgcttaataaactctttaat

SEQ ID NO: 42725 - DNA, 1819 bp, Homo sapiens
cggtgatggagcgctaaccgggggcgcggcggcggcgagggctcggcgggccattggctaccggccgcggcaaaggcagcttggggacccagcgtgcgcggggcccgcgggccgggccggggtgacctgggctgcagccatggaagaacagagggaggccctgaggaagatcatcaaaacactggctgtgaagaatgaagaaattcagagctttatctactccctgaaacagatgctgctgaacgtggaggcgaactcggcgaaggtgcaggaggacctcgaagcagagttccagtccctcttctccctcctggaggagctgaaagaaggcatgcttatgaagataaaacaggaccgtgccagccgcacctacgagctgcagaaccagctggctgcctgcacgcgggccctggagagctccgaggagcttctggagacagccaaccagactctgcaggccatggacagcgaggactttcctcaggctgccaagcaaatcaaagatggagtgaccatggcccctgccttccggctatcattgaaagcgaaggtcagtgacaacatgagtcacctcatggtggacttcgcgcaagagcggcagatgctacaggcactcaagttcctgcctgtgcccagcgcacccgtgatcgacctggctgagtccctggtggcagataactgtgtgaccctggtgtggcgcatgccggatgaggacagcaagattgaccactacgtgctggagtaccggcggaccaacttcgagggcccgccccgcctcaaggaggaccagccctggatggtcatcgagggcatccggcagacagagtacaccctgacaggtctcaagtttgacatgaaatacatgaacttccgtgtgaaggcctgtaacaaggcagttgcaggagagttctctgagccggtgactctggagacaccagcgttcatgttccgcctggatgcgtccacatcccaccagaacctgcgggtggatgatctctccgtggagtgggacgctatgggcgggaaggtgcaggatatcaaggctcgcgagaaagatggcaaggggcggacggcgtctcccatcaactccccagccagaggtactccatctcccaagaggatgccctcaggtcgtgggggacgggaccgcttcaccgctgagtcctacacagttctgggggacacgctgatcgacggcggggagcattactgggaggtgcgctacgagccggacagcaaggcgttcggcgtgggcgtggcctaccgcagcctgggccgcttcgagcaactgggcaagacggccgcctcctggtgcctgcacgtcaacaattggctgcaggtcagcttcacggccaagcacgccaacaaggtcaaggtgctggacgcccccgtgcccgactgcctgggtgtgcactgtgacttccaccaaggcctcctgtccttctacaatgcccgcaccaaacaagtgctgcacactttcaagaccaggttcacacagccgctgctgcctgctttcacggtatggtgtggcagcttccaggtgacgacaggcctgcaggtccccagtgctgtgcgctgcctgcaaaagcgaggcagtgctaccagcagctccaacaccagcctcacctaggcccccaggcacccacccagctggggtgtttttgggggagtcgccgccaagcccaggctgctggagccaggcaccctcctctgtcacttgctgcttggagccttaactccagatgggggggtcaccaagagggagtgggcaccctggcgggccctctccccacctcacctcttaataaaggtcagacac

SEQ ID NO: 42726 - DNA, 1795 bp, Homo sapiens
cggtgatggagcgctaaccgggggcgcggcggcggcgagggctcggcgggccattggctaccggccgcggcaaaggcagcttggggacccagcgtgcgcggggcccgcgggccgggccggggtgacctgggctgcagccatggaagaacagagggaggccctgaggaagatcatcaaaacactggctgtgaagaatgaagaaattcagagctttatctactccctgaaacagatgctgctgaacgtggaggcgaactcggcgaaggtgcaggaggacctcgaagcagagttccagtccctcttctccctcctggaggagctgaaagaaggcatgcttatgaagataaaacaggaccgtgccagccgcacctacgagctgcagaaccagctggctgcctgcacgcgggccctggagagctccgaggagcttctggagacagccaaccagactctgcaggccatggacagcgaggactttcctcaggctgccaagcaaatcaaagatggagtgaccatggcccctgccttccggctatcattgaaagcgaaggtcagtgacaacatgagtcacctcatggtggacttcgcgcaagagcggcagatgctacaggcactcaagttcctgcctgtgcccagcgcacccgtgatcgacctggctgagtccctggtggcagataactgtgtgaccctggtgtggcgcatgccggatgaggacagcaagattgaccactacgtgctggagtaccggcggaccaacttcgagggcccgccccgcctcaaggaggaccagccctggatggtcatcgagggcatccggcagacagagtacaccctgacaggtctcaagtttgacatgaaatacatgaacttccgtgtgaaggcctgtaacaaggcagttgcaggagagttctctgagccggtgactctggagacaccagcgttcatgttccgcctggatgcgtccacatcccaccagaacctgcgggtggatgatctctccgtggagtgggacgctatgggcgggaaggtgcaggatatcaaggctcgcgagaaagatggcaaggggcggacggcgtctcccatcaactccccagccagaggtactccatctcccaagaggatgccctcaggtcgtgggggacgggaccgcttcaccgctgagtcctacacagttctgggggacacgctgatcgacggcggggagcattactgggaggtgcgctacgagccggacagcaaggcgttcggcgtgggcgtggcctaccgcagcctgggccgcttcgagcaactgggcaagacggccgcctcctggtgcctgcacgtcaacaattggctgcaggtcagcttcacggccaagcacgccaacaaggtcaaggtgctggacgcccccgtgcccgactgcctgggcctcctgtccttctacaatgcccgcaccaaacaagtgctgcacactttcaagaccaggttcacacagccgctgctgcctgctttcacggtatggtgtggcagcttccaggtgacgacaggcctgcaggtccccagtgctgtgcgctgcctgcaaaagcgaggcagtgctaccagcagctccaacaccagcctcacctaggcccccaggcacccacccagctggggtgtttttgggggagtcgccgccaagcccaggctgctggagccaggcaccctcctctgtcacttgctgcttggagccttaactccagatgggggggtcaccaagagggagtgggcaccctggcgggccctctccccacctcacctcttaataaaggtcagacac

SEQ ID NO: 42727 - DNA, 1781 bp, Homo sapiens
cggtgatggagcgctaaccgggggcgcggcggcggcgagggctcggcgggccattggctaccggccgcggcaaaggcagcttggggacccagcgtgcgcggggcccgcgggccgggccggggtgacctgggctgcagccatggaagaacagagggaggccctgaggaagatcatcaaaacactggctgtgaagaatgaagaaattcagagctttatctactccctgaaacagatgctgctgaacgtggaggcgaactcggcgaaggtgcaggaggacctcgaagcagagttccagtccctcttctccctcctggaggagctgaaagaaggcatgcttatgaagataaaacaggaccgtgccagccgcacctacgagctgcagaaccagctggctgcctgcacgcgggccctggagagctccgaggagcttctggagacagccaaccagactctgcaggccatggacagcgaggactttcctcaggctgccaagcaaatcaaagatggagtgaccatggcccctgccttccggctatcattgaaagcgaaggtcagtgacaacatgagtcacctcatggtggacttcgcgcaagagcggcagatgctacaggcactcaagttcctgcctgtgcccagcgcacccgtgatcgacctggctgagtccctggtggcagataactgtgtgaccctggtgtggcgcatgccggatgaggacagcaagattgaccactacgtgctggagtaccggcggaccaacttcgagggcccgccccgcctcaaggaggaccagccctggatggtcatcgagggcatccggcagacagagtacaccctgacaggtctcaagtttgacatgaaatacatgaacttccgtgtgaaggcctgtaacaaggcagttgcaggagagttctctgagccggtgactctggagacaccagaacctgcgggtggatgatctctccgtggagtgggacgctatgggcgggaaggtgcaggatatcaaggctcgcgagaaagatggcaaggggcggacggcgtctcccatcaactccccagccagaggtactccatctcccaagaggatgccctcaggtcgtgggggacgggaccgcttcaccgctgagtcctacacagttctgggggacacgctgatcgacggcggggagcattactgggaggtgcgctacgagccggacagcaaggcgttcggcgtgggcgtggcctaccgcagcctgggccgcttcgagcaactgggcaagacggccgcctcctggtgcctgcacgtcaacaattggctgcaggtcagcttcacggccaagcacgccaacaaggtcaaggtgctggacgcccccgtgcccgactgcctgggtgtgcactgtgacttccaccaaggcctcctgtccttctacaatgcccgcaccaaacaagtgctgcacactttcaagaccaggttcacacagccgctgctgcctgctttcacggtatggtgtggcagcttccaggtgacgacaggcctgcaggtccccagtgctgtgcgctgcctgcaaaagcgaggcagtgctaccagcagctccaacaccagcctcacctaggcccccaggcacccacccagctggggtgtttttgggggagtcgccgccaagcccaggctgctggagccaggcaccctcctctgtcacttgctgcttggagccttaactccagatgggggggtcaccaagagggagtgggcaccctggcgggccctctccccacctcacctcttaataaaggtcagacac

SEQ ID NO: 42728 - DNA, 859 bp, Homo sapiens
cggtgatggagcgctaaccgggggcgcggcggcggcgagggctcggcgggccattggctaccggccgcggcaaaggcagcttggggacccagcgtgcgcggggcccgcgggccgggccggggtgacctgggctgcagccatggaagaacagagggaggccctgaggaagatcatcaaaacactggctgtgaagaatgaagaaattcagagctttatctactccctgaaacagatgctgctgaacgtggagtgggaggtgcgctacgagccggacagcaaggcgttcggcgtgggcgtggcctaccgcagcctgggccgcttcgagcaactgggcaagacggccgcctcctggtgcctgcacgtcaacaattggctgcaggtcagcttcacggccaagcacgccaacaaggtcaaggtgctggacgcccccgtgcccgactgcctgggtgtgcactgtgacttccaccaaggcctcctgtccttctacaatgcccgcaccaaacaagtgctgcacactttcaagaccaggttcacacagccgctgctgcctgctttcacggtatggtgtggcagcttccaggtgacgacaggcctgcaggtccccagtgctgtgcgctgcctgcaaaagcgaggcagtgctaccagcagctccaacaccagcctcacctaggcccccaggcacccacccagctggggtgtttttgggggagtcgccgccaagcccaggctgctggagccaggcaccctcctctgtcacttgctgcttggagccttaactccagatgggggggtcaccaagagggagtgggcaccctggcgggccctctccccacctcacctcttaataaaggtcagacac

SEQ ID NO: 42729 - DNA, 1728 bp, Homo sapiens
cggtgatggagcgctaaccgggggcgcggcggcggcgagggctcggcgggccattggctaccggccgcggcaaaggcagcttggggacccagcgtgcgcggggcccgcgggccgggccggggtgacctgggctgcagccatggaagaacagagggaggccctgaggaagatcatcaaaacactggctgtgaagaatgaagaaattcagagctttatctactccctgaaacagatgctgctgaacgtggaggcgaactcggcgaaggtgcaggaggacctcgaagcagagttccagtccctcttctccctcctggaggagctgaaagaaggcatgcttatgaagataaaacaggaccgtgccagccgcacctacgagctgcagaaccagctggctgcctgcacgcgggccctggagagctccgaggagcttctggagacagccaaccagactctgcaggccatggacagcgaggactttcctcaggctgccaagcaaatcaaagatggagtgaccatggcccctgccttccggctatcattgaaagcgaaggtcagtgacaacatgagtcacctcatggtggacttcgcgcaagagcggcagatgctacaggcactcaagttcctgcctgtgcccagcgcacccgtgatcgacctggctgagtccctggtggcagataactgtgtgaccctggtgtggcgcatgccggatgaggacagcaagattgaccactacgtgctggagtaccggcggaccaacttcgagggcccgccccgcctcaaggaggaccagccctggatggtcatcgagggcatccggcagacagagtacaccctgacaggtctcaagtttgacatgaaatacatgaacttccgtgtgaaggcctgtaacaaggcagttgcaggagagttctctgagccggtgactctggagacaccagcgttcatgttccgcctggatgcgtccacatcccaccagaacctgcgggtggatgatctctccgtggagtgggacgctatgggcgggaaggtgcaggatatcaaggctcgcgagaaagatggcaaggggcggacggcgtctcccatcaactccccagccagaggtactccatctcccaagaggatgccctcaggtcgtgggggacgggaccgcttcaccgctgagtcctacacagttctgggggacacgctgatcgacggcggggagcattactgggaggtgcgctacgagccggacagcaaggcgttcggcgtgggcgtggcctaccgcagcctgggccgcttcgagcaactgggcaagacggccgcctcctggtgcctgcacgtcaacaattggctgcaggcctcctgtccttctacaatgcccgcaccaaacaagtgctgcacactttcaagaccaggttcacacagccgctgctgcctgctttcacggtatggtgtggcagcttccaggtgacgacaggcctgcaggtccccagtgctgtgcgctgcctgcaaaagcgaggcagtgctaccagcagctccaacaccagcctcacctaggcccccaggcacccacccagctggggtgtttttgggggagtcgccgccaagcccaggctgctggagccaggcaccctcctctgtcacttgctgcttggagccttaactccagatgggggggtcaccaagagggagtgggcaccctggcgggccctctccccacctcacctcttaataaaggtcagacac

SEQ ID NO: 42730 - DNA, 1531 bp, Homo sapiens
gagaaaccctgtctctactaaaaatataaaaaattagccgggccatggtggctcacgactgtaatcccagctactcaggaggctgaggcaggagaatcgcttgaaccagggagtcggaggttgcagtgagccaagatcgtgccactgcactccagcctgggtgacaagagcaagactctgtctctaaaaaaaaaaaagtctccaccctgccaaacatggaacccctttgtggccatgcccccaaaattgtccaacatgtggttgggcagccctgcagcaagccccctgccccctgaaccaggcacagaatcccgaccccctctcctttccgtcttggtcagtgcccagcgcacccgtgatcgacctggctgagtccctggtggcagataactgtgtgaccctggtgtggcgcatgccggatgaggacagcaagattgaccactacgtgctggagtaccggcggaccaacttcgagggcccgccccgcctcaaggaggaccagccctggatggtcatcgagggcatccggcagacagagtacaccctgacaggtctcaagtttgacatgaaatacatgaacttccgtgtgaaggcctgtaacaaggcagttgcaggagagttctctgagccggtgactctggagacaccagcgttcatgttccgcctggatgcgtccacatcccaccagaacctgcgggtggatgatctctccgtggagtgggacgctatgggcgggaaggtgcaggatatcaaggctcgcgagaaagatggcaaggggcggacggcgtctcccatcaactccccagccagaggtactccatctcccaagaggatgccctcaggtcgtgggggacgggaccgcttcaccgctgagtcctacacagttctgggggacacgctgatcgacggcggggagcattactgggaggtgcgctacgagccggacagcaaggcgttcggcgtgggcgtggcctaccgcagcctgggccgcttcgagcaactgggcaagacggccgcctcctggtgcctgcacgtcaacaattggctgcaggtcagcttcacggccaagcacgccaacaaggtcaaggtgctggacgcccccgtgcccgactgcctgggtgtgcactgtgacttccaccaaggcctcctgtccttctacaatgcccgcaccaaacaagtgctgcacactttcaagaccaggttcacacagccgctgctgcctgctttcacggtatggtgtggcagcttccaggtgacgacaggcctgcaggtccccagtgctgtgcgctgcctgcaaaagcgaggcagtgctaccagcagctccaacaccagcctcacctaggcccccaggcacccacccagctggggtgtttttgggggagtcgccgccaagcccaggctgctggagccaggcaccctcctctgtcacttgctgcttggagccttaactccagatgggggggtcaccaagagggagtgggcaccctggcgggccctctccccacctcacctcttaataaaggtcagacac

SEQ ID NO: 42731 - DNA, 286 bp, Homo sapiens
gtgaagaatgaagaaattcagagctttatctactccctgaaacagatgctgctgaacgtggagaggcggtggggcagtcctggggaggtaaggggaggggaggaagctggagggtgcagccttaggaactggcccattgctgttgatgcctgtgggaggtctcaggttccctctctgaacacgggctttggccgattctggctgttccgacccaggcgaactcggcgaaggtgcaggaggacctcgaagcagagttccagtccctcttctccctcctggaggagct

SEQ ID NO: 42732 - DNA, 1488 bp, Homo sapiens
gacagaactcagagctgcaagagaaagaagactgaattcagtctctcttgcagaaaaattgttttccgtcaagttgataataatgatcacactgagaatgaatgactcaagatgaatatccaaagatatatcaaaacctggtcagcagtcgtggggaaaggaagaaagcctgagttgagtttatgaaagttttccactaaagtcagcaacagcttaaattcaaaccaggcacaagacgcttgaatctccatatgagttgttcatcaaagggctgaaagaaaagaaatctgagcccgagcacggtctggcctaaaagctttcaagtgactcctttctgttgcaaatgaaagaagtcctgctactctaaagaataactaaaccagactggagtcactgaaactgatggaagaacatctcaggcatgagtgccatggtgacgtcatcagctccgttcacaaccactcaccatgaggccattgctcctgtggaggacactggctttaggactcatgaagtagtacctcaggaaggtgtctctgtaagtgttccttccaccagctccaagacacaatgagatggagagaactggaacaattccctatgattgcagctggatattttcacatgaactatctagtaatgaaggcaatggcatgtggtgtggcaaagactggccccagattacatttccagtccttttgtactgaggaggggctttgggaccaagacagtaggagtgagggtacaggttccacattctatttctctcttagttttctgtggttatcttggtgactgcatggtaaagatggaggtgacaaaagatggaaggagcctggatccctgaatgacttcatggtgcagagccttacactacccccaactcatactaaaacaggggtgggaggaacaatagaccattattctgttaaggtgctgaaattgtagagctgttaatttgaacagttagagtttcttatactgatacagtatccttaccctggattgttgaaataattagtccaaatagtttctttgcctaaaactgtggacagagcctaagcaatattgaatccaagacaaggtatatttatcaaatgctactcactatacaatacagatgaatgtggcacttacttcccgtgttgttacccagcctgcttctagtattctttacacaaaataacattcatgagcaacctgggcacaagaggtctctgtcaaaataagtctttgatttctctccagataaactcgtgtgtgtgtgtgtgtgtgtgtgtgtgtgtgtgcatgtccattttatatttggttttagttacaattcaaggagtctttccttttagacaatggtccatacattcatggaaggcagaactaatcagagaacctggttcaaaagttttaggggattctttgagaaatgtttcccagaatttaaacttgggacttgactataagtattagtgtacaaaatcacagaggatatca

SEQ ID NO: 42733 - DNA, 878 bp, Homo sapiens
  misc_feature (23)..(23): n is a, c, g, or t
  misc_feature (31)..(31): n is a, c, g, or t
  misc_feature (34)..(34): n is a, c, g, or t
  misc_feature (39)..(39): n is a, c, g, or t
  misc_feature (42)..(43): n is a, c, g, or t
  misc_feature (826)..(826): n is a, c, g, or t
cgacttaagtgcgagggactctnttaatacnccnccgcnacnnttgcaaatgaaagaagtcctgctactctaaagaataactaaaccagactggagtcactgaaactgatggaagaacatctcaggcatgagtgccatggtgacgtcatcagctccgttcacaaccactcaccatgaggccattgctcctgtggaggacactggctttaggactcatgaagtagtacctcaggaaggtgtctctgtaagtgttccttccaccagctccaagacacaatgagatggagagaactggaacaattccctatgattgcagctggatattttcacatgaactatctagtaatgaaggcaatggcatgtggtgtggcaaagactggccccagattacatttccagtccttttgtactgaggaggggctttgggaccaagacagtaggagtgagggtacaggttccacattctatttctctcttagttttctgtggttatcttggtgactgcatggtaaagatggaggtgacaaaagatggaaggagcctggatccctgaatgacttcatggtgcagagccttacactacccccaactcatactaaaacaggggtgggaggaacaatagaccattattctgttaaggtgctgaaattgtagagctgttaatttgaacagttagagtttcttatactgatacagtatccttaccctggattgttgaaataattagtccaaatagtttctttgcctaaaactgtggacagagcctaagcaatattgaatccaagacaaggtatatttatcaaatgctactcactatacaataaantccgatgcggccgatatatggcggcaaagagattgtgtataataaaaaaata

SEQ ID NO: 42734 - DNA, 1194 bp, Homo sapiens
  misc_feature (23)..(23): n is a, c, g, or t
  misc_feature (31)..(31): n is a, c, g, or t
  misc_feature (34)..(34): n is a, c, g, or t
  misc_feature (39)..(39): n is a, c, g, or t
  misc_feature (42)..(43): n is a, c, g, or t
cgacttaagtgcgagggactctnttaatacnccnccgcnacnnttgcaaatgaaagaagtcctgctactctaaagaataactaaaccagactggagtcactgaaactgatggaagaacatctcaggcatgagtgccatggtgacgtcatcagctccgttcacaaccactcaccatgaggccattgctcctgtggaggacactggctttaggactcatgaagtagtacctcaggaaggtgtctctgtaagtgttccttccaccagctccaagacacaatgagatggagagaactggaacaattccctatgattgcagctggatattttcacatgaactatctagtaatgaaggcaatggcatgtggtgtggcaaagactggccccagattacatttccagtccttttgtactgaggaggggctttgggaccaagacagtaggagtgagggtacaggttccacattctatttctctcttagttttctgtggttatcttggtgactgcatggtaaagatggaggtgacaaaagatggaaggagcctggatccctgaatgacttcatggtgcagagccttacactacccccaactcatactaaaacaggggtgggaggaacaatagaccattattctgttaaggtgctgaaattgtagagctgttaatttgaacagttagagtttcttatactgatacagtatccttaccctggattgttgaaataattagtccaaatagtttctttgcctaaaactgtggacagagcctaagcaatattgaatccaagacaaggtatatttatcaaatgctactcactatacaatacagatgaatgtggcacttacttcccgtgttgttacccagcctgcttctagtattctttacacaaaataacattcatgagcaacctgggcacaagaggtctctgtcaaaataagtctttgatttctctccagataaactcgtgtgtgtgtgtgtgtgtgtgtgtgtgtgtgtgcatgtccattttatatttggttttagttacaattcaaggagtctttccttttagacaatggtccatacattcatggaaggcagaactaatcagagaacctggttcaaaagttttaggggattctttgagaaatgtttcccagaatttaaacttgggacttgactataagtattagtgtacaaaatcacagaggatatca

SEQ ID NO: 42735 - DNA, 438 bp, Homo sapiens
aggctgggcgcggtgtcacgcctgtaatcccagcactttgggaggccagaggcaggcggatcacaaggtcaggagatcgagaccatcctggctaaaacggtgaaaccccgtctctactaaaaatacaaaaaaattagccgggcatggtggcgggcacctgtagtcccagctactcgggaggctgagacaggagaatggcttgaacccgggaggcagaggttgcagtgaaccgagattgtgccattgcactccagcctggttgacaagagcaagacttcatcacaaaaaaaaaaaaaaaagaaaaaaacccaaaaacaagatagcccatggaacagaatagagaggaagagacaggcccccacatatactgtcctctgatttattactaaagtcctactgcaatttagtgggaggaggaagatcttttaaataaatggt

SEQ ID NO: 42736 - DNA, 120 bp, Homo sapiens
ctatctaccttcttccactgtaggtgtcctggttctcaataggcatcagcacatttacttattagctcaatcctacaatatacctaaaacaatttcagaattgctttgctggtacgtcta

SEQ ID NO: 42737 - DNA, 790 bp, Homo sapiens
tggacttaagcaatctgcctgcttcagccccccaaagggccgggattacaggtgtgagccactgctcccagcctcctaagctctttacatgttaaacagcagcactagttgagtacctcttacccaaaatgctttggaccatattattgcggatttctgactttttcagattttggaatgtttgcaatatacttaccagttaaaccttccaattctgaaaatccaaaatgctccaatgagcatttcctttgggtgtctttttggcactcagaaaatttcagatttggggttttcagatttaggatgctcaatcatgatgtagtaatcatgacagtgagacactttaaaaatgtcattgaaaaacaaaaacaaaaataagaaaaaagaaaaaaatatataattgaagatttaaattacatgcttacctgagtttctttcataagtctgctgtatacaacctaggaaatgcaaaaactaaaataaaaattacctataactcatttacttagagatagactcaatattttcatttatttcctattttgttttactgtgcagatacattttaaacttttatgaattttaagttgaaaaactaatacatgaacatattcttattgcaaaaattcaaaccttatacgtaaagctgaaggcccccaatgacttccattcctagactcagtcccttttgcagagattctgtgaggagtttggtatatatagtattttcaagatctctctttgtagaaatagggtattgttttatggtgttaaaagaaatacttatgta

SEQ ID NO: 42738 - DNA, 476 bp, Homo sapiens
tgtgtatggtgcgaaaatggggttggagagactcattaatgggtttgctccatagtgcccttgtgtggggtatacactttttttttctttgaggcacagtgcagtggcgcaatcccagctcactgcaacctccgcctcctgggctcaagcgattctcctgcctcagcctcccaagtagctgggactacaggtgcccgccaccacactctgctaattttttgtagtttgagtagagatggggtttcaccatgttggccaggctggtctcaaactcctgacctcaattgatccgcccacctcggcctcccaaagtgctgggattacaggtgtgagcctctgtgcccggccgggtgtacacttttatatgacacataaggctgggtctaggcagaattataaatagattattgccttttgccttttttttccctctgttttcccccatgtctttcttcattgtccccatagaccctaat

SEQ ID NO: 42739 - DNA, 474 bp, Homo sapiens
aaacctcgtctctactaaaaataccaaaaattagccaggcgaggtggcagatgcctgtaatcccagttactttggaggctgaggcaggagaattgcttgaatccgggaggcggaggttccggtgagccaagatcatgccactgcactctagcctgggtgacagagtgagactctgtctcaaaaaaaaaaaaaaaatcttttggagatagaattactttgatagggactttcatcatgtaaaaacaaacatcaacaaaccctgacgaatatctgctgaaatctaaagactgtctaccgttagtagtgactgatgtttccacagactttcacaaacaagagacagcaataccaacatgattatgagctatgagaaagtgtccattaatacctgtcctaagtagatcaaaaatgaaaatagttctataccacatattttgctgtcgtaatccaacattatttgttaagagtaccaca

SEQ ID NO: 42740 - DNA, 965 bp, Homo sapiens
catttcagcctgcaggtgccccgggctttagtcctggatctgaggcttgggcccggcattcatccccaccaccaccaccaccaaaagcagttcttagtgaaaattgtaggcgagcctgttaagcgttgtagaagaggaagccttccaggagaggtgccatgcggtgccctttagtggcagcacggcaaggttctggaggcgggggaagccaccaagagacagtgacagggtcagcgggggcagacgccacatggcaaagagcagagaagcccgggaggtgtgaggagtggccgacctggcctcagcgcatctgggcactgggcgcaagatgaagcttcagggggcagatgtgactgggctccacagcagggagggggaggggaagagagaacacatcacagaaactgcacaaaataagcagcccatgaaaaacaacctagaaaaagaggcgaaaaatgaacagcaaaccggaccctgcttcctccagcaggaggctcccacccactgctggtcacaacccgctgtctggacctgccgcttacgggatgaggtgggcctgcagggaacgcggggcttctggttgctgttagtggtggcttttcttctcactttgtgtagcccccagaaccgtgaggggcatccgagtgggtgagcacaggcgtccgctgaagagccgcctggaccagggcggtcagcgctgtggggaggcctttgcccgaccgcgccactgtttctcaccaacattcactgtgtcctgcggggcttgaggcttagactgacgggagctattccgggtgtttaattgaaggtctagcacttgaccagcccctggaggagctgacaaccacctaagacacatttggacttggtgtccaccaagagtgactttgtgcaaagaaatggctgagcactagaataactaaatgcaaataaaatgcgtctttcagtgcagttcagacaggtca

SEQ ID NO: 42741 - DNA, 409 bp, Homo sapiens
gtatctcctcttctccgagtacctgtccctcaagatattctctgccccagaggtacattctgcccccactttctgtctcttaaaaaaacaactttgcccatttaaaaaagaattttgacttaggcagctttaattctctgcactgagtgttcttatctgtggatggaggtataagatttcaagagtaataccccctcccaatgtttcagtaataatctaaattcacattaagccttaggctggagaacatttgagctattcgctttagctactagctctgaaaacttcaaagcataacattcccaagtttatctaaaacttgaatcttaaaaataatgataattatctgttatgcttcaaagcataacattcccaagtttattaaaaacttgaatcttaaaaatactga

SEQ ID NO: 42742 - DNA, 293 bp, Homo sapiens
atagatttaaattttatagaaaccttttcccttatctagtgcaagaggtagctaagtgcttattttctcaaagtactgtgttataaaaagtattcctagtgtagtcaaagcttctctttagactgataaaacttagagcacctgcatttacttccaacaaagcagaattaaagaaaatgagacttggccgggtacgtttgtaatcccagcactttgggaggccgaggcaggtggatcatgaggttaggagatcaagaccattctggctaacatggtgaaaccctgtctctacc

SEQ ID NO: 42743 - DNA, 578 bp, Homo sapiens
catcctaagcccgcgtgtatcctaccccctccttctgcagatccaatgtccgtctggcaattgccccattccctctcgctggagagatcccttccgcctcgccacaggcgtcccacgctgcccggagtcgtgcgccccgggacgggtagttttgggttcctcgacgcttggccaggtttaggaaagacccgctgtcttccttgctgcccccacctaggagactcggcgccttgcgctccgtcctttttaatggtgtcgcggcttgtccctctggcttgctccctcctagtccctaccccacacggctcccttcgccagctccatgacaatcccactcgtgctgaagaccttgggcaaagaagtaaccatcggtcttcccctcccttcccattcctccggcggcaggactagggggaaaggtgcccgggatacaagcccctcacgcagacccactgatgcggccgtggttctgccattggcccctctccgaatggtgaggttctcctgctaaccctggccccatggcataactagtataaccccagtgagaggaacccagagttccagtcctcccctgc

SEQ ID NO: 42744 - DNA, 148 bp, Homo sapiens
aaaattaaggaaagccatatgaaatgttcaaaatgatcaaaaataattggataggaaaaggaaaaggataaaaaaaggatgggcctggtgcggtgcctcatgcctataatcccagcactttaggaggccaaggcgggaggatcacctg

SEQ ID NO: 42745 - DNA, 301 bp, Homo sapiens
gacaagaagtaagaaacaatagggggccttatctacaaactctctggtcttctatttgcagattttgataatcactctgttcctaaatctttctgctttgcatgtaacttcccataactgtcaggggactaggcatttctttgcatagtaaatttattctgtatgttcagtgatcttgttttgatttttctttatttctgtcctttttcctcattgcctattcgccaaattcccaccccaccctgtgctcactctccaccctctgtattccccatcttcatctgccttcagaccatgagag

SEQ ID NO: 42746 - DNA, 316 bp, Homo sapiens
  misc_feature (269)..(269): n is a, c, g, or t
  misc_feature (277)..(277): n is a, c, g, or t
  misc_feature (279)..(279): n is a, c, g, or t
tgcattgagagtgcacacgttgctatatggctctgagcctgctgagtcagggccaaccctctgatcaccctcctgtagctccaagaaggagggcagttattcaccctccacgccgttccttcctgggttcgggggcagctccccggaggcttcaggtacccacctttcctgcaggtgtccaggctcctctgcctaccagtggggtggcgaccatcaccaaggtgtgaggggcggggggacctgcctgggggctgatcaggcaggtccanagcctctntnaatgacttcaccaataaaatttctaacttcctgttcc

SEQ ID NO: 42747 - DNA, 389 bp, Homo sapiens
tactcaggaaggatttgggacgatcacttgaggctaagagtttgagaccagccagggcaacatagcaagactccatctctacaaaaaataaaataagtagctggacacgatggcacacaccttaagtcccagctacttgggagtctgaggcagaaggatcacttgaacccaggagttggaggctgcagtgagctatgatcacgccattgcgatcataggctgggtgacagagcaagagaccctgtctcttaaaaaaagaaagaaagaaaagaaaaatgatactcaacccttgtccattgggcctgactctcacctcccacctctactttgtgaggaagggacagggtgttaatatgtcttcattggagggtactggggcccagagaggg

SEQ ID NO: 42748 - DNA, 363 bp, Homo sapiens
cgggttccctggactgccttcttattttgtctctcttagtcagcttccctctcaggtgaaatctcacctctactcccagtgcctaagatctggcttgctgagaagccagatgatggcacccagaagttcaggagggcagctccccaaatttctccctctttctcccactctgtgtactgcttcgtggcgtgatttttttttttttttttgagacaggatcgccccctgtcacccaggctggagtgcagtagcacgatcatggctcactgcagccttgacttcccaggctcaaacaatcctcctgcctcagcctcctggagagctgggactacaggtgtgtgccaccacatccagctaattttt

SEQ ID NO: 42749 - DNA, 548 bp, Homo sapiens
tttagactcttcccttttttggagggaggaaataagtaaatctatagttttgtggggttttttcccccttctatttaggatgtttccttagggtagacagccagaaattagaacttctgggtcaaagaacatttaaaaaaatttttatgcatgttaaaatgttttattttctaaaaatattctatcattttgcattttcacaagtgttttgtgagctgtacaaatgttcttttcaccacatttttaaaaagtcacacgaaaggctgggcgtggtggctcacgcctgtaatcccagcactttgggaggccaaggcgggctgatcacgaggtctggagttcaggaccagcctgaccaacatggtgaaaccccgtctctacaagtacaaaaattggttggatgtgattgtgcgcatctgtggtcccagctacttggggggctgagacgggagaattgcttgaacctgggaggcagagcttgtggtgggccgagatcgcgccactgcactccagcctgggcgacagagtttggctctgtttcaaaaaaaaca

SEQ ID NO: 42750 - DNA, 526 bp, Homo sapiens
tttagactcttcccttttttggagggaggaaataagtaaatctatagttttgtggggttttttcccccttctatttaggatgtttccttagggtagacagccagaaattagaacttctgggtcaaagaacatttaaaaaaatttttatgcatgttaaaatgttttattttctaaaaatattctatcattttgcattttcacaagtgttttgtgagctgtacaaatgttcttttcaccacatttttaaaaagcccagcctaaaatatatttaaaattaaaacatagattgatacacatctaaactgggaagaggctagaagcggtggctcactcctgtggtcccagctacttgggaggctgaggtgggaggattgcttgagcctggaagctggagcctgcagtgaactatcattgtgccactgtactccagcctaggcaacaaaatgagatcctgtctaaaaataaatacatatgtgtgtgtaaggttgcagctgggcacaatgctttatgcgtgtaatcctagcac

SEQ ID NO: 42751 - DNA, 271 bp, Homo sapiens
ggctgctggattggagggccttggtccactaatgcggtttgtcgtggaaactaggctccactgacccagcccacagctcccctggctgcagtgcttcgtaaatacttcagcaaaaatcaaagaggaatgaggctgctggtcctgctcctgatgtgtccgtatctggctaggggagacatgcacatactcagtgacttaaggctcttgatccatataacttcaggcaggcactaagggatctgatataatctgaagtaatgaacaatgcccc

SEQ ID NO: 42752 - DNA, 2576 bp, Homo sapiens
ccccaacacacgaagactgacggtggcgggtgctgcacatctcagccggagctctgaaggcatttagctgagcgctggcctgcacctggagagagtgagagacaccagcctccactgccaggaaggcccagggtcctcagggaccaagacgcaggagacggccgctgccagggtcctcgggacttctgtgtggccttcgctaccggagccctgaggcgccatccccatgtgcccttcgggctggtccaggaggaggccctgcggcggccacagactggggggacaaagccccaggaactcagaaccttgtgggttttggaagaggagccgcgcagcaaggtcccgacgcctgcagggagctgaacggggagccgcgcgaggaagggagtgcagcagacccagtacgcaaatgctgaccctacaaaacgcaccgcgggttctcgagccgtggggatcccggcggtgctctccagagaccgcagctgcaggagctgggcggtccccggcaggtgccacgagggtgcgatctcggccgagaaccaccaggcgtccacgtccacggagggactcattctccgtgcccatctcacagggagcaaaggaggcggagggagccccggactcactgggttctgacccagacccttctcttctgcagggtggagtcctcctcccagagaagcccagacgttcgtttgggagacccagggacactcggggccatcacctgcccctcactggggctcccaggggagacttcacgcagtgcccagtgtcctcccgctgggatcctcctgcccccgaggggcgcccgtgtcccccagcaccccaaggaagagaatgagctgtctttggcgggtgctgtgctattttctgtccttatttcacctagaatggccatttccagaactcaatccctgcaaatgaatttcttctaacgccccttttcagtatcaaggagcaggaagcaatatcctttaaaaaccgatcggccatacatttctgctcattaaataaatatttttactttggacccgattgatttttcagacacacggaacaatgggactgactcacctgtgtgcagctgggagcctccttcctccccggggacctttgaagtcacagtgaggcggccacacctggtgcacaggtggagcccggccgataggcacctgaattctcaccaacttcacagggtgttcagaaacgggctcgcactcggccgacacgcccccttcctggatccctggggtgggatgcccagtgtggctgcaccggagaaagggtgaaaaccagcggagagagggccgggaaaggctcccccacaggcatgtcaaggagagaacctgcagttccaccacaccctccagccccctcccaggcaatctccccactccagcccctgacccctgaccaccttgctccttggtatccagagccaggccggaactcagggagggccgcgccgttcacttctgtaagggagcctccgttcagtcagtcattcaacaaacatgaatccagagccgcatgcactgctggtcccgtcccagctgctggtcacggagcggagaaagcttgaaggccgtggtgtctactgagaggcagatgacaaaccaggagcacgagtcacagcacacactggcgcagctgcagggagctgggcagagccgggcctggcacatggggcaggaggctgtggccctaacgccatggtgggcgccacagaccttgtcagaaggggtctgagcagagacattgatttggtttcattatcatatagaacagaatagaaaactcagacatgaagctgcacacatacacccgtctggtctttgacaagaccaacgaaaacaagccgcggggaaaggactccctgtccgatagatggtgctgggataagcagctcagtcacaggcagaagaaggaaactggactcttacccttccgcatagacgaaaatcaactctagatggattaaagactcaaatgcaagacgtcaaactataaacatcctggaagacaacgtcttcttgactttggcgttggcaaagaacgctggctaagtcctcaaaagcaattgcaacaaaaacaaaaatagacaagtgatacctaattaaactgaagagcttctgcacagcagaagaaactgccaacggaggaaacagacaccctacagaatgggagaaaatgtctgcaaactatgcatctgacaaaggcctaatatccagcatctataggacgcttacacaaatcaacaagcaaaaaacaaccccattaaaaaatgggcggccgggcgcggtggctcatgcctgtaatccgagcacttcgggaagctgaggcgggcggatcacaaggtcaggagatcgagaccatcctggctaacacggtgaaactccgtctctactaaaaaatattaaaaaattagctgggcgtggtggtggccgcctgtagtcccagctactcgggaggctgaggcaggagaatggcgtgaaccagggaggaggagcttgcagtgagccgagattgcgccactgcactccagcgtgggctacagagtgaaactctgtctc

SEQ ID NO: 42753 - DNA, 383 bp, Homo sapiens
ccaagttaaaaaattgttatatgctgggcacagtggcacaaacctgtagtcccagttacttgggaggctgaggcatgaggattgctcgagcccaggagtttgaggtcggcctgggcaacatagtgagacctcatctttttttaaaaaataattgttatattaatgtttaacaataaatttatgagacagtacagtagactggttaatcgtggaagattgggtgtcaagccaacctgtttactagctgtattactttggaaggattccttaatctctgagccttagtttgtttatctgtaaaaggaatgcaatagcatttaaaaggtgtttaacattgttagtgaatgaatgaatgtcatatataaagtactatagacagttct

SEQ ID NO: 42754 - DNA, 306 bp, Homo sapiens
agccccaggattgggttagatgctcctgggctgtgctcctgcagcatcctgaatgtacactcctggtatgaattatcactccacattataattgcctaattgctggcttgcgctcccctctatgctgtaagcccttggacagcaatgttgtgtatttttcttatatcaacagtactggctagtggctcacagtaatcccagtactttgggatgccgaagcaggaagattgcttaagcccaggagttcgagaccagcctgggcaacaaagtgagacgtcactcatctctaccaaaaatgaaaaaaaa

SEQ ID NO: 42755 - DNA, 595 bp, Homo sapiens
atttggtgagaaacccaactcagtaacctaatacctgcctttgtgtgtgtgtacaaaaataaatgatgcaaaattgtaagtttcaaagacttgaataactttattggctaatattaatttagcaatgttaaccatcagattaattttaggcttggggcagttttagtgattgggggagaacaagagatggacttttgagttttaggtatctgtatgtatgtactttcttgacctctgttatatttctccagataagtactgtttaaataacatataaagatgtcagatgagcaatagatagataagaatggtgcaaaaaaaaatcaaaatatgaagctactgagagcaatttctgagtctcagcatactgagttttggccccaaagtgcctggggaaaatggacatatcatctaaaaagctgtaaataccagccaacaacaggaagtcttagactcctgtcccacacttctgagctgcagggtgtgggggaagccccatgcctttatctcactgtctctatctctagcaaggaaacctgtttcctgactctgcagaatttcgctttccccctttttccttaaaagcagagttaca

SEQ ID NO: 42756 - DNA, 1199 bp, Homo sapiens
cagaaataagtgagtgtctcttagcagcagaaatgcagctgtgagctgctggggagtgtagggatggcaggaacaccaaacacgtgtccaacctcgaggacaacaggcagatggtggggacaaagcaggagacctgcctttgagcctctgctctgctagctattagtggtgaccttgggcaagccacttcatctctctcagcttcttcctctgtaaaatggagagcataaccctacttcttttaggacttgagcatgcaagggttggaaataatgtagatagagcttctggaagggctcagcttggaatgtggaagcccctgttggtgcaaagagctgggcccaaaggaaagaaggaaagggctcgtgagcacagacgcaggggtggagccagagaatgggtctggaagaggaagcatggagctgggtcttgacactgagctcttgcgttcctcgcctccctttctcttggcatttcctcaccacccttccaacatctttacagttggggcttactctttgccaccattggtcccccatccaggccagccttccttggctcagttccaggctcatcaaaagccttattcctccaggatggcccttggcagctggttgggagggaaaggatctcatggggtttccatacacactgaggggtgagtgactcactgcagctgggagtccaaggacaatcctactagctgctgacaaaacctggcttctgcctctgaagcgaaccaagccctgacggtggaatttccagcagtgggtgaaaaaccttcctagtcttcatcagttcacatatatcaaggacactccaaagatggaggtcaaatgaaacccgaagtcacagaaaaaggagagtaagaaaataaaagagataaataataattgtctccaaggtagacaaaagaaagccccaccaggcaccttctgtgtgcaggaggagatggcactctcgctgagtctcccagaaggaactgtggccctttaaggaagctggtacatacaggagcctgaaattactgagcctgaaataagtcttacgtaaatgccaatttcttacggggcttttttgtatgtctttctttctttatctctctctcttttttttaaaggtatgatatataatgggttccttttgcagaatgcagcctctacttgaactctctcttaattaaagctcattgtggatta

SEQ ID NO: 42757 - DNA, 266 bp, Homo sapiens
tgtcttaataaaagccattctgacaggtgggcggtgatacctcattgtggttttgatttgcagttccttgatgattagtgatattgaacatcttttcatttacctgctggccatttgtatgtcttcctttgagaaatgtctattcctgaatagcttttgcccattttttaacagagtcttttaaaatattgagttgttttaggtcctcatgtattttagatattccttatcagatgtatggtttgcaaatacaatatttcctctca

SEQ ID NO: 42758 - DNA, 523 bp, Homo sapiens
gtgttcaactgacaagtctataatgcagatatcctgaaatctgaaacacttctggtcccaagcattttagttaagagatagtcaacctgtattctatttaatcttaatttacaaacaattctaacaaacatggctgtttgatttccaactccatagcagactcaggaaggaagctgaatgaagagataaaagtgtgtccattggcagaggactaaaggagatttgagcacctgtcagatgggtactgtaccagaagaaaggagcactttgaaagcgtagcttatggggtaggaaagtattttatttaggaaaaaaaacccttcatttattccaaatgataaaatgtaaaatgggtttccataaagtgccagatacatgagatgttgttgattttataaatgatgatcatgtatttacagccttttacagttttttatatccattgacttatttgtgtctttgtctttaaaatctgccattgcaaatagctgttttaataaaccaattttgccttggcccctga

SEQ ID NO: 42759 - DNA, 449 bp, Homo sapiens
atccagcctgaggatagactgccccggttgaagtgacggattaagaaggcccctaaatggtgccctttgagtggcccaaagcacataaatcagctgttgagaagttcaatcagaaaccaacttttagcaaacatacttctcaaaacaaataagcattttgaccttcatgtagaagctctaaatacagtaaattcaagttacaaccctgtggacatgtagactagtgattaaataaagatcaggttactgatggccctgaagaactcatttttgggggttatatctgttgacacttaactatgttatcaattaaaactgagaatttaaggatacatatatttttaattttatttttaaataacagtaagccccaaacatcttaccgtatgacatattggaaaaacaactgtatttccaaaaataaaaaacataatgaaaagaaaaaaaaa

SEQ ID NO: 42760 - DNA, 546 bp, Homo sapiens
ctaccactatctgtttaaatcatcgtttatttatattccttaaatattcatacctttcacataagtgagatacattatttttaaaaacgcagttttccttcttgattttttcatattgtcccattattctgagaagagtttattttatgagaattaagttattatcttacagaataaatctgattactgactagatacaagataaccacatatttttcctagaataatttaattccaattttacttatttgtaccttatatgacttattttcaggttagaaaaatgtggtcctacagttttgttttgaagtttgcctgggccatgtgaagccaccattatcatttacgtcaaaaatgaaggttatctgttgcccaagagaaaaatacagcattctcaatttaaaacactaaaatagtgagggtttcataagctgtttcagtgatttctgaccttgggttggaaagctctcatgtctcagttacctcagtgggtatagtgacattgtcccagtctgcattaccaaattgtttcaaatcactttaatt

SEQ ID NO: 42761 - DNA, 765 bp, Homo sapiens
gtctgccttttctctccttaattgatcacacattttttcaaaataatatattcctggtgattaataatgactgactatacattgaagatgtttttctgagccaaggtttttctcaacctccacactgttgacatttgggccaggtaattctttgtagagaggagatgtggggggctattgtgtttatacagaatgttaagcaatattcctggccttggcctacaagatgctagtagcactttctgtttctaacccccatagcctctattgtgacagacacaaatgttttcagacattggcagatgtcacctggggaaaaaaaattgccccctgttgaaaaccattgctcatgggtcatgtatagcttatgcagactcttggtctccgttaatatccttcatcaccctttttcactgtctctaatagataagaaatttggctaatcagggataaatggaaataaaggaggggaaacatatgcaataacaatataacaatgtagatatgaaaattctgtgacagcaatgtagctatactatttttatcacatagtttttttcttttgggaaaacctgatagagaccagtaacaaaacggtgaatttaaaagaatcagttcatccattattttaagatagaattaatatttgatcacattttcaaccaagaaggatttctgtgccattcagatatgaatacaaataacagtatatgaagaagggaaacatttattgtttatattctaaagtttccaaattagtctccc

SEQ ID NO: 42762 - DNA, 436 bp, Homo sapiens
  misc_feature (2)..(2): n is a, c, g, or t
  misc_feature (263)..(263): n is a, c, g, or t
cngtctcgtggcgatacctgaaatgcacccgcttcccggcccatgcaggagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatngtgaggctggcttctgggttgtccacaccactctctgctgtgttgacttcctgttgtcttcatcaaagcttttttccgtggtattctaaaattaggccagcagtggggctgggagggcatctgtgttagtcccttcctggctgtgatccgccacactcactgtcagtattaag

SEQ ID NO: 42763 - DNA, 369 bp, Homo sapiens
gtgtaaagcatgccgtctctcctcatctcacacggaaatcctgaacatccttcaaggctcacgttggagacgggtcctctcttttgtgttcggcactagtggtagctgacactatgtgccaggtgctggctaagcacttcatatcctttatctcgttgtgtcttcaccactctctaaggtaggtactataatttcctctattttatgtatgaggaaactgaagcccagagagggtggataatttgccagcgtcacacagtgaggggtggaaccagctttcaagctcaggtcttcctcactccaacgtcaacgctctcagccactacattaatttttccttatgttacagacgtggcaaactcaaatgtc

SEQ ID NO: 42764 - DNA, 414 bp, Homo sapiens
agcgagaccctatctcagaaaacaaaaaaagaaagaaaaaacccagcttgaagttagtgtaaacaactaaagcacaaaactatgatcttatcccactggacattttactatctgaattcactcacagtacttggtccctaagtctgtgtaaccattgctggctgcctttgacttaagggctcagttggttaaagcccaaagctgaggctcaagtcatgggtccagtctcattaatggccagttattttgctctgttcttattctatatcccggaccccactttctgtgttgcatatttatgacgttggtcacgagggtggcttgaccagagagggaacagaggaaggcaaatccatcaccacagctactagcaaaacaagcacaaatcctgtgaatggaggataagatatgttt

SEQ ID NO: 42765 - DNA, 272 bp, Homo sapiens
tcagctggagagacatgggagatgcaacctgaaaggtgtacgccatattgagatgcctggacttcatcctgtgagcagcagagtgtttggatagattctgggaagtgaaaatgttggggcaaaggggatgaatatttgaagtttttcaatactggacttccaatttgcttttcaaaagtttataataatttatattcatctaagcaatcacgagggtccctttattgcattcctgcctgcactgagtgctctcattaaaagcaatctttgtg

SEQ ID NO: 42766 - DNA, 405 bp, Homo sapiens
caccccttcacccgttccagttttacataagttttcctcactacacagagatggtgtggtgccaccaagatcattattcattttacaaccttactgggatcccctgatgaaatccctctgagactacagcacagtagcccctggcagaagagaggaccctgtacctacaagatgccttgcctatctcagagatccagaccattgtcagattttagagttcctagtatggagaaaagtcccttgagaacagtagagcctggattgaactcttttaaaataagtaggaggtaggcgcttgtggtcccagctactcgggaagctgaggcaggaggatcgctggagcccatgatgcagagagacacgattgcgccactgcactgcagcgtgggcaacagagtgagactg

SEQ ID NO: 42767 - DNA, 391 bp, Homo sapiens
ctagattgagttattcattctgtttttctttttcttttattaaaaatccaaatactcaaaaatcaaaacacaaaaatgtgttaagtgaaagaagccagtcacaaaaaatcacgttgtatgattctgtttgattctatttctgtgaaatgtccagaaaagacaaatccatagagacagaatgtagattagttggggggcaggggatggagcgaggagataggaccttaccccactaaaggctacaggtgttttcagggtgatgaaaatacagccctcctgggccaggcacagtggctcatgcctgtaattcctgcacattgggaggctgaggcaggtgaatcacttgagcccaggagttggagaccagcctagagatggcaaaccctgtcta

SEQ ID NO: 42768 - DNA, 651 bp, Homo sapiens
catctgtaaaatagcagttttttgtgagattgtgtttttttgtgagatttcaatgcaactaaatgtgctaaagaataggtaaaactgaacacagtaaatacgtttctgctccctctgctctgatggccaatctcttttcttcattttaccatcacacatgttgaacagtctgtacttgttagtttcagttctatttttttttaagaggcagagtctaactctgtcatccagcctggagtacagtggcatgatcaaagctcactgcaacatccaactcctgggcttaagggatcctagctacttgggaggctgaagtgggaagatcacttgagcccaaggagttcaaggcttcagtgagccatgattggtgccactgcacgtccagcctgggggacagagtgagaccctgtctcttaaaaagcaagaaaagaaagagaagactgagaataagaagatctctttgaaaataaaataagactgctaaaagtatttggtatacagtctggaaaataaagttgagggaatctctccagataaagagcaaaaagaaatagatagaaaaatataaagaaagaaaaaagacatagacaatcaatatgtaatgttaggagttcctggaagagagaacagagacagtgtaggtgaagaaat

SEQ ID NO: 42769 - DNA, 386 bp, Homo sapiens
acagacatgtgccactgcatgcagcctgaagtattttttttaaacttctctatgtatccatatattattaccacttttttcaacataagtgacagccattacttggacatgcctgctcccaagaagtcatatttaataaataagctattaatcctctaggcgaaggactccaatatgcaattctctaacacaggtcacaaattagcattctaaaaccagacttacaccttaaagggcatggataatatgggagaaaatacaaatcagtaatttattttgaaacaagaaactattataagataccattcctctagaaaaatactaatcctttagcattctaatacttttatttctagatttgtaggttcatggggaaaaaaaagagt

SEQ ID NO: 42770 - DNA, 549 bp, Homo sapiens
attctgacggttaattttagacatctacttgagtggattgagagacacacatagctggtcaaacacgatttcagccatgaatcaggcataaatattctgatggttaattgtagacgtctacttgactggattgagagacacacacagctggtcaaacacgatttctgggcatatctatgagggcgtttctggaagacactgagataaccatgacccaatgtggatgggcactgatatggtttggctgtgtccccacccagatctcatcttgaattgtagttcctgtaatacctacatgtcgtgggagggacccaatgggaggtgactgaatcatggtggtggttactgccatgatgttctcatgacagtgagtgagttctcatgatctgatggttttataaggggcttttcccgtttggctcagcacttcttgttgctgccatgtgaagagggatagctttgcttccccttctgccatgattgtgaggcccctgcagccatgtggaactgtcagcccattaaacccctttgttctttataaattgctca

SEQ ID NO: 42771 - DNA, 430 bp, Homo sapiens
tctggagcacacagaagtgcccctggaattctcccagcatcccacatgactggctccttccccctgggtctgtgcttacatgctccctgctctgaccgtccctgaccacccgattgaaaatgtcatcctccaccccggcactgcctgcctgctgctccaggcacgccctcttccagagcaccctagaatccaggtgttgtggctctcccacttgactgtgatctccacatgagcaggcgttaggtgtctgttcactgctacatcctggtgtgtaacaggcacttggcaaacgtggagggaatgaagggctgttgccatgtgtgtgtgttggcgaggggggttacgtttaagcagccacctgtgtgagctcaccttcatcagtaggcagcgtgaccatccaggcaggtatgagatagccactctggcaagg

SEQ ID NO: 42772 - DNA, 227 bp, Homo sapiens
aaactttcagttatcagatgagcaaattctggggatctagtgtagaaaatgggtggtgttggatgtgttaattaatttgattttggtaatcattacacagtgtacatgcatatcaagtcaacaccgtacatcttgaatgtattcagtctttctcagttaaatatttaaatttaaaattaaatattcaattatatattattcaataaaatcaattacatgttatagtt

SEQ ID NO: 42773 - DNA, 1296 bp, Homo sapiens
ggaacactcacagcagcctttcccagcacctgacctcaagggatatggcgtctaccaatttacataattgcctttgtcatcagttttcccataacatggtacgaagttaaatgagagcacctgagctccccttcctctgagtgcatttattccatccctccaagctgtggccttccatccccatccaagagacctgcagctgtgaagaagctcaagacttctttctcattgcctgcctcccagccattagtccccaccacagcccaggccacctggaaaatgggttccaaagcactatcactactaggtgacccctgaatgtggacaaggccacagctcttcaggcagcatttcaggggctatccagttgtcatccctctcatacccctctcctacccacccctatccccactattgtggaatgcacgaagggacagctggcaaaggcagtgaaccaagatgcagggaaggccctgtatgatggggaggatctaaagcaaaagccttttgtgcattgcctcaggttcagcagcagcagccctcactctgaagcctaccttgagaagccaggcatttctgtgaaaagctcatcagcatgtatttacaatgcaaactagaaccaactcccagtcagctaataacagaccccaggaaaaagaaaaggtcttccagacctccccgacacactttagaaccctcaggggtgaaaaagagggtgctccagggcagtgcaacttaaactgtggttgaaggacaaacagcctctgcaatacttgaggagcttgttagaaacccaaactcacagccccctccagacctacgtacagaatgtatattagcaagattcgctaggtggtttatgtgcacgttaaagtttaagaagcactgcctgagaatcccttggtcctaattaattcttttccacactcagatttgctaatgggtttcaccttatctcttgactcttgtttgatggcaacaggaaatagtagcatttcaggaagggtggaaaatataaaaagcactcccaacccaagcctccaaaaaacagcaattttcattttgtgtccatatattcccttctaatcattgtcctcatgcaagattttttttcataaagatgatctgctacataattttatatcatactctttctcctaacattacatcacaagtatactttcatgttgctgctacattcttcacacttgtcattttaatggccataaaacatgacatctagtgcacatatataattatgtagactcctattattaaatatttggatttcttcca

SEQ ID NO: 42774 - DNA, 510 bp, Homo sapiens
ggtaaggaggcctgcgggcttgagcctctgtgacagaaacattttggtccactaacaaatatggcgaaaccgttgggatttgttcatgttaggtgaaggcgttaaggatgagcagtgtggtattatcatgctttgtgtttgaaatatatcataagataaaaatttaaatgcaaaccataaaattatgaatatatcattaaattttggtacatctaactggtagggaatgttatgaagcctttaaattttcttttctggctgggtactgtggctcacacctgtaatcccagcattttgggaggccgaggcagaaggatcacttgagccccaaagttcaagaccagcccgggcaacatggcaagaccccatctctacaaaaaaaatttaaaaattagctgggcctggtggtgcacacctataacaccagctacacagaaggctggcatgagaggtgagctacgattgcaccactgcactccagtctggttgacagaccatgactctctcttt

SEQ ID NO: 42775 - DNA, 567 bp, Homo sapiens
attttgctgacggatggtctggtctggaagatctaagatggcttctcttaacaggtctagtgacttggcaggagatggccagaggctgcgacttagctgggactgttgactagaacacctacatgtagcctctctagcatagccatatcagggtaactggacttctcacatggtaactatattcccccagagtgaacattccaagagaaccaggcagaggcttatgtctttgttgcctggtctcagaattcacgtagcattattactaccatactctgttggtcaaagcagtcatgaatctgcccagatttaaggggagaggaatagactctaccatttgataagggagtggcatggtaactttggcaaagaacatatgggatagaagatattgttggaaaatacgatctggatttggaaaatacaatctgccagtttataagctatattaaagtttcccagggaatatttttcctgaattctgtgggatcagtaggaaaaacatagaattccaagagcgttcattgcaatttgcccaagtatggctaactaccatgagggttagtg

SEQ ID NO: 42776 - DNA, 572 bp, Homo sapiens
ggattatattgggaaatctttcaaaagtttacctcttcggaatatgcattttaagaagtttcttttgtacctgagactggcctgcttttagggagcttgacctattttatggctatgagcattaaactacgttagataattttctagaatctagataatgcaagccagaaaaaatctgattgcttcattggtttatttttttccagctgaagatttttcttgaccttaattatatggttaattgcctcaaatcctgattatacttcacatgtggaaatatagcctcaggtatcaagaacaactggagcaaaagcttcctaaataattttcaacattagcattagtaatactggttttcttaaacggagaaaaactacacaaattgctgtttgcatctcagttaatctgaatcatatttctttcctttgaaaatgcttattctctttgatttataaagttttataatggaggcttctgaaaaagtcttaaagtaaggcaaatgacttggggtaatgcctactttagtactttaaagaatgatttgatctctaagaaatagctatgttccatga

SEQ ID NO: 42777 - DNA, 2407 bp, Homo sapiens
taatgagagggaaaacaagtatgaagctgtgtggctgaaaccgtcttggcaagttagggaaagaaaacggaagtcactggggctgatcacagtgctaagcatgagagcactgcaagatgaggtcacggaggtgggcagggaccggcttgtgccaggccttgctggcagggtgaagagtttgccttttctctgcgtacaatggaaaggagaagaggttttaagcaagagaatggcttggtcatgtgtatgtctttgagacaccctggctagtctatgtatgatgcaaaaggtgggtggggcagggtgacaagaaaatactgttccggagcttcctgtggctgtgcctataagaggtggtggtggtggtgtggaaggaggtgtggcagtgaataaacagagatgtagaaacagcgtgtacatatattttaaggaacactgaggacgtgatgctggaatttgtgatgagagagtggaaaaaatccagctgctgtatgtttccaggaaacttctaggacagaggctattcaacaagctcatgaagatgaccttctatgggcattttgtagccggggaggaccaggagtccatccagcccctgcttcggcactacagggccttcggtgtcagcgccatcctggactatggagtggaggaggacctgagccccgaggaggcagagcacaaggagatggagtcctgcacctcagctgcggagagggatggcagtggcacgaataagcgggacaagcaataccaggcccaccgggccttcggggaccgcaggaatggtgtcatcagtgcccgcacctacttctacgccaatgaggccaagtgcgacagccacatggagacattcttgcgctgcatcgaagcctcaggtagagtcagcgatgacggcttcatagccattaagctcacagcactggggagaccccagtttctgctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagggctgagattgaggactggttcacggcagagaccctgggagtgtctggcaccatggacctgctggactggagcagcctcatcgacagcaggaccaagctgtccaagcacctggtagtccccaacgcacagacaggacagctggagcccctgctgtcccggttcactgaggaggaggagctacagatgaccaggatgctacagcggatggatgtcctggccaagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgcttcgcactgcgcaggatggaggagctgggcctgcatcctgctgaccaccaggtgtactttggacagctgctaggcatgtgtgaccagatcagcttcccgctgggccaggccggctaccccgtgtacaagtacgtgccctatggccccgtgatggaggtgctgccctacttgtcccgccgtgccctggagaacagcagcctcatgaagggcacccatcgggagcggcagttgctgtggctggagctcttgaggcggctccgaactggcaacctcttccatcgccctgcctagcacccgccagcacaccctcagcctccagcaccccccgcccccgcccaggccatcaccacagctgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtgggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgc

SEQ ID NO: 42778 - DNA, 2400 bp, Homo sapiens
ggtctcactctgttgctgtcttcacggagagcaggagcagaggctttgagaagccagtgggccttggcctcagccctgccggcagagggtccccaccatgcagctgaagtgccagggtgcttgtgaagtctaagcccttgtctggcatttgtcaggaatataggcgcacacttaagcggcccgggcgggtaccgccgtcccgccatggctctgaggcgcgccctgcccgcgctgcgcccctgcattccccgcttcgtccagctgtccacggcgccggcctcccgcgagcagcccgcagcgggcccagcggccgtgccaggaggtgggtcggccacggcagtgcggccgccggtgcccgccgtggacttcggcaacgcgcaggaggcgtaccgcagccggcgaacctgggagctggcgcggagcctgctggtgctgcgcttgtgcgcctggcccgcgctgctggcgcgccacgagcagctgctgtatgtttccaggaaacttctaggacagaggctattcaacaagctcatgaagatgaccttctatgggcattttgtagccggggaggaccaggagtccatccagcccctgcttcggcactacagggccttcggtgtcagcgccatcctggactatggagtggaggaggacctgagccccgaggaggcagagcacaaggagatggagtcctgcacctcagctgcggagagggatggcagtggcacgaataagcgggacaagcaataccaggcccaccgggccttcggggaccgcaggaatggtgtcatcagtgcccgcacctacttctacgccaatgaggccaagtgcgacagccacatggagacattcttgcgctgcatcgaagcctcaggtagagtcagcgatgacggcttcatagccattaagctcacagcactggggagaccccagtttctgctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagggctgagattgaggactggttcacggcagagaccctgggagtgtctggcaccatggacctgctggactggagcagcctcatcgacagcaggaccaagctgtccaagcacctggtagtccccaacgcacagacaggacagctggagcccctgctgtcccggttcactgaggaggaggagctacagatgaccaggatgctacagcggatggatgtcctggccaagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgcttcgcactgcgcaggatggaggagctgggcctgcatcctgctgaccaccaggtgtactttggacagctgctaggcatgtgtgaccagatcagcttcccgctgggccaggccggctaccccgtgtacaagtacgtgccctatggccccgtgatggaggtgctgccctacttgtcccgccgtgccctggagaacagcagcctcatgaagggcacccatcgggagcggcagttgctgtggctggagctcttgaggcggctccgaactggcaacctcttccatcgccctgcctagcacccgccagcacaccctcagcctccagcaccccccgcccccgcccaggccatcaccacagctgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtgggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgc

SEQ ID NO: 42779 - DNA, 506 bp, Homo sapiens
aatatttatatttcctctgtcttttaaaactgaacaccgaggtgggttttgtggtgggtggtgaacggacaggtttgggcctcgatcccccacccgaccctagcacccacaggtgggggtgccccctctgctgatgcgcctcctccctcagcaccatggacctgctggactggagcagcctcatcgacagcaggaccaagctgtccaagcacctggtagtccccaacgcacagacaggacagctggagcccctgctgtcccggttcactgaggaggaggagctacagatgaccaggatgctacagcggatggatgtcctggccaaggtgagctgtcccgctcgggcagagggtacctgggactcgtggagaagagggcacctgcctcacttgagcaacagttgctcccactctcccaccccctgcgcctctcagaaagccacagagatgggcgtgcggctgatggtggatgccgagtccgctgcattggatcctctagacaccagc

SEQ ID NO: 42780 - DNA, 610 bp, Homo sapiens
  misc_feature (24)..(24): n is a, c, g, or t
agagtcgactctaagatcccctgncatatgccaaggccaaggtgatggtggcctcccacaatgaggacacagtgcgcttcgcactgcgcaggtaggtgtgccccaccctgcaccgaaaccccaacctgagccgttgtctcctccggctggggagaggtggcagcagcgcagagctcagggtgggcagagcgacctgctgggtggtcgggcatttgtggggaaaggctggtgaaatgagctggagggtggcttcagtgggcaggcccaggcccgctggcgttctggacatcggactgtgagagcacaatggctttttgcagttacgttggtttttaaaattaacttttttctttttttgagatagaatctcgctctgtcacctatgctggagtgcagtggcgtggtctcggctcactgcaacctccgcttcccaagttcaagcaattcttcatgcctcagcctcccaagtagctgggattacaggcatgtgccaccacgcctggctaatgttttgtatttttagcagagacagggtttcaccgtgttggccagactggtctcaaactcctggcctcaagtgatcctcccttcttgggcttgccatatgcaa

SEQ ID NO: 42781 - DNA, 3896 bp, Homo sapiens
  misc_feature (2492)..(2492): n is a, c, g, or t
ggtctcactctgttgctgtcttcacggagagcaggagcagaggctttgagaagccagtgggccttggcctcagccctgccggcagagggtccccaccatgcagctgaagtgccagggtgcttgtgaagtctaagcccttgtctggcatttgtcaggaatataggcgcacacttaagcggcccgggcgggtaccgccgtcccgccatggctctgaggcgcgccctgcccgcgctgcgcccctgcattccccgcttcgtccagctgtccacggcgccggcctcccgcgagcagcccgcagcgggcccagcggccgtgccaggagctgctgtatgtttccaggaaacttctaggacagaggctattcaacaagctcatgaagatgaccttctatgggcattttgtagccggggaggaccaggagtccatccagcccctgcttcggcactacagggccttcggtgtcagcgccatcctggactatggagtggaggaggacctgagccccgaggaggcagagcacaaggagatggagtcctgcacctcagctgcggagagggatggcagtggcacgaataagcgggacaagcaataccaggcccaccgggccttcggggaccgcaggaatggtgtcatcagtgcccgcacctacttctacgccaatgaggccaagtgcgacagccacatggagacattcttgcgctgcatcgaagcctcaggtagagtcagcgatgacggcttcatagccattaagctcacagcactggggagaccccagtttctgctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagggctgagattgaggactggttcacggcagagaccctgggagtgtctggcaccatggacctgctggactggagcagcctcatcgacagcaggaccaagctgtccaagcacctggtagtccccaacgcacaggtaacacctccgctcctcagtgaggcccagctcagcagggcgctgcgctaagaagggaattcagcctgccacgtgtgtctcttgttgcctaccctgggaacttaacatgaccaaaatcactgcacactatggccccacagaccccctgtggtccagggggaagaagacaagcccactagtgtccacagagtgcttggcgggacagagacccacgcggagccttaagacaccacaaggagagggggtctgggggccttccccaagtcatctgtcttgtgcatcaggtcaccccaaacttcagaggcctgaaacggcagcagccactctgcttctgcctcatggttctggggttgacagggctcagctgggcagtcctcccctggggtctcctgggtagctgtactcacagagtggtggcgctgggacctgggggaggcacccattcacatgtctgggagttggtgctggctgtggcttgggctttttcccaacatggcagctgggctctaagggccagtgtcacctgagacgtgagagccaggcagaagctgggtgaccttttcctgcctcgcctcagaagtcacacggtgtcttttctggcaagttctgtttgttagaagcatgtcaccaggccagcctgtatacagcggggagaggaatgagactcatctgcctgtgggaggggggcccaggacctggcagactgcttgaaaccacagcttaaactgggattcaaagaaagaacagaagcaccttcagaaaacatcctgcagaggcagctttccatgacacatctagccccagtccactaagggcccagcctcaaacttagagcccccgacccagagcctcggggcgcagtgcgtacagtgtggctgtgcaccaaggccaccagctgttggagactttagcatggtgtagcaagggatagagtggtactgtttgtgcccagtgaggcaaggctgctggggccagcaaaggggtgagcgggaggccctgcgggatgggtccccacggcctctgagcaccagcaacttgaaggcctcatcctggtggttgccctggtccctggctacgtgtcagcacgtgctgcacaactgccctgtctgcctgtagccaggggtcttcctcctgggccctctgcctgctccgggtggagcccttctgtttgacgattgggtgatcagtgttcacttgttcaatgtcacatgggagttgcagggggctctcccacaacggtggggcctctgtgggaactggggagtacacacttcggagtgcaggcctggactgagcctggggcccactgacatgggcactgagctccctcgtggtacccctaggccccgcatagggcagtgcactggctgcgttggaggttcaggggcactgtgctgcttgtccaggtggccctccctcccagccctgcacngacgggtgagagggttcctgtgggctgggaatactgagagaggtttagcctgggcctcagggtggcactttcccgcccttgctgtggcctgaccgcgtgttgcacccccagacaggacagctggagcccctgctgtcccggttcactgaggaggaggagctacagatgaccaggatgctacagcggatggatgtcctggccaaggtgagctgtcccgctcgggcagagggtacctgggactcgtggagaagagggcacctgcctcacttgagcaacagttgctcccactctcccaccccctgcgcctctcagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgcttcgcactgcgcaggatggaggagctgggcctgcatcctgctgaccaccaggtgtactttggacagctgctaggcatgtgtgaccagatcagcttcccgctgggccaggccggctaccccgtgtacaagtacgtgccctatggccccgtgatggaggtgctgccctacttgtcccgccgtgccctggagaacagcagcctcatgaagggcacccatcgggagcggcagttgctgtggctggagctcttgaggcggctccgaactggcaacctcttccatcgccctgcctagcacccgccagcacaccctcagcctccagcaccccccgcccccgcccaggccatcaccacagctgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtgggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgc

SEQ ID NO: 42782 - DNA, 1526 bp, Homo sapiens
aatatttatatttcctctgtcttttaaaactgaacaccgaggtgggttttgtggtgggtggtgaacggacaggtttgggcctcgatcccccacccgaccctagcacccacaggtgggggtgccccctctgctgatgcgcctcctccctcagcaccatggacctgctggactggagcagcctcatcgacagcaggaccaagctgtccaagcacctggtagtccccaacgcacagacaggacagctggagcccctgctgtcccggttcactgaggaggaggagctacagatgaccaggatgctacagcggatggatgtcctggccaaggtgagctgtcccgctcgggcagagggtacctgggactcgtggagaagagggcacctgcctcacttgagcaacagttgctcccactctcccaccccctgcgcctctcagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgcttcgcactgcgcaggatggaggagctgggcctgcatcctgctgaccaccaggtgtactttggacagctgctaggcatgtgtgaccagatcagcttcccgctgggccaggccggctaccccgtgtacaagtacgtgccctatggccccgtgatggaggtgctgccctacttgtcccgccgtgccctggagaacagcagcctcatgaagggcacccatcgggagcggcagttgctgtggctggagctcttgaggcggctccgaactggcaacctcttccatcgccctgcctagcacccgccagcacaccctcagcctccagcaccccccgcccccgcccaggccatcaccacagctgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtgggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgc

SEQ ID NO: 42783 - DNA, 3801 bp, Homo sapiens
  misc_feature (2647)..(2647): n is a, c, g, or t
ggtctcactctgttgctgtcttcacggagagcaggagcagaggctttgagaagccagtgggccttggcctcagccctgccggcagagggtccccaccatgcagctgaagtgccagggtgcttgtgaagtctaagcccttgtctggcatttgtcaggaatataggcgcacacttaagcggcccgggcgggtaccgccgtcccgccatggctctgaggcgcgccctgcccgcgctgcgcccctgcattccccgcttcgtccagctgtccacggcgccggcctcccgcgagcagcccgcagcgggcccagcggccgtgccaggaggtgggtcggccacggcagtgcggccgccggtgcccgccgtggacttcggcaacgcgcaggaggcgtaccgcagccggcgaacctgggagctggcgcggagcctgctggtgctgcgcttgtgcgcctggcccgcgctgctggcgcgccacgagcagctgctgtatgtttccaggaaacttctaggacagaggctattcaacaagctcatgaagatgaccttctatgggcattttgtagccggggaggaccaggagtccatccagcccctgcttcggcactacagggccttcggtgtcagcgccatcctggactatggagtggaggaggacctgagccccgaggaggcagagcacaaggagatggagtcctgcacctcagctgcggagagggatggcagtggcacgaataagcgggacaagcaataccaggcccaccgggccttcggggaccgcaggaatggtgtcatcagtgcccgcacctacttctacgccaatgaggccaagtgcgacagccacatggagacattcttgcgctgcatcgaagcctcaggtagagtcagcgatgacggcttcatagccattaagctcacagcactggggagaccccagtttctgctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagggctgagattgaggactggttcacggcagagaccctgggagtgtctggcaccatggacctgctggactggagcagcctcatcgacagcaggaccaagctgtccaagcacctggtagtccccaacgcacaggtaacacctccgctcctcagtgaggcccagctcagcagggcgctgcgctaagaagggaattcagcctgccacgtgtgtctcttgttgcctaccctgggaacttaacatgaccaaaatcactgcacactatggccccacagaccccctgtggtccagggggaagaagacaagcccactagtgtccacagagtgcttggcgggacagagacccacgcggagccttaagacaccacaaggagagggggtctgggggccttccccaagtcatctgtcttgtgcatcaggtcaccccaaacttcagaggcctgaaacggcagcagccactctgcttctgcctcatggttctggggttgacagggctcagctgggcagtcctcccctggggtctcctgggtagctgtactcacagagtggtggcgctgggacctgggggaggcacccattcacatgtctgggagttggtgctggctgtggcttgggctttttcccaacatggcagctgggctctaagggccagtgtcacctgagacgtgagagccaggcagaagctgggtgaccttttcctgcctcgcctcagaagtcacacggtgtcttttctggcaagttctgtttgttagaagcatgtcaccaggccagcctgtatacagcggggagaggaatgagactcatctgcctgtgggaggggggcccaggacctggcagactgcttgaaaccacagcttaaactgggattcaaagaaagaacagaagcaccttcagaaaacatcctgcagaggcagctttccatgacacatctagccccagtccactaagggcccagcctcaaacttagagcccccgacccagagcctcggggcgcagtgcgtacagtgtggctgtgcaccaaggccaccagctgttggagactttagcatggtgtagcaagggatagagtggtactgtttgtgcccagtgaggcaaggctgctggggccagcaaaggggtgagcgggaggccctgcgggatgggtccccacggcctctgagcaccagcaacttgaaggcctcatcctggtggttgccctggtccctggctacgtgtcagcacgtgctgcacaactgccctgtctgcctgtagccaggggtcttcctcctgggccctctgcctgctccgggtggagcccttctgtttgacgattgggtgatcagtgttcacttgttcaatgtcacatgggagttgcagggggctctcccacaacggtggggcctctgtgggaactggggagtacacacttcggagtgcaggcctggactgagcctggggcccactgacatgggcactgagctccctcgtggtacccctaggccccgcatagggcagtgcactggctgcgttggaggttcaggggcactgtgctgcttgtccaggtggccctccctcccagccctgcacngacgggtgagagggttcctgtgggctgggaatactgagagaggtttagcctgggcctcagggtggcactttcccgcccttgctgtggcctgaccgcgtgttgcacccccagacaggacagctggagcccctgctgtcccggttcactgaggaggaggagctacagatgaccaggatgctacagcggatggatgtcctggccaaggtgagctgtcccgctcgggcagagggtacctgggactcgtggagaagagggcacctgcctcacttgagcaacagttgctcccactctcccaccccctgcgcctctcagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgcttcgcactgcgcaggatggaggagctgggcctgcatcctgctgaccaccaggtgtactttggacagctgctaggcatgtgtgaccagatcagcttcccgctggtgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtgggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgc

SEQ ID NO: 42784 - DNA, 2961 bp, Homo sapiens
  misc_feature (1665)..(1665): n is a, c, g, or t
aatatttatatttcctctgtcttttaaaactgaacaccgaggtgggttttgtggtgggtggtgaacggacaggtttgggcctcgatcccccacccgaccctagcacccacaggtgggggtgccccctctgctgatgcgcctcctccctcagcaccatggacctgctggactggagcagcctcatcgacagcaggaccaagctgtccaagcacctggtagtccccaacgcacaggtaacacctccgctcctcagtgaggcccagctcagcagggcgctgcgctaagaagggaattcagcctgccacgtgtgtctcttgttgcctaccctgggaacttaacatgaccaaaatcactgcacactatggccccacagaccccctgtggtccagggggaagaagacaagcccactagtgtccacagagtgcttggcgggacagagacccacgcggagccttaagacaccacaaggagagggggtctgggggccttccccaagtcatctgtcttgtgcatcaggtcaccccaaacttcagaggcctgaaacggcagcagccactctgcttctgcctcatggttctggggttgacagggctcagctgggcagtcctcccctggggtctcctgggtagctgtactcacagagtggtggcgctgggacctgggggaggcacccattcacatgtctgggagttggtgctggctgtggcttgggctttttcccaacatggcagctgggctctaagggccagtgtcacctgagacgtgagagccaggcagaagctgggtgaccttttcctgcctcgcctcagaagtcacacggtgtcttttctggcaagttctgtttgttagaagcatgtcaccaggccagcctgtatacagcggggagaggaatgagactcatctgcctgtgggaggggggcccaggacctggcagactgcttgaaaccacagcttaaactgggattcaaagaaagaacagaagcaccttcagaaaacatcctgcagaggcagctttccatgacacatctagccccagtccactaagggcccagcctcaaacttagagcccccgacccagagcctcggggcgcagtgcgtacagtgtggctgtgcaccaaggccaccagctgttggagactttagcatggtgtagcaagggatagagtggtactgtttgtgcccagtgaggcaaggctgctggggccagcaaaggggtgagcgggaggccctgcgggatgggtccccacggcctctgagcaccagcaacttgaaggcctcatcctggtggttgccctggtccctggctacgtgtcagcacgtgctgcacaactgccctgtctgcctgtagccaggggtcttcctcctgggccctctgcctgctccgggtggagcccttctgtttgacgattgggtgatcagtgttcacttgttcaatgtcacatgggagttgcagggggctctcccacaacggtggggcctctgtgggaactggggagtacacacttcggagtgcaggcctggactgagcctggggcccactgacatgggcactgagctccctcgtggtacccctaggccccgcatagggcagtgcactggctgcgttggaggttcaggggcactgtgctgcttgtccaggtggccctccctcccagccctgcacngacgggtgagagggttcctgtgggctgggaatactgagagaggtttagcctgggcctcagggtggcactttcccgcccttgctgtggcctgaccgcgtgttgcacccccagacaggacagctggagcccctgctgtcccggttcactgaggaggaggagctacagatgaccaggatgctacagcggatggatgtcctggccaagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgcttcgcactgcgcaggatggaggagctgggcctgcatcctgctgaccaccaggtgtactttggacagctgctaggcatgtgtgaccagatcagcttcccgctgggccaggccggctaccccgtgtacaagtacgtgccctatggccccgtgatggaggtgctgccctacttgtcccgccgtgccctggagaacagcagcctcatgaagggcacccatcgggagcggcagttgctgtggctggagctcttgaggcggctccgaactggcaacctcttccatcgccctgcctagcacccgccagcacaccctcagcctccagcaccccccgcccccgcccaggccatcaccacagctgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtgggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgc

SEQ ID NO: 42785 - DNA, 4145 bp, Homo sapiens
  misc_feature (2647)..(2647): n is a, c, g, or t
ggtctcactctgttgctgtcttcacggagagcaggagcagaggctttgagaagccagtgggccttggcctcagccctgccggcagagggtccccaccatgcagctgaagtgccagggtgcttgtgaagtctaagcccttgtctggcatttgtcaggaatataggcgcacacttaagcggcccgggcgggtaccgccgtcccgccatggctctgaggcgcgccctgcccgcgctgcgcccctgcattccccgcttcgtccagctgtccacggcgccggcctcccgcgagcagcccgcagcgggcccagcggccgtgccaggaggtgggtcggccacggcagtgcggccgccggtgcccgccgtggacttcggcaacgcgcaggaggcgtaccgcagccggcgaacctgggagctggcgcggagcctgctggtgctgcgcttgtgcgcctggcccgcgctgctggcgcgccacgagcagctgctgtatgtttccaggaaacttctaggacagaggctattcaacaagctcatgaagatgaccttctatgggcattttgtagccggggaggaccaggagtccatccagcccctgcttcggcactacagggccttcggtgtcagcgccatcctggactatggagtggaggaggacctgagccccgaggaggcagagcacaaggagatggagtcctgcacctcagctgcggagagggatggcagtggcacgaataagcgggacaagcaataccaggcccaccgggccttcggggaccgcaggaatggtgtcatcagtgcccgcacctacttctacgccaatgaggccaagtgcgacagccacatggagacattcttgcgctgcatcgaagcctcaggtagagtcagcgatgacggcttcatagccattaagctcacagcactggggagaccccagtttctgctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagggctgagattgaggactggttcacggcagagaccctgggagtgtctggcaccatggacctgctggactggagcagcctcatcgacagcaggaccaagctgtccaagcacctggtagtccccaacgcacaggtaacacctccgctcctcagtgaggcccagctcagcagggcgctgcgctaagaagggaattcagcctgccacgtgtgtctcttgttgcctaccctgggaacttaacatgaccaaaatcactgcacactatggccccacagaccccctgtggtccagggggaagaagacaagcccactagtgtccacagagtgcttggcgggacagagacccacgcggagccttaagacaccacaaggagagggggtctgggggccttccccaagtcatctgtcttgtgcatcaggtcaccccaaacttcagaggcctgaaacggcagcagccactctgcttctgcctcatggttctggggttgacagggctcagctgggcagtcctcccctggggtctcctgggtagctgtactcacagagtggtggcgctgggacctgggggaggcacccattcacatgtctgggagttggtgctggctgtggcttgggctttttcccaacatggcagctgggctctaagggccagtgtcacctgagacgtgagagccaggcagaagctgggtgaccttttcctgcctcgcctcagaagtcacacggtgtcttttctggcaagttctgtttgttagaagcatgtcaccaggccagcctgtatacagcggggagaggaatgagactcatctgcctgtgggaggggggcccaggacctggcagactgcttgaaaccacagcttaaactgggattcaaagaaagaacagaagcaccttcagaaaacatcctgcagaggcagctttccatgacacatctagccccagtccactaagggcccagcctcaaacttagagcccccgacccagagcctcggggcgcagtgcgtacagtgtggctgtgcaccaaggccaccagctgttggagactttagcatggtgtagcaagggatagagtggtactgtttgtgcccagtgaggcaaggctgctggggccagcaaaggggtgagcgggaggccctgcgggatgggtccccacggcctctgagcaccagcaacttgaaggcctcatcctggtggttgccctggtccctggctacgtgtcagcacgtgctgcacaactgccctgtctgcctgtagccaggggtcttcctcctgggccctctgcctgctccgggtggagcccttctgtttgacgattgggtgatcagtgttcacttgttcaatgtcacatgggagttgcagggggctctcccacaacggtggggcctctgtgggaactggggagtacacacttcggagtgcaggcctggactgagcctggggcccactgacatgggcactgagctccctcgtggtacccctaggccccgcatagggcagtgcactggctgcgttggaggttcaggggcactgtgctgcttgtccaggtggccctccctcccagccctgcacngacgggtgagagggttcctgtgggctgggaatactgagagaggtttagcctgggcctcagggtggcactttcccgcccttgctgtggcctgaccgcgtgttgcacccccagacaggacagctggagcccctgctgtcccggttcactgaggaggaggagctacagatgaccaggatgctacagcggatggatgtcctggccaaggtgagctgtcccgctcgggcagagggtacctgggactcgtggagaagagggcacctgcctcacttgagcaacagttgctcccactctcccaccccctgcgcctctcagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgcttcgcactgcgcaggatggaggagctgggcctgcatcctgctgaccaccaggtgtactttggacagctgctaggcatgtgtgaccagatcagcttcccgctgggccaggccggctaccccgtgtacaagtacgtgccctatggccccgtgatggaggtgctgccctacttgtcccgccgtgccctggagaacagcagcctcatgaagggcacccatcgggagcggcagttgctgtggctggagctcttgaggcggctccgaactggcaacctcttccatcgccctgcctagcacccgccagcacaccctcagcctccagcaccccccgcccccgcccaggccatcaccacagctgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtgggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgcagctgagagccctttgccctcacacagggtcagctctgggcaacaaagagggagtggctcagacagggtcagagaagtctcatcccagactctg

SEQ ID NO: 42786 - DNA, 3564 bp, Homo sapiens
  misc_feature (2160)..(2160): n is a, c, g, or t
agctggggccagtcgtgcagaagccatgcccaccttgtggccgggatggagtggggactaggaaggcaccagccggggaggaccaggagtccatccagcccctgcttcggcactacagggccttcggtgtcagcgccatcctggactatggagtggaggaggacctgagccccgaggaggcagagcacaaggagatggagtcctgcacctcagctgcggagagggatggcagtggcacgaataagcgggacaagcaataccaggcccaccgggccttcggggaccgcaggaatggtgtcatcagtgcccgcacctacttctacgccaatgaggccaagtgcgacagccacatggagacattcttgcgctgcatcgaagcctcaggtagagtcagcgatgacggcttcatagccattaagctcacagcactggggagaccccagtttctgctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagggctgagattgaggactggttcacggcagagaccctgggagtgtctggcaccatggacctgctggactggagcagcctcatcgacagcaggaccaagctgtccaagcacctggtagtccccaacgcacaggtaacacctccgctcctcagtgaggcccagctcagcagggcgctgcgctaagaagggaattcagcctgccacgtgtgtctcttgttgcctaccctgggaacttaacatgaccaaaatcactgcacactatggccccacagaccccctgtggtccagggggaagaagacaagcccactagtgtccacagagtgcttggcgggacagagacccacgcggagccttaagacaccacaaggagagggggtctgggggccttccccaagtcatctgtcttgtgcatcaggtcaccccaaacttcagaggcctgaaacggcagcagccactctgcttctgcctcatggttctggggttgacagggctcagctgggcagtcctcccctggggtctcctgggtagctgtactcacagagtggtggcgctgggacctgggggaggcacccattcacatgtctgggagttggtgctggctgtggcttgggctttttcccaacatggcagctgggctctaagggccagtgtcacctgagacgtgagagccaggcagaagctgggtgaccttttcctgcctcgcctcagaagtcacacggtgtcttttctggcaagttctgtttgttagaagcatgtcaccaggccagcctgtatacagcggggagaggaatgagactcatctgcctgtgggaggggggcccaggacctggcagactgcttgaaaccacagcttaaactgggattcaaagaaagaacagaagcaccttcagaaaacatcctgcagaggcagctttccatgacacatctagccccagtccactaagggcccagcctcaaacttagagcccccgacccagagcctcggggcgcagtgcgtacagtgtggctgtgcaccaaggccaccagctgttggagactttagcatggtgtagcaagggatagagtggtactgtttgtgcccagtgaggcaaggctgctggggccagcaaaggggtgagcgggaggccctgcgggatgggtccccacggcctctgagcaccagcaacttgaaggcctcatcctggtggttgccctggtccctggctacgtgtcagcacgtgctgcacaactgccctgtctgcctgtagccaggggtcttcctcctgggccctctgcctgctccgggtggagcccttctgtttgacgattgggtgatcagtgttcacttgttcaatgtcacatgggagttgcagggggctctcccacaacggtggggcctctgtgggaactggggagtacacacttcggagtgcaggcctggactgagcctggggcccactgacatgggcactgagctccctcgtggtacccctaggccccgcatagggcagtgcactggctgcgttggaggttcaggggcactgtgctgcttgtccaggtggccctccctcccagccctgcacngacgggtgagagggttcctgtgggctgggaatactgagagaggtttagcctgggcctcagggtggcactttcccgcccttgctgtggcctgaccgcgtgttgcacccccagacaggacagctggagcccctgctgtcccggttcactgaggaggaggagctacagatgaccaggatgctacagcggatggatgtcctggccaaggtgagctgtcccgctcgggcagagggtacctgggactcgtggagaagagggcacctgcctcacttgagcaacagttgctcccactctcccaccccctgcgcctctcagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgcttcgcactgcgcaggatggaggagctgggcctgcatcctgctgaccaccaggtgtactttggacagctgctaggcatgtgtgaccagatcagcttcccgctgggccaggccggctaccccgtgtacaagtacgtgccctatggccccgtgatggaggtgctgccctacttgtcccgccgtgccctggagaacagcagcctcatgaagggcacccatcgggagcggcagttgctgtggctggagctcttgaggcggctccgaactggcaacctcttccatcgccctgcctagcacccgccagcacaccctcagcctccagcaccccccgcccccgcccaggccatcaccacagctgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtgggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgc

SEQ ID NO: 42787 - DNA, 1276 bp, Homo sapiens
ggtctcactctgttgctgtcttcacggagagcaggagcagaggctttgagaagccagtgggccttggcctcagccctgccggcagagggtccccaccatgcagctgaagtgccagggtgcttgtgaagtctaagcccttgtctggcatttgtcaggaatataggcgcacacttaagcggcccgggcgggtaccgccgtcccgccatggctctgaggcgcgccctgcccgcgctgcgcccctgcattccccgcttcgtccagctgtccacggcgccggcctcccgcgagcagcccgcagcgggcccagcggccgtgccaggaggtgggtcggccacggcagtgcggccgccggtgcccgccgtggacttcggcaacgcgcaggaggcgtaccgcagccggcgaacctgggagctggcgcggagcctgctggtgctgcgcttgtgcgcctggcccgcgctgctggcgcgccacgagcagctgctgtatgtttccaggaaacttctaggacagaggctattcaacaagctcatgaagatgaccttctatgggcattttgtagccggggaggaccaggagtccatccagcccctgcttcggcactacagggccttcggtgtcagcgccatcctggactatggagtggaggaggacctgagccccgaggaggcagagcacaaggagatggagtcctgcacctcagctgcggagagggatggcagtggcacgaataagcgggacaagcaataccaggcccaccgggccttcggggaccgcaggaatggtgtcatcagtgcccgcacctacttctacgccaatgaggccaagtgcgacagccacatggagacattcttgcgctgcatcgaagcctcaggtagagtcagcgatgacggcttcatagccattaagctcacagcactggggagaccccagtttctgctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagggctgagattgaggactggttcacggcagagaccctgggagtgtctggcaccatggacctgctggactggagcagcctcatcgacagcaggaccaagctgtccaagcacctggtagtccccaacgcacagacaggacagctgagccctgctgtcccgttcactgagggatcttctgtcaacggtaccgaca

SEQ ID NO: 42788 - DNA, 134 bp, Homo sapiens
aaattcatatatgaatgcaagatgtgtggcaatggtggcattaaaagccggtggggaaagtatgggttgctcagtacatggtggtaggacaattggttatccatatgggaaaaagtaaaattagatcctggtga

SEQ ID NO: 42789 - DNA, 374 bp, Homo sapiens
gatttttttaaaaaactcaaaccaaatatgaataattttaatgtcctcattaagcatcaaggaaggaacttgttacagtgttacaattttacctaatctgcattaggttgcaaagttatctaatgcagatttcaaaaggtttctagtcactatacatcaggatgaaattggagaactttggagttgcattctttaattttatgtgtcaacttgcctgtgccacccagtgtccagattaaacattatttctgagcgtgtctgaaagggcatttccagaggagattagcattgcaattggtggacttggatttccttcccaatgtggttggacatcatccaacccattgaggcctgaataggatgaaaaggcaaag

SEQ ID NO: 42790 - DNA, 415 bp, Homo sapiens
agaaagtggaagaattgtcagacggtgttgagtaagtatttgaggttggtgattccgctttgcacaatggaaacagctctctgcttttgtttagccttgcttggtgggggcagtggcagggtccatcaaaggcttcaggtttgccagagaattccaaggcagggaaagacatggaagtgtggccattacagcactgatacacagagaaaaaggttggaatccatgggatgaaagtcttgaaaaactttccatgagggatccttgagaaaataaaatagaagaagcactcatccattcaacaaatagttattagcatcaatcatgtgccaaattatcttttacatctggagaaaccacactgcagaaaaaaggaaaagaaaaccccttgtgtttacagagcttatggtctagctaa

SEQ ID NO: 42791 - DNA, 313 bp, Homo sapiens
gtttgactctggcagcctaatgtccagagtccctaatttggtgttggggtgatgagcacttttgctcctgtgtttgagcaaggcctgcccagggcctggtactacctgaggagccccttctactggcacaacagcctgggggcgtgggtgccagtgccctttggatagccttgacttgcccaaggtcagcccaaggccagggagtatctggaggctctggcatatttgcatacaaaaggctgtttgccttggaatttgtgctgggaatggagcttagtctggcaccctgtgctcttgttcatcctgcctggcc

SEQ ID NO: 42792 - DNA, 798 bp, Homo sapiens
agaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatatggctatttcccttataactcaatagtaccttaacacaaagtataactctgtagagttggtgaatattttagggaaatattagcaaaatgcatgtagtaaagacatcttatgaaaactgtattcatggaatttgatttagcatgctcaagcgacggccagcgaaaccgtat

SEQ ID NO: 42793 - DNA, 737 bp, Homo sapiens
ttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatatggctatttcccttataactcaatagtaccttaacacaaagtataactctgtagagttggtgaatattttagggaaatattagcaaaatgcatgtagtaaagacatcttatgaaaactgtattcatggaatttgatttagcatgctcagttgccagttcccattatcgatactctttctatgcagaataccttagaaccgttatttccctcagtgtagattgctcttaaaatgtattcagttatttagtggcccc

SEQ ID NO: 42794 - DNA, 262 bp, Homo sapiens
gcgggtgtgatggctcatgcctgtaatcccagctcttagggaggcagaggtgggagaatagcttgagcccaggcaggtcaaatgaggtccttagggaagaccctaatctaatatcactgatatccttacaaaaaggggaagtctggaaacagagagctacagggagaatgccatgtgaccatgaagatggccatctacaagccatagagggaggcctggaacatatcctgccttcgcagccctcagaaagaaccagccctac

SEQ ID NO: 42795 - DNA, 792 bp, Homo sapiens
gcacattcctcgcattctaggattgagatacacagtttggttcttgtgagggcagccagggctggggaggagggcagagaacatcccagagatcaagactgctcttcttgctccctccccgactgacttggcccacactgactggcctgccacccctttacagtgatctccacccagtctctctctgcaaaggcctcccttggctctctgataaagttggagctgtgggtgcagcatttcacttggacctagcagcatcaatgagccagctcctcactggggaacatgcaaacccccagctgctggtgtgcaggaaaagaatccaggagatcacctgatgaagcccagcattttacagagcaaagtggtgaaaggaccctggtgagaggcccaaagaacaggaggtgtgagccaagagaaggtcctgccaggcctatgttgcaggctatttggaggctgaacttgaggaagacagatgtcagctttctgaagaaagtgtcaagcatttgtcccttacaaggactgggaagaaagagcatacattttccccgttgcctgcccttgacatatttataacatcccaggactggcactgaccatcctctcccaagtaacggaatgtcaagatgactgcagagattatgctgtgagtagaaaagctttatagtaagccgaggtgatcaccagcctccctgagctaaaataatcacagactttttttcttagtgacccctgtcctactctcaggcaccttatatcctcaaatcttaaatagagttaagagattgggca

SEQ ID NO: 42796 - DNA, 703 bp, Homo sapiens
gcacattcctcgcattctaggattgagatacacagtttggttcttgtgagggcagccagggctggggaggagggcagagaacatcccagagatcaagactgctcttcttgctccctccccgactgacttggcccacactgactggcctgccacccctttacagtgatctccacccagtctctctctgcaaaggcctcccttggctctctgataaagttggagctgtgggtgcagcatttcacttggacctagcagcatcaatgagccagctcctcactggggaacatgcaaacccccagctgctggtgtgcaggaaaagaatccaggagatcacctgatgaagcccagcattttacagataggcagtggagcaggggaatccagttgacactgtggctaaatttcagaaaacctcccatgagatcttgcaaaggagatggagaaaatatggctgaatgccagcaaggtaggacggaagcatgactgctctaacaaccaagctcaaagagcactgctcacccaatgtttccttcatgactagagcaaagtggtgaaaggaccctggtgagaggcccaaagaacaggaggtgtgagccaagagaaggtcctgccaggcctatgttgcaggctatttggaggctgaacttgaggtcagtatcaccagcatttttaggacggcagtggcctgatcaagtttatattc

SEQ ID NO: 42797 - DNA, 758 bp, Homo sapiens
gcacattcctcgcattctaggattgagatacacagtttggttcttgtgagggcagccagggctggggaggagggcagagaacatcccagagatcaagactgctcttcttgctccctccccgactgacttggcccacactgactggcctgccacccctttacagtgatctccacccagtctctctctgcaaaggcctcccttggctctctgataaagttggagctgtgggtgcagcatttcacttggacctagcagcatcaatgagccagctcctcactggggaacatgcaaacccccagctgctggtgtgcaggaaaagaatccaggagatcacctgatgaagcccagcattttacagataggcagtggagcaggggaatccagttgacactgtggctaaatttcagaaaacctcccatgagatcttgcaaaggagatggagaaaatatggctgaatgccagcaagagcaaagtggtgaaaggaccctggtgagaggcccaaagaacaggaggtgtgagccaagagaaggtcctgccaggcctatgttgcaggctatttggaggctgaacttgaggttgaggcagaattaactgttgcatgagatgtggggtatgggagaaggcctgagtacctagaaggattgggatgccatgaactgacagaggttgtgtaatagtgtgatataataagaaatacatggtgggcatggtggctcaagcctgtaatcccagcaccttggccaccactgcaggaccat

SEQ ID NO: 42798 - DNA, 730 bp, Homo sapiens
gcacattcctcgcattctaggattgagatacacagtttggttcttgtgagggcagccagggctggggaggagggcagagaacatcccagagatcaagactgctcttcttgctccctccccgactgacttggcccacactgactggcctgccacccctttacagtgatctccacccagtctctctctgcaaaggcctcccttggctctctgataaagttggagctgtgggtgcagcatttcacttggacctagcagcatcaatgagccagctcctcactggggaacatgcaaacccccagctgctggtgtgcaggaaaagaatccaggagatcacctgatgaagcccagcattttacaggccaatgaagatacacaggctttccatggcgcacatgagggaggacatggacttgagaattgtgaggcttgaagaatcctcagagatcacctagcataacaggaaaccaaggatttggagggaaaaatcttgtcgcagatcacacagaaatatcagggcctggtttgaatcttacctctgccccaaccagttgtgtgaccttgagaaagtgaagatcttttttgttcattggtttcctcatctgtaaaatagggatttaattttacctgcctcagaagattgtagtgaggattaaatgaggtgataaaactataatgtttaggacagtaaattgtatgtaatataatattaataaatattagccattattaa

SEQ ID NO: 42799 - DNA, 975 bp, Homo sapiens
gcacattcctcgcattctaggattgagatacacagtttggttcttgtgagggcagccagggctggggaggagggcagagaacatcccagagatcaagactgctcttcttgctccctccccgactgacttggcccacactgactggcctgccacccctttacagtgatctccacccagtctctctctgcaaaggcctcccttggctctctgataaagttggagctgtgggtgcagcatttcacttggacctagcagcatcaatgagccagctcctcactggggaacatgcaaacccccagctgctggtgtgcaggaaaagaatccaggagatcacctgatgaagcccagcattttacagataggcagtggagcaggggaatccagttgacactgtggctaaatttcagaaaacctcccatgagatcttgcaaaggagatggagaaaatatggctgaatgccagcaaggtaggacggaagcatgactgctctaacaaccaagctcaaagagcactgctcacccaatgtttccttcatgactagagcaaagtggtgaaaggaccctggtgagaggcccaaagaacaggaggtgtgagccaagagaaggtcctgccaggcctatgttgcaggctatttggaggctgaacttgaggaagacagatgtcagctttctgaagaaagtgtcaagcatttgtcccttacaaggactgggaagaaagagcatacattttccccgttgcctgcccttgacatatttataacatcccaggactggcactgaccatcctctcccaagtaacggaatgtcaagatgactgcagagattatgctgtgagtagaaaagctttatagtaagccgaggtgatcaccagcctccctgagctaaaataatcacagactttttttcttagtgacccctgtcctactctcaggcaccttatatcctcaaatcttaaatagagttaagagattgggca

SEQ ID NO: 42800 - DNA, 812 bp, Homo sapiens
gcacattcctcgcattctaggattgagatacacagtttggttcttgtgagggcagccagggctggggaggagggcagagaacatcccagagatcaagactgctcttcttgctccctccccgactgacttggcccacactgactggcctgccacccctttacagtgatctccacccagtctctctctgcaaaggcctcccttggctctctgataaagttggagctgtgggtgcagcatttcacttggacctagcagcatcaatgagccagctcctcactggggaacatgcaaacccccagctgctggtgtgcaggaaaagaatccaggagatcacctgatgaagcccagcattttacagataggcagtggagcaggggaatccagttgacactgtggctaaatttcagaaaacctcccatgagatcttgcaaaggagatggagaaaatatggctgaatgccagcaaggtaggacggaagcatgactgctctaacaaccaagctcaaagagcactgctcacccaatgtttccttcatgactagagcaaagtggtgaaaggaccctggtgagaggcccaaagaacaggaggtgtgagccaagagaaggtcctgccaggcctatgttgcaggctatttggaggctgaacttgagagtggctgtgagaggaaattcagaagtatctttggaagcattttgttaattttgagatgctggggacatcatcaaaatgaaaaacttttgtgcctcaaagaacaccatcaagaaactgaaaagacaacccaagaagacaaaatttgcaaatcttatatctga

SEQ ID NO: 42801 - DNA, 291 bp, Homo sapiens
actaagacttgtaaaacatcaggagttctcgtactaatggtctcagtatccctttatactcttaaaaattactgagaactccaaagagcttttaagtggaatgataggtagatagatagatagtaaatagatagatatctgtcattatttgccatatttgaaattgagactgataatatttaaaaattgttatcagttcatttaaaaataataataataaactcagaaaacttttgtgttgttataaaaattgttttaaaatcacagaacccttgaaatggtctgtcgacg

SEQ ID NO: 42802 - DNA, 429 bp, Homo sapiens
aaataatatctgatacactttttaaattattgcagatggaaaaattctatttcagcacagataaatagaaaaaattctattttaccgctgtcaaactgttgaagaaaagcagtattactgaaatggctcagtcataccagtttgaaggcactttgtccttaaatccagttattgctgtcagcgtcttcaaataggaatactcgactacagcaaagcccttacacctttaatacactgggaagcacttgggctttgccagccacaaacacattacttactgtgttaggctcacctccactttcttctcactaatcaaaagtagcacataactccttcgcatacatcattttcatgacctcaagccgatttactaagaaataaatttcttactcactttataaagaaatgtatgaagtatatgtatacata

SEQ ID NO: 42803 - DNA, 709 bp, Homo sapiens
gtaggaagttcattccagttctgcaaggtgtctgctttcagaatggagcccactttggtggtggcaaggcctggctgagttctttcaaagcaacatccaacttctctttgctctttgacttcctccagattctctcctgtgctggaggtaataagggttgcacttccctctttacttacactggtgaaacatgcagcgaggattcaaggtcaaaattgggtcaaagttaaactaacacagtctcctgccccacttacctgtcctctaaccccatccaccagccctaagtggtcatcacatgatcagaagtcagctgggggaagagcagggatagatagagcaattaaggagcctcttttggggtaagccacatgacaggggctttgcaacagtctttcatgagtggccgaaatcccccactcactgcaaatgtgcttctcaaagatgcaggattttttaataaacagaggaaatgataaattatgttgtaattccactccaaaggcatttggttcttaacagccaaatcctctgtagtctttaaataaacaaaaacttatttggtgaacagacagggaggaaaatgaaagattttctgtacttgggttccacatgtcaacaatttctctcctgtgtgtatgttggccaaagctgtatcatgataaatgaataaaggaaaacctcgagcccagggcagtcagacagctca

SEQ ID NO: 42804 - DNA, 1071 bp, Homo sapiens
gtgtatctgtgtattctttaccctcttggatgagtattgctttacattaagttcccagaagtataaattctagacccaaagaaatgtatatttttaactgaaaaggtgatgacaaattgttcttcagaaaaattacatgaaggctggacgcagtggctcatgcctgtaatcccagcattttgggaggctgaagcaggaggatcacttgaggtcaggaatttgagaccagcctggccaacatgtcaaaacccaatctctactaaaaataaagaaattagccaggtgtggtgatgggcatctgtaatcctagctattcaggaggctgaggcatgagaattgcttgaacccaggaggcagaggttgcagtgagctgagatcacacctctgcagtccagcctgggcaacagagtgagacttggtctcaaaaaaaaaaatgtatgaatgttcactcccacaaatagtattaacctgtttcccttatactgttcatcatcagtctcggcaacctgagataaatataatgatactttatgcttagtttagtttgcatttcttttattattagtgatgttgaccttctttttgtaagttaattctcaattttcttctgtggattatctgtttatatcctttgcccttttcctttaggtcttatcattcgttatattgatttgtaaaagcttctcgtatgttcaggatattagtgttgcaaatgtttgggcctttgttgatatttcttctgtgtccaattacagtttaaaattttatgtgataaaattgtaagtatttataattatggtcctttggtttcatctcatgcttagaaaggggttccccactccataattactaaaatatttattcatgccgggggcagtggctcacgcttgcaatcccagcactttgggaggccaaggtgggcggatcacttgaggtcgggagttcaaaaccagcctggacaacatggcgaaacctcatctctactaaaaatacaaaaattagctgggcacagtggtgggcgcttgtaatcccagctacttgggaagctgaggcaggagaatcatttgaacc

SEQ ID NO: 42805 - DNA, 454 bp, Homo sapiens
gacttaaatctatgttccctgtttcctggctgttgcattgtgtaggcccatttgatagttatactttgagattattgtaaacagaaggagttaacacagcttgctttggccagtgcttagctattaatacagtggtatctgtagggcctgtagtacctgccacagcctggaaagggggaccttagagcatgctagcctatgtaaactcagtattctggcccaacaacagccatcactgtgagtttcatctgtaatggctggctgcccatttctacctatactctgaataaccagagtgatactcccttctgagggttctcttgtatgacttcagaatgttccccaaactgaaagctcccgagtcaaagttcttacccattttctggcattctctgagtacaggctttctaaagcgtggggagaagtggatatgaagagctgagtactctctggg

SEQ ID NO: 42806 - DNA, 301 bp, Homo sapiens
ggcacgagcggcacgagcggcacgagtagaatattcatagcagcactgtttgtgcccaagactgcaagcagcctaaatccccataacatttttttacttggaaaaatatttatttagtatttattgtttgtttaattatttataagaacatttaatatgtgatctaccctcttagtgaatttttaaatttgcattatttttgactgtaggtacaatgttgtacagcagatctgtggagcttattcaacttgtttgactgaaactttatgccagctgatcagtaactccccatttcctcctc

SEQ ID NO: 42807 - DNA, 389 bp, Homo sapiens
atagtttccatcaattcttaaaagaagctgtatgtacaattcaagttcaccatcgttactggcatttggtctgataactggctactgttaatagtggcaaacagacttaaatacaggatactttacatatgacactttacctgcctcttttaaattttaaaattattctatttaaaataatctgacattataaatttctatgagtaaattatagaatggtctattaatttttcctttagtttgttgtgctttctgtggtcacagaaaatgctttagaaaaaataaaattattctagcccaggcacagtggctcatacctgtaatcccagcactttgggaggctgaggtgggcagaacacaaggtcaggagttcaagaccagcctggcca

SEQ ID NO: 42808 - DNA, 682 bp, Homo sapiens
atatcgtcgacccgcgccgtcggtgacacacagacctacttggaatggacaatgacagtaacacctatgtgacagctagtatcttgatataaagaacctattttagcatggcccatgggtctgtcggaagaaaaaaatgaatactaaccagtgaccattcaaccttaagaaatggggagagggagaagaggttgaaaatggtcacataaagcataatgaaatgaaaagaatgctttaggtggggacaacgggagtagaagtgttctgatgctactctatgtcatttgtttttacagaaatatcttgtgaagtcagggagtattcctttatcagcaaaaacttcacaattggtgttccagctgtggctgaccagctaaatagtttgaaagaaaaataatattttaaaataaagtttaaagagctttaaaagaaaaacatttaaaaaggaaaaaatcatttttaagattttaaaagaaaaaaacttttaaatgttgaaaaaaatttaagttgttatttttaaaagaaatattttaaaagttaaaaataattttttaatttaaagaagtttcagaattttaaaaattaaaagcaaagaaaattaaattcttaaagtttaaaaatgtaaaataaattaaggaacaaggttaaaaatgaaagtttaccaaaaaaggaagaaaatact

SEQ ID NO: 42809 - DNA, 1248 bp, Homo sapiens
agcacagtgagcagggatgaccacataccaggaatcccctcacttacagactgtctacagtggtttacaaggccagagcacctaggaagcagtgccaaaatcaaatgcaatagttgccaaagctaccaggagtctactaaacagctcacaatgaaaaaattacccattgtggcttgttttcatctcaagcggtttgagcatgtaggcaaacagaggcgaaagattaatacctttatctcctttcccttggagctggacatgactccgtttttggcctctactaaagagagcagaatgaaagaaggccagccaccaacagattgtgtgcccaatgagaataagtattccttgtttgcagtgattaatcaccatggaactttggaaagtggccactataccagcttcatccggcaacaaaaggaccagtggttcagctgtgatgatgccatcatcaccaaggctaccattgaggacttactctacagtgaagggtatttactgttctatcacaaacagggtctagagaaagactagtcttaccagaccacttactgaaaaaaaagtaaatgattaggcaaggattttgaagtgacacacagacctacttggaatggacaatgacagtaacacctatgtgacagctagtatcttgatataaagaacctattttagcatggcccatgggtctgtcggaagaaaaaaatgaatactaaccagtgaccattcaaccttaagaaatggggagagggagaagaggttgaaaatggtcacataaagcataatgaaatgaaaagaatgctttaggtggggacaacgggagtagaagtgttctgatgctactctatgtcatttgtttttacagaaatatcttgtgaagtcagggagtattcctttatcagcaaaaacttcacaattggtgttccagctgtggctgaccagctaaatagtttgaaagaaaaataatattttaaaataaagtttaaagagctttaaaagaaaaacatttaaaaaggaaaaaatcatttttaagattttaaaagaaaaaaacttttaaatgttgaaaaaaatttaagttgttatttttaaaagaaatattttaaaagttaaaaataattttttaatttaaagaagtttcagaattttaaaaattaaaagcaaagaaaattaaattcttaaagtttaaaaatgtaaaataaattaaggaacaaggttaaaaatgaaagtttaccaaaaaaggaagaaaatact

SEQ ID NO: 42810 - DNA, 423 bp, Homo sapiens
gtgaataagtctcatgagatctgatggttttacaaaggggagctcccctgcacatgccctctctcttgtctgccatgtaagatgtgcctttgcttttcctttgccttctatcatgattgtgagttctccccagccatgtggaaccgtgagttcactaaacctctttcttttataaattacccagtcttgggtatgtctttattagcagcatgagaacagactaatacacctgccaagaattttttctatattttggccagattgtatagttttttatggtgggagggtgaatctgacacaagctatttggtgtcaagtatccaagtcacatactaatttatttttaatgtaaagctatacaaccttctttctatacctaaatttttaattaaaatataataattaaaatattactaaaaattt

SEQ ID NO: 42811 - DNA, 684 bp, Homo sapiens
tattggccaggctggtcttgagctccagacctcaagtgatccacctgccttggcctcccgaagtgctgggttacctgtgagccactgcgcccagccaatatgcctttcttttaaattgccaactagagtgtgacaagaaagcctttggcctctcgtttgatcaggtttcttgaagaagcttttcgtgaaagatagagtggtagttatttatgtttcagagacttttaaaaaatccatacacaagtctttcaggatcttctcattccttttttagttatttcttttaaaaagtagtctgatatcttaccttacaggttggagaccctgatggattctgcatcgttttaggatttgcctctgattcttgctagtgttctcttttctgtcattatggggtttgccccgttttctctaatgtgctattcctgtgttttggttttgagttcttggttgcatgtgacctgactgcttctggagacagtacagtgcttgtcgtctctcagctgctgcttctgtgtctcaggagggctgagggctgccctccctcgggagcctccgtgcttcctcaggctttgctctttgttctgtacctctcttcacgttacctttgggtggtggttttcattcctgtgccgcctgcttctgggccagtgatccaggtgtctggtgaccacccgggcacag

SEQ ID NO: 42812 - DNA, 528 bp, Homo sapiens
gcagaatctcctgcctaggggatcagagcccagatgagtgcctctaaacagggctgaagagaaggctgcaggcctggaacagaggtgatagaattagatttcagctttgtgtctcagtgaaggaaacacaggcatccattaaaagcaccttcccttctggccttgctgctgcggagagcggcagcgtgcaaatccagcccctacctctcctcactcatctgttcacagcactgtggccttcagaacagtgtgtcagaaattaccttcttccataactgatcttcaggcctgaaaaggaaaaatttccaagcatagatctcctgaaatccctaaggagattgggcaaagagcctaaggaaaacaggactttgcatgttgttcctcatgcctacctaaaaatgctggttgcaccaggcaagtccttggttaatgcatcagtgaaatggattttgtagttcccagcacatgcactaatggaagtccctgcatgaatttcatgcctgcacttcttattggcaagagcagcgt

SEQ ID NO: 42813 - DNA, 333 bp, Homo sapiens
actggagctaattagcggctatccactttatatgaggtatgtgctcttcagttcaacatagtttccattacttcaccttcaaactatatccagaacccaaccattccacaccacttcactgttatctccttagttctaactgacatcacctctcacctggattattacaaattacctcttaacggaactctttgctttcttccattctccctttggggatatactcttaatataatggccagagtgatcctgttaaaagcctaagttattcatttatttaacaacatttattgagcacccttatataccagccacagttttagtgcttggaat

SEQ ID NO: 42814 - DNA, 432 bp, Homo sapiens
gactggtcatcttttacagctttgattcatgctcttagtttccagttttatatgtgcttaagcattataagacacctcagtatttttaggaaataagtggggacataaatataaacaacccggaaatcactgcccctagaattcacagagtggaagaaccaagctttttagggctgatgtggcgtgggctgggagacttctcttttgagaggctgatactggtctttgaatgaactctttaccccaccaaaagtagaaaaaggattccagtgacttcagaaatttttgttgttgttttgagaatgttggcaccactgggaataatgagagacgcctggcctattcaaaagtggcatcagaaacctcagtgttggaaatgcagcctttggttgtccatccccgcagctagagcatgagccccccaaggccaga

SEQ ID NO: 42815 - DNA, 388 bp, Homo sapiens
gtcctatagaagtctatatacagattcatttgattgttccatacactgtcttgcctgtaaatattaatttggatgttgatttttatttaatataaaaacagaaaaggggtcaggcgcggtggctcacacttgtagtcccaacactttgggaggccgaggcaggcggatcacttgacgccagcagtttgagaccagcctggccaacatggtgaaaccccatctctgctaaaaatacaaaaattaaccaggcatggtggtgcctgtaatcccagctactcgggaggctgaggcaggagaatcacttgaacctgggaggcggaggttgcagtgagccgagattgcgccactccagcctggacgacacagtgagaccctgtctcaaaaaaaa

SEQ ID NO: 42816 - DNA, 422 bp, Homo sapiens
tgtaatctaaaaatggtgatgctcaggaattaaaaataaattgaacccgctgtctgcaattcccttacattccctgcaacacacaatctcatcaactcttcaaggaaagactatacaagctctagaaagtgaagttctcaggtagcctccttcttttcctcccaccatttccaacctttggtagattaaaagggtaacttcctgtttttcattatctaaaatgaactgacctaatcagttggctctgtttctcattggagttttccttggttcttctcatttataaaaagaaatgcataataagaaatgcaaatttgggatgaaataacctgtaccataaacccccatgacacaagtttacctatataacaaacctagacatgtacccctgaacttaaaacaaaagttaaaaacaaacaaac

SEQ ID NO: 42817 - DNA, 433 bp, Homo sapiens
agaaaccccggaacagaactcgagttacctcaattccgttattctctcagagttttgtatttaaatttgaaacaacaaaggagaatgcaaactacaaagtataattaatgctgattggtaagtgcaagttttaattcatacatgaaatatcttactgaattattgttattattttttagagacagggtctcactttgtcatccaggctggagtgcagtgttgtgatcatggctcactgcagccttgatctcctgggctcaagccattccctgtctcagcctcctgagtagctaaggctacaggtacatgctaccatgcccaactaattaaaagaactttttggtagagatgtttgttcatttttgttttttgtttgtttgttttcagacagtctcactccagcctgggtaacaagagtgaaactccatctcga

SEQ ID NO: 42818 - DNA, 3389 bp, Homo sapiens
tctccctgcggacgggcgctgattggcccgtttgaaatgcgccaggcgggagctcacctgggctcttagcgtcgccgccggcttcgcagagcaccgcgccttagccgcgaagttctagttcttgctgccggtcctaacgtcccgcagtcttcgccagccagccgtcccgcatgcgcgtttgggcggcgtggagcctgctgccatgaagtcagcgagagctaagacaccccggaaacctaccgtgaaaaaagggtcccaaacgaaccttaaagacccagttggggtatactgtagggtgcgcccactgggctttcctgatcaagagtgttgcatagaagtgatcaataatacaactgttcagcttcatactcctgagggctacagactcaaccgaaatggagactataaggagactcagtattcatttaaacaagtatttggcactcacaccacccagaaggaactctttgatgttgtggctaatcccttggtcaatgacctcattcatggcaaaaatggtcttctttttacatatggtgtgacgggaagtggaaaaactcacacaatgactggttctccaggggaaggagggctgcttcctcgttgtttggacatgatctttaacagtatagggtcatttcaagctaaacgatatgttttcaaatctaatgataggaatagtatggatatacagtgtgaggttgatgccttattagaacgtcagaaaagagaagctatgcccaatccaaagacttcttctagcaaacgacaagtagatccagagtttgcagatatgataactgtacaagaattctgcaaagcagaagaggttgatgaagatagtgtctatggtgtatttgtctcttatattgaaatatataataattacatatatgatctattggaagaggtgccgtttgatcccataaaacccaaacctccacaatctaaattgcttcgtgaagataagaaccataacatgtatgttgcaggatgtacagaagttgaagtgaaatctactgaggaggcttttgaagttttctggagaggccagaaaaagagacgtattgctaatacccatttgaatcgtgagtccagccgttcccatagcgtgttcaacattaaattagttcaggctcccttggatgcagatggagacaatgtcttacaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccgtcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttactgaacctaaaactgagaagccagagagaccctctcgggagcgagatcgagaaaaagttactcaaagatctgtttctccatcacctgtgcctttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtagtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatgaactgacagtcccagtactgaaagaacattttcatttgtgtggatgatttctcgaaagccatgccagaagcagtcttccaggtcatcttgtagaactccagctttgttgaaaatcacggacctcagctacatcatacactgacccagagcaaagctttccctatggttccaaagacaactagtattcaacaaaccttgtatagtgtatgttttgccatatttaatattaatagcagaggaagactccttttttcatcactgtatgaattttttataatgtttttttaaaatatatttcatgtatacttataaactaattcacacaagtgtttgtcttagatgattaaggaagactatatctagatcatgtctgattttttattgtgacttctccagccctggtctgaatttcttaaggttttataaacaaatgctgctatttattagctgcaagaatgcactttagaactatttgacaattcagactttcaaaataaagatgtaaatgactggccaataataaccattttaggaaggtgttttgaattctgtatgtatatattcactttctgacatttagatatgccaaaagaattaaaatcaaaagcactaagaaa

SEQ ID NO: 42819 - DNA, 354 bp, Homo sapiens
tctccctgcggacgggcgctgattggcccgtttgaaatgcgccaggcgggagctcacctgggctcttagcgtcgccgccggcttcgcagagcaccgcgccttagccgcgaagttctagttcttgctgccggtcctaacgtcccgcagtcttcgccagccagccgtcccgcatgcgcgtttgggcggcgtggagcctgctgccatgaagtcagcgtgagtacgaggccgccgagcagggagagagggcggacgggggccgaggcctcggggctgggggcaggcgtctccactcagggggcaggcgtctccactcaggccgcggccgtacgcgggcagcgcggacagcatcccgcc

SEQ ID NO: 42820 - DNA, 3701 bp, Homo sapiens
tctccctgcggacgggcgctgattggcccgtttgaaatgcgccaggcgggagctcacctgggctcttagcgtcgccgccggcttcgcagagcaccgcgccttagccgcgaagttctagttcttgctgccggtcctaacgtcccgcagtcttcgccagccagccgtcccgcatgcgcgtttgggcggcgtggagcctgctgccatgaagtcagcgagagctaagacaccccggaaacctaccgtgaaaaaagggtcccaaacgaaccttaaagacccagttggggtatactgtagggtgcgcccactgggctttcctgatcaagagtgttgcatagaagtgatcaataatacaactgttcagcttcatactcctgagggctacagactcaaccgaaatggagactataaggagactcagtattcatttaaacaagtatttggcactcacaccacccagaaggaactctttgatgttgtggctaatcccttggtcaatgacctcattcatggcaaaaatggtcttctttttacatatggtgtgacgggaagtggaaaaactcacacaatgactggttctccaggggaaggagggctgcttcctcgttgtttggacatgatctttaacagtatagggtcatttcaagctaaacgatatgttttcaaatctaatgataggaatagtatggatatacagtgtgaggttgatgccttattagaacgtcagaaaagagaagctatgcccaatccaaagacttcttctagcaaacgacaagtagatccagagtttgcagatatgataactgtacaagaattctgcaaagcagaagaggttgatgaagatagtgtctatggtgtatttgtctcttatattgaaatatataataattacatatatgatctattggaagaggtgccgtttgatcccataaaacccaaacctccacaatctaaattgcttcgtgaagataagaaccataacatgtatgttgcaggatgtacagaagttgaagtgaaatctactgaggaggcttttgaagttttctggagaggccagaaaaagagacgtattgctaatacccatttgaatcgtgagtccagccgttcccatagcgtgttcaacattaaattagttcaggctcccttggatgcagatggagacaatgtcttacaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccgtcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttactgaacctaaaactgagaagccagagagaccctctcgggagcgagatcgagaaaaagttactcaaagatctgtttctccatcacctgtgcctctttctagtaactatattgctcagatttccaacggccagcaactcatgagccagccacagctacataggcgctctaactcttgcagcagcatttctgtagcttcctgtatttcggaatgggagcagaaaattcctacgtacaacacacctctcaaagtcacatctattgcaaggcgtaggcagcaggagccaggacaaagcaaaacttgtatcgtgtcagacagaaggcgagggatgtactggactgaaggcagggaggtggttcctacattcagaaatgagatagaaatagaagaggatcattgcggcaggttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtagtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatgaactgacagtcccagtactgaaagaacattttcatttgtgtggatgatttctcgaaagccatgccagaagcagtcttccaggtcatcttgtagaactccagctttgttgaaaatcacggacctcagctacatcatacactgacccagagcaaagctttccctatggttccaaagacaactagtattcaacaaaccttgtatagtgtatgttttgccatatttaatattaatagcagaggaagactccttttttcatcactgtatgaattttttataatgtttttttaaaatatatttcatgtatacttataaactaattcacacaagtgtttgtcttagatgattaaggaagactatatctagatcatgtctgattttttattgtgacttctccagccctggtctgaatttcttaaggttttataaacaaatgctgctatttattagctgcaagaatgcactttagaactatttgacaattcagactttcaaaataaagatgtaaatgactggccaataataaccattttaggaaggtgttttgaattctgtatgtatatattcactttctgacatttagatatgccaaaagaattaaaatcaaaagcactaagaaa

SEQ ID NO: 42821 - DNA, 2587 bp, Homo sapiens
tggtacggtccggagccgctggtatcttggatgcagatgcgcgacaatgtcttacaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccgtcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttactgaacctaaaactgagaagccagagagaccctctcgggagcgagatcgagaaaaagttactcaaagatctgtttctccatcacctgtgcctctttctagtaactatattgctcagatttccaacggccagcaactcatgagccagccacagctacataggcgctctaactcttgcagcagcatttctgtagcttcctgtatttcggaatgggagcagaaaattcctacgtacaacacacctctcaaagtcacatctattgcaaggcgtaggcagcaggagccaggacaaagcaaaacttgtatcgtgtcagacagaaggcgagggatgtactggactgaaggcagggaggtggttcctacattcagaaatgagatagaaatagaagaggatcattgcggcaggttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtagtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatgaactgacagtcccagtactgaaagaacattttcatttgtgtggatgatttctcgaaagccatgccagaagcagtcttccaggtcatcttgtagaactccagctttgttgaaaatcacggacctcagctacatcatacactgacccagagcaaagctttccctatggttccaaagacaactagtattcaacaaaccttgtatagtgtatgttttgccatatttaatattaatagcagaggaagactccttttttcatcactgtatgaattttttataatgtttttttaaaatatatttcatgtatacttataaactaattcacacaagtgtttgtcttagatgattaaggaagactatatctagatcatgtctgattttttattgtgacttctccagccctggtctgaatttcttaaggttttataaacaaatgctgctatttattagctgcaagaatgcactttagaactatttgacaattcagactttcaaaataaagatgtaaatgactggccaataataaccattttaggaaggtgttttgaattctgtatgtatatattcactttctgacatttagatatgccaaaagaattaaaatcaaaagcactaagaaa

SEQ ID NO: 42822 - DNA, 2838 bp, Homo sapiens
  misc_feature (25)..(26): n is a, c, g, or t
tctaattccaaaaattaaggatagnngttagaaccagaaaaactccacatactacaacattaaattagttcaggctcccttggatgcagatggagacaatgtcttacaggtaaagttgtagtatgtggagtttttctggttctaactctatccttaatttttggaattagagtaatccagccaacatggcaaaaacctgtctcgagtaaaattggaaaaatcagccaggcatggtgatgcaccactcctgtaatcccagctacttgtgtacctgaggcaggaggatcgcttgaacctgggaggcagaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccgtcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttactgaacctaaaactgagaagccagagagaccctctcgggagcgagatcgagaaaaagttactcaaagatctgtttctccatcacctgtgcctctttctagtaactatattgctcagatttccaacggccagcaactcatgagccagccacagctacataggcgctctaactcttgcagcagcatttctgtagcttcctgtatttcggaatgggagcagaaaattcctacgtacaacacacctctcaaagtcacatctattgcaaggcgtaggcagcaggagccaggacaaagcaaaacttgtatcgtgtcagacagaaggcgagggatgtactggactgaaggcagggaggtggttcctacattcagaaatgagatagaaatagaagaggatcattgcggcaggttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtagtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatgaactgacagtcccagtactgaaagaacattttcatttgtgtggatgatttctcgaaagccatgccagaagcagtcttccaggtcatcttgtagaactccagctttgttgaaaatcacggacctcagctacatcatacactgacccagagcaaagctttccctatggttccaaagacaactagtattcaacaaaccttgtatagtgtatgttttgccatatttaatattaatagcagaggaagactccttttttcatcactgtatgaattttttataatgtttttttaaaatatatttcatgtatacttataaactaattcacacaagtgtttgtcttagatgattaaggaagactatatctagatcatgtctgattttttattgtgacttctccagccctggtctgaatttcttaaggttttataaacaaatgctgctatttattagctgcaagaatgcactttagaactatttgacaattcagactttcaaaataaagatgtaaatgactggccaataataaccattttaggaaggtgttttgaattctgtatgtatatattcactttctgacatttagatatgccaaaagaattaaaatcaaaagcactaagaaa

SEQ ID NO: 42823 - DNA, 3440 bp, Homo sapiens
tctccctgcggacgggcgctgattggcccgtttgaaatgcgccaggcgggagctcacctgggctcttagcgtcgccgccggcttcgcagagcaccgcgccttagccgcgaagttctagttcttgctgccggtcctaacgtcccgcagtcttcgccagccagccgtcccgcatgcgcgtttgggcggcgtggagcctgctgccatgaagtcagcgagagctaagacaccccggaaacctaccgtgaaaaaagggtcccaaacgaaccttaaagacccagttggggtatactgtagggtgcgcccactgggctttcctgatcaagagtgttgcatagaagtgatcaataatacaactgttcagcttcatactcctgagggctacagactcaaccgaaatggagactataaggagactcagtattcatttaaacaagtatttggcactcacaccacccagaaggaactctttgatgttgtggctaatcccttggtcaatgacctcattcatggcaaaaatggtcttctttttacatatggtgtgacgggaagtggaaaaactcacacaatgactggttctccaggggaaggagggctgcttcctcgttgtttggacatgatctttaacagtatagggtcatttcaagctaaacgatatgttttcaaatctaatgataggaatagtatggatatacagtgtgaggttgatgccttattagaacgtcagaaaagagaagctatgcccaatccaaagacttcttctagcaaacgacaagtagatccagagtttgcagatatgataactgtacaagaattctgcaaagcagaagaggttgatgaagatagtgtctatggtgtatttgtctcttatattgaaatatataataattacatatatgatctattggaagaggtgccgtttgatcccataaaacccaaacctccacaatctaaattgcttcgtgaagataagaaccataacatgtatgttgcaggatgtacagaagttgaagtgaaatctactgaggaggcttttgaagttttctggagaggccagaaaaagagacgtattgctaatacccatttgaatcgtgagtccagccgttcccatagcgtgttcaacattaaattagttcaggctcccttggatgcagatggagacaatgtcttacaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccgtcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttactgaacctaaaactgagaagccagagagaccctctcgggagcgagatcgagaaaaagttactcaaagatctgtttctccatcacctgtgcctctttctagtaactatattgctcagatttccaacggccagcaactcatgagccagccacagctacataggcgctctaactcttgcagcagcatttctgtagcttcctgtatttcggaatgggagcagaaaattcctacgtacaacacacctctcaaagtcacatctattgcaaggcgtaggcagcaggagccaggacaaagcaaaacttgtatcgtgtcagacagaaggcgagggatgtactggactgaaggcagggaggtggttcctacattcagaaatgagatagaaatagaagaggatcattgcggcaggttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtagtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatgaactgacagtcccagtactgaaagaacattttcatttgtgtggatgatttctcgaaagccatgccagaagcagtcttccaggtcatcttgtagaactccagctttgttgaaaatcacggacctcagctacatcatacactgacccagagcaaagctttccctatggttccaaagacaactagtattcaacaaaccttgtatagtgtatgttttgccatatttaatattaatagcagaggaagactccttttttcatcactgtatgaattttttataatgtttttttaaaatatatttcatgtccccgtacatcgttagaagcttgaattcgagcagtagtagtagtaggcggccgc

SEQ ID NO: 42824 - DNA, 3348 bp, Homo sapiens
tctccctgcggacgggcgctgattggcccgtttgaaatgcgccaggcgggagctcacctgggctcttagcgtcgccgccggcttcgcagagcaccgcgccttagccgcgaagttctagttcttgctgccggtcctaacgtcccgcagtcttcgccagccagccgtcccgcatgcgcgtttgggcggcgtggagcctgctgccatgaagtcagcgagagctaagacaccccggaaacctaccgtgaaaaaagggtcccaaacgaaccttaaagacccagttggggtatactgtagggtgcgcccactgggctttcctgatcaagagtgttgcatagaagtgatcaataatacaactgttcagcttcatactcctgagggctacagactcaaccgaaatggagactataaggagactcagtattcatttaaacaagtatttggcactcacaccacccagaaggaactctttgatgttgtggctaatcccttggtcaatgacctcattcatggcaaaaatggtcttctttttacatatggtgtgacgggaagtggaaaaactcacacaatgactggttctccaggggaaggagggctgcttcctcgttgtttggacatgatctttaacagtatagggtcatttcaagctaaacgatatgttttcaaatctaatgataggaatagtatggatatacagtgtgaggttgatgccttattagaacgtcagaaaagagaagctatgcccaatccaaagacttcttctagcaaacgacaagtagatccagagtttgcagatatgataactgtacaagaattctgcaaagcagaagaggttgatgaagatagtgtctatggtgtatttgtctcttatattgaaatatataataattacatatatgatctattggaagaggtgccgtttgatcccataaaacccaaacctccacaatctaaattgcttcgtgaagataagaaccataacatgtatgttgcaggatgtacagaagttgaagtgaaatctactgaggaggcttttgaagttttctggagaggccagaaaaagagacgtattgctaatacccatttgaatcgtgagtccagccgttcccatagcgtgttcaacattaaattagttcaggctcccttggatgcagatggagacaatgtcttacaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccgtcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttactgaacctaaaactgagaagccagagagaccctctcgggagcgagatcgagaaaaagttactcaaagatctgtttctccatcacctgtgcctctttctagtaactatattgctcagatttccaacggccagcaactcatgagccagccacagctacataggcgctctaactcttgcagcagcatttctgtagcttcctgtatttcggaatgggagcagaaaattcctacgtacaacacacctctcaaagtcacatctattgcaaggcgtaggcagcaggagccaggacaaagcaaaacttgtatcgtgtcagacagaaggcgagggatgtactggactgaaggcagggaggtggttcctacattcagaaatgagatagaaatagaagaggatcattgcggcaggttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaaggtaaaaaactaattttcacaggagaaaaaaatatatttaaaaattcaacaaaagtccatttgtcctgctactcctttggtgacacacaggtagtgtcaactggaacatcagtaggtatttgatataacctttttgttagcagaaaattagtcactgcttaggttttaagtctgccaaactgggactaagtatgctttaaataggtatagattcttcggtttcttagaattctagatccatgatgtactttaattttttaatgactgtatatttagttttaaccactacttaaagtaatctaagcaaagaattcctattgctctccatcagttcaagataaaaaaacaaaaacaaaacaaaacgaaacctatgttaaaatttgacccgtcaaaattactcagtattgagctgcctaaagccgttttccagaaagagacttgcctgactatagaagaattcccctttgatcatagggtcagtgaataatcaggaaagtaaaagataagaccaaaaaa

SEQ ID NO: 42825 - DNA, 1035 bp, Homo sapiens
cttgcaagtgttattcctgaggagaatctcttggaaagaacatgggaaggtaggggtcaggaggctaagctatggccttagccaccaactctctttgcaaacttatctaaaatgagataagttacctggatgacctaaagacctttctggctcacaacatttgtggcctgtgccagaaataaattacgagtgactggtgttttaacgtaagagtctttgctgaactagaaagcaatattgcatttcacctaggtgtggagcctgctaaataactgtgttttatagactattgagaggagctgatctttttcctcttgtcattttcctctcagtgttctgtggctgtggagatgagagcaggatcccagctgggacctggatatcagcatcacgcacaacccaagcgcaaaaagccatgaactgacagtcccagtactgaaagaacattttcatttgtgtggatgatttctcgaaagccatgccagaagcagtcttccaggtcatcttgtagaactccagctttgttgaaaatcacggacctcagctacatcatacactgacccagagcaaagctttccctatggttccaaagacaactagtattcaacaaaccttgtatagtgtatgttttgccatatttaatattaatagcagaggaagactccttttttcatcactgtatgaattttttataatgtttttttaaaatatatttcatgtatacttataaactaattcacacaagtgtttgtcttagatgattaaggaagactatatctagatcatgtctgattttttattgtgacttctccagccctggtctgaatttcttaaggttttataaacaaatgctgctatttattagctgcaagaatgcactttagaactatttgacaattcagactttcaaaataaagatgtaaatgactggccaataataaccattttaggaaggtgttttgaattctgtatgtatatattcactttctgacatttagatatgccaaaagaattaaaatcaaaagcactaagaaa

SEQ ID NO: 42826 - DNA, 188 bp, Homo sapiens
tgagaatgggggtgggaattcagatgaaatgttagagaaaaaagtgctttctccatgatgtttctttccacaaatatgcttgcataagcaaattaaggaagactattttatagcgacatgaaatgtttatataccaaatattgaacatagtggtctaccttcctagattgagattttagagaaaacaa

SEQ ID NO: 42827 - DNA, 449 bp, Homo sapiens
actatttagctttacaatcttatctaagtttaatatttctctggagtattatacgttatatatatattataaaatatatataattttcattagaagaataacatgtcatgtcacttggcgttttagtcctagtcttaaatgaagataccagcatctcataatttaggagactaatcttttttttctttcccatagacctccacaatctaaattgcttcgtgaagataagaaccataacatgtatgttgcaggatgtacagaagttgaagtgaaatctactgaggaggcttttgaagttttctggagaggttagaaacacctagaactagaaaaatacagaatgatgaatatcacctagagttgctactaagtttgatggcaattttttttgacttattagaaagcatgtataatgaaatgactgagttcaggtttgaccaatgatttct

SEQ ID NO: 42828 - DNA, 397 bp, Homo sapiens
tataaaacaaggggtggtggacaatctgttcagtttactgatattgagactttaaagcaagaatcaccaaatgggtaagtaaccatcaaaaatctctgtataaaagttggtcattttcttagctgctcattttggaggaacagaatagcctgtgaaatgtatcattaattctccaaagggatgtagatagtattcccctacttctaatatttttcctcttcttagatggaaaaataattgttgcatcatgtttcccctttttcagtagtcgaaaacgaagatcttccacagtagcacctgcccaaccagatggtgcagagtctgaatggaccgatgtagaaacaagggtaggggaaaaattaaatatttgtctgcctactaaaattaggtttgtcat

SEQ ID NO: 42829 - DNA, 501 bp, Homo sapiens
cggacctcagctacatcatacactgacccagagcaaagctttccctatggttccaaagacaactagtattcaacaaaccttgtatagtgtatgttttgccatatttaatattaatagcagaggaagactccttttttcatcactgtatgaattttttataatgtttttttaaaatatatttcatgtatacttataaactaattcacacaagtgtttgtcttagatgattaaggaagactatatctagatcatgtctgattttttattgtgacttctccagccctggtctgaatttcttaaggttttataaacaaatgctgctatttattagctgcaagaatgcactttagaactatttgacaattcagactttcaaaataaagatgtaaatgactggccaataataaccattttaggaaggtgttttgaattctgtatgtatatattcactttctgacatttagatatgccaaaagaattaaaatcaaaagcactaagaaa

SEQ ID NO: 42830 - DNA, 3247 bp, Homo sapiens
gtactcctcaaccactctcctaatgattggaacaaaagaaaaaaaaagaaaaaaaaagccatgaagtcagcgagagctaagacaccccggaaacctaccgtgaaaaaagggtcccaaacgaaccttaaagacccagttggggtatactgtagggtgcgcccactgggctttcctgatcaagagtgttgcatagaagtgatcaataatacaactgttcagcttcatactcctgagggctacagactcaaccgaaatggagactataaggagactcagtattcatttaaacaagtatttggcactcacaccacccagaaggaactctttgatgttgtggctaatcccttggtcaatgacctcattcatggcaaaaatggtcttctttttacatatggtgtgacgggaagtggaaaaactcacacaatgactggttctccaggggaaggagggctgcttcctcgttgtttggacatgatctttaacagtatagggtcatttcaagctaaacgatatgttttcaaatctaatgataggaatagtatggatatacagtgtgaggttgatgccttattagaacgtcagaaaagagaagctatgcccaatccaaagacttcttctagcaaacgacaagtagatccagagtttgcagatatgataactgtacaagaattctgcaaagcagaagaggttgatgaagatagtgtctatggtgtatttgtctcttatattgaaatatataataattacatatatgatctattggaagaggtgccgtttgatcccataaaacccaaacctccacaatctaaattgcttcgtgaagataagaaccataacatgtatgttgcaggatgtacagaagttgaagtgaaatctactgaggaggcttttgaagttttctggagaggccagaaaaagagacgtattgctaatacccatttgaatcgtgagtccagccgttcccatagcgtgttcaacattaaattagttcaggctcccttggatgcagatggagacaatgtcttacaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccgtcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttactgaacctaaaactgagaagccagagagaccctctcgggagcgagatcgagaaaaagttactcaaagatctgtttctccatcacctgtgcctttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtagtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatgaactgacagtcccagtactgaaagaacattttcatttgtgtggatgatttctcgaaagccatgccagaagcagtcttccaggtcatcttgtagaactccagctttgttgaaaatcacggacctcagctacatcatacactgacccagagcaaagctttccctatggttccaaagacaactagtattcaacaaaccttgtatagtgtatgttttgccatatttaatattaatagcagaggaagactccttttttcatcactgtatgaattttttataatgtttttttaaaatatatttcatgtatacttataaactaattcacacaagtgtttgtcttagatgattaaggaagactatatctagatcatgtctgattttttattgtgacttctccagccctggtctgaatttcttaaggttttataaacaaatgctgctatttattagctgcaagaatgcactttagaactatttgacaattcagactttcaaaataaagatgtaaatgactggccaataataaccattttaggaaggtgttttgaattctgtatgtatatattcactttctgacatttagatatgccaaaagaattaaaatcaaaagcactaagaaa

SEQ ID NO: 42831 - DNA, 2993 bp, Homo sapiens
ctagaactagaaaaatacagaatgatgaatatcacctagagttgctactaagtttgatggcaattttttttgacttattagaaagcatgtataatgaaatgactgagttcaggtttgaccaatgatttctctgttgtcctaggccagaaaaagagacgtattgctaatacccatttgaatcgtgagtccagccgttcccatagcgtgttcaacattaaattagttcaggctcccttggatgcagatggagacaatgtcttacaggtaaagttgtagtatgtggagtttttctggttctaactctatccttaatttttggaattagagtaatccagccaacatggcaaaaacctgtctcgagtaaaattggaaaaatcagccaggcatggtgatgcaccactcctgtaatcccagctacttgtgtacctgaggcaggaggatcgcttgaacctgggaggcagaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccgtcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttactgaacctaaaactgagaagccagagagaccctctcgggagcgagatcgagaaaaagttactcaaagatctgtttctccatcacctgtgcctctttctagtaactatattgctcagatttccaacggccagcaactcatgagccagccacagctacataggcgctctaactcttgcagcagcatttctgtagcttcctgtatttcggaatgggagcagaaaattcctacgtacaacacacctctcaaagtcacatctattgcaaggcgtaggcagcaggagccaggacaaagcaaaacttgtatcgtgtcagacagaaggcgagggatgtactggactgaaggcagggaggtggttcctacattcagaaatgagatagaaatagaagaggatcattgcggcaggttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtagtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatgaactgacagtcccagtactgaaagaacattttcatttgtgtggatgatttctcgaaagccatgccagaagcagtcttccaggtcatcttgtagaactccagctttgttgaaaatcacggacctcagctacatcatacactgacccagagcaaagctttccctatggttccaaagacaactagtattcaacaaaccttgtatagtgtatgttttgccatatttaatattaatagcagaggaagactccttttttcatcactgtatgaattttttataatgtttttttaaaatatatttcatgtatacttataaactaattcacacaagtgtttgtcttagatgattaaggaagactatatctagatcatgtctgattttttattgtgacttctccagccctggtctgaatttcttaaggttttataaacaaatgctgctatttattagctgcaagaatgcactttagaactatttgacaattcagactttcaaaataaagatgtaaatgactggccaataataaccattttaggaaggtgttttgaattctgtatgtatatattcactttctgacatttagatatgccaaaagaattaaaatcaaaagcactaagaaa

SEQ ID NO: 42832 - DNA, 3693 bp, Homo sapiens
  misc_feature (3675)..(3675): n is a, c, g, or t
tctccctgcggacgggcgctgattggcccgtttgaaatgcgccaggcgggagctcacctgggctcttagcgtcgccgccggcttcgcagagcaccgcgccttagccgcgaagttctagttcttgctgccggtcctaacgtcccgcagtcttcgccagccagccgtcccgcatgcgcgtttgggcggcgtggagcctgctgccatgaagtcagcgagagctaagacaccccggaaacctaccgtgaaaaaagggtcccaaacgaaccttaaagacccagttggggtatactgtagggtgcgcccactgggctttcctgatcaagagtgttgcatagaagtgatcaataatacaactgttcagcttcatactcctgagggctacagactcaaccgaaatggagactataaggagactcagtattcatttaaacaagtatttggcactcacaccacccagaaggaactctttgatgttgtggctaatcccttggtcaatgacctcattcatggcaaaaatggtcttctttttacatatggtgtgacgggaagtggaaaaactcacacaatgactggttctccaggggaaggagggctgcttcctcgttgtttggacatgatctttaacagtatagggtcatttcaagctaaacgatatgttttcaaatctaatgataggaatagtatggatatacagtgtgaggttgatgccttattagaacgtcagaaaagagaagctatgcccaatccaaagacttcttctagcaaacgacaagtagatccagagtttgcagatatgataactgtacaagaattctgcaaagcagaagaggttgatgaagatagtgtctatggtgtatttgtctcttatattgaaatatataataattacatatatgatctattggaagaggtgccgtttgatcccataaaacccaaacctccacaatctaaattgcttcgtgaagataagaaccataacatgtatgttgcaggatgtacagaagttgaagtgaaatctactgaggaggcttttgaagttttctggagaggccagaaaaagagacgtattgctaatacccatttgaatcgtgagtccagccgttcccatagcgtgttcaacattaaattagttcaggctcccttggatgcagatggagacaatgtcttacaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccgtcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttactgaacctaaaactgagaagccagagagaccctctcgggagcgagatcgagaaaaagttactcaaagatctgtttctccatcacctgtgcctctttctagtaactatattgctcagatttccaacggccagcaactcatgagccagccacagctacataggcgctctaactcttgcagcagcatttctgtagcttcctgtatttcggaatgggagcagaaaattcctacgtacaacacacctctcaaagtcacatctattgcaaggcgtaggcagcaggagccaggacaaagcaaaacttgtatcgtgtcagacagaaggcgagggatgtactggactgaaggcagggaggtggttcctacattcagaaatgagatagaaatagaagaggatcattgcggcaggttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtagtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatgaactgacagtcccagtactgaaagaacattttcatttgtgtggatgatttctcgaaagccatgccagaagcagtcttccaggtcatcttgtagaactccagctttgttgaaaatcacggacctcagctacatcatacactgacccagagcaaagctttccctatggttccaaagacaactagtattcaacaaaccttgtatagtgtatgttttgccatatttaatattaatagcagaggaagactccttttttcatcactgtatgaattttttataatgtttttttaaaatatatttcatgtatacttataaactaattcacacaagtgtttgtcttagatgattaaggaagactatatctagatcatgtctgattttttattgtgacttctccagccctggtctgaatttcttaaggttttataaacaaatgctgctatttattagctgcaagaatgcactttagaactatttgacaattcagactttcaaaataaagatgtaaatgactggccaataataaccacagtaggatgggggtgtgcgttcggtgcagacatattagctatgtgacattcaggagatgccaanaagattttaaatcggaag

SEQ ID NO: 42833 - DNA, 3277 bp, Homo sapiens
tctccctgcggacgggcgctgattggcccgtttgaaatgcgccaggcgggagctcacctgggctcttagcgtcgccgccggcttcgcagagcaccgcgccttagccgcgaagttctagttcttgctgccggtcctaacgtcccgcagtcttcgccagccagccgtcccgcatgcgcgtttgggcggcgtggagcctgctgccatgaagtcagcgagagctaagacaccccggaaacctaccgtgaaaaaagggtcccaaacgaaccttaaagacccagttggggtatactgtagggtgcgcccactgggctttcctgatcaagagtgttgcatagaagtgatcaataatacaactgttcagcttcatactcctgagggctacagactcaaccgaaatggagactataaggagactcagtattcatttaaacaagtatttggcactcacaccacccagaaggaactctttgatgttgtggctaatcccttggtcaatgacctcattcatggcaaaaatggtcttctttttacatatggtgtgacgggaagtggaaaaactcacacaatgactggttctccaggggaaggagggctgcttcctcgttgtttggacatgatctttaacagtatagggtcatttcaagctaaacgatatgttttcaaatctaatgataggaatagtatggatatacagtgtgaggttgatgccttattagaacgtcagaaaagagaagctatgcccaatccaaagacttcttctagcaaacgacaagtagatccagagtttgcagatatgataactgtacaagaattctgcaaagcagaagaggttgatgaagatagtgtctatggtgtatttgtctcttatattgaaatatataataattacatatatgatctattggaagaggtgccgtttgatcccataaaacccaaacctccacaatctaaattgcttcgtgaagataagaaccataacatgtatgttgcaggatgtacagaagttgaagtgaaatctactgaggaggcttttgaagttttctggagaggccagaaaaagagacgtattgctaatacccatttgaatcgtgagtccagccgttcccatagcgtgttcaacattaaattagttcaggctcccttggatgcagatggagacaatgtcttacaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccgtcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttactgaacctaaaactgagaagccagagagaccctctcgggagcgagatcgagaaaaagttactcaaagatctgtttctccatcacctgtgcctctttctagtaactatattgctcagatttccaacggccagcaactcatgagccagccacagctacataggcgctctaactcttgcagcagcatttctgtagcttcctgtatttcggaatgggagcagaaaattcctacgtacaacacacctctcaaagtcacatctattgcaaggcgtaggcagcaggagccaggacaaagcaaaacttgtatcgtgtcagacagaaggcgagggatgtactggactgaaggcagggaggtggttcctacattcagaaatgagatagaaatagaagaggatcattgcggcaggttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtagtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatgaactgacagtcccagtactgaaagaacattttcatttgtgtggatgatttctcgaaagccatgccagaagcagtctttcacggcactatctgtgccttctaacacttagttagtgccttttcatttgcaacagatactgtgatggcatgagggacactcgtggctgcatgactgtttcagttgcatactacga

SEQ ID NO: 42834 - DNA, 193 bp, Homo sapiens
tctccccttgcttccagtgcctggcaccagcaggcagccagtgaatgtgtagaccaggggacgttcactggtcaacgggttggttagtcacctgattagctagttggcctagaggctcagtcttgagttagcagactcacgttccaacctcagctcagccacttcctagttgtatggcctgttatggaaattc

SEQ ID NO: 42835 - DNA, 307 bp, Homo sapiens
actggataaagggtgatctgtctgtattatttcttacaactacacatgaatttatagttatctcaatataggcagtttaaaattttaaaagaggccagaagagtcaagtatgtgacatgtggttgagagtaacaaactgtctatcataagagaaataaataacatggtgcagttaaatatcatcaatttggaatccaatcactttcttcgataacactcaattagcagatatgcaattatattagctgttattaacaaaaactggaaatccattacactattatactgctattacattacattatat

SEQ ID NO: 42836 - DNA, 431 bp, Homo sapiens
cttgttaactggttctcagattaaattaagtatatattgtgatggtagtaattctctccactaggtggtagtatagcctgttaaatacactgtatttcctggtgtggattagatttctagaatcttttgttttcacaaaaacatatttggtggtgaggttcttagtatgtccatgtctgcagtgtttttcttctcttaatttttataatttaatagtattataaaataccttttaaaggtatttagtttattttttctctcttctccctccgtctatccattcattcatccatacatccacccataaaaaatcaggtgcctgctctgtgccaggcataatgataagctgaaccatatagagaataagacctacaagtccttgcccgcatgcagcttacattgaggaagagggtgaatcagaagacctgata

SEQ ID NO: 42837 - DNA, 2076 bp, Homo sapiens
ggagccctggcgggcacttcctaccgtacgaggcgcaggtgggagacttccgccctcgcgggactggctagggcgtttgaccgccggcggtgaaggggaggcggtgggcgtcttggagaacagagcgagatggagaagcgaggccgaggcgtgaagtcgagccccatccagaccccgaaccagacccctcagcaggctccggtgacgcctaggaaagaaaggaggcctagcatgttcgagaaggaggcagtgagtgcggagactgctaggggcccgagacggctatgtccgaccgtttaagtgaaatcgctccccagtgggccccgctcccgtcaccacccccagagccaaggaggcagcatctcccttttgtgtttcttttttccccagatgcgaaattgaagcctgagactgagttgggcagtcccctttggacttgagtgctaaagttttcttgttttttaattagggccatagaaccctacataagtcgattggaagggtggttacaagatcttcttttcaaatttactcagcttgcggatttcctgagagtactctgagtattattgctttgtactaaaacacagtatgttagtgtatttagtgccattataagcagttttgctagcgaaaaatgagtgtgttgtattaaaaaaataatttgataaaccaggcagaatagtgccatgttttgggtttttaaaacatcagcagtctggatatttgaagaatgtacaggagaaaaaaacttaagttgaaaataccctgtccaaaacttactgatattgatggaaagggtcattattcagttttattggtggtataacaggtatttctatatgattaggctttgaaaaccgttaatgtattaaagactctatattttattgatactttaacagaaaattagtttgcccaaggatacaaagctgtaatgatagagctgggaccagaacctgtatgctagtactcggtccaattggcctatactggtttctcttcgtacttacttcgtggacctataataggatgaagatagagatgacaggcaaaacaattttttgaagaccctaaaacattttaagattactcttaaaaagagaattctcaaaataatggcgaaatttcaggttcttgtttccctggtgtctacattttacagaggaaagaacgaactaaataaaggaggaaaagcaaacaggccaagtttacacagctaagaaaaagagcagagcagggctagaaacctaaatcagttggacttaaaacttcacactcccaaacactatgctgtatttcttggcaatgagtctgagtaacaggtcaccaacagtaaagaaaaatttctatatattgaggcagacaagggtggcttttataaacttactgcctatctgaggtctgaagtggtctttaaaattcaatgagcctgaactcaaaatgaggagacacataggtgcacctggtatataggttaaaatctgggagtgaggggacatggaccaaagtaattattagtatttgatatggatgtgatcaattatagctatctttaaagttgattcttttagaggtgagaaatttgaatagaacaataattgggaagaaattgagaaaggactctacaaatgctcactaaatgtacctgaggaaactgttcacttagttatttctaatttaaggtagctgttaatttccctattttggagcataggaaaatttaagacatactgtttcatcaatatgaccatctcttgattttatctgtcttgcctccatttctttttttctagtggtagcacctcagttaacttttagagaattaactcatctgcaattgtatagagctttggtgagattgtcagctacttcccttaactttttaataaggatgagacccaaactaagctaattagatgaattctttgaaataatgcaaagaaaatgattgaggtttattcacattgaagatgagaagctaaagtgttccctgtgtctttctgaatctggttcatcagccttctctgctgttatgtaaactgtatctttccaataaattatactttggcttaa

SEQ ID NO: 42838 - DNA, 805 bp, Homo sapiens
caggaaaaaaataaaaagaaaaaagagaatgcagtcaactgtgtagaatcctacttagtgattaagatgcagtcatacagtgcataatgatattttagtcagtgactacatacacaatggttgtcttatcaatattgtaataccacatttttactgtaccttttctatgttttgacatatttagatacacaaatacttattgtgttatagttgtctactgtattcaatatagtcacatactctacaggtttgtagcctgggagcaatatgctatataccacatagtgcaggtatgttgtaggctctaatcatttaggtttgtataagtacgctctatgatgtgtgcacaatgatgacatagtctaatgatgcatttctcagaatatatccctgtcattaataggtggatgatatataaagaggaaatagctattgggtttggcatccaggttattggagaccttctgaaaaggagttttgatagagtaatcagtaatagcaatcctattagaatcagttaaggactgaaagtgggaaaacagcaactggagaaaactctttaaagaaatttgctgggaaaatttttatgtaaatatagacaagcttatcctagtatttatatgggaaggctagggtagctaaaacaatttgacaaagtaaaataagtgggaagaatcaatctatctggttgtaaagctttttatttaaccatagtaatctaggacagtatggtaatggaggaggcctagacacataggagattgcaacagaataaagaacccagacacagattgaactgtggtat

SEQ ID NO: 42839 - DNA, 966 bp, Homo sapiens
agcctgtataacggggtgctcaaacaccaatttttctcaggattactgaaaaacttaaatatacaggccaggtgtggtggctcactgcctgcaatcccaacattttgggaggctaaggcgggccgatttcttgagctcgagtttgagaacagactgtgcaacatgacggcttcatcggcgctttgccacttgtacccgagtttttgattctcaacatgtccgagactgctcctgccgctcccgctgccgcgcctcctgcggagaaggcccctgtaaagaagaaggcggccaaaaaggctgggggtacgcctcgtaaggcgtccggtcccccggtgtcagagctcatcaccaaggctgtggccgcctctaaagagcgtagcggagtttctctggctgctctgaaaaaagcgttggctgccgccggctatgatgtggagaaaaacaacagccgtatcaaacttggtctcaagagcctggtgagcaagggcactctggtgcaaacgaaaggcaccggtgcttctggctcctttaaactcaacaagaaggcagcctccggggaagccaagcccaaggttaaaaaggcgggcggaaccaaacctaagaagccagttggggcagccaagaagcccaagaaggcggctggcggcgcaactccgaagaagagcgctaagaaaacaccgaagaaagcgaagaaagccggccgcggccactgtaaccaagaaagtggctaagagcccaaagaaggccaaggttgcgaagcccaagaaagctgccaaaagtgctgctaaggctgtgaagcccaaggccgctaagcccaaggttgtcaagcctaagaaggcggcgcccaagaagaaataggcgaacgcctacttctaaaacccaaaaggctcttttcagagccaccactgatctcaataaaagagctggataatttctttactatctgccttttcttgttctgccctg

SEQ ID NO: 42840 - DNA, 1073 bp, Homo sapiens
agcctgtataacggggtgctcaaacaccaatttttctcaggattactgaaaaacttaaatatacaggccaggtgtggtggctcactgcctgcaatcccaacattttgggaggctaaggcgggccgatttcttgagctcgagtttgagaacagactgtgcaacatgacggcttcatcggcgctttgccacttgtacccgagtttttgattctcaacatgtccgagactgctcctgccgctcccgctgccgcgcctcctgcggagaaggcccctgtaaagaagaaggcggccaaaaaggctgggggtacgcctcgtaaggcgtccggtcccccggtgtcagagctcatcaccaaggctgtggccgcctctaaagagcgtagcggagtttctctggctgctctgaaaaaagcgttggctgccgccggctatgatgtggagaaaaacaacagccgtatcaaacttggtctcaagagcctggtgagcaagggcactctggtgcaaacgaaaggcaccggtgcttctggctcctttaaactcaacaagaaggcagcctccggggaagccaagcccaaggttaaaaaggcgggcggaaccaaacctaagaagccagttggggcagccaagaagcccaagaaggcggctggcggcgcaactccgaagaagagcgctaagaaaacaccgaagaaagcgaagaaagccggccgcggccactgtaaccaagaaagtggctaagagcccaaagaaggccaaggttgcgaagcccaagaaagctgccaaaagtgctgctaaggctgtgaagcccaaggccgctaagcccaaggttgtcaagcctaagaaggcggcgcccaagaagaaataggcgaacgcctacttctaaaacccaaaaggctcttttcagagccaccactgatctcataagagtgatattcttacaaaaaaaaagggggggttaaattcctgaggcagtaggttccgtttgtcagggctaaggggtaagagagggggttaagggggaaaggtggttggagaccttggggtatgacccgaaatcgggaaaagtaggagcgggaaggt

SEQ ID NO: 42841 - DNA, 977 bp, Homo sapiens
agcctgtataacggggtgctcaaacaccaatttttctcaggattactgaaaaacttaaatatacaggccaggtgtggtggctcactgcctgcaatcccaacattttgggaggctaaggcgggccgatttcttgagctcgagtttgagaacagactgtgcaacatgacggcttcatcggcgctttgccacttgtacccgagtttttgattctcaacatgtccgagactgctcctgccgctcccgctgccgcgcctcctgcggagaaggcccctgtaaagaagaaggcggccaaaaaggctgggggtacgcctcgtaaggcgtccggtcccccggtgtcagagctcatcaccaaggctgtggccgcctctaaagagcgtagcggagtttctctggctgctctgaaaaaagcgttggctgccgccggctatgatgtggagaaaaacaacagccgtatcaaacttggtctcaagagcctggtgagcaagggcactctggtgcaaacgaaaggcaccggtgcttctggctcctttaaactcaacaagaaggcagcctccggggaagccaagcccaaggttaaaaaggcgggcggaaccaaacctaagaagccagttggggcagccaagaagcccaagaaggcggctggcggcgcaactccgaagaagagcgctaagaaaacaccgaagaaagcgaagaaagccggccgcggccactgtaaccaagaaagtggctaagagcccaaagaaggccaaggttgcgaagcccaagaaagctgccaaaagtgctgctaaggctgtgaagcccaaggccgctaagcccaaggttgtcaagcctaagaaggcggcgcccaagaagaaataggcgaacgcctacttctaaaacccaaaaggctcttttcagagccaccactgatctcaataaaagagctggataatttctaaaaaaaacacaaaaacaaatacaacaaaaaacaaaaaaag

SEQ ID NO: 42842 - DNA, 277 bp, Homo sapiens
tggcaagcaatggttgtctctaagtaacacagaagaagtcctttttcaacaaagcctttaaaaagcctcccagctctcaggcattcgaaaaacacagttgtgtgtgtgtgtgtgtgtgtgtgtgtgtgtgtgtgtgtgtgtctttttctttttcctgcaagacttagctgtgaagtcaaggtcactattcctagggagctcagctgcacaagaagcctagagctgcattgctgggcctggagcctgccctgaccctctgtgctggactgtgctttcc

SEQ ID NO: 42843 - DNA, 400 bp, Homo sapiens
aattacatgattccactggggattttccccagaaaataacagcattacttattcccaaggaatttcctgaattttaatgatgacagctttattattgctattagtagttacattactacaaatattacatacaagctttaatatatgcagcaaactataagttatacataagaataacatttactaaatgcctctgatattctagataccttgctaagaactttagctacaaagtatgtcgtggcaaagaatgcaaacttagagactgacatccttggttctaatctaggttccacgactccttttttttttttttttttttttttctgagacggagtctcgctctgtcgcccaggatggagtgcagtggcatgatttcagctcactgcaagctccaagc

SEQ ID NO: 42844 - DNA, 391 bp, Homo sapiens
aaggatggacagtggatagcttgtggaggtaaaataaagtaagttggactgatgttggtttcagaacttaaatctcagtcataagtatagggctctcttgtgattcaatgccaagcttgtaaattaagctgctttaaaggagtgttggagataggagaagtgagttagaaatataaaaacagagctgggtgaggtggctcatacctgtaatctcagcactttgggaggccaaggagttcaagaacaacttgggcaacagggcaaaataccacctttacttaaaaaaattagccgggcatgatggtgtacatctgtagccctagctacttgggaggctgaggtaggaagattacttgagcacaggaagtcgaggctacaatgagctgtgatc

SEQ ID NO: 42845 - DNA, 463 bp, Homo sapiens
tggacagcacagaggaggtggacagcacagaggcgggcacagaggaggtggacagctggacagcacatggacagcacagaggaggtggacagcacatggacagcacagaggaggtggacagcacagaggaggtggacagcacagaggaggtggactgcccagtggtggcctttgacaggtaggaggatgcagtgctgcaggctattttgttttttgttacaaaactgtcttttcccttttcccctccacctgattcagcatgatccctgtgagctggttctcacaatctcctgggactgggctgaggcaggggcttcgctctattctccctaaccatactgtcttcctttcccccttgccacttagcagttatccccccagctatgccttctccctccctcccttgccctggcatatattgtgccttatttatgctgcaaatataacattaaactatcaagtg

SEQ ID NO: 42846 - DNA, 1701 bp, Homo sapiens
atgtaagtgctacaatatttatgaaaaatatgatttgcggatgggaaggaggttatggaaaaaggagaaaactggcgggcatagctgatatcagtgcgctagcacctttaaggagcctctcagttgtggagcaggggagccccagtcaaccacaggaattattttttttaaatttcataaccagcctgtttagattccagtcttcctagctatatcacatatgccttgttgatatgctctttctgctttctttagacttaatgtttgacgggggtgggggtgtctggaagaacaggaaaggtggggatcctaaggcagattaaaggactccctccaccccactacagcctcccataactctagtcatccctctcatagtacaggactgatttctctgtgtctgtttgtacacacaaatgtgcatacagacataaattcccccaccccataccaaggtggttacctagcaggaatgagcgtaggtggctgctggccaccattaccaccgtctgcatcagctgtgttgtctctctttggggtaaagtcctaccccagaatgagaaaaggctggggagagtagggcaggttaaaggagcttatgtcctctgtagatgtaggtttgtatcatagctactagggtttatttttttaatggggggctaatagcacagagttatctcaccagcagtagctactggtgagtgatgttttagctgtaagaagtggctatgagcaatagtttcactgactttaccttagggcagtgccacagtaatctgggaacttgttagaaatacacattctcaggccccatcccagacttattgaatcacagactctgggggcagggtttaaaagcactccaagtgattctaatgcacactaaaggttgagaaccatttcttagggataagctgggaaatttttacaggtgtggaggatatttcaaatacatcttttgcctttgcactaacatgctttcatttctttcagtctcttcctccattccctttaaagtcttccccatcatatcactgatctcaaaagctagatttgtcttcattttagtcgtatccctaaaaccatgcattggtctggacaggagttgtcccatattcccttgcagactggtcactccatgttctctgttacagtaaggaccagccaagcttcagctgtcccattcctccccctacaacacacacacctttcaggcagggaggagatgagcttccagccccaagagtggaggctgccacatcctaacatagtatctattgaaaaggaagcagtgtgtatctatgattatatctctgttcatctatatatttttgacatgtagcaacacctctccatcttatcaaggaactcaactcggtctgggtctccccagtgcccagtggtggcctttgacaggtaggaggatgcagtgctgcaggctattttgttttttgttacaaaactgtcttttcccttttcccctccacctgattcagcatgatccctgtgagctggttctcacaatctcctgggactgggctgaggcaggggcttcgctctattctccctaaccatactgtcttcctttcccccttgccacttagcagttatccccccagctatgccttctccctccctcccttgccctggcatatattgtgccttatttatgctgcaaatataacattaaactatcaagtg

SEQ ID NO: 42847 - DNA, 670 bp, Homo sapiens
ctactactactaaattcgcggccgcgtcgacttttagtcgtatccctaaaaccatgcattggtctggacaggagttgtcccatattcccttgcagactggtcactccatgttctctgttacagtaaggaccagccaagcttcagctgtcccattcctccccctacaacacacacacctttcaggcagggaggagatgagcttccagccccaagagtggaggctgccacatcctaacatagtatctattgaaaaggaagcagtgtgtatctatgattatatctctgttcatctatatatttttgacatgtagcaacacctctccatcttatcaaggaactcaactcggtctgggtctccccagtgcccagtggtggcctttgacaggtaggaggatgcagtgctgcaggctattttgttttttgttacaaaactgtcttttcccttttcccctccacctgattcagcatgatccctgtgagctggttctcacaatctcctgggactgggctgaggcaggggcttcgctctattctccctaaccatactgtcttcctttcccccttgccacttagcagttatccccccagctatgccttctccctccctcccttgccctggcatatattgtgccttatttatgctgcaaatataacattaaactatcaagtg

SEQ ID NO: 42848 - DNA, 690 bp, Homo sapiens
aacttcacttaagcctcccaacaacgctgcaagggtagaggctgctgttttccccacttatgaaaatatgagtttgcccacaatcatacagtaggaacagtttttcttactccagaaactgtgctttaaaaagtcaaagaaagaaataaccaagtttgttatggtaacattggtagaggacttgagtggtgcttccacctactgggcttccagagcagctagatacgataggtagattcatattaacctctggaggggatggggtgggaggaccaccctagagccaacaaaggaggtggggggccagactattattatcttcaccgaacaaacaagaaacagggaaggaggaaggcaagaaaagagaaaataactctgccgagatttctagcctaggagacttgcgggttggtggccaaactgacaaataggaaatagttgaaaaagagctgtcctgggaagcatttgtgaagttctgccttgcgtgtgtagaatgtgggttcatggtggaactttcaagtgtttacatcctgtgtgcaaatgaaaataaggcacaggtacagcttttactcttcaacaaatattttttaaaaacacaaggcgtcctgatactaaaaagtgatgtttccccatagttgacaggtaaaaaacactttctttctaaattaagtacaattaattgtgatctta

SEQ ID NO: 42849 - DNA, 720 bp, Homo sapiens
aggagctgaggccctgtccctgggctgacggcagatgcattggtttgttggaggtggctggtttggtggtttggtggttcggtttcctggcctgcacacgtcactaaaggtgtctcaggaacattctacagcagcctgtggggcccttgtgtgagcaggactggcactgtgggatgacagggcatcctaggtcctggtttatcttctctgctcccagtggctgctgtctgtgcccctcagcttccccagcgtgatgtttttgcctcagtttccccagcgtgactccccacttcagcttcctcagcatgatgtccttgtctcagtttccacagcatgacatccccacctcagcttccccagtgtgatgtccccgcctgccatcctgtcctgcagccaagagctcctctgggctcagccaggactgctgatttgcagtcacgtcctgtctcgggtgcagcctggagcttcaggggtgtgacgctttgggggtcatggccaccagcctcttggaaacaccctctggagccccgccttgggcagcactgcatggccttgctgtgtttcctgcccggggccatttcattaatactgtgtttgcgggagttctgtctctcgtctttggagcgccccctccctctatttctgtacaggggagctgcttctttctttcttcccccatctttcctgcctattaaattcctgctccttaaaactaaaaga

SEQ ID NO: 42850 - DNA, 533 bp, Homo sapiens
gaaagccaaaatcactaaggggactaaacattttaattctgtctaagagatctctgaagatgacatagttcagttgtctgctttagcctcccagtgctttagtttctcttataaaatagtcgttaaactgaagagaggggtactgggctgtaagcagcacaatcagcatatattagatgagccatcatatttaacattacatgctaacttttcactgtggtgttctgtctcaaaataaatgaattatcctaaaatatttttatgactatctttccattttatgtgaaaattagacaaatttgaagaaatttaaggcactgtattttgttctttgaaaccaatgagaacaaagacacaatgtaccagaatctttgagacacagctaaagcagcgtttagagggaaatttatagcactaaatacccacatgagaaactgggaaatatctaaaatcaacaccctaacatcacaattaaaagaactagagaagcaaaagcaaacaaattcaaaacctagcaaaagacaagaaataac

SEQ ID NO: 42851 - DNA, 412 bp, Homo sapiens
cgtttcttctataaaatttgcctttttggctgaaacaaaacacagatgggtcttgggaaaagagaaagaattattataaattttatcaagtggagattctaattgcagtattgctttagatttagggttggtttagttactggagaaaatcaacatatcccttggtatttgaaaagcagccatcaatctgttaaatacttttccctatgaatcttagtaatgacagtatactttctcaccacaggattatatcactctccaactctcagtcatagtctaatctgcaaggactttgatcatctcttcatttcacagaacatcaaattagcccacgtcaatgacatcataataattacaggaagcggtaataatcctaagcactgcaatatgatacatgcatgccagagggtgg

SEQ ID NO: 42852 - DNA, 491 bp, Homo sapiens
actcctgtctttcaaggagtccttgtacaattgtcccattacacagctcactgaggttctgttcatttttttgtctgagtgctatattttaaatcggttatactcctagtttttgaggttcacttatctttatttcagcaatatctcctctgctgttttgtccattcagtgcattattattattattattatcattattattattttttaagagacagggtcttactagttgcccctgttgggcttgaaattcctgagttcaagcgatccttccacctcaggctctgagtagctgggactagaggcatgtgccaccacaccaacctccatccagtgcttctagatattgttgtgttcatatatagtagcttgaattgtgtcttttcttttgttcataaattgtcttgaagtaacatgtactaacataaaatttccactttaatcatttttaagtgtgtcattcaggagcattaaatacatttacaatgtgt

SEQ ID NO: 42853 - DNA, 444 bp, Homo sapiens
accttccaggctttggaataccagaggctgttcttgatgttgacgttaaaaccactagtaccaacgatctgttttgggttttttattttgttttgagagggagtttcactcttgtcgcccacgctgaagcagagtggcgcaatcttggttcactacaacctccacctcccaggttcaagcgattcttctgcctcagccttcagagtagctgggatttacaggcgcccgccaccacacccagctaatttttgtatttttagtagagatggggtttcaccatgttagccaggctggtctcaaactcctgagctcaagtgatccacctgcctcggcctcccaaagtgctgggattacaggcctgagccaccgcacccggcctcaacgatctgttaaacataccacctcatcaactggatgatttctaaagaaaagtcctccccaatg

SEQ ID NO: 42854 - DNA, 160 bp, Homo sapiens
aatctgcctattaggatattgtgacaatgaagaaagagaataaaggtgaatatttctggtgaaaaagttaaactgattttaaaataattcaacaaatctgattagtggtcattaagcaatatgaaagataatgattaacaatatatcattcttaataagt

SEQ ID NO: 42855 - DNA, 263 bp, Homo sapiens
aaaagggtttctgagaacattctggtgcactacataatccttatgtaggaaagctaggatgccagatgtttatgtgttccatcctcattctcattaaaggttccatttttttttttttttttttttttttttaccaccaactttaattgcaaccaattcactaggctgccttaattataacattttagattaggaaaagacttagaaatcatctagtgtttgtcaaaccaaaatgatcatctgaatcacctacgatgctttaa

SEQ ID NO: 42856 - DNA, 512 bp, Homo sapiens
tctaggttgtgtgctccttgtgaaaatctaatgcccccctctccccgccccatctccacacatacccctggtccctggtgccaaaaaggttggggacctctcctgtaaagaaatccactcaggctgcttagggagtgctaagggcaggttgttgcaattttaaataagatgattcgaaaaagtgtcattgagtgacatctgagcaaacacctgaataagttgaaggagcaagccatggagatctctgagaagaaactgtccaagtagaggaaacagcaaatacaaatgcccccaaagtagaagcatttttgagaaagagcttagaggccagtttagctgaagtggagtaaatgaaggggaagaatagcaagtaagatcagacaggtaatgaaggccaaatcatgcagggcctcataggccacctatacaaactttgtttttattctaaataagatgggaagccactggactgttttacaaagaagagtgaaattatttgtcttcattttaag

SEQ ID NO: 42857 - DNA, 443 bp, Homo sapiens
aaattagccggacatggtggtgcgtgcctgtagtcccagctacttgggaggctgaggcaggggaatcgcttgaacccgggagatggaggttccagtgagccgagatctcgtcactgcactccagcctggtgacacagcaagactccatctcaaaaaacaacaaaaaaagttaccttataatccagcaattccatcactaggtatacagccaagagaaataaaaacgtgtttatacaaaaacctgtacacaaatattcactgcagcattattcacaacagtcaaaaagtagaaaataatccaagtgcccatcaactgatgaatggataaacaaaatatggtacatccatcaaactgagtattatccagccatgaaaaggagtattgatgcaagtcacaacgtggatgaactctgcactgtaatgctaagcatcagaagcagacc

SEQ ID NO: 42858 - DNA, 476 bp, Homo sapiens
cttcagaggcttcccattggctttccccaccatgataactcaagaccaaggaccctgagcttcttaccaatgtggagattgctccagctgcccaatatgtactcccaattatgcactcaggaactaagaaaatgactactggatgggtcagtgtattcctggacccactgtaagctggacattatccaggactctgcttattacctgatccccataagcccccacacttagagaggagccatgtgtattacatactttgggtaacacctgtgaaatgtctgggtattcctctttcctcaacataaaatcagtcaagaaaatgggccgtgggacacagaccaaagagtaattcattaatttacagtaaatattttgttttcagtatttgcagggtttcttctttatagggacccaacaacctcttaagtcaacagattctgtggtctcagtgtgaagataggctcaggtctgagact

SEQ ID NO: 42859 - DNA, 457 bp, Homo sapiens
cgcaggatggagctctaggggctggaaaccttggctgaaggtgcctttgagggcctctgcttcattgttttcaaactgttcttcagagatctaggcttcttctccttcctcaggggcctccactccaagctccgccagagtttatttattaataataactattagtagtagcatcatatgaaaagcccactaggggacagctatactttactgaatactgaccaggtaccaagcatggccacatgtagtctctcacttactcctcacagcaaccttacgggataagaactgttattcttcccattaattaaatgagaaaaactgaggagtatgttttatgagtagccaaaggtcctccaaacagtaggaagaggggccaggctccagtgctcacagccctcaccactgctccacactgccgccttcttagggaaaggaaaaagtgccactgcattta

SEQ ID NO: 42860 - DNA, 417 bp, Homo sapiens
aattttactttatgagtactttaaacaagagggctcattatcatgagacaagtactagagcctaccaatgactctagagcatctgatcaccatgccactgatcaattctatcaactttcgtctagtactgttccttaatctgttgcatgtatatggagttgggatgaggaatagggatgcagattacaaatgtagatttgtatgggatcctgatgaaagcaactgacctcagaaaattccatgtgtgcaacacacacacacacactcacatagagtggtaggaggtttcatgaggttcacagattcctgaggtttatccaagcaccctaaattcaaagcctatgtagatgcaccctcttgtcaaccagttaccttctagctatcagctatttcttgtgagcctactatgcaaaaaag

SEQ ID NO: 42861 - DNA, 181 bp, Homo sapiens
cccaggtcaggcctcacggtggcctctccaggatgagctcctgccctccgatggcatctccaggccccaaatggtctccggtcggtgggctcctccacgccaaggttgggcctcccggcgaccgccgcaggcccaagttgtcctgaagtcgggctctcccggccctgcctcccagcaagta

SEQ ID NO: 42862 - DNA, 452 bp, Homo sapiens
ggacagcagaaaaatattttcagttatacagacttagaaacatgtccacctacctttcctggaaaactgacttataagttacatttcacttacttgaaacatgaatgaagataaattctagaacagagaagttgtggcttccttactggcagcaagtgataaaacaatttaatctcagagttaagactaaataactagtggtaggtataaatatgaatgaaattgtaaaaaaataatacttttgtatttagaaccacctcctttcctactttgatctaaaaattccggaatgtatcaaatctggtaactgaaccagtgagggttgggtggtggggcaaagaacatacatagaaagtgaccaaagaggaaacatgagaggcacgaaaagtctagggaagcccctacgagaagcatctaatgtacttagatacaaataacccattaaaaaaaaa

SEQ ID NO: 42863 - DNA, 505 bp, Homo sapiens
cagaatctcactgttgcccaggctggagtacagtagcgcaatcacagctcactgcagcctctcactgtagcctcaaccctgctgggctcaagcgatctcccacattagcctcctgagtagcctggttaatttatttataatttgtagctgggattacaggtacacaccaccaggcctggcctttgccagcctgggcaacgtggcaagaagataacatgtagacaagcagtcaaacatgtattctttttttcccccttttatatgactgatagaattctctgcccactgatctaccatcttgtttttttcacttaactatgtgtctcagtggtttttaaaaatatttatggctgggtgcaatggctcatgcctgtaatcccagctacttgggaggctgaggcaggagaattgcttgaacccaggaagcagaggttgcagtgagctgagattgctccgctacactctaccctgggtgacagaggaagagtccatctcaaaaaaaaaa

SEQ ID NO: 42864 - DNA, 399 bp, Homo sapiens
cccatatcccctgctgagccacgtgtgtgtgtgtgtgtgtgtgtgtgtgtgtctgtgtgtgtgtgtctgtgtgtgtgtgtgtctgtctctctctcttctggatcgctgctgttgcctcctctctgatcaccctgctttcacccttggcccactgtagtctgttctcaacatagcagccctttgcaaacaaacaccactttgacactcctaggctctgaactccccaacagcttcttatcttgctcagagtaaaagccaatggccttggccctgtgtaattcccctgggtttcctgccagtgctcctccccacttccctgctccatccaccctgcagttcctccacagcacaggtgtctttgcacttccccagatacctgaacagctccctcccccacag

SEQ ID NO: 42865 - DNA, 299 bp, Homo sapiens
ggggggaaggacgatgaaaaattacttaatggctacaatgtacattattcaggtgatcgacttccgaaaagcccctaattgaccatagcacatgtaacaaaatcgtacttgcactccataaatttatatacataaaaaaagaaaagttaaatcaaagcataaaaaagaaatgaaaaggccgtcttacataaaccgcaagttcagaagtctttaattaagaatccaatttcaggccgggcagtggctcacacctgtaatcccagcacttcgggaggccacactgggcagatggcttaagg

SEQ ID NO: 42866 - DNA, 430 bp, Homo sapiens
atgggatttgataagatctgttcttttaggaagacctctctgatggctgtgttagtgatttggggttgtggatacagcataatatagcagtgatagcagagagaacaattgggaggcaacttggaattgtgtcaactctcatctttaatgatagctatttttaaatattttttcaataattaaaaatctcgaagtttttccaatcagatatcctcatcttcctgagttcttatttccagtcagggaaacacattttctcctcatttaatttggaactcagaggattaaaataccctgagttttttctaaaagttcattactcattctatccttgaggtgagtggcttataaaaatcattactttaaaataccaaaattttgaatgtcaagtgtactgtagcaaacactgtaagaaaaggcatggtctcac

SEQ ID NO: 42867 - DNA, 240 bp, Homo sapiens
ggttcagtattataaacttcaaaaatcagtggccaagaggagaaagaagattccagagctaagcataagatggaggtgtgcttgacttttaaccctccccacccctccaagcagtggctcagaactcacaaagtcagagaattcttctgaatacccacaaagtggggctaacagctatattcaatttcagacctaaggatgatgaaaatcattgcttggttggaaacacagaaagtgttt

SEQ ID NO: 42868 - DNA, 302 bp, Homo sapiens
ctcatgccatgttgtgattctgtggtggactgggctccgctgggcgactctccagcagctgcaagcagatggtggctggggctggagtcaactcagtgccggacaggactgggcagccatgcagatggcatcttcactcgagtctggggtagctggacagctgagggcttgctgagcattgctgtctctgctctcccttcctctatccctgtggcttcttcacacagggctcccttggacgcccttacagcgtgctggtctctgggaagccagaccccttccatggtgtgtggctttccctt

SEQ ID NO: 42869 - DNA, 616 bp, Homo sapiens
tgagatggagtttcgctcttgtagcccaggctggagtgcaatggcacgatctcagctcactgcaacctccgcctcccgggttcaagcaattctccaatgtcaaggaaatcttagaaagtttcaaggtaaatttggtctttcacaagcttgatgaacaaagagaagcaaccctcgagtaacacttgcgctatacttgaggaaatggcactcagttcttcaataaaacaactcatcattccgttgtaaataaccattaaaaagagaaatattgaattctatgcaaaaaaggattagaaggaaaaatatcttcaaagtgttcataagtatgttctgcaatgactgaaagtctcatgagacatacacagtaaagatactttatttttacttttttgtgtaactctcatcagggccaaacctatcttattcagcaaaaaatccctgttatcaacctgccaaaaataagattcaataaaatatctgcagctgggtgcagtggctcccacctgtaatcctagtactttgggaggcagaggtgggcggatcacaaggtcaggagatcaagaccatgctggctaacagagtgaaaccctgtctctacaaaaatacaaaaaaaaaa

SEQ ID NO: 42870 - DNA, 424 bp, Homo sapiens
aatgagaatacacacgttgcctgtgtagcatagtgcctagcatggaataagcagtgtttgtctacttctttaattatgaaataataatcagatctgcttttcatcacaggcagagggcagaattgatgataggccttcagaattgaccaactccctttcaggaagaatgtcatactgcagatgcagtagccttttagtagcctaaaaagccttcttatccattgtaaagcaggagaatccatgggctgatctatatttacatgctgtacatatcttccccactggaagtttacggaggaaggatggtggcaatagcataacaacagaggggagagactagtacaggtatcgtacaactacatacatgctcagagcatgcccaggacctcaggaggaccagagcagataacacaacaccttgcag

SEQ ID NO: 42871 - DNA, 224 bp, Homo sapiens
cttgctggaagtggggcctggagtagccttgggagctgccaccctaggcacaccaatggtgaccccagtgccactcatcactggcctatgtgggcctgctcctctgtggtggacttgaaccttactgctccagccatctcccctgcctgcctgtcaagcctcgctgttgactgtagtcatcttcatgccaaaggccagacatagcctgcgagacttggatggga

SEQ ID NO: 42872 - DNA, 424 bp, Homo sapiens
  misc_feature (418)..(418): n is a, c, g, or t
  misc_feature (420)..(424): n is a, c, g, or t
ccacctcctcctgccagtccagctgctgctgcccggcctcctgcgtgtccctcctctgccgccccgcaagctcccgcctggcctgctacagcctctgctcaggcaagaagtccagctgctgagtgctcaatccttgtctcctgctgactgtgtctttgctgccaagcaggattctccagtctcaggagcccctggagtcctcagaatccaccagctccatcagtagccacagagctgctgcctgaaggggattttgagcgcgtcacactttcctccccactgtctgggaagagacaacccacaaatccctcagcaggtggactgtggctttctggagcccccttctccaaatgtgttgcttatacccaatgtgacaaagaagaactgctctaatcaataaattcttgagtcaggaaanannnnn

SEQ ID NO: 42873 - DNA, 274 bp, Homo sapiens
cccctggtaaataaaatattggtaaattagttccactgattatgatagcagaggttaatatagccctatggtcaaagtcttggatatattcatatctggagcagattaaggaattttgctaactgacttcaacttcttagcaatcttaaaatgtaagcttaaatatcttgtaggtgtcagtgaaagaggagtatgttcatcttgtggccacaattcagcaattagtgcagataagaatgatcttgtttgaagagcagtggggaaaagctgggta

SEQ ID NO: 42874 - DNA, 357 bp, Homo sapiens
taggtgacagttcagttgtttgctgcagaagagcagcagttcaatattggaattaactttaattttatgtttttaatctgttactaattttttacagaataattgtagtttttataatctggttaattatatgtttgagctgcattactttgcaatgtaagtttttttttttggcatggtcaaataacaaaaattctggttaatgcttatttcatattacaggagaatccagatatttcattagggaaacatataagcagagtgtgatcaggctgtatgaattatttataagagatgtgagtgaaaagatctatttgtagcttaagagtaagtagagtcagatgcatgtagagtctt

SEQ ID NO: 42875 - DNA, 478 bp, Homo sapiens
gatagccaatgccacccatggctgctgcgacggacattgggagtgactgctgtgtggagactgctgtactgggaccatcagtatgaatactttcttctttcttcaagcgcacatttgtaataggcaggaccaagtccctttctacttggaattgccagcttgggctcattgtgggtgctcagcatgtgccattaccactggactcatgagaggtagaaaaaggcgtaaagggggcatagacacggccaatgcctcctgacaatgatcatacaagccacgggcagcaggtgtcccacagaagggctgccagccctaatcacaggagtctgaccagatcctccttgatagtgacaggaggaagccagccctcctcctcagccctggaggagttcacacagcaaatcaacaaatgctaaatgggagacttccggcagccgctcacgcctgccattgggcatcccagtctcctcgtggttcc

SEQ ID NO: 42876 - DNA, 168 bp, Homo sapiens
cccactctcctctttccgcccactctcctcgtttccgcccactctcctctttccgccagcaccacagtataaaatactacagcactctgtgttaaagactaactgtctacatctccatatgttgtagtgttgtagtattttatactgtggtgctgcgagagagagtgg

SEQ ID NO: 42877 - DNA, 2802 bp, Homo sapiens
tctacagaacaaactgcacagcttggtactgagctcttcattgtcaggcaacttcttcaaatagtgaagcagaaaaccaatcaaaattcagtggacactacattgaaatttactttgagtgcactttggaacctcacagatgaatctccaaccacttgtagacactttattgaaaaccaagggttagaactcttcatgagggttctagagtctttcccaactgagtcatccattcagcagaaagttctaggacttttgaacaatatagctgaagtacaagaattacattctgaattaatgtggaaagattttatagaccacatcagtagtctcctacacagtgtggaagtggaagtcagttactttgcagctggaattattgcccatttaatatccagaggtgaacaagcttggacattgagtcgtagccagaggaattctctgctggatgatttgcattcagctattttgaaatggccaactccagagtgtgagatggtagcatacaggtcctttaatccatttttcccattacttggctgtttcacaacaccaggagttcagctatgggcagtttgggccatgcaacatgtctgcagcaagaatccttcaaggtattgcagcatgctgattgaagaaggaggattgcagcatttatacaacatcaaagatcatgaacatactgatccccatgtccaacagattgctgtggccattctggatagcttagaaaaacacattgtgcgccatgggaggccacctccctgtaaaaaacagccccaagccagactaaattgatagccataagtattggatagttgaatcacaggaatcctttttgtgattggtccatttggaatatcttaccctccctgatgttttgggggtttctatgacaagagtcataaaatcagtttgggattgataatgtgtagtactgcccatgtgaacagtctctaatttgtcttgtgattttaaacttatgagtcaagaagggtctcttcctttatcattgccttttaggaaattttccacatctttcagtgtttgaacttacttgtgcttgagattctacagttttatggtaaagtttgcacgaacccttaggccagacttttctgatctcagagtcccttccaatcaatttgcagcttcacataagctgttgacctgatttctgacactgcttcagttgtaaattttatactgcttctgtataaaatgcctttcttctctatctgtgtatattttataagatgtccttcttagtgtgaaagaagggaaatgtggatcatcttgtggaagctaatcactggcaggagcctggatggctggcggaaagatatatgagaaagaaaaattatgaaggtagaacagagtgtaggaactgggaattggtttcatggtataggttttaaaatgagacaggctacccttcgggagtccacctctcttgaggcggtgagcagaagcttgtcctccatatttatacctagaagtgtggactgctggttcctgcacagactgccggttattcactaggaatatttccccaagcaccacagtataaaatactacagcactctgtgttaaagactaactgtctacatctccatatgttgtagtgttgtgaaaatgtgattttaaaaaattatcgccagttaaaactggctattcttttcctctatttcaaagtcatttttgttcagtggaatagagacagcaacatggtgttaacctctcaattaaaatacaattgacaccagtaaattttgccataaaaagttaaaatctcttgttcaaaatatgtgtatcttcttaatgtgttcatgttagagaaagtgtccccatctcactgccaaaaatgaaagaaaataattaaactctttaaatgattaaatgtaatgattctactcgcagtgcataacagcacatatttttgacagattattttttaggcaattacctttccttaaggtatctgatacagtatagtaaagaatcacttatatcagtaatagcacttgagagatagcaagtcaccaagaaacttaattttcatttaaaattttattttgtgaataaggtcaatctacaatcccagataactacattttttttcatagatggccagtgttttcaacagagatttaaaatggaatattaaaattatagtgattattcagaagcattttaatttagaaaggagctggtttgttagttcactgatgacattttttgacaaacattttataccattatcacaataatcagacttgaattttttttggagttccttcatgtgaatgaaaactgagttaaaagaaagtaggcatttaggtctggatgcagtggctcatgcttgtgatcccagcactttgggaagctgaagcaggaggattgcttgagcccagaagttcaagactagcctgggcaacatagtgagactcggtctctaccaaaaaaaaaaattttttttttttaaattagctgggtgtggtggcacctgggaaacagagcgagacgctgactcaaataaatatctaaatagatatttagaatcactgaaaaccatattaaatgctgggttaatgctgacttaattggcttaaggaatttttataggcgtaagataaattttcacagactaagtttatttcagacaaaatagagaattcttttaaaagttttttttttttttttcctttttcgaatgttaatgtctaagacaaagttcagaaaacgagatggcctgtggtagtttggaaattgctagatatgttgaccgtttccaggtctttt

SEQ ID NO: 42878 - DNA, 1767 bp, Homo sapiens
ctcgtcgcgtagggtatcctatgggggtgtgggtaggctaagcgtttggatgctgcatgctgcgtgcttgatgccagacttttctgatctcagagtcccttccaatcaatttgcagcttcacataagctgttgacctgatttctgacactgcttcagttgtaaattttatactgcttctgtataaaatgcctttcttctctatctgtgtatattttataagatgtccttcttagtgtgaaagaagggaaatgtggatcatcttgtggaagctaatcactggcaggagcctggatggctggcggaaagatatatgagaaagaaaaattatgaaggtagaacagagtgtaggaactgggaattggtttcatggtataggttttaaaatgagacaggctacccttcgggagtccacctctcttgaggcggtgagcagaagcttgtcctccatatttatacctagaagtgtggactgctggttcctgcacagactgccggttattcactaggaatatttccccaagcaccacagtataaaatactacagcactctgtgttaaagactaactgtctacatctccatatgttgtagtgttgtgaaaatgtgattttaaaaaattatcgccagttaaaactggctattcttttcctctatttcaaagtcatttttgttcagtggaatagagacagcaacatggtgttaacctctcaattaaaatacaattgacaccagtaaattttgccataaaaagttaaaatctcttgttcaaaatatgtgtatcttcttaatgtgttcatgttagagaaagtgtccccatctcactgccaaaaatgaaagaaaataattaaactctttaaatgattaaatgtaatgattctactcgcagtgcataacagcacatatttttgacagattattttttaggcaattacctttccttaaggtatctgatacagtatagtaaagaatcacttatatcagtaatagcacttgagagatagcaagtcaccaagaaacttaattttcatttaaaattttattttgtgaataaggtcaatctacaatcccagataactacattttttttcatagatggccagtgttttcaacagagatttaaaatggaatattaaaattatagtgattattcagaagcattttaatttagaaaggagctggtttgttagttcactgatgacattttttgacaaacattttataccattatcacaataatcagacttgaattttttttggagttccttcatgtgaatgaaaactgagttaaaagaaagtaggcatttaggtctggatgcagtggctcatgcttgtgatcccagcactttgggaagctgaagcaggaggattgcttgagcccagaagttcaagactagcctgggcaacatagtgagactcggtctctaccaaaaaaaaaaattttttttttttaaattagctgggtgtggtggcacctgggaaacagagcgagacgctgactcaaataaatatctaaatagatatttagaatcactgaaaaccatattaaatgctgggttaatgctgacttaattggcttaaggaatttttataggcgtaagataaattttcacagactaagtttatttcagacaaaatagagaattcttttaaaagttttttttttttttttcctttttcgaatgttaatgtctaagacaaagttcagaaaacgagatggcctgtggtagtttggaaattgctagatatgttgaccgtttccaggtctttt

SEQ ID NO: 42879 - DNA, 690 bp, Homo sapiens
  misc_feature (671)..(671): n is a, c, g, or t
actttccacagtagcagagtagcataccccaaccaccctctaatagctagcttgtttgtataggtagaatgattcatctctccattttaaatggctagatgtttcgtggaagatcttaaaattgcctgcctcttttgaacaatatagctgaagtacaagaattacattctgaattaatgtggaaagattttatagaccacatcagtagtctcctacacagtgtggaagtggaagtcagttactttgcagctggaattattgcccatttaatatccagaggtgaacaagcttggacattgagtcgtagccagaggaattctctgctggatgatttggtagggtcattccataccaacaaaagacattcatagtggttaaactatcaaagcctcataatgtagtaaataatgcagtgctaaataaatattgtaatcctttcttgtgtgtcttttgtcttccagcattcagctattttgaaatggccaactccagagtgtgagatggtagcatacaggtaattagtatcataattaacagtaaaccagcaacctagtctagagatcattcctaagagtcattcctactagatgcataatttttccctcaggcacctcaatattggttatttatttatttattttgagacagagtttcactccagcctgagcganccgagcaaggctccgtctc

SEQ ID NO: 42880 - DNA, 2891 bp, Homo sapiens
tctacagaacaaactgcacagcttggtactgagctcttcattgtcaggcaacttcttcaaatagtgaagcagaaaaccaatcaaaattcagtggacactacattgaaatttactttgagtgcactttggaacctcacagatgaatctccaaccacttgtagacactttattgaaaaccaagggttagaactcttcatgagggttctagagtctttcccaactgagtcatccattcagcagaaagttctaggacttttgtgtggatctgctgatgatgaattcttcagcttttgtctgactgaaaacatctttacttaacctttgtttttgaaagatacttttaccagaacaatatagctgaagtacaagaattacattctgaattaatgtggaaagattttatagaccacatcagtagtctcctacacagtgtggaagtggaagtcagttactttgcagctggaattattgcccatttaatatccagaggtgaacaagcttggacattgagtcgtagccagaggaattctctgctggatgatttgcattcagctattttgaaatggccaactccagagtgtgagatggtagcatacaggtcctttaatccatttttcccattacttggctgtttcacaacaccaggagttcagctatgggcagtttgggccatgcaacatgtctgcagcaagaatccttcaaggtattgcagcatgctgattgaagaaggaggattgcagcatttatacaacatcaaagatcatgaacatactgatccccatgtccaacagattgctgtggccattctggatagcttagaaaaacacattgtgcgccatgggaggccacctccctgtaaaaaacagccccaagccagactaaattgatagccataagtattggatagttgaatcacaggaatcctttttgtgattggtccatttggaatatcttaccctccctgatgttttgggggtttctatgacaagagtcataaaatcagtttgggattgataatgtgtagtactgcccatgtgaacagtctctaatttgtcttgtgattttaaacttatgagtcaagaagggtctcttcctttatcattgccttttaggaaattttccacatctttcagtgtttgaacttacttgtgcttgagattctacagttttatggtaaagtttgcacgaacccttaggccagacttttctgatctcagagtcccttccaatcaatttgcagcttcacataagctgttgacctgatttctgacactgcttcagttgtaaattttatactgcttctgtataaaatgcctttcttctctatctgtgtatattttataagatgtccttcttagtgtgaaagaagggaaatgtggatcatcttgtggaagctaatcactggcaggagcctggatggctggcggaaagatatatgagaaagaaaaattatgaaggtagaacagagtgtaggaactgggaattggtttcatggtataggttttaaaatgagacaggctacccttcgggagtccacctctcttgaggcggtgagcagaagcttgtcctccatatttatacctagaagtgtggactgctggttcctgcacagactgccggttattcactaggaatatttccccaagcaccacagtataaaatactacagcactctgtgttaaagactaactgtctacatctccatatgttgtagtgttgtgaaaatgtgattttaaaaaattatcgccagttaaaactggctattcttttcctctatttcaaagtcatttttgttcagtggaatagagacagcaacatggtgttaacctctcaattaaaatacaattgacaccagtaaattttgccataaaaagttaaaatctcttgttcaaaatatgtgtatcttcttaatgtgttcatgttagagaaagtgtccccatctcactgccaaaaatgaaagaaaataattaaactctttaaatgattaaatgtaatgattctactcgcagtgcataacagcacatatttttgacagattattttttaggcaattacctttccttaaggtatctgatacagtatagtaaagaatcacttatatcagtaatagcacttgagagatagcaagtcaccaagaaacttaattttcatttaaaattttattttgtgaataaggtcaatctacaatcccagataactacattttttttcatagatggccagtgttttcaacagagatttaaaatggaatattaaaattatagtgattattcagaagcattttaatttagaaaggagctggtttgttagttcactgatgacattttttgacaaacattttataccattatcacaataatcagacttgaattttttttggagttccttcatgtgaatgaaaactgagttaaaagaaagtaggcatttaggtctggatgcagtggctcatgcttgtgatcccagcactttgggaagctgaagcaggaggattgcttgagcccagaagttcaagactagcctgggcaacatagtgagactcggtctctaccaaaaaaaaaaattttttttttttaaattagctgggtgtggtggcacctgggaaacagagcgagacgctgactcaaataaatatctaaatagatatttagaatcactgaaaaccatattaaatgctgggttaatgctgacttaattggcttaaggaatttttataggcgtaagataaattttcacagactaagtttatttcagacaaaatagagaattcttttaaaagttttttttttttttttcctttttcgaatgttaatgtctaagacaaagttcagaaaacgagatggcctgtggtagtttggaaattgctagatatgttgaccgtttccaggtctttt

SEQ ID NO: 42881 - DNA, 2681 bp, Homo sapiens
actttccacagtagcagagtagcataccccaaccaccctctaatagctagcttgtttgtataggtagaatgattcatctctccattttaaatggctagatgtttcgtggaagatcttaaaattgcctgcctcttttgaacaatatagctgaagtacaagaattacattctgaattaatgtggaaagattttatagaccacatcagtagtctcctacacagtgtggaagtggaagtcagttactttgcagctggaattattgcccatttaatatccagaggtgaacaagcttggacattgagtcgtagccagaggaattctctgctggatgatttgcattcagctattttgaaatggccaactccagagtgtgagatggtagcatacaggtcctttaatccatttttcccattacttggctgtttcacaacaccaggagttcagctatgggcagtttgggccatgcaacatgtctgcagcaagaatccttcaaggtattgcagcatgctgattgaagaaggaggattgcagcatttatacaacatcaaagatcatgaacatactgatccccatgtccaacagattgctgtggccattctggatagcttagaaaaacacattgtgcgccatgggaggccacctccctgtaaaaaacagccccaagccagactaaattgatagccataagtattggatagttgaatcacaggaatcctttttgtgattggtccatttggaatatcttaccctccctgatgttttgggggtttctatgacaagagtcataaaatcagtttgggattgataatgtgtagtactgcccatgtgaacagtctctaatttgtcttgtgattttaaacttatgagtcaagaagggtctcttcctttatcattgccttttaggaaattttccacatctttcagtgtttgaacttacttgtgcttgagattctacagttttatggtaaagtttgcacgaacccttaggccagacttttctgatctcagagtcccttccaatcaatttgcagcttcacataagctgttgacctgatttctgacactgcttcagttgtaaattttatactgcttctgtataaaatgcctttcttctctatctgtgtatattttataagatgtccttcttagtgtgaaagaagggaaatgtggatcatcttgtggaagctaatcactggcaggagcctggatggctggcggaaagatatatgagaaagaaaaattatgaaggtagaacagagtgtaggaactgggaattggtttcatggtataggttttaaaatgagacaggctacccttcgggagtccacctctcttgaggcggtgagcagaagcttgtcctccatatttatacctagaagtgtggactgctggttcctgcacagactgccggttattcactaggaatatttccccaagcaccacagtataaaatactacagcactctgtgttaaagactaactgtctacatctccatatgttgtagtgttgtgaaaatgtgattttaaaaaattatcgccagttaaaactggctattcttttcctctatttcaaagtcatttttgttcagtggaatagagacagcaacatggtgttaacctctcaattaaaatacaattgacaccagtaaattttgccataaaaagttaaaatctcttgttcaaaatatgtgtatcttcttaatgtgttcatgttagagaaagtgtccccatctcactgccaaaaatgaaagaaaataattaaactctttaaatgattaaatgtaatgattctactcgcagtgcataacagcacatatttttgacagattattttttaggcaattacctttccttaaggtatctgatacagtatagtaaagaatcacttatatcagtaatagcacttgagagatagcaagtcaccaagaaacttaattttcatttaaaattttattttgtgaataaggtcaatctacaatcccagataactacattttttttcatagatggccagtgttttcaacagagatttaaaatggaatattaaaattatagtgattattcagaagcattttaatttagaaaggagctggtttgttagttcactgatgacattttttgacaaacattttataccattatcacaataatcagacttgaattttttttggagttccttcatgtgaatgaaaactgagttaaaagaaagtaggcatttaggtctggatgcagtggctcatgcttgtgatcccagcactttgggaagctgaagcaggaggattgcttgagcccagaagttcaagactagcctgggcaacatagtgagactcggtctctaccaaaaaaaaaaattttttttttttaaattagctgggtgtggtggcacctgggaaacagagcgagacgctgactcaaataaatatctaaatagatatttagaatcactgaaaaccatattaaatgctgggttaatgctgacttaattggcttaaggaatttttataggcgtaagataaattttcacagactaagtttatttcagacaaaatagagaattcttttaaaagttttttttttttttttcctttttcgaatgttaatgtctaagacaaagttcagaaaacgagatggcctgtggtagtttggaaattgctagatatgttgaccgtttccaggtctttt

SEQ ID NO: 42882 - DNA, 484 bp, Homo sapiens
tgagatagctctcgctctgtctcccaggtctgtcttccaggctggagtgcagtggtgcaatctcggctcactgcatcctcaacctccttagttcaaaccccttctgccttagcctcctgagcagctaacaggcacacaccactgcagctggccaatttttttttttttttttggtagagatggggtctcactatgttgccaaggctggtctcaaactcctgggctcaagtgatccatctgcctcggcctcccaaagtgctgggattttaggtgtgagccactgtgcttggtgtaatttaacttttatattccccctccttttttttttttttttaagatattcttaaagttcattgttatcctgatcaccaaatccagggacctttcacttcccttgcaactggcagtgaatcacttcttggtggatattgcctcttcttgttcatcgtggagctgaaatactctgcctttaacgtcctgattg

SEQ ID NO: 42883 - DNA, 148 bp, Homo sapiens
taccttgcaaggctgtcaatcaatcagcaactttattttcacgtttctggtacaatttctgagaagtgtgttgaaaattatccctccctcccccacaaaattcccctacctggaatatttgaattccttgtccacttagaaaaacttg

SEQ ID NO: 42884 - DNA, 324 bp, Homo sapiens
agagtggggtgatggataaagtactacacactgggttcagtgtacactgctctggcaacgagtgcaccaaaatctcggaaattactactaaagaagttactcatgtaaccaaacaccacctggtccccaaaactactgaaatttttttaaaaatgaaaaacccagctattcatttaataaaatcaaactttacagaattatctaagtaaaaataaaaagttttaccattttctttattttttcagaaattacttctgttgagtatttggtgacactttctagatcttttctatgtataagtacactcatagacacataaataaa

SEQ ID NO: 42885 - DNA, 453 bp, Homo sapiens
tgtgaagctgcccaggtggtgtgtaggaaattttggtagagaaagaaatagtttgaaagttggtttctgacaagaggaaagaaaaggctgcaacactaaaggaagactcaaagtgttaaaaggacgctcaaaatgtagtattgtggcaggtcgggcagagacggggttttactgtgttagccaggatggtctcggtctcctgacctcgtgatctacccgcctcagcctcccaaagtgttgggattacaggcatgagccaccgcgcccagccgtcttgtcaaaatactctaagacttcatctgtttagaatcaaaagtgcggaagacctgggaattatgtaataaggatagcagaataatcctcgtcactgacaggtggtgagctgtaaagtgttcttttgttgcagtggcagagatttcagcaatggagggaaatccagtggccaagatgctt

SEQ ID NO: 42886 - DNA, 627 bp, Homo sapiens
attttgacattcagtgaggcctttttagtgtttttaatgtgtgcattatagtacgtataagaacatactgaaattaccaatttaatcatatccttctccagattattagcattttgacggtagggactataatgattttatctctgtatacctagtatctaccactgtgaatatcacgtagtagattattttgttggatgaatggatgcttgctaaaataactgctgtgtacgcgtgtgtatatttgtacctgtatacacactgctatgggtttgaagggatcatgtctccttcaaaattcatgtcgaaaaataatccccctaattaaatagtattaagagggtgtggggttttggggaagtgtacccagagctgctgattgttctagaaccaccccactattccaagtttattaggctcagagccactgagagccttgagttctgggcacttctgtcacccatctccttttgcagcaccagacaaagaattttcctttttagcctcattgtttgcatgcctaggagtcggtcactgtgctcctcgtagtctttgggtctcagaaatagtgaacaggtacagcatccagggtggaatttttgcctttagtaccctcccttgaactct

SEQ ID NO: 42887 - DNA, 449 bp, Homo sapiens
cctaaacaaatggatgaaatctatgggtcagattttccccctaagaagctcaatcattatgcacatggaaaatgcaaggttttacatcccacatatatttcagacactttaatgctttgattcagccttaatggcagggcttgggattttgttcccactttagtacagccagctaggattttagtgtttatagaaataaagcataaaaaagtaatatttcccatgacaaacatcagggactgggtgctttacaagtttaagtttttaaacattttaaaaatatgataacagtttttgtaaaacagttttaacttttgaataatgaaaatcttactcagaaatgactggtacatttttaatgtacccacaacaaaaccttttttttgtagtcttgtaagtgaaagaaaaagccaattcttaatgtgtaagaagtgctgaatatgagacaa

SEQ ID NO: 42888 - DNA, 3831 bp, Homo sapiens
  misc_feature (1)..(1): n is a, c, g, or t
  misc_feature (3)..(3): n is a, c, g, or t
  misc_feature (8)..(8): n is a, c, g, or t
  misc_feature (13)..(13): n is a, c, g, or t
  misc_feature (15)..(15): n is a, c, g, or t
  misc_feature (18)..(18): n is a, c, g, or t
  misc_feature (130)..(130): n is a, c, g, or t
  misc_feature (1001)..(1001): n is a, c, g, or t
nanctttnttctntnaanagcctgtgacctgttgttacagccggacaatctagcttgtaaacccttctggaagcctcggaacctgaacatcagccagcatggctcggacatgcaggtgtccttcgaccangcaccgcacaacttcggcttccgtttcttctatcttcactacaagctcaagcacgaaggacctttcaagcgaaagacctgtaagcaggagcaaactacagagacgaccagctgcctccttcaaaatgtttctccaggggattatataattgagctggtggatgacactaacacaacaagaaaagtgatgcattatgccttaaagccagtgcactccccgtgggccgggcccatcagagccgtggccatcacagtgccactggtagtcatatcggcattcgcgacgctcttcactgtgatgtgccgcaagaagcaacaagaaaatatatattcacatttagatgaagagagctctgagtcttccacatacactgcagcactcccaagagagaggctccggccgcggccgaaggtctttctctgctattccagtaaagatggccagaatcacatgaatgtcgtccagtgtttcgcctacttcctccaggacttctgtggctgtgaggtggctctggacctgtgggaagacttcagcctctgtagagaagggcagagagaatgggtcatccagaagatccacgagtcccagttcatcattgtggtttgttccaaaggtatgaagtactttgtggacaagaagaactacaaacacaaaggaggtggccgaggctcggggaaaggagagctcttcctggtggcggtgtcagccattgccgaaaagctccgccaggccaagcagagttcgtccgcggcgctcagcaagtttatcgccgtctactttgattattcctgcgagggagacgtccccggtatcctagacctgagtaccaagtacagactcatggacaatcttcctcagctctgttcccacntgcactcccgagaccacggcctccaggagccggggcagcacacgcgacagggcagcagaaggaactacttccggagcaagtcaggccggtccctatacgtcgccatttgcaacatgcaccagtttattgacgaggagcccgactggttcgaaaagcagttcgttcccttccatcctcctccactgcgctaccgggagccagtcttggagaaatttgattcgggcttggttttaaatgatgtcatgtgcaaaccagggcctgagagtgacttctgcctaaaggtagaggcggctgttcttggggcaaccggaccagccgactcccagcacgagagtcagcatgggggcctggaccaagacggggaggcccggcctgcccttgacggtagcgccgccctgcaacccctgctgcacacggtgaaagccggcagcccctcggacatgccgcgggactcaggcatctatgactcgtctgtgccctcatccgagctgtctctgccactgatggaaggactctcgacggaccagacagaaacgtcttccctgacggagagcgtgtcctcctcttcaggcctgggtgaggaggaacctcctgcccttccttccaagctcctctcttctgggtcatgcaaagcagatcttggttgccgcagctacactgatgaactccacgcggtcgcccctttgtaacaaaacgaaagagtctaagcattgccactttagctgctgcctccctctgattccccagctcatctccctggttgcatggcccacttggagctgaggtctcatacaaggatatttggagtgaaatgctggccagtacttgttctcccttgccccaaccctttaccggatatcttgacaaactctccaattttctaaaatgatatggagctctgaaaggcatgtccataaggtctgacaacagcttgccaaatttggttagtccttggatcagagcctgttgtgggaggtagggaggaaatatgtaaagaaaaacaggaagatacctgcactaatcattcagacttcattgagctctgcaaactttgcctgtttgctattggctaccttgatttgaaatgctttgtgaaaaaaggcacttttaacatcatagccacagaaatcaagtgccagtctatctggaatccatgttgtattgcagataatgttctcatttatttttgatgtagaatttacattgccatgggtgttaaataagctttgagtcaaaagtcaagaaagtgactgaatatacagtcaccttttatgaaatgagtctctgtgttactgggtggcatgactgattgaggtgaagctcacggggccaggctgaccgtcttgaccgttccacttgagataggttggtcatcgtgcagaaggccccaggacctcagcacacacagcctcctcttggtctgagtaggcatcatgtgggggccagatctgcctgctgtttccatgggttacatttactgtgctgtatctcagatgttggtgtctggaagtttattcttaagagactgctacccagctggtctgtattattggaagttgcagttcgtgctttggttggccttctggtctaaagctgtgtcctgaatattagggatcacaattcactgaaatacagcagtgtgtggaggtgatggccagttaatctgctgaactggttttgactaatgacaaacctctttttaagatggtagaatggaggtgatagtcacaaaagtaaatgttccatttttatgaatgactttctacagagtttctatttctaaagaaaaaacaattgttcacatcccatctgatgattagcatgtgtgtaatgaatgctgtcttggtctcccctgtggaaacccttctccctgtgccttagagcaggtgtgtacatctctcactacctttctcatgggtgctgttagattttggcacccgttttctcagcattcagcccagggaatgtggttttcacttcttcgtcagataagaccaacatgaaggggtatgttgagaaacatcctgaggcaaggtgggaggtgggatggggcaggactttcccttccaagcacatgcatggcaggtggggaaaggggggcttgcacccctgctggaaagaaaaggtttgtgtatatttctgatgcaaatgtcatactcactgctctgtaaaggcagctggcagctttttgggaaaagaacgtgctcgtctgttctctggcatcaagtttcttgcagctgctctgagggagagacagtgagctgcaagactgcctccccataacaacaggcaactcagagaagagtcattttatgttgttcctatggaatctggaatgagtgcagagctcctacccacacatgactgccccgccatttcatcctaggcattctgtgaaggagattggttagtccaaacttgctaacatacgaaaattcacttggaacatgatgagagatttcttattgaggccaagagatgtttcctgtcccagaggaaccattaggagtcgcttttagggtattcagctttgttcatgaaataaggcatctctgagaaagtggccccagggagagaatggaggactgggaggagaagcattaactgagctccaagggtgtgtgggcagagagcttgctatgtgaactcactccttaagaaaatggaagagaaaaagagagtgctagttaaaaaatcgggatgttttagtttggatttagggttttgatacttatgttgaaatactaatgtttctgatcaataaaatcaaactcttaatataccgagtaatgaaaccatagtgtgattgcctcagaataaattgagaagt

SEQ ID NO: 42889 - DNA, 5597 bp, Homo sapiens
  misc_feature (1)..(1): n is a, c, g, or t
  misc_feature (3)..(3): n is a, c, g, or t
  misc_feature (8)..(8): n is a, c, g, or t
  misc_feature (13)..(13): n is a, c, g, or t
  misc_feature (15)..(15): n is a, c, g, or t
  misc_feature (18)..(18): n is a, c, g, or t
  misc_feature (130)..(130): n is a, c, g, or t
  misc_feature (1001)..(1001): n is a, c, g, or t
nanctttnttctntnaanagcctgtgacctgttgttacagccggacaatctagcttgtaaacccttctggaagcctcggaacctgaacatcagccagcatggctcggacatgcaggtgtccttcgaccangcaccgcacaacttcggcttccgtttcttctatcttcactacaagctcaagcacgaaggacctttcaagcgaaagacctgtaagcaggagcaaactacagagacgaccagctgcctccttcaaaatgtttctccaggggattatataattgagctggtggatgacactaacacaacaagaaaagtgatgcattatgccttaaagccagtgcactccccgtgggccgggcccatcagagccgtggccatcacagtgccactggtagtcatatcggcattcgcgacgctcttcactgtgatgtgccgcaagaagcaacaagaaaatatatattcacatttagatgaagagagctctgagtcttccacatacactgcagcactcccaagagagaggctccggccgcggccgaaggtctttctctgctattccagtaaagatggccagaatcacatgaatgtcgtccagtgtttcgcctacttcctccaggacttctgtggctgtgaggtggctctggacctgtgggaagacttcagcctctgtagagaagggcagagagaatgggtcatccagaagatccacgagtcccagttcatcattgtggtttgttccaaaggtatgaagtactttgtggacaagaagaactacaaacacaaaggaggtggccgaggctcggggaaaggagagctcttcctggtggcggtgtcagccattgccgaaaagctccgccaggccaagcagagttcgtccgcggcgctcagcaagtttatcgccgtctactttgattattcctgcgagggagacgtccccggtatcctagacctgagtaccaagtacagactcatggacaatcttcctcagctctgttcccacntgcactcccgagaccacggcctccaggagccggggcagcacacgcgacagggcagcagaaggaactacttccggagcaagtcaggccggtccctatacgtcgccatttgcaacatgcaccagtttattgacgaggagcccgactggttcgaaaagcagttcgttcccttccatcctcctccactgcgctaccgggagccagtcttggagaaatttgattcgggcttggttttaaatgatgtcatgtgcaaaccagggcctgagagtgacttctgcctaaaggtagaggcggctgttcttggggcaaccggaccagccgactcccagcacgagagtcagcatgggggcctggaccaagacggggaggcccggcctgcccttgacggtagcgccgccctgcaacccctgctgcacacggtgaaagccggcagcccctcggacatgccgcgggactcaggcatctatgactcgtctgtgccctcatccgagctgtctctgccactgatggaaggactctcgacggaccagacagaaacgtcttccctgacggagagcgtgtcctcctcttcaggcctgggtgaggaggaacctcctgcccttccttccaagctcctctcttctgggtcatgcaaagcagatcttggttgccgcagctacactgatgaactccacgcggtcgcccctttgtaacaaaacgaaagagtctaagcattgccactttagctgctgcctccctctgattccccagctcatctccctggttgcatggcccacttggagctgaggtctcatacaaggatatttggagtgaaatgctggccagtacttgttctcccttgccccaaccctttaccggatatcttgacaaactctccaattttctaaaatgatatggagctctgaaaggcatgtccataaggtctgacaacagcttgccaaatttggttagtccttggatcagagcctgttgtgggaggtagggaggaaatatgtaaagaaaaacaggaagatacctgcactaatcattcagacttcattgagctctgcaaactttgcctgtttgctattggctaccttgatttgaaatgctttgtgaaaaaaggcacttttaacatcatagccacagaaatcaagtgccagtctatctggaatccatgttgtattgcagataatgttctcatttatttttgatgtagaatttacattgccatgggtgttaaataagctttgagtcaaaagtcaagaaagtgactgaatatacagtcaccttttatgaaatgagtctctgtgttactgggtggcatgactgattgaggtgaagctcacggggccaggctgaccgtcttgaccgttccacttgagataggttggtcatcgtgcagaaggccccaggacctcagcacacacagcctcctcttggtctgagtaggcatcatgtgggggccagatctgcctgctgtttccatgggttacatttactgtgctgtatctcagatgttggtgtctggaagtttattcttaagagactgctacccagctggtctgtattattggaagttgcagttcgtgctttggttggccttctggtctaaagctgtgtcctgaatattagggatcacaattcactgaaatacagcagtgtgtggaggtgatggccagttaatctgctgaactggttttgactaatgacaaacctctttttaagatggtagaatggaggtgatagtcacaaaagtaaatgttccatttttatgaatgactttctacagagtttctatttctaaagaaaaaacaattgttcacatcccatctgatgattagcatgtgtgtaatgaatgctgtcttggtctcccctgtggaaacccttctccctgtgccttagagcaggtgtgtacatctctcactacctttctcatgggtgctgttagattttggcacccgttttctcagcattcagcccagggaatgtggttttcacttcttcgtcagataagaccaacatgaaggggtatgttgagaaacatcctgaggcaaggtgggaggtgggatggggcaggactttcccttccaagcacatgcatggcaggtggggaaaggggggcttgcacccctgctggaaagaaaaggtttgtgtatatttctgatgcaaatgtcatactcactgctctgtaaaggcagctggcagctttttgggaaaagaacgtgctcgtctgttctctggcatcaagtttcttgcagctgctctgagggagagacagtgagctgcaagactgcctccccataacaacaggcaactcagagaagagtcattttatgttgttcctatggaatctggaatgagtgcagagctcctacccacacatgactgccccgccatttcatcctaggcattctgtgaaggagattggttagtccaaacttgctaacatacgaaaattcacttggaacatgatgagagatttcttattgaggccaagagatgtttcctgtcccagaggaaccattaggagtcgcttttagggtattcagctttgttcatgaaataaggcatctctgagaaagtggccccagggagagaatggaggactgggaggagaagcattaactgagctccaagggtgtgtgggcagagagcttgctatgtgaactcactccttaagaaaatggaagagaaaaagagagtgctagttaaaaaatcgggatgttttagtttggatttagggttttgatacttatgttgaaatactaatgtttctgatcaataaaatcaaactcttaatataccgagtaatgaaaccatagtgtgattgcctcagaataaattgagaagtccaacttcctagttttgtttaattagtttcactttttctactctccccagtatgctagaaatgggaatcgttgccctgcagattacggcaaaacatctgttttaagcaaagctgcattttttgactcagaaattgtcccagacggtggatataagatgaaattcagaaaaacgttctgccaagtcacaggcttttagatattatggaaacaagaaatggaaaacaggatgatctccatgagaggccttgatcctgagagtaaaaggcttgtgtagataggttagacaacgtcctctagaaaagagaccagggataagtccaggtttccaggaaaaccaagaagcctgcgggtagctgaaggtagagtgctagttgttcatcttaacttaccaatgagctacagaaaggacttagcatctgatgtcatcagctttgccaggagagtgatcaaggaggttaaagctcaggtaaaggtgtgccttctcagagattggctacaagcaacagagaccacctcaacagagaccacctcaacagactcagcccagccatacaaggtgccaaagctcctccagagggctgtcttgggcctttgaggcaattgatctccagaaagagtcagaagtcattccagtccaggcccaggtattcagatggtgacccagccagataatagtatcttgagcaaataatagtatcttgagtgcaaataagcaggaagactgtccttcaaaaaatgtggggttacatgattttcagagcctttttttcagagttgagcatcttttcttttaaaagaaataaggggcaagaggaccaattttattccttgaggaaaaatgacacacccttctcccaaaagaaagaaaactctctggccccccaacttcaacactaatttggctccctgaagaagagagaaaatattatttctgtctttattgaagagaaatgggcaatgccaatgtgaaggttactagtcttttttattttctattggtgaagactactactgctcttatttagcagatcttataccttcagtggtcaccagtatagcaggtgaggtataaggaaaacagcagtgtgatgataaatggtaattaatatactttgtctgtgtcagcaatagggaatggtggggactgtggcaaactgaagcgcccctgttccacccacagtgggtaattttccagtcgactgtggccatgaagtacttcctgatcttcccatttttcaagaaaagctgacaatctggatttttatatgaaaaattctgattttaaaaaatattggcaacaagagcgaaactccgtctcaacaacaacaacaaaaagtttggtatgtttctctcaagaaaaaagcatggtgagtccagacagcagcaaaagcttttgtgaaaaccaattgtgttcatctagatagtaagtaactcctatttttactgttaattttttaaaagagaatttttccctgtggaaactccctgttagtacgtcctaggggagaaagcctgtggaatatggtggttattgatggcgttgcctttgtttcatctttgagtttgccctttgtgggatctagtgggataatgagcactgacagaactcttaacagcgtgctgtatttttgacattgaaaatgttaatgacttgatttgtacataactctgtaactaggtgaaagtagatcacagctgacatttacaaaatgtttttgtaccttagaatttctgcattaaataaaatgttttgttttaaaaaaaa

SEQ ID NO: 42890 - DNA, 747 bp, Homo sapiens
gcacgaggagaactagtctcgagttttttttttgcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaacctcaaaaaaaaaaaaaaaaaaaaactcgaaaaagtttggtatgtttctctcaagaaaaaagcatggtgagtccagacagcagcaaaagcttttgtgaaaaccaattgtgttcatctagatagtaagtaactcctatttttactgttaattttttaaaagagaatttttccctgtggaaactccctgttagtacgtcctaggggagaaagcctgtggaatatggtggttattgatggcgttgcctttgtttcatctttgagtttgccctttgtgggatctagtgggataatgagcactgacagaactcttaacagcgtgctgtatttttgacattgaaaatgttaatgacttgatttgtacataactctgtaactaggtgaaagtagatcacagctgacatttacaaaatgtttttgtaccttagaatttctgcattaaataaaatgttttgttttaaaaaaaa

SEQ ID NO: 42891 - DNA, 185 bp, Homo sapiens
tatgaaaaattctgattttaaaaaatattggcaactaagttaaaattcaagtgaatttagacccagcagaagacatggatggacctgatttggtccactgactaccagtttgttaacctgtgctttataagatttgaaggaaaggcattcatggtaattacagacggtgccaccagaaaatgctc

SEQ ID NO: 42892 - DNA, 2830 bp, Homo sapiens
tggcagtcggaagttgcctgagcagatcccagccggctggctcgagtggccttcgtcgtcccttggcgccctgggagagtcgctgacgggtggactgacggaccgcctgaggacggccggccagggcggtgaaagcgccagccctatggcgcgggtcgcgtgaggcggaaggccgaggacggccggcggcggcgcccgccccggcgatgcgggccccgcccgtcgcctcaggtgccatttggattgtactttagtggcacgatgtactctgagtggaggtcactgcatttggtgattcagaatgatcaaggccataccagtgtgctgcacagctatccagagagcgttggacgagaggtggcaaatgctgtagtccgtcctcttgggcaggtgttaggtaccccttcagtggctggtagtgagaatttgttaaaaactgacaaagaagtaaaatggaccatggaagtaatttgctatggactgacccttccattggatggagagactgtaaaatattgcgttgatgtatatacagactggattatggctttagtgttgccaaaagattctattccattgccagttattaaagagcctaatcaatatgttcaaactatactaaaacacctacagaatctttttgtaccaagacaggaacagggttccagtcagattcgactatgcttacaggtcctgagagccattcagaaactggcccgtgagtcatctctcatggcccgagaaacttgggaagtcttactgttgtttcttctgcagattaacgacatacttctggccccaccaactgttcaaggtggcattgctgagaatctagcagagaagttgattggtgttctctttgaggtgtggttactagcttgtactcggtgcttcccaacacctccttattggaaaacagccaaggagatggtggctaactggaggcatcacccagcagtggtggagcagtggagcaaggtcatttgtgcactcacttccagattgctacgctttacatatggtccttcatttcctgcatttaaagttcccgatgaagatgccagtctgatccctccagaaatggataatgagtgtgtgcacagacatggtttcgctttttacacatgttaagtaatcctgtggatttgagtaacccagctattataagctctactcccaaatttcaggaacagttcttgaatgtgagcggaatgccgcaagaattgaatcagtatccctgccttaaacatctgcctcaaatattttttcgtgccatgcgtggaatcagctgtctggtggatgcattcttaggtatttctagaccccgatcagacagtgctcccccaacacccgtgaatagattaagtatgcctcaaagtgctgctgtcagtaccacccccccacataaccggaggcaccgggctgttactgtgaataaggccaccatgaagacaagcacagttagtactgctcatgcctctaaagttcagcaccagacgtcctccacctctcctctgtcaagtccaaatcagactagttcagaaccccggccactgcctgcccctcggagaccaaaggttaacagcatcttgaatctctttggatcatggttatttgatgcagcatttgttcactgtaaacttcataatgggataaacagagacagcagcatgactgccattacaacacaagctagcatggagtttcgacggaaagggtcacaaatgtccacagacaccatggtttccaatcctatgtttgatgcaagtgaatttcctgataactatgaagcaggaagagctgaggcttgtgggacactgtgtaggattttttgtagcaagaagactggagaagagattctgccagcttatttatccaggtcttggaatttttgtttgttttttcatttatatagttttgatagtgaagccattgttggttggccgactgaaccgatgagtgatgttggtctgaaatacctacagatgtctgtaagtgatcgacatttgcctgaaatctttcattttacctgtctcatcagatttggtaaagacccttaagacccttttgttttagaagtgctatttatgtcatcttatttgaatctttttaatatggagagatttcgaaggaccacaattatttgttaacaaatttttagcacagtattcccatgtaggcagtccagaaataagtcagctgtaaatcctgcctccaaggagcttattttctgggcaaagccccaaacaaagccgtgtacacatgtaacaatgatccagcaggaattaggatattgatgggagaggcacagataatgtgctgtgggcattcaggggaagaagcagcgcacatttatttactgtaggggattcaggaaagagttttgggggattaaatgattatgctggacttataaaggatgagtagcatttagcctatgttagaaagttggttagggtcatcttctccaaatctatggcttcagccatctttgttaatgcctctgccatccattcagttgctcaggccagaaacgaagagtcattttagaatcctcttcttctgtatctttagttgatcaaccgatcaaccaactcttgccttcctgctacttaactctctttctgatctctcttttcactctatccccaccattatactttagactttgtcacttttctcctaaattaactcataatggcctcccgttcttcttgacactgttttgccttccttaactgatcattcacacaagtgcagaagtgaggttaatatcaacagagtatttagatatctgcatacttgctaggttctcaggagatagaattaa

SEQ ID NO: 42893 - DNA, 2351 bp, Homo sapiens
tggcagtcggaagttgcctgagcagatcccagccggctggctcgagtggccttcgtcgtcccttggcgccctgggagagtcgctgacgggtggactgacggaccgcctgaggacggccggccagggcggtgaaagcgccagccctatggcgcgggtcgcgtgaggcggaaggccgaggacggccggcggcggcgcccgccccggcgatgcgggccccgcccgtcgcctcaggtgccatttggattgtactttagtggcacgatgtactctgagtggaggtcactgcatttggtgattcagaatgatcaaggccataccagtgtgctgcacagctatccagagagcgttggacgagaggtggcaaatgctgtagtccgtcctcttgggcaggtgttaggtaccccttcagtggctggtagtgagaatttgttaaaaactgacaaagaagtaaaatggaccatggaagtaatttgctatggactgacccttccattggatggagagactgtaaaatattgcgttgatgtatatacagactggattatggctttagtgttgccaaaagattctattccattgccagttattaaagagcctaatcaatatgttcaaactatactaaaacacctacagaatctttttgtaccaagacaggaacagggttccagtcagattcgactatgcttacaggtcctgagagccattcagaaactggcccgtgagtcatctctcatggcccgagaaacttgggaagtcttactgttgtttcttctgcagattaacgacatacttctggccccaccaactgttcaaggtggcattgctgagaatctagcagagaagttgattggtgttctctttgaggtgtggttactagcttgtactcggtgcttcccaacacctccttattggaaaacagccaaggagatggtggctaactggaggcatcacccagcagtggtggagcagtggagcaaggtcatttgtgcactcacttccagattgctacgctttacatatggtccttcatttcctgcatttaaagttcccgatgaagatgccagtctgatccctccagaaatggataatgagtgtgtgcacagacatggtttcgctttttacacatgttaagtaatcctgtggatttgagtaacccagctattataagctctactcccaaatttcaggaacagttcttgaatgtgagcggaatgccgcaagaattgaatcagtatccctgccttaaacatctgcctcaaatattttttcgtgccatgcgtggaatcagctgtctggtggatgcattcttaggtatttctagaccccgatcagacagtgctcccccaacacccgtgaatagattaagtatgcctcaaagtgctgctgtcagtaccacccccccacataaccggaggcaccgggctgttactgtgaataaggccaccatgaagacaagcacagttagtactgctcatgcctctaaagttcagcaccagacgtcctccacctctcctctgtcaagtccaaatcagactagttcagaaccccggccactgcctgcccctcggagaccaaaggttaacagcatcttgaatctctttggatcatggttatttgatgcagcatttgttcactgtaaacttcataatgggataaacagagacagcagcatgactgccattacaacacaagctagcatggagtttcgacggaaagggtcacaaatgtccacagacaccatggtttccaatcctatgtttgatgcaagtgaatttcctgataactatgaagcaggaagagctgaggcttgtgggacactgtgtaggattttttgtagcaagaagactggagaagagattctgccagcttatttatccagattttacatgcttttaattcaaggtttgcagataaatgattatgtgtgccatcctgtcttggccagcgttattctaaactctcctcctttgttctgctgtgacttgaaagggattgatgttgtggttccttactttatttcagctcttgaaaccattttgcctgacagagaactctcaaaattcaaaagctatgtaaatccaacagaattgcgaagatcctccattaatatcctgctttctttgttgcccctccctcatcattttggcacagtcaaatctgaggtggtcctggaaggaaagtttagtaacgatgacagctcttcttatgataaaccaataacttttctgtccctgaagttgagacttgtgaatatattaataggtgccttgcaaactgaaacggaccccaacaacacccaaatgatattaggtttgtattcacacgttattttgtaagtgaaaccaaagtac

SEQ ID NO: 42894 - DNA, 1370 bp, Homo sapiens
tggcagtcggaagttgcctgagcagatcccagccggctggctcgagtggccttcgtcgtcccttggcgccctgggagagtcgctgacgggtggactgacggaccgcctgaggacggccggccagggcggtgaaagcgccagccctatggcgcgggtcgcgtgaggcggaaggccgaggacggccggcggcggcgcccgccccggcgatgcgggccccgcccgtcgcctcaggtgccatttggattgtactttagtggcacgatgtactctgagtggaggtcactgcatttggtgattcagaatgatcaaggccataccagtgtgctgcacagctatccagagagcgttggacgagaggtggcaaatgctgtagtccgtcctcttgggcaggtgttaggtaccccttcagtggctggtagtgagaatttgttaaaaactgacaaagaagtaaaatggaccatggaagtaatttgctatggactgacccttccattggatggagagactgtaaaatattgcgttgatgtatatacagactggattatggctttagtgttgccaaaagattctattccattgccagttattaaagagcctaatcaatatgttcaaactatactaaaacacctacagaatctttttgtaccaagacaggaacagggttccagtcagattcgactatgcttacaggtcctgagagccattcagaaactggcccgtgagtcatctctcatggcccgagaaacttgggaagtcttactgttgtttcttctgcagattaacgacatacttctggccccaccaactgttcaaggtggcattgctgagaatctagcagagaagttgattggtgttctctttgaggtgtggttactagcttgtactcggtgcttcccaacacctccttattggaaaacagccaaggagatggtggctaactggaggcatcacccagcagtggtggagcagtggagcaaggtcatttgtgcactcacttccaggtaggttattgtcattgccctgccttccttcacctgtctgaccttaggcagctttctggcattcatggaatacattataacaaaggctgggtctgttattactgtactttagatacagaattgagccactttttaaatatagatataacagtttggctagtgcctgtttaaaacatttcagaataatcaagtattcttgagaaacagataaattttataccctacttcccccacaaaaaattccactcttattttgatcattaaaatatgcatgatcattaaaatatgcctaatcattattttaaagaaacaaaccatagaaagatataatagaaaagttctcctgaaatcctaccatgtatatttata

SEQ ID NO: 42895 - DNA, 578 bp, Homo sapiens
aaatagtggcaaagaagaccccagtatgggcacttgtagtagtacaaatccttcataccctccagtagatttgtgtgtgtaaaaataccacagtggttttaatcccttgtcaatttctgttactatcagtttgtactattcagttggcacattctgctttatcaacatggtttttaatgattgacctttatttatgcttgtaaactgtgatgtaatcctcacttgattcattttcatttgactagggtggtggagaaaataacctgaagagtcatagtcgcaccaatagtggtattagttcagcaagtggtggaagcacggagcccacgactcccgatagtgagagacctgctcaagctctcttaagagattatggttagtcgtgtttcttttgaaattcaaagtttaatagaatgactttaatgcttacatttataaaacaaaaacattaaaaatgttaatgttcatgttttttatatacttaagtataatagagaggatgtcagtcttaagaagctaagaaaaaacaaatctttttgatttagctgtatagcttttgggtagtatattagatttgg

SEQ ID NO: 42896 - DNA, 410 bp, Homo sapiens
tggccttcgtcgtcccttggcgccctgggagagtcgctgacgggtggactgacggaccgcctgaggacggccggccagggcggtgaaagcgccagccctatggcgcgggtcgcgtgaggcggaaggccgaggacggccggcggcggcgcccgccccggcgatgcgggccccgcccgtcgcctcaggtaaccgggcagccggccccgccgcggccggaccctcccctctccttccctctcttccccacctggcggtcaagggacggctgaggcttgtttctcggctctgggtgctccaggggcccggcctttggaagctcatctgcaaatttttgggagacccacgggggcggggaaagcttggccctggagtgggcggctgctgtcgagtctgtgtaaacccggtctaat

SEQ ID NO: 42897 - DNA, 2560 bp, Homo sapiens
tggcagtcggaagttgcctgagcagatcccagccggctggctcgagtggccttcgtcgtcccttggcgccctgggagagtcgctgacgggtggactgacggaccgcctgaggacggccggccagggcggtgaaagcgccagccctatggcgcgggtcgcgtgaggcggaaggccgaggacggccggcggcggcgcccgccccggcgatgcgggccccgcccgtcgcctcaggtgccatttggattgtactttagtggcacgatgtactctgagtggaggtcactgcatttggtgattcagaatgatcaaggccataccagtgtgctgcacagctatccagagagcgttggacgagaggtggcaaatgctgtagtccgtcctcttgggcaggtgttaggtaccccttcagtggctggtagtgagaatttgttaaaaactgacaaagaagtaaaatggaccatggaagtaatttgctatggactgacccttccattggatggagagactgtaaaatattgcgttgatgtatatacagactggattatggctttagtgttgccaaaagattctattccattgccagttattaaagagcctaatcaatatgttcaaactatactaaaacacctacagaatctttttgtaccaagacaggaacagggttccagtcagattcgactatgcttacaggtcctgagagccattcagaaactggcccgtgagtcatctctcatggcccgagaaacttgggaagtcttactgttgtttcttctgcagattaacgacatacttctggccccaccaactgttcaaggtggcattgctgagaatctagcagagaagttgattggtgttctctttgaggtgtggttactagcttgtactcggtgcttcccaacacctccttattggaaaacagccaaggagatggtggctaactggaggcatcacccagcagtggtggagcagtggagcaaggtcatttgtgcactcacttccagattgctacgctttacatatggtccttcatttcctgcatttaaagttcccgatgaagatgccagtctgatccctccagaaatggataatgagtgtgtgcacagacatggtttcgctttttacacatgttaagtaatcctgtggatttgagtaacccagctattataagctctactcccaaatttcaggaacagttcttgaatgtgagcggaatgccgcaagaattgaatcagtatccctgccttaaacatctgcctcaaatattttttcgtgccatgcgtggaatcagctgtctggtggatgcattcttaggtatttctagaccccgatcagacagtgctcccccaacacccgtgaatagattaagtatgcctcaaagtgctgctgtcagtaccacccccccacataaccggaggcaccgggctgttactgtgaataaggccaccatgaagacaagcacagttagtactgctcatgcctctaaagttcagcaccagacgtcctccacctctcctctgtcaagtccaaatcagactagttcagaaccccggccactgcctgcccctcggagaccaaaggttaacagcatcttgaatctctttggatcatggttatttgatgcagcatttgttcactgtaaacttcataatgggataaacagagacagcagcatgactgccattacaacacaagctagcatggagtttcgacggaaagggtcacaaatgtccacagacaccatggtttccaatcctatgtttgatgcaagtgaatttcctgataactatgaagcaggaagagctgaggcttgtgggacactgtgtaggattttttgtagcaagaagactggagaagagattctgccagcttatttatccagattttacatgcttttaattcaaggtttgcagataaatgattatgtgtgccatcctgtcttggccagcgttattctaaactctcctcctttgttctgctgtgacttgaaagggattgatgttgtggttccttactttatttcagctcttgaaaccattttgcctgacagagaactctcaaaattcaaaagctatgtaaatccaacagaattgcgaagatcctccattaatatcctgctttctttgttgcccctccctcatcattttggcacagtcaaatctgaggtggtcctggaaggaaagtttagtaacgatgacagctcttcttatgataaaccaataacttttctgtccctgaagttgagacttgtgaatatattaataggtgccttgcaaactgaaacggaccccaacaacacccaaatgatattaggggcaatgttaaatattgttcaagattcagcacttttggaagccattggttgccagatggagatgggtggtggagaaaataacctgaagagtcatagtcgcaccaatagtggtattagttcagcaagtggtggaagcacggagcccacgactcccgatagtgagagacctgctcaagctctcttaagagattatgctcttaatacagattcagctgctgggctcctgattcgcagcattcatctcgtcac

SEQ ID NO: 42898 - DNA, 411 bp, Homo sapiens
  misc_feature (347)..(347): n is a, c, g, or t
  misc_feature (392)..(392): n is a, c, g, or t
atttcagacatctgagcaggagtgggctgctgtctacagtcaccctttccatgtcaaagggtgtctgactagtgtctgatggcgtgtgggtttgtggggattgacaagatgaacacccacacaaacacatgcaggctcatctttctcttttccctcctctgtgtgcaacatcattattctaactgcaattggaactcctacaggtatcaagacaaatgctctagtctgactgaattgaaatcaccgcgcccggccgaaagtagccttttttaaatgtgaatctctcccttgataatgttcacagagttggtgaaatctaccagaaagccaaggccaaggtcctcttntctcctttgaaatattcctgttcagaagtgagtttgctcttctgnaccacagttttattttcac

SEQ ID NO: 42899 - DNA, 426 bp, Homo sapiens
gcacaattaaaaaattttggagactctctaggagaaggtgagatggtacatcatggactctggttctgaagttgcctcttattcacagagattgctagaagtctggaggtagggtgggaacagggaccttcagtgactgccagcgggtgtggacccctccccacaccaagaagggatctttgcatgagaaattcacgggagtcaagaatcagccaatttcaggatctcctgggtcctcctgactgagcagcacacagtgctgagaggcattggggaggttcactcttcaaactgagatgcttgtctcctgcatgttaacggcagccatacctgaactcgtctcaataaatttttcatagcatcgtatcttcattaaaattttattctattagcattctgaatacaaaccactaagtatataattgc

SEQ ID NO: 42900 - DNA, 321 bp, Homo sapiens
catgtgccaccacacccgcctaatgttgtatttttggtagagacggggtttctccatgttggtcaggctggtctcaaactcccaacctcagatgatccgcccgccttggcctcccaaagtgctgggattataggcatgagccaccgcgcctggccgatcaccaccacttttgagtttactttttttcttatggccgctggtgaggggggatcttggaaacaagaaaatctgactattgtttagtatttttcctggtaggtgtctcttgccactgagtagaccttttgtaaaggggatggggtctttacaaacaatattgag

SEQ ID NO: 42901 - DNA, 221 bp, Homo sapiens
ccaatataaatctcctcacatataaacataaacacaaggagatttattacaggagttaattgaaattggctcacacaattatggtgattaagaagtcccatcggctgggtgcggtggctcacgcctgtaatcccagcaccttgggaggctgaggtgggtggatcacaaagtcaggagattgagaccatcatggctaacatggtgaaaccccgtctctacta

SEQ ID NO: 42902 - DNA, 403 bp, Homo sapiens
gggaattgctttaaaactccaagcctccaagcagatcatgtcgtctcttggttaaactcttcagtggcttccatgcgaacttctcaccctgggttctctgtgctttggtggggcctacctctgagcccagagcttacactccctcctctcaacacactccactcttggttccttgaatgaactaagttcatcccctccttagggcttccagaacattctgtcccatatcttcacatggtttcttcttaccattcaggtctcacctcaaaaatcacttcttccagctgggcgtggtggctcacacctataatcccagcactttgggaggctgaggcaggaagatcgcttgaggccaggagttggagaccaatctggtcaacatagtgagagcccacctctacaa

SEQ ID NO: 42903 - DNA, 471 bp, Homo sapiens
aaaccagcacaccctagtcactctgaccagcagcagcacagatccccaagtcccccttctgttcctgcagcctatgccttgtggcccagattagttcccagttgctgcctggggtgctctagcattgccttgtagggtgcacaggactgtggaaaggcgggaaagggacaattagagtcatctccacttcatgcttacagcactctcactagatttcaagtggaagcctagaaggtatgttagttacttggaacacccactctgtggaacgtgaagaggtatttctgcagctcactgatagggaaatgtgctaaacaaaactaaccagatctctgtaaagcaggaacttctcagagccccgatgcgttaatacagggaacttgtacgaggggctatattacatgaagcctttgctactgttacctttttttaaggaacagctcatggaaatagtgtaccttgagttcactt

SEQ ID NO: 42904 - DNA, 661 bp, Homo sapiens
gtctactgacatggttttttgcacccttgtgaaaaatcattgaatatatttgtgtaaatctgtttctgggttctcttctgttccgttgttttgagtatctgttgctctgtcagtatcacactgtcttgattactgtagctacatagtctgacttaatgccaggtggagtctattcaccttatttttcaacagttttagatgttctaaggcttgttcctttccatgttaatttttaaaagaagcttgtctataactacaaaaactgttctaggattttgagaggaattgatttaatgaattagacttttgaaattgcatatgtaatgttaataaagttaaaaatggtaattctgttaaggaaaacaatttagttccttccaaagtctaacgctagttcttattttctgaagaaatgtgtatttttatgattttgaaattattgaatgaatattaatcagcctgggcaacgtggcgaaagcccgtctctactaaaaacacaaaaagattagccaggcatggtggtatgcatctggtcccaggtactcgggaggccgaggtgataggatcacctgagcctgggggaggttcaggctgctgtaagctgtgattgcaccacggcactcagcctgagtgacagagggagactctgtctttaaaaaaa

SEQ ID NO: 42905 - DNA, 491 bp, Homo sapiens
tggtaagggcatataactattaatactttatgagaccatggtattttgcagccaatcttaaggataaatctacattgtgttcaggattctgtgttgggccagacttaacaatgaccattatgtgtagaaaatagcaaccattgttgctgaattaaactctctctggagatttaaacatttttttaaaaaattaagctaataggccaagcgtggtagctcacgcctgaatcccaacactttaggaggccgacgcgggcggatcacttgaggacaggagtttgagatcagcctgggcaacgtggcgaaagcccgtctctactaaaaacacaaaaagattagccaggcatggtggtatgcatctggtcccaggtactcgggaggccgaggtgataggatcacctgagcctgggggaggttcaggctgctgtaagctgtgattgcaccacggcactcagcctgagtgacagagggagactctgtctttaaaaaaa

SEQ ID NO: 42906 - DNA, 358 bp, Homo sapiens
cgctgtgtgaccttgggtaacgtggccgccctctctgtaactgagagcacaggattaggcaggctttgaggctctgaggtgaccctgctccccctcaccccgtcatgctctgtgccttccacggcctgcctcctggccctgctcgggccgtgtccttctggaatgcccttcttgctgccttgtgggcagtcagactgactcgaatccagcaggacttaactgaccttcccagggaatgtgggggctcttgcgggaatcgtgtctctccccacagttctgagtttcttgagggcaggattggggctgaaccgctcttggtcttccgccgctgacttccagtgcctggcccagagacaga

SEQ ID NO: 42907 - DNA, 367 bp, Homo sapiens
agggggaggggtgggaaatggagagttattacagtatttaatgggcctagagtttgagttgaagaagatcaagttctggagatgatggtggccatggttgcaatggtgctgtgaatgtattaatacttaatgctagtgaattgtatattaaaaatagctaaaatgataaattttatgttatgtatattttgccacaatttttaaaaaagcaacagattttcatgcattaatattatgccataaagaatacacataaagctgcttcttcataagactcctacagattttaaacacttaaaagatttctcttttttttaggtgcggtggcaaggagtagggagggggaaaggttttgaagcttttctgg

SEQ ID NO: 42908 - DNA, 331 bp, Homo sapiens
gcccccgcagcacccccaagtgccctggccccaaggccagtccagctcccagccacaactcgggcacccctgctccctatgcccaggctgtgccccaccagctcccagtgggcccagcacgacccagccccggccccccagcgtccagcctagcggaggcggaggcggcggcagcggaggcggagggagcagcagcagtagtaacagcagtgccggtggaggggctggcaagcagaatggcgccaccagttacagctcagttgtggcagacagcccggcagaggtggctttgagcagcagtgggggcaacaatgccagcagccaggccttg

SEQ ID NO: 42909 - DNA, 2899 bp, Homo sapiens
atggagttctgcatgacaggaacaatggtttttaagtggactaatcagagctattaatgcatatgcagtgaaggcaggaactttgctacatgcagggcttatcattttgctaataacaatgcctggcacagattagcgatgtgttgaaataaaacatattctgggagatataagatagagaaagagagcagcatgtagtagaaatagatgtcgaaagatgaattaagatgatgcattaagcttgaaacgtgaggcagagaaagctgtacataagttgaaggctttgagttaaaagactataggaattagatgagtgggggctatggagaacagagagaatttagagtgtggacaagtgttctatgagcagagactgggactagccaaaacgtgatgatgggcagctagcttggaaagaatgcttacaacgtgaaaattatatatttataaaaggccattacttctgttaaagaacaatagaccccagtgaaaagaaaggaaattgaaaaatagagaaaatgtggagaaaactagaatctctatagacagcgtcaatgcagcatcaattatatgaaccacttttgagcacaaagaactattgttttgaccttggaggcaatttggtcttcattaggtttagctgtaggatagttgatgttcattattccctataacacttgtgatggcaaaaccttcacaaatttatatgatctaggtatgttttcaatccttacaacccaaataaccgatcataactctcactatgtcatttgaaaaaaaaaatgatcatcagaagtgtaattcaattagcaagtatcagtagtggagtataaattattattggttaatactaagtatgattgaaaaatcgtagtagatggaaatatgggaatctttattttggatgaataaactttatgcctaaaacatatgtttataaaaaatactttgtgaataaacccattgtctaatatttaaaagagttgaagtatgctattataagatcttccttaattgatgaaatgatgcaaagccaataatattgctccacttactgaagtatagagatgaagagaaaactttttctttattccatgttctatataagtcaagaactagagctcaagattaagatttttgttttttgttttttttccatttccctgggaacagagcaacagtctttctgggtctaaaacatccttttttcagtacaccccacagcatcctatagaaatatgttgcaatcagttgccaagtcacatcctagcttaatgtcagcaattttctttctgaaccaattttgcactcagcattaagaggaaatattgaagggagacataccttttatgtttgtaaaatttatacttcttgagataaaaaagcaactatatccattgtcgtgggatcttgagaagaaataagaaaatgaaatattatagaaaatattatattatttaattgtcctgttctaaaacactttctaagcctgcctgtttttttgccaaattaaattaatatttggatgtagacagcttttcagagtggcagtatcatagtcaatgaagatgacctgaggcacagttattgctaattggacatagaaaccaccttcactcatatataaaaattattatgtgctacactagatatttcaggagaattgataaaagaaagactgttgtattcatatgcttgtcttcctggctagaggatctgttttaattaatcagctcatggagtttggaaaatatttatagtatacatagctgagtgttcatgtaaattttgaatacattcatacatcttttttttaaaaaaagattgaacttcaaaaccattttcttacatactcagtagaagttgttatgagccaacattttttgtgagctatactattttaaacatctaaagtaaattatttgacatataaaaagacttcttcatttaaaaatatatcttttaaaaataattttacaagtgatggcatctcattttagaagaagaggcatcaatgacagcagttacagtaactcgatgctgaatatgtttttaaatacaagatgctgtgttcagcattgtacatacattatcaaattttattctgataatatgctgcatgatgtattaggctgggttctctcagacagaacctacacgtatacttatatatatatacacatgcatatacatacacatacagagagagagaaagagagagagagagagatctctacatttattagaggaattggatcatgcgattatgggggctgagaagttccaggataggttgtctgcaagctggagaaccagggaagagagtagagtagctttctccaagtcctgaagcttcagaactagggaaactgatggtataactctcagtcagaggccaatggactgagaactcagacagccactttgcaactcctggaatcccaaggccagagagcctggagtttggatgtccaaaagcaccagaaggagggtgtcttaggtccaggagagagtgagctttcctatgcatttttgttttatccatacccctgaccaattggatggtgcccacccgcattgagggtgggtgtccctctattaaatattttaactataattttaactgtgatataggcactgaattcttgttgctaataatctggtaagatccatctgaactatgaagtgagtacctggaggaactcctacattttaggctttcaaaggttacaggcttttcgtgtgtgtgtgtgtgtgtgtgtgtgtgtgtgtgcgttttgagaaaaatggaattcaaacactgtgattagaatgtatgtttacttatatagaattaatgaatgtatataataataattactgtatataattttaaaatataataaagtctctttatcca

SEQ ID NO: 42910 - DNA, 680 bp, Homo sapiens
gcgcggcgggggcgggcggccaggctagtcgggcgggtgcgcggggcgctcggggcccggggccagagctggagccggagccgggcgggcgccatggagtgggctgcgtgcggggtgctgtcgcgctggaagcgctaccacatcaaggtgcacctggcggacgaggcgctgctgctacctgctgaccgtgcggccgcgggacacgctcagcgacctgcgcgcccagctggtgggccagggcgtgagctcctggaagcgcgccttctactacaacgcgcggcggctggacgaccaccagacggtgcgcgacgcgcgcctgcaggacggctcggtgctgctgctcgtcagcgaccccagcgaggcgcagcggctcacacccgcaatcccagcactttgggaggctgaggcaagcagatcacttgagtccaggagttcaagaccagcctggccaacatggtgaaaccccatctctactaaaactacaaaaattagccgggcatgatggcgcatgcctgtaatcccagctactggggaggctgaggcaagagaatcgcttgagtctgggaggcggaggttgcagtgagctgagatcgtgccattacactctagtctgggtgacagggtgaaactccgtctctaaagaaataaataataaaattttatttcacgccatccctgct

SEQ ID NO: 42911 - DNA, 1330 bp, Homo sapiens
acagtgggcagaatagggaagccttgaacgccaaggcaagggctatgttttttctgcaacctgtgtctttctgtctccctctttcaggtagtctgggttggaggaggcagagccatgaccaaggggacctgggtactggctgaaggaataggctggggtagagggcacttttggaaggcacttctcctgcctcctgggagcctagatctcactccagggtctgggctcccaggtggaccatgaaaccctggcctgaccagctgatgcacactgcttcagacactcctgctggagccccagtccctgacaaggacctaggacatttttgctcctgcccagcctatcgggagggagccttgagcctttcagctctgctgtgtgactttgaggttgttgctcccctcttggggccctgggtgccctgtcttcagtggaaagcactgtgccaccttggaaagctcccatgggcagccagagggcatcgcaagaagagaaagcacagaaggggcaggagagacactcagaggcacttccgctcttgcccaggacattctcccagccacacctttgcccaagccgtgccccctgcctggagcacttttcaacctcttctctgcagctccaatacacctgggattgcagtctcctccaggaagtcttctcagattccctccttcccagccagagagcacctagccttctttggggcccccacaggccctttgtgcagtgaacagccctggctgggggtgcagccagtcgtgtccgaactctccaatgactaagcggggagatgcggacatcctagctccttctcaggcctccaactgtgccccatttccacccccaaatacctccccaggaggcacctgtgcccaccccctgggctgtttcccccttccccttaaatccggatgcctcgtcttgcatagggtcttggggcagcggggaaggggttctgaagaactctggccaagaggacgaggatctgggggtggggaactgggcctagctgtgggaggtcatcgcggggcattgcagggagtgcgttgtgggaattccgggtggagaccctcagggcagtgtgccgggcctccgttgcacctctgacctgcagccacgtcatcgttgcgcagcccctggggagggtctttggggagggggtgccgaggctacgcatgtcctcgagggccgtgtacactctccaggcaccatgggcggaggcgccagaggctgggaagaaataatgttttagttaagagtcctgttggctgcaggactcagagcatggacaggtggatagtaaatcaccaccacggggacagccgtg

SEQ ID NO: 42912 - DNA, 413 bp, Homo sapiens
tcacgccatccctgctttctctctttccccatcacttgtcagcagccgacttctctacgttttacttatttttttcacctgtctcctgcagtagactgtaaactctgtgagggtactgccgtccatcttgttccctgctggattgccagttcagtgcctggcacatagtaggtgcttaataaatgttagtgagatgtattgtctcactaacataatcgtgagcagaggcaaggattgggctgctcagaatatttttctggagctctagcggtgcctggatgcaggggagggaatttctgggtcagaggtgagccctggcaggggcaggaagaggcaccagccagacagtgggcagaatagggaagccttgaacgccaaggcaagggctatgttttttctgcaacctgtgtctt

SEQ ID NO: 42913 - DNA, 185 bp, Homo sapiens
cctgcgcgcccagctggtgggccagggcgtgagctcctggaagcgcgccttctactacaacgcgcggcggctggacgaccaccagacggtgcgcgacgcgcgcctgcaggacggctcggtgctgctgctcgtcagcgaccccaggtggccgcggggctcggggtggggtggggcgggggcggcgg

SEQ ID NO: 42914 - DNA, 592 bp, Homo sapiens
gcgcggcgggggcgggcggccaggctagtcgggcgggtgcgcggggcgctcggggcccggggccagagctggagccggagccgggcgggcgccatggagtgggctgcgtgcggggtgctgtcgcgctggaagcgctaccacatcaaggtgcacctggcggacgaggcgctgctgctacctgctgaccgtgcggccgcgggacacgctcagcgacctgcgcgcccagctggtgggccagggcgtgagctcctggaagcgcgccttctactacaacgcgcggcggctggacgaccaccagacggtgcgcgacgcgcgcctgcaggacggctcggtgctgctgctcgtcagcgaccccaggtagtctgggttggaggaggcagagccatgaccaaggggacctgggtactggctgaaggaataggctggggtagagggcacttttggaaggcacttctcctgcctcctgggagcctagatctcactccaggtggcagaaaacagccaagttccaagagaatcgcttgaacccaggagtcagaggttacagtgagccgaaatcacgccattgcactccagcctggcgacagagcag

SEQ ID NO: 42915 - DNA, 1600 bp, Homo sapiens
gcgcggcgggggcgggcggccaggctagtcgggcgggtgcgcggggcgctcggggcccggggccagagctggagccggagccgggcgggcgccatggagtgggctgcgtgcggggtgctgtcgcgctggaagcgctaccacatcaaggtgcacctggcggacgaggcgctgctgctacctgctgaccgtgcggccgcgggacacgctcagcgacctgcgcgcccagctggtgggccagggcgtgagctcctggaagcgcgccttctactacaacgcgcggcggctggacgaccaccagacggtgcgcgacgcgcgcctgcaggacggctcggtgctgctgctcgtcagcgaccccaggtagtctgggttggaggaggcagagccatgaccaaggggacctgggtactggctgaaggaataggctggggtagagggcacttttggaaggcacttctcctgcctcctgggagcctagatctcactccagggtctgggctcccaggtggaccatgaaaccctggcctgaccagctgatgcacactgcttcagacactcctgctggagccccagtccctgacaaggacctaggacatttttgctcctgcccagcctatcgggagggagccttgagcctttcagctctgctgtgtgactttgaggttgttgctcccctcttggggccctgggtgccctgtcttcagtggaaagcactgtgccaccttggaaagctcccatgggcagccagagggcatcgcaagaagagaaagcacagaaggggcaggagagacactcagaggcacttccgctcttgcccaggacattctcccagccacacctttgcccaagccgtgccccctgcctggagcacttttcaacctcttctctgcagctccaatacacctgggattgcagtctcctccaggaagtcttctcagattccctccttcccagccagagagcacctagccttctttggggcccccacaggccctttgtgcagtgaacagccctggctgggggtgcagccagtcgtgtccgaactctccaatgactaagcggggagatgcggacatcctagctccttctcaggcctccaactgtgccccatttccacccccaaatacctccccaggaggcacctgtgcccaccccctgggctgtttcccccttccccttaaatccggatgcctcgtcttgcatagggtcttggggcagcggggaaggggttctgaagaactctggccaagaggacgaggatctgggggtggggaactgggcctagctgtgggaggtcatcgcggggcattgcagggagtgcgttgtgggaattccgggtggagaccctcagggcagtgtgccgggcctccgttgcacctctgacctgcagccacgtcatcgttgcgcagcccctggggagggtctttggggagggggtgccgaggctacgcatgtcctcgagggccgtgtacactctccaggcaccatgggcggaggcgccagaggctgggaagaaataatgttttagttaagagtcctgttggctgcaggactcagagcatggacaggtggatagtaaatcaccaccacggggacagccgtg

SEQ ID NO: 42916 - DNA, 326 bp, Homo sapiens
gcctctagggtagggacatggccttggtgtctcatttctttttggactaacacgtggaccagagccgtgttgcccctgacttgctgggtgaccttgggaaaattgcttctcctctctgggctctgttacctgtctccttacaataaaggattgagctttgatttggctttactgcactctttgcctgcaattcctgtgactgccatcaggtggcagaaaacagccaagttccaagagaatcgcttgaacccaggagtcagaggttacagtgagccgaaatcacgccattgcactccagcctggcgacagagcaggactctgtctca

SEQ ID NO: 42917 - DNA, 587 bp, Homo sapiens
ccctgtaatagagatagaaataagctccaaaaaccaaggacaataattcaaagggagttagaacttacgagagtagggacagtcagttgcatctagtgagcactgataatgcattcttcaggcagaatgtatttccctttgattgtaagttcatggtctttcctgagaaaattccaactgtgtctgatggggagtctggagaataccactgctggaattggtgtctttcagaggctggcagaggaaggagcaacagcatggattgtgtgcagcaggtgtttttattaacacatgcattatcacttttatttgtcacttcatggagtcaagtgacctttcccagggcacatgggcagacttttcccagtggctgttcctgggcttcagagtacacccaggggaaaattatctgttagttactttctccctcttcttgacaccttctgagttccaacgagtcagaagataatcataatcagaataacatctcaaaagagaagctaattgcagttttttcttagttgcaaaagaaatacatggtcactgtagaaatcatgaaacacacagcacaaagcaataaaaaaaaa

SEQ ID NO: 42918 - DNA, 476 bp, Homo sapiens
ctgtattactaaaatgtagcaagttaacaagagtacttgctaaaaaatctatgtgactactaaacaaattgccctaatatcatctactcaagtttcctaattcccctagtgggtaagtaagtaaaatctggatttttaaatactcaaaataaatatttactgtttttctagaaattgcctgcttcctactcactccatgcctgaaataattaagaatcagaagatagaaatcttaggcgagatggaagctacaaggttaataacgaagaagttctatcatttctatcgtagaagtattcttttagaaattttccttttaaaaaatagctgtgaaattagtggtagtagggattcatttatcttttttctctctttaggtgactcatttttataacaaagtttgttccttcatcaatctcctgaatgcttacaaagtagcaccaacacatcaatatattgaacagtcttgttgaaac

SEQ ID NO: 42919 - DNA, 389 bp, Homo sapiens
gcatgaacccaggaggcggagcttgcagtgagccgagatcgcgccactgcactccagcctgggcgacggagcgagactccatctcaaaaaaaaaaaaaaaaaaaaaaaatagttcccaggcccctgttagacttcatgctccctggctttccctctctcctacaaatattagaatttgttgctcgcctgctatatgttggggcctgcatgctgtgtgttgtgaggagggcaggcaaagctcattgcccttgggatttgttacctggcaagaaagcaaacactgaaccagtaatgataagtaatgactgattttgaaggaaccatacaggcacctaggaatacagaaagggatttccttcctgagttgggggatggaggaaggtttcttt

SEQ ID NO: 42920 - DNA, 416 bp, Homo sapiens
ccattcctcgtggaatgatgtgatgacatcagtgaatctagaccaacgctctggaatcttggaagcatttggtccctaacgcttggctacagccagtgctctttcacactgtcatgggctgcactctgggtaagtgtaagctccgcttcaagggcctggaactccagagagccatgaaggcactcactcagggtggctatcactcattcctgtactagaccaagtctcggatcctgaactatcttctcccaaggagtctcaggggatggggaagggaccacctgtgagtctccagatgaatgattggggatgcagcaggaataaaaacagtttttgaattttgggggaagacaggagaggagggaatgtgggcaaaagagagaaggaaggagggctgacaggagagccaactccca

SEQ ID NO: 42921 - DNA, 780 bp, Homo sapiens
ttttggataagataagggatattggtctttagttctttcttgcaatgtcagtaagctgcaaagtgttccctcttgcattttctgaaagaatctagatcactcctttcttaaatgtttgctaaaatttccagagaagcctgggaatttaatttctttagcagtgtgagaggaaaataaatcttcggaccccaaaatcactaagctaaagggaaaagtcaagctggaactgcttagggcaaaccagcctcccattctattcaaagtgatccctctgaggctcacctaagacaaatgcatatctgattgcttcctctcccctattgcttatgtgaaaatgcagattcattgagccagagtaaattgcgtattatttgtattaggtggaaggccatcaaagactcaaaaaatccaactttttgtcttacctacttctaacctggaagcccccacttgttgccttaccagaccaaaccaatgtacgacttacacatattgatgatgtgtcatgtctccctaaaatgtataaaagcaaactgtatcccgaccacactgggcacatgtctcaggacttcctgaggttgtatcacaggcacatccttaacccaggcaaaataaactttctaaatcaactgagacctgtctcagatattctggggtctcagtagacattagactattcagatttcctccatcagttttggaaacttgtgtctctctcttttttttttgagacagaatttcgctcttgttgcccaggttggagcgcaaaggctccatctt

SEQ ID NO: 42922 - DNA, 365 bp, Homo sapiens
tcctgggtccaagtgattctcttgcctcaacctcctgagtagctgggattacaggcgtatgtcaccgtgcctggctaagtttttgtatttttagtagagatggggtttcatcatgttggccaggctggtcttgaactcctgacctcaggtgatccacctgcctcagcctccaaaaaatgctgggattacaggcgtgagccaccatgcccagcctacatgtgtaattttaaaagtaaaatgaaatataattttacttaacagaaaaaaaatgaagtgaaacaattactaaacttcaaacatttcttttttttttttttttaatttgagacagggtctcactctgtcacccacgctggagtgcataa

SEQ ID NO: 42923 - DNA, 391 bp, Homo sapiens
ctctagaccctcggcacagggcagctgtcctggaaaggtggaaatgcaatggccagtgctgctggggcttccagtaacatggtggcccattaagatctagctaataatggctgggtgtggtggctcatgcctataatcccagtactttgggaggctgacacgggtggatcacctgaggtcaggagtttgaaaccagcctggccaacatggtgaaaccccatctctactaaaatacaaaaagaaaattagctgggcctggtggcaggcgcctaatcccagctatttgggaggctgagcaggagaatcacttgaacccgggaggcagaggttgcagtgggccaagatggcaccattgcactccagactggacgacaagggtgaaattccaact

SEQ ID NO: 42924 - DNA, 3682 bp, Homo sapiens
  misc_feature (1)..(2): n is a, c, g, or t
  misc_feature (5)..(5): n is a, c, g, or t
  misc_feature (7)..(8): n is a, c, g, or t
  misc_feature (10)..(12): n is a, c, g, or t
nngangnntnnngaagaaatggtaggcatggtcagcattcttaggcaatgtggatttcacatttcctaagcatgtctcagcatgtttgagacacccagagggaaggaacaaacatttgttccttcctctctacttttgttagagtcctggtttctgcactcttcatctgctgtctacctgtgcagagagcatagacacacacatgaacatatagatagaatcatgttgtgaatagcacttccagttttagaaatttgtgaatgtggtgataaaggtaaagcacctgagactgaaaggagtgattaaaatctcaggtagtttagacatgggcaagagatctagttaatgagtttgttccctctctcccttgctttttattctttattgcatagaaatgttggtgtaccaggcataaaggccagagaatattgtggttgttcttgttcactaaggtgttaatgacttactctagtttcagattttttttttctcttcagaaggctgtgcttaagagggcagactgtgaaatcatactgcttgggtataaatcgtaactctgccacttactacctgtgtgattctggacaagttatttaaatctagtgtacttcggtttagtcatctgtgaaatggggataatgatatctgtttcatgaagttgttgaggattaaatgaggcaatatatggaaattgcatagatcaatgtctgatatgtggtgagtgctatataagtgttggctttaaacctgtgtatctcaaaattcacccattagatctatatttaacaattacacaaatttaaacacatggatacatttgcaaatatgctgtattctaagtgtaataaatgagaattatttgccgactcagtcatgcttaatttaactacttttatttattttaaatgtatgaaggacataaataaaatcaatttcccctcttcaactgtttatttctttcttgggaaagcaacagtctcttcctgccaaacttggatataaaagttatcagtctctctagtataacaccttatacatgatgagtgctctatacatgtttgctgaatataatcaaattcgggaacaatcatcagatttactagattaactaggctgggaggttgaggaaggaaagaatcaaagttgatttaaggtgaagcttgaagtaggtggtggtggtattaatggtaataataagtgatttggaaacttgtactgtgtgaccatgggaaagttacttctatgtgtcttagttttctggtctctaaaattatgataattttacatgtattttgtagggttttggtgaagatgaaatgtgataataggtatgaagtatttcatttattgatataataagtgagaactgctattatattgttatttataataatttgaagtacattttcatggttatatttcttgatgtacaaattctgtttctagaatgtcgagttatatgagtttgtggaaatgtcaagaggccaggtcatcttggtttctctgcctttttaactgtgttagccaacctacgccaagctctggagtagagtattaaagtaccattgaggtttgcatcctggggtgggagtaggagagaggagtatattgatactcttttctaagatacagagttggtcattccttagtttaaaagatagaattgagttcactgataggaaaccactgataggaattacatttataggcatcatcagtgatcaagagttggcattttaatcatgaacatttttcagtttatatgtaatctattatggtagttatttttttaaaaaagaagcaatattaagttgagtagagtttgagtgctttttaaaaaaatgaattgctaaatgtccaccatggttttctcttctgtctgtattatggcttgcagaatgaaacagtcatttatctttttgctctttcttccctctgtgttttacagtatcatagaattttcaaaactgaaagatgcattggttatatatgttctgtctctttatttcctacatgaggaaactgaaacgacatgtttgagatttgaccaggtgtagatttgtgctgtatgtagagatttggctaggctatgtgactagttaatgacagcctctggcatgacagaactcagatattctgaatcttatgctagtgctttttaaccccttgactttagtacttcccaactcaaagaactttacgttttctgccatatactgaaggaatgggaaaagagagaggagaaaggtgaaaatagaagagggtctgcagctgataaaagaggacatgggacatgatatgatagaacagtttagcaagtatagtgtattgggtagaatagcatagaatttaagagcttgagcattaaaatcaagctgtcttgggttctatttctggcacttctgcctcattgctctgtgactctgagcaagttatgtgtttttactttaatctttttttcttttttcattgattaaaagggggtgggtactaataataacttcctcactaaagtttggggcttatacctgtcagtggaaaggggaaaaccagttgtgtggtgatgatttagctttaaaatacttgatttagctgctgtatatgattcagcacaagatgatatccgggattttttttttattaagggatagtaataggtatgttctgaggctttttgtttcaatacatgctatgatttctgatacctatagcaataaagggatatgaggattcagttcatttaaaaagcatcagcagtggtttttttcacagaccagttgttaaaaacaaaaacggaccatagacccaactaggttgaaaatgaaaatatgtgggtacaaggatttaagtatttctccagtcttctaaagttcatagacaaagccatagattggggccttgggataagggaaacaaaaataaataaaaactcagtgaaagtaaacataagctttcagattctatgggaaagtaaaatcagcctataagattatctggatgagattaatgtcatttttcttgcaaatcctggaccattcctgccagatatggctaaagggaactttaattttgtttagcgctctctccattcttaacaggagttcagtattttttcgttaatgtggaagagtttggctaagaacctctctatagtttgtaggtagtgagttagaaataggataatagaaccttggtttttctaatgtgctatctatacaaaaaacacaggtcattctgacctcagcagggtcatactggctggaggtgtagaaggaactggtgggtagttcatttacatttgacagcagatgccttaagagtgtatctatgggcagaggcaacctgtagtttccttcctccaacagagtccagtggcataagaacagtatagttggcctgcttttagggaggttggacttaccctgatcccccaattttaagatgttgagatttgtaaatgcattcagtttcttaaatgttaaaggtgaataaatgtgtatcttatagttcaggaaatatgcttagacatgtaagtcatatttgcctaaagagttactttttaggctgggcgtgatggctcacacctgtaaacccagtacgttgggaggctaaaatgggaggattgcttgagcccaagagtttgagaccagcctgggcaacaaaatgagaccccctctctaca

SEQ ID NO: 42925 - DNA, 747 bp, Homo sapiens
caggcgaggggttgggtggcggttgagacagcggcggtactgggatgggtaggtgaggatcccgagactgagtgagcttctgcgcgcggtgcttttgggaacgcgggactggcaacctgcggcgccaggagctgggccgaggcgcggcggcgcggctgcgggccgccgtctggatgggaagttacggcgaagtccacccagcgtttctcaggcaatctgaaggcaaatcctgtttagacccaggcgaaggttcctggtgacccaggctctcaccagccaattgtcccttgccgtcctcctgagggtatctggagcttcagtgctgtgtgctcttggcctccacactggggatgccactgactcccactgtccagggcttccagtggactctccgaggccctgatgtagaaacttccccattcggtgcaccaagagcagcctcacatggtgtgggccgacatcaagagctgcgagatccaacagctcccatcaaggaagatccagagacattctccttaccaagacgttaagaaatgcacaggtgaggagaacagcggcatgcgtgtaaaggtcctgtggcacccatcctctgcaggctggaggtcatggcgggagatgctgcatggatttgccctccccgctgtcagtgagaacaacagggttctggaagagtagaggacaggccatgggacttggccatctagagataaggcgggagggatttccttgagaggcagggatatgtgg

SEQ ID NO: 42926 - DNA, 1350 bp, Homo sapiens
caggcgaggggttgggtggcggttgagacagcggcggtactgggatgggtaggtgaggatcccgagactgagtgagcttctgcgcgcggtgcttttgggaacgcgggactggcaacctgcggcgccaggagctgggccgaggcgcggcggcgcggctgcgggccgccgtctggatgggaagttacggcgaagtccacccagcgtttctcaggcaatctgaaggcaaatcctgtttagacccaggcgaaggttcctggtgacccaggctctcaccagccaattgtcccttgccgtcctcctgagggtatctggagcttcagtgctgtgtgctcttggcctccacactggggatgccactgactcccactgtccagggcttccagtggactctccgaggccctgatgtagaaacttccccattcggtgcaccaagagcagcctcacatggtgtgggccgacatcaagagctgcgagatccaacagggagccttgggaggagcccgaatcactgatggaatcggacagtgcatggagatggttcagcaggacgaggtgtcattggaggacagcgtggagtgcagagagacatgctttgaaatgggattgatccagtcctccttccttcactaccacatgaatgctgggcagcccaggatcacactcactgcaccctcaactcagaccgttacctggcacactggcctcactcttgtcggagactgagctattggcagtgccttcagctctgagctcaggcacctcgaacattgtttttgtcgttaaggatcctaaagtgctgcggggactgatcacatttttctcaacatccctggccccacctcttctgccacaaacgtcagcatggtggtatctgccggcccttggtccggtgagaaggcagagatgaacattctagaaatcaacaagaaatcgcgcccccagctggcagagaacaaacagcagttcagaaacctcaaacagaaatgtcttgtaactcaagtggcctacttcctggccaaccggcaaaataattacgactatgaagactgcaaagacctcataaaatctatgctgagggatgagcggctgctcacagaagagaagcttgcagaggagctcgggcaagctgaggagctcaggcaatataaagtcctggttcactctcaggaacgagagctgacccagttaagggagaagttacaggaagggagagatgcctcccgctcattgaatcagcatctccaggcctcctcactccggatgagccggacaactcccagggacgggacctccgagaacagctggctgagggatgtaggctggcacagcacctcgtccaaaagctcagcc

SEQ ID NO: 42927 - DNA, 1007 bp, Homo sapiens
caggcgaggggttgggtggcggttgagacagcggcggtactgggatgggtaggtgaggatcccgagactgagtgagcttctgcgcgcggtgcttttgggaacgcgggactggcaacctgcggcgccaggagctgggccgaggcgcggcggcgcggctgcgggccgccgtctggatgggaagttacggcgaagtccacccagcgtttctcaggcaatctgaaggcaaatcctgtttagacccaggcgaaggttcctggtgacccaggctctcaccagccaattgtcccttgccgtcctcctgagggtatctggagcttcagtgctgtgtgctcttggcctccacactggggatgccactgactcccactgtccagggcttccagtggactctccgaggccctgatgtagaaacttccccattcggtgcaccaagagcagcctcacatggtgtgggccgacatcaagagctgcgagatccaacagtccctggccccacctcttctgccacaaacgtcagcatggtggtatctgccggcccttggtccggtgagaaggcagagatgaacattctagaaatcaacaagaaatcgcgcccccagctggcagagaacaaacagcagttcagaaacctcaaacagaaatgtcttgtaactcaagtggcctacttcctggccaaccggcaaaataattacgactatgaagactgcaaagacctcataaaatctatgctgagggatgagcggctgctcacagaagagaagcttgcagaggagctcgggcaagctgaggagctcaggcaatataaagtcctggttcactctcaggaacgagagctgacccagttaagggagaagttacaggaagggagagatgcctcccgctcattgaatcagcatctccaggcctcctcactccggatgagccggacaactcccagggacgggacctccgagaacagctggctgagggatgtaggctggcacagcacctcgtccaaaagctcagcc

SEQ ID NO: 42928 - DNA, 1491 bp, Homo sapiens
caggcgaggggttgggtggcggttgagacagcggcggtactgggatgggtaggtgaggatcccgagactgagtgagcttctgcgcgcggtgcttttgggaacgcgggactggcaacctgcggcgccaggagctgggccgaggcgcggcggcgcggctgcgggccgccgtctggatgggaagttacggcgaagtccacccagcgtttctcaggcaatctgaaggcaaatcctgtttagacccaggcgaaggttcctggtgacccaggctctcaccagccaattgtcccttgccgtcctcctgagggtatctggagcttcagtgctgtgtgctcttggcctccacactggggatgccactgactcccactgtccagggcttccagtggactctccgaggccctgatgtagaaacttccccattcggtgcaccaagagcagcctcacatggtgtgggccgacatcaagagctgcgagatccaacagctcccatcaaggaagatccagagacattctccttaccaagacgttaagaaatgcacaggaagatggccaatctttcctaagctgctgaccttacaagaaaaagaatcgtactgctaagaattcaaacttcagcagtcatggggagccttgggaggagcccgaatcactgatggaatcggacagtgcatggagatggttcagcaggacgaggtgtcattggaggacagcgtggagtgcagagagacatgctttgaaatgggattgatccagtcctccttccttcactaccacatgaatgctgggcagcccaggatcacactcactgcaccctcaactcagaccgttacctggcacactggcctcactcttgtcggagactgagctattggcagtgccttcagctctgagctcaggcacctcgaacattgtttttgtcgttaaggatcctaaagtgctgcggggactgatcacatttttctcaacatccctggccccacctcttctgccacaaacgtcagcatggtggtatctgccggcccttggtccggtgagaaggcagagatgaacattctagaaatcaacaagaaatcgcgcccccagctggcagagaacaaacagcagttcagaaacctcaaacagaaatgtcttgtaactcaagtggcctacttcctggccaaccggcaaaataattacgactatgaagactgcaaagacctcataaaatctatgctgagggatgagcggctgctcacagaagagaagcttgcagaggagctcgggcaagctgaggagctcaggcaatataaagtcctggttcactctcaggaacgagagctgacccagttaagggagaagttacaggaagggagagatgcctcccgctcattgaatcagcatctccaggcctcctcactccggatgagccggacaactcccagggacgggacctccgagaacagctggctgagggatgtaggctggcacagcacctcgtccaaaagctcagcc

SEQ ID NO: 42929 - DNA, 854 bp, Homo sapiens
caggcgaggggttgggtggcggttgagacagcggcggtactgggatgggtaggtgaggatcccgagactgagtgagcttctgcgcgcggtgcttttgggaacgcgggactggcaacctgcggcgccaggagctgggccgaggcgcggcggcgcggctgcgggccgccgtctggatgggaagttacggcgaagtccacccagcgtttctcaggcaatctgaaggcaaatcctgtttagacccaggcgaaggttcctggtgacccaggctctcaccagccaattgtcccttgccgtcctcctgagggtatctggagcttcagtgctgtgtgctcttggcctccacactggggatgccactgactcccactgtccagggcttccagtggactctccgaggccctgatgtagaaacttccccattcggtgcaccaagagcagcctcacatggtgtgggccgacatcaagagctgcgagatccaacagggagccttgggaggagcccgaatcactgatggaatcggacagtgcatggagatggttcagcaggacgaggtgtcattggaggacagcgtggagtgcagagagacatgctttgaaatgggattgatccagtcctccttccttcactaccacatgaatgctgggcagcccaggatcacactcactgcaccctcaactcaggcaagtccagcagccaatcttaggagacctgggctacagaacagtctcccaagttccaggctcacaaaacctaggtggggatgaaagctgagaaagtgaggaggtggttcaggggatcactctttcctactcattcctctcatctcaaactcaccctctactgcaacactgag

SEQ ID NO: 42930 - DNA, 389 bp, Homo sapiens
ttgacttcaataccctgtggttattccaagcaagtctacaattttgctatgacttctggctagattcatgatcttcctttctaatgttatttaccatggaactttcttgagaaaacatttcctatgccaggagctgtagcaatccacttcttagctaatggaaagccactctgaatagctaatgtacctatcacaaaatgggcaaaaatgctgctttgcatagtatatgcaccacaacatttgctgaacatcatctttagtacaaacttaaaggggggcaatatcccaaaagactaaaataacggcaacttccttaatgctgtcgattttagttacactttactttttaggtgaattataaagtacttcataacatatttgtttgatgg

SEQ ID NO: 42931 - DNA, 536 bp, Homo sapiens
ggcacgaggctgagggcagagctgtttgcctggcagaggaggagcaaacagccatgttgtaaatggcctctgaggaggactggcctctaggagttgaggacctcaagcctacatctgcaaggaattgaacgatgccaagaacccgaacaaactctgaagatgagaatgcggccctgttggttgaatccatggatgtggaacccatggatgtgaaggactgactgtactttgcactagtggttctcaaagtgtgggccctggaccagtggcagcagcatcacctgggaacttgtgagaaatgcacttttcagctcctgtttcagatggacctatcagaatctctgcagggaggctgtgaggatctagaggatacagctacggagaacatgctgggttccttgagctgctaagcactgaagtcccaccaatggtgacgaaggtctaaggagaacattgcaattgcacaaaatgatccttggaaattctttagaagggcaccatcttggagacccagaatcaataaaaccagcatggct

SEQ ID NO: 42932 - DNA, 888 bp, Homo sapiens
ggcacgaggctgagggcagagctgtttgcctggcagaggaggagcaaacagccatgttgtaaatggcctctgaggaggactggcctctaggagttgaggacctcaagcctacatctgcaaggaattgaacgatgccaagaacccgaacaaactctgaagatgagaatgcggccctgtgccaagactggctgccttcccctgtttctgtaccacactggttcctgaagctatttgagtttgagactgctggggtaacctgacccacttcaaggatctgaaagtattttacagttggttgaatccatggatgtggaacccatggatgtgaaggactgactgtactttgcactagtggttctcaaagtgtgggccctggaccagtggcagcagcatcacctgggaacttgtgagaaatgcacttttcagctcctgtttcagatggacctatcagaatctctgcaggaacattttgaagtcccctcatatacaatgaaatgatagatttgtcaacatagataaatctcaaaaacacaataagtgaagaaagtaagttgcagatggaaataatatgtgatggtcaaacaatctagatgtttctgtgaaggtgtttttggatgagactaacattgacattggtggactttgagtaaagcaggttgcctgcgtgccataatgtgggtattctcatccaatcagttgcgggatttaacagagcaaagactgaggtcccctgagaaaataggattccaccagcagacagccttcagccttgaactgcagcgtcacctcttccctgggcctcccaacctgctgacactttgatcttggacttctagcctccataactgtgtgagccaattccctaaaataaatctctctctgtacaca

SEQ ID NO: 42933 - DNA, 392 bp, Homo sapiens
ttagaaagatctgttagaatccaggtcttctgtttgctgtcttactattactgaggtttgtttgtttttttaaaattatagatgtgggaaaactgaagcagtggcataatcgttgaaatgcagagctgtagtgcgacctctttgtggttcagtctccagcccacattgcagtagaggagctgtgtcaggagaggagacaggttgcttgttttcagaattgtggttaacaacaaccattgttctttcctctttccccactctttatcagttctggaaatgtttttcttagactaggtagttactaggggtttgcttctaagaaacttttttttttttggtgacagtttcaggatgttttatgctttttgcctgggtctgtcttctttgaagga

SEQ ID NO: 42934 - DNA, 327 bp, Homo sapiens
gtaaaggaaatgagtttttgggaaactgaatgatgctaggtctggggcaggaaaacactagttggatctggggcacactattgcaccagaaagtgaggaagcaatcaaagactggtgtgattacattaaaagaccataggaattaagtagaagaagctcccactggccaaaaaatgggagaatttgagttcacaaagagaataatgactgcgattgatagaaatatatcaaatatctaaaaatcagtaagttcagaacaggacaagggtgtcactctttccatttccacattgtaccatagaacattctggctaggacagctaggca

SEQ ID NO: 42935 - DNA, 373 bp, Homo sapiens
  misc_feature (1)..(1): n is a, c, g, or t
nggtcggtccgctcacgcctcgtaatcccagcactttgggaagctgaggtgggctgatctcaagtgttccgcctgcctccacctcccaaagggctgggattacaggctaattttgtcttaaagtctataaaggcacttggtgggtagaacagttgcaagtctattgaacagcatttgagtttgttgagttatataagggagaggtctgacaattagttttaattactcaattagaatagaaagcattaagattatggaattagtagattcagaggcatgggattctcattaagcttttaggagtgcctgctctttctgtgggaatagtgtggggataggctggctatattttactgtttagatgtttactaga

SEQ ID NO: 42936 - DNA, 181 bp, Homo sapiens
taaacacacacaaactgaaggacattctacaaaatcattttcatcagttctcctcaaaagtgtcaaggccaagaaaggcaaggaaagactgaggaattgttatggcctggaaggcaatacttctctatggagaagtaacaactaaatgcaatatgggatcatccggaataggattctgaaa

SEQ ID NO: 42937 - DNA, 369 bp, Homo sapiens
gagcaggtacagaggacggaacttagaccttagcctggagcctttgtctctttgcttactggaagcttgagaccagccctgcccctccatgggcctcagtttcttcatctataaaatgagcaggttgatcccgacctctctgaagaaaactccagactgtctggagcagctgccagtggcaatggggacagctgaggcaggggctcctggtgggagcagaccctctagctgagcagttgcgcccatctccatcctattgaagctgggaggacctgagttttgtgagggtagctgaggcagtgaaggtgaggccgagcttccctgtgctcacacaaccaatgatcaacttgtttctcctccttctctaag

SEQ ID NO: 42938 - DNA, 407 bp, Homo sapiens
catgaatgttcatatttatagcagcattattcataactgaaatgtgcaaacaacccaacgtccattcactgataaatggacaaataaaatactgtataagcattcaacagaataatattcagccataaaagagaatgatgggcctggcgcagtggctcacacctgtaatcccagcactttggcaggccgagatgggcagatcacctgaggtcgggagttcaagaccagcctgaacaacatggagaaacctcgtctccattaaaaatacaaaattagccaggcatggtggcacaggcctgcaatcccagttacttgggaggctgaggcaggagaatcacttgaacccaggaggcagaggttgcagtgggccgagatcacaccactgcactccagcctgggtaacaaga

SEQ ID NO: 42939 - DNA, 274 bp, Homo sapiens
ctgttactaacatttaaacatcaaagatattctggtacttttatgttgtagagtatatataagaccatattttccctaaaggtatttactatccagggtgtgtttgtgtgtgtgtgtgtgtgtgtgtgtgtacgcacacgtgtgttttcttagctgttagccttttttagaagtcacctaactgatagcattttcctatcacaagatcactggcagtgcgtggaggaagaacttgagtgaggccatattaacagcagggagatgagttaggaga

SEQ ID NO: 42940 - DNA, 519 bp, Homo sapiens
tcttctgccaagtgtctgaccccatggggttgttctgtgtttgcatttaagcaagtgacttctgggaagtccccggccgcccggggttctatgatatttgtagtgccggggctcgcacactgctgcccccagcctgtagaggactttcttcagggcccgtagctgctgggcgtacccctggcaggcgggctgtgccgcgggcacatttgccttttgtgaaggccgaactcgagctgtatcctcataggaaacagtgatcaccccggacgggcgtccaggaccctgagggccatggccaaaaggctcctgagtgtgcctggtggtctggctggggctcacggtgggctgtctggggagggtgggtgcctccactatgatccttaaaggattcctctgtgtgggtggatgcgtgtgggcacgactttgtactcagaaattgaactctcagtcacgtggaagccacgggactgctccgaagccgccataataaaatctgattgttcagcccccaaaaaagtg

SEQ ID NO: 42941 - DNA, 244 bp, Homo sapiens
tgatatactgtttcttatgtgttgggagccctagagacaactgctctatatgaatagcaacacagagaaaatcaacattgcgcctcctatgcagttgatacagaaggcaactaaagaggtcccttctgccttctaaggagacagatttctttctccataagatgttacacacaggaaaagacactccagagtccacgaccacatttgtaatcaccactcacttcataggttaattactgctgac

SEQ ID NO: 42942 - DNA, 254 bp, Homo sapiens
  misc_feature (246)..(246): n is a, c, g, or t
  misc_feature (248)..(248): n is a, c, g, or t
actgtatggcagaaaaggttttcaaaatgcatgagagaattatagcaaagagaaataactcacactaaagtttttaaaatatctccggactatggctaggaactattactatggctaacaagtgtaatttcagcattttgggaggccaaggcaggcagatcccttaagtctaggagtttgagaccagcttgggcaatgtggtgaaacccccctctgcaaaaaatacaaaataattagcggggtgtngngtggtg

SEQ ID NO: 42943 - DNA, 313 bp, Homo sapiens
cactgctcccggctgtccttctttttgctagcactaccttctcctctccagcagaacctggagaagcaggtagcatggggctagctgcctaagtcttcaggtttggctaagaccctggatccagactgcctgcttacacagcctagcttttcacactctgtgcaatgatttccttctctttaaggcagggattaaatagcaactccttaatagaagtgaaaattaaataaattacaatgtgtagagccattagaagagtgtcttgatgtggtaagaactatgtgtttgctgtgactattgagttaggtgtttg

SEQ ID NO: 42944 - DNA, 144 bp, Homo sapiens
attttttaatcttcatccatttggtaagatgttgtgtatttgactaaaaccatagtgtttagaaaaaccaatatagttagtagtagaaaatatgtcacagcagaagcactgccgaggggagagtgtcgctgtcagtcacggctt

SEQ ID NO: 42945 - DNA, 458 bp, Homo sapiens
agaatggactaatggtcttttaaaaacacacctcaccaagctcagccaccaacttaaaaaggactggacaatacttttaccacttgcccttctcagaattcgggcctgtcttcggaatgcgacaggatacagcccatttgagctcctgtatagatgctcctttttattaggccccagtctcattccagacaccagaccaacttggactgcgcccccaaaaacttgtcatccctactatcttctgtctagtcatactcctattcaccattctcaactactcatacatgccctgctcttgtttacactgccggtttacactgtttctccaagccaccacagctgatatctcctggtgctatccccaaaccgccactctcaactcttaaagtaaataaatcatctttgctggcagggctatgctgaacctccttaggcactctctaattggatgtcctggg

SEQ ID NO: 42946 - DNA, 422 bp, Homo sapiens
tttttgaaaattgaccagacacttttataaagactatcttgtgtcatcgttatgataatcctatgtggaagttatcttcagcttcattttaccaatgagataaatgaaactgtggtagtataaataaataacttgtctaaagatactgagtagcagaggaagcattccatcccagacccattgaattctcgagatctaagatcctgccaggctgtttctggaatacagagcagaaaattccctcctgttcaagcgctaactagataagtccttcttcacaaatgccaagtaagcacagaaaaagagcaacagggaaaaagtttatgctccaaggaagaagtcaaccccagactgcagggatcgtggtgagattgtatcaggattggaccttggggaaagcttccttatatttgagactcata

SEQ ID NO: 42947 - DNA, 238 bp, Homo sapiens
tttattttgggaaaaacttgttcaagagttaaacagtttcataaagaaggtgcatttgtgttctctaatacaatcaggtaaaagaaaaaaggtaactagagataaaacagaaatcttgatagacagtatagaaagattttgggtgcaaaagaaagcataatattagacatctaaaattttttaaaaagtacatcaaaattatctcaatctggagaaagtcaacgaagaaaactaagaa

SEQ ID NO: 42948 - DNA, 409 bp, Homo sapiens
gctgcaggactacagcatgtgtggtgcgcagcatggactcaggatgtagtcggtaaatgaataaaatgttatcaaataagaaaaacacagggcgtggaactcataaggccagtgttgtagggagcttccctgtatgggttcacacaaacacacacacacacacacacacacacattctccaaaagccacacaaagaagtaaatacagaggggtatagacaatcattaggaacgcagcaatggaagttgccaaaattggatttttttcacagagaaaagaccacttgaatatccaactcagcctgagagaggaagtcaacaggacggacgccgcgcaaagaaagagctcccgctgattgtgcgctgcccgctgcaaagaactgaataacatggtctgcaacgctccagac

SEQ ID NO: 42949 - DNA, 254 bp, Homo sapiens
aaaaataaataaataaataaataacttgtctgccttcttcatagcagtgatgaggaatcataaaagtggcatttaacaaagctctaagataccatacacatataagtaactaagtatttttttaaaaataattcctttttttttttttaatagctgaaggctaaatctttaaattgctaggctttctcatccgagagtggaaaatctctgttctccctgcgtgggctccagggtccgtttgataagctgctttc

SEQ ID NO: 42950 - DNA, 276 bp, Homo sapiens
ggcctcccatagtgctgggattacaggcgtgagccaccgcactcagcctcctgtgcttttgtatcaaagaaaccatcaccagatcccttgtcatgaagatttttcccgttttttttttctaagagttttataattttagctcttacgtttaggtctttgattcattttgagttcatttttgtgcatgacgtaaagattcaacttcatgctgggcgcagtggctcacacctgtaattccagcagtttcagaggctgagacaggaggatcacttgagg

SEQ ID NO: 42951 - DNA, 265 bp, Homo sapiens
gtttgctgtacgtgaatagttcttcttctaaagtaatagattcatattgtttgctgtcctggctgtctcttttcttttctttcatatcttttgttgtgtttttaaagtgacttttatatatgaatacaaagcaactcacgaagtagggtgtgggttgggggcaagaagtgccctgcaggctttggactgtttgtccaccaggtataatcacactctgctttagaaaacttttaaagtcatcagcaaggctcaaacagactctttt

SEQ ID NO: 42952 - DNA, 391 bp, Homo sapiens
gagccactgagcccgcgagcagcacccctgaagtgactcagggacaggagtttctccagcccatgagattttactccccagaccctacttcactggcgtctggagggtggtctttgagaagatctatatgtgatccttttgttttgttttgtttttgtttttgccactctgtcgctccagcagcatcacatctggacatacctaccttaaaaagctgaacttcttttctttgagatggagtctgtgtctgtcatgcactccagcctgggcaacggaatgagactccgtctcaaaaaagaaaaaagaaggaaagtgcacacatcctaggtgtacaagtcgtcgcaaaacacatgcgtggcgagctgccacccaggagaaacagaacatggcc

SEQ ID NO: 42953 - DNA, 464 bp, Homo sapiens
ggggattatgggagctacaattcaagatgagatttggatggggaaacagccaagccatatcaggtgggaaaatgaaaacttagagagctgaagtaagttgcataattcacttagagttggttagtggcacacccagactggaaatccaggtctctcaaattgcaagtctttaagccaaaccatggggtaaacagctgaaaattctgctaagttgcaaattatgattcagcttatctgatacagggcctaaggttctgcttttctagtgagttgccacatgataaccatgtttgtggtctatgaaccaaattttgagcagcaaggatacagaagacctacatattcaactcttccttccaaaaaaggacctaaattttactcagagttctcttctctccctcactgcagcccatgtgactcaatggagtcggaccctatgtccatctccaacctgaatcttggtc

SEQ ID NO: 42954 - DNA, 440 bp, Homo sapiens
tttaagctggtgatttgccacaatgtgaggtgaggtggtcactttcgaacttggagtgaatggtcactaagcggggaccttgccaggcagcaagataaggaacctcccagggccacccatttgcctcaggccttgtgttttatttcatagcctgctcgaattcattatatggttacatttttcccaaacaaaatactcaccgcttaaatataatccagtcctttccaagttgaaataattttgggatttgccatttgaattacccacaagacatctttcctatatacccatgactgtttcttaaaagaatcccagctgggaaatgatttgctgccccaaggaaacaagcaggtttacatatccccatccccaccctgctttcactctctctctctctctctgtctctgatttcttcaacttttccactagggccaactga

SEQ ID NO: 42955 - DNA, 418 bp, Homo sapiens
gcgcgatctcaggtcactgcagcctccacctcccagattaaagtgattctcctgcctcagcctcccgagtagctgggattacaggagcgtgccaccacgcccggtaattttttgtatctttagtagagacgaggttccaccatgttggccaggcaggtctccaactcctgaccccgtgatctgccctcctcggcctcccaaagtgctgggattacaggtgtgagccaccatgcccagccttctggtttcttttattatcaattttttctcataccttagaaatgaaactgtcagaccctttgtgatttgttgtttacgtatgtattggctaattatggtaaatagcacagttgaaaatgttttgcaaaaattgagttttttgttttgttttgttttttgagacagtctcgctctgtca

SEQ ID NO: 42956 - DNA, 815 bp, Homo sapiens
tgggctcaagcagtcctcccatctcagcctcctgaatagctggaacaacaggtgcgcatcaccgtgcctggctaattttttaatttttagtagaggtagggtctcacaatgttgcccaggctgggctctaactcctggcctcaagcatttctcctgcctcagcctcccaaagagctgggattacaggcatgagccaccacacccgcacccagccttgttcatgtattttcaggctttttctgtgcttcattttggacggtttctatggctttgtcttcaagtttattaatctttaattccggcatttctgatatattcttagttctactcatatttttcctcttcatttatttttcatccgtcatgagatgaaaattttgatttatgtttgtttattgtccacatctctatttaatatattcaggcattcttctacttcttgaacatatagtttacagttgcaataactattttaatatctttgcttactaattccatcatctgtatcatttcctggcttgtttctattgctacatttttttcctcataatgggtcacattgttctgtttattacatgcctagtttttttcactggattccaggcatggtggattttaccttgtgttctggatatcattgtatttttagaaatattcttgagctttattctgggacacttaagttatttggagatagtgtaatcctttcaagtctttttatgcttagttgggtgggaacagaacaaacttaactaggggctaatgttgcccatctactgagtcaataatcttatgattattctactcgatgtctt

SEQ ID NO: 42957 - DNA, 340 bp, Homo sapiens
gatattttaaatatccccttgccccattttttaatgcaaatagaatggatcagggctagaaaaacattcttttggaccatatgaataacaggcttctaagaaaattaccttcattatagtaaatagggtggacagtttttttttttaaatttatccaaaatgtattggttacactaaagtagtatagtgctgtttatttttttttttttatagtcttagccttagcctaatttacattgtttcctatcttagtattcatagacttttggacctaggttagtttgccttattaaaatgacactgggttagtaggatacttaggcaagagagtggagtgtcc

SEQ ID NO: 42958 - DNA, 823 bp, Homo sapiens
ggtgcccagctcaccatgagcacggtcaattcacaaggtagtttttataaataaaggttttgggcaagctgaacgtggtccagagagatattaatgagagggcaagggggaagagttaatgaaaacatacttcctggtggaacataaactgctttttggaactggagaggctttaaaattattttcccaaaaccctgtggcgtttcttttctggaggcaatgagatggggagaaatgacaaatggcttcgttttattattttctcctctctcgttctccatatttttggtagggaaaattggacatttattttggccattttccttctattcgcagaatcaattacatttttggtgtattatgcgtggtaaatatactcaaggatcctctggcttaaaagcaatgagttgattattcgaacatcccttctttaaaggcagttaattgcatggaaaacataggcccccattgtctggtccctttaaacttttattctgagatttgttcccagggtctgggctgtgtagtgtagttgttgttctgcatcattggctgttgtatattccaagaaaaataattttaagcttttaaatcatacagtgattgaaatcttgcatttcagatggactgaaatctcaggccactagtgttcaaggatctacaacattttataacctatatcacttaaaggaggcttggctagctttgggagaatgctgccttctagagggttatgtaaatcaggaattgtggctaattttttcttttgtagattgctgcctgttctggaatttttttcttccactcaaaagtgtgatggtgc

SEQ ID NO: 42959 - DNA, 414 bp, Homo sapiens
cagggacaaaacctgcacagttatgatcagagagttttaaatcaagaagaggaaatagtaggatcgggcccctttctacaacccagctaagccaccagtcaactcatattttgattctgcatctaagctgactgcacatgagattcactcggggagcatttgaaaaccagtgccacccaggcccccaaccccaaaccaatcaacagaatctcttgggggtaaagctgggcactgacgggggaagatctgatttattatcccctaaagacaaaaatgaaattggaagatcacaacataacattctaatgatatcaccacactggctcaggtgctcatggtgaacctggaatttgattccagaccttctgcaggcattcaagtgcagcctggacgacatagcaaggaactatctca

SEQ ID NO: 42960 - DNA, 465 bp, Homo sapiens
gttaaccagatatttgtgtttgtaaagtccaagaactctattgtctgagaaagggagtcatcctagacttccccctctgtggtgggcatctgatgtttctttggctatctgaaattcaatcttcctccctaacatcaccctaacatttggggggtgaggattttctttactaaattttgaatattataaatcgagataccttgtccttgctctatgaaagctgatggggctctcagatgcaattatatcctccttccataagatctgtaactcttattgtcttgattatcaaaagccaaccatatggcttaaactcagctagctgggagtgccttttctgggacttctctttagttctcctattatcaaagcaattgacttcagcttcccagtgacctcttaagtctagacggcattttcctgttttctgccccaccaaactcaatattaaacttctttccttcc

SEQ ID NO: 42961 - DNA, 483 bp, Homo sapiens
aggaaaagacattagcaaaagacttgactaagaatttttacacaagagaatatccacacggtggctcacacctgtaatcccagcactttgggaggctgaggtgggcagataacctgaggtcaggagtttgagaccagcctggtcaacatggtaaaactccatctctactaaaaatacaaaaactaactgggcatggtggcaggcacctgtaatcccagctactcaggaggctgaggcaggagaatcacttgaacccgggaggcagaggttgcagtgagctgagattgtgccactgcactccagtctggatgacagagcaaaactccatctcaaaaagaaaaaaaaaaaagagatgatatacagatagcaaacagtatctgaaaaaattgcacaacatcatcttagtcaatgggaaaatgcaaattaaaactgcaaagagatactttgacaaacccactaaaatggccagaacttttcaatgga

SEQ ID NO: 42962 - DNA, 400 bp, Homo sapiens
tggaagataggagatattcctcaatctctgcagggatgttttcctcatttgtgggagaaaaaaactacatatataggcaagccacaatgatcagtaaattgcagcttattagttatactaagatctggtctcctcacacataaaagaggttacatcaactactggcactttctgtgatacctagcctgtcgtaaatgtgctgtttttattcctagcaaatgtttgaatccaagcaaaacctaattggaggtatggattttaccttccatctgaggactgaggctgccttccaaaaagttaggggagttttatttgaggcttcttggctgtggactctgtttcctacctaggtcacatgtaaaacaggaagattaaaactaaatcaaatcaacatttattg

SEQ ID NO: 42963 - DNA, 353 bp, Homo sapiens
catggaagaaggcaaagggtgagcaggcacatcacatggtgaaagcaagagagagagtggggaggtgccatacacttaatgaacagaagtcacacactattttgaggatagtaccaagaggatggtaataaaccattcaggagaaactcacccctgtgatccaatcacctcccaccaggccccacctccaacattggggattacaattcaacatgagatttgagtggggtcagcatccaaactatatcaacataatacctgataatgataataaatgagtatgttactgctttatgtatttattatgctatacttttaatcattattttacagtgtaccctgtctactttaaa

SEQ ID NO: 42964 - DNA, 1005 bp, Homo sapiens
tacttgttaaaatatctaactacgtaattgctacatgggggagctgctggtgttgttgaggtccttgggagcattccactggacttcaccatttctccaaaattatcagcccagtcagcttcatatacccagatatggacacttctacacgtgaaattcaaactgaagataaaactctgactttggagtataaacttttgccttgagtatgaaaccttgacattgctgaaagaaaagtggaaactgtaagggacaacaagtttcaccaaggcacagtcttctctgataggccagcagagcagctaaggagaagacagatcattcaagaacttaagtcgtttgttagctacagcatttccattgctgtgatacacattcagccattttggaggaaagctaagcaggttctgaccacccattttcatgtactttaaataacaaatattatttctcaaggtcttcattttatcattaaattcagctaattactacctgatttcaaaggcagctagtgtagaagactggtcacaagaatttttttttaaatagaaaaccctaaaatgcaaatcaagaaattcagttacaggctgcaagtgacctaaaattcccctactctagctcagcagccatcagtcagtatagcatcagccacaggtcactgctctgcatacagttccttttcaacccttacaagacctgcttcattgctttaaaaatgtagtgttgatacttgaactgaatttagtcattggtaacttaaatattcacaaaattgtcataaagcttctgaaacatctggcaatgccagatctgtaatcatcacttttaaattgaatttgcagaattaactctaaagttgcagcaaccatatttattagagaaatctttaagcatatacatatggttccctataagcattcattcagagatcatctgtgcctaaaagaaaatgataaaaatgtgtcataatatcaaaggggtctagatcaggggttggtaaactac

SEQ ID NO: 42965 - DNA, 455 bp, Homo sapiens
tccctcttcatctaaacatctcctaccctagtttagtgcctcataattctttgctaactactgtgttaactccagatggtttcccagttactagtctcatactgaccattgcttccagataatcttcctggcccaaaaattttccttgaaggcctggaataaatgtcactccttccatccaccaagccttggggatatactttaacctattgattaagaatatagatagatggagccaggcgcggtggctcacgcctgtaatcccagcactttgggaggccgaggcgggtggatcacgaggtcaagagatcaagaccatcctggccaacatggtgaaaccccgtctctactaaaaatacaaaaaattagccgggtgtggtagcgagcacctgtagtcccagctactcgggaggctgaggcaggagaatggtgtgaacctgggaggcggaccttgc

SEQ ID NO: 42966 - DNA, 779 bp, Homo sapiens
ctacaggcgcccgccaccatgcccggctaattttttgtatttttcatagagacatggtttcaccatgttagccatgatggtctcgatctcctgacctcgtgatccacatgccttggcctcccaaagtgctgggattacaggcgtgaccactggcgcccggctagttttctctttttgtcgtgtctaccttcctacttgcctcacaccagtcagttggctttctgtgtcaagcctgaggaatgaatctcatgaaagagcattgggagagcggagattttgggaaattgctttcagaacacaaaatcccacatgcgtgggcttgttccctgcaagcttaatcttgcctgatgtatatgtgtacatgtggaaggctgaaggaagtgctataaatgccccattcgtaagtattcagccatcgtgtgctgaaagcctgccgtctgccggacactgaaatgtggccttcacaggccgagggtctttaagaagcatggccgtgggggctgagagcagggtggggtgacaggacaggttactgagactgaattttgtctgaagagtagggagagctgtagtggttcccctttgctggttgttggtttttgtgtgcccccccacctcaaacccccccaccgtaagagaatcagaagggtcccatctgccttgcagggaagggtcatggttggtgactggtaacatctgggggaggggccacttcattatgccacccagaatatcaaagcagcttaggcgttggaacccagggaaggaagaagagatta

SEQ ID NO: 42967 - DNA, 261 bp, Homo sapiens
  misc_feature (14)..(14): n is a, c, g, or t
  misc_feature (22)..(22): n is a, c, g, or t
agggaatctcaggntacaaggnaaacaccaagaagtccccatgagtccctacagccacaataaattgaattctgccaaaaatcttaataagcttggaagaagaccttcagctcctgatgagaacccagccagaaacaagatgagaacccagaaacaagattttcatcttatttcaacctgagcagagaacccagaggagccctggccagatttttggtctacaggattgaggtaacaactgggggtataaattgaattctg

SEQ ID NO: 42968 - DNA, 1024 bp, Homo sapiens
gttggaaaaaccacactaggcaaaggacttgtgtcaaaatcaggactgaaatacattaatgtgggtgatttagctcaagaagtctgatcatcgtatatcatggagtctggcaagatggcttctcccaagagcatgccgaaagatgcacagatgatggcacaaatcctgaaggatctgggaattacagaatatgagccaagacttataaatcagatgttagagtttgccttccgttatgtgaccacaattctagatgatgcaaaaatttactccagccatgctaagaaagctaccgttgatgcagatgatgtgcagttggcaatccagttccacgctgaccagtcttttacctctcttcccccaagagatttttttattagatatcgcaaggcaaagaaatcaaaccccttttccattaatcaagccatattcaggtcctagattgccacctgatagatattgcttaacagctccaaattataggctgaaatctttacagaaaaaggcatcaacttccacgggaagagtaacagtcccgcagttaagtgttggttcagttgctagcagaccaagtactcccacactaggcacaccaaccccacagaccatgtctgtttcaactaaagtagggactcccgtgtccttcacagggcaaaggtttacagtacagatgcctacttcacagtctccagctgtaaaatcttcaattcctgcaacatcagcagttcagaatgttctgattaatccatcattaattgggtccaaaagcttcttattaccactaatacggtgttatcacaaaatactgccaatgaatcatcaaatgcattgaaaaagcgtgaagaagatgatgattatgataatttgtaatttagccttgctgcatgtaacatgtatacttggtcttgaattcattgtactgatactaaacatgcgtgctggatgttttcaagttgtattttagaaaactttcatatttaatgagtaaatacaattaccatacttttcaattgaaatgaaggtt

SEQ ID NO: 42969 - DNA, 479 bp, Homo sapiens
tgctggtattataggtgtgagccactgcacccatccaagagctttttttcttctagatttcaagaggcctcttttcctgtcctaaaagatggagctaaattctctaacgtgccccatgcagtgcccacaaaatcttccttttctttccttttctgggcgtccttggggccctgtacttgctgtcacctgtgtctggggttctcttctgcaggtctttccaggccttccctgcatcctctgccttccctcccccggccactccccgtcttagcaggagccactgcctggacttccctcgcgtacctgctgctggtttcatgtcaccttccctgcctgaatgtaagctccctaaggacaaggactccatcttgtgtcctgaatcctgccagacttcagccttttatcagtggctggtgtggagcggtctttggtcgcttgctggagggtccatcaaggctgtgtgagggaccttcttgtgg

SEQ ID NO: 42970 - DNA, 188 bp, Homo sapiens
ccaccagaaggagtaggctaatttgtatttttctccctgtaggaaatatcagggtcttcagccaaacagtggggaaagggtgttagagcgggtcagacacttcataccatccccctgatttcatggtgtcttaggtatttatcagtgtttcaaaatttataaattgctatgatgtcttttctcgctct

SEQ ID NO: 42971 - DNA, 197 bp, Homo sapiens
accccgtttctgctcaagcctcagagttggaaactccagtccttctggagcatccgggcaggccagagatctcaggcttttcttgcaggctgggaggtgagccctcaccaagtgacttctcagatgacgcgcttttctgggatccgaggcttatgaatctacagggaacattcagtgtccccatctggctctctagg

SEQ ID NO: 42972 - DNA, 485 bp, Homo sapiens
tctttttgtagaatataaaggaaagctcattgataaagtataataaagatgactgtaagacaaaatccaattctaaaagtatgatttttttctagtagaaaattgatgtaagaaatcatacattattcatacatttataggtcatctctttgagttttcagtgaactatagaaactatatggagttaaaaaacaaaacggcagccaatctcagtggctcacacctgtaatcccagcactttggaaggttgaggcaggcagatcacctgaggttgggagttcaagaccagtctgaccaacatggaggaatcccgtctctgctgaaaatacaaaattagccaggcatggtggcacatgcctgtaatcccagctgctcgggaggctgaggcatgagaatctcttgaacctggaaggcagaggttgcagtgagccgagatcacgccactgcactccagccttggggacagagcgagacactgtctccaa

SEQ ID NO: 42973 - DNA, 443 bp, Homo sapiens
tactcttaaattttagcagagttcagacctctcccataatcctaatgttgtggcctttcattagtcttacaaagtcaggtttccattcttgagcaaggagggacttagttttagggagggactattaccatccttgctttcaagttaaaccatgggcagggcatggtggctcatgcctgtaattccagcactttgggaggccgaggcaggcagatcacttgaggtcaggagttcaagaccagcctggccaacatggcgaaaccctgtctctactaaagatacaaaaaattagccaggtgtggtggtgtgcgcctgtagtccctactattcggtaaagtgagacaatagaattgcttgaacccaggaggcagaggtttcagtgagctgagattgcaccactgcactccagcctgggtgacaggacaagaccctgtctccaaaaa

SEQ ID NO: 42974 - DNA, 833 bp, Homo sapiens
aaaataaggatgataatacccacctctcatcatgccataaaacttacataagcaaatacctgtgaagtgcttcaaacaatgcctggcacatagcaattgtgctgctattttaactataataataatttaaggctttcaatatctttatggtcctccaaacactttgttctgacaacagagtgggttgtcataaaatttaaaacttgggaatgaccttactattgattaatctaacccaaccctctcccggtatcatcaataggcctcatcaatcgcccctcatggcttgcacattttctggaatgggggactcactgtctccctggtagcctctatccttgttgtggggctctgataatttgcttcaagtaagtgtccaacactgaagttgctgagtcagacggcatattcacttacaagcctttcaattctaattcccaatgtgtccttaagaaaggtgatattcatatacagtactactcataaagtgcccaattcaacacaacctgaagcaaggagagttggattaaaagccactttctaatttgatcaacagaacaataactattcttctttcctattttatattcattatagtactaatgaaactaagtattttttctcaaatatttactgccttactttttccattttgacttgcctgttaatgtcctttatctatttatttgatgcatttgcttttaccttgattaatttatagattccctgtcttaagcatactcgttctttgttaaaaagtttgaaaatagttttcccaacatgtcatttaaattttagttttgattttggtctaatgtgataaacagatattt

SEQ ID NO: 42975 - DNA, 850 bp, Homo sapiens
ccagggtctcatcgtcatgtctacaagcctggaagagattttcaattgcatctttgatgcccatgttcctccgctctggggaaaggcatacccctcacaaaagccattggctgcctggacccgggacttggccatgcgtgtggagcagtttgagctgtgggccagccgggcccggcctcctgtgatcttctggttgtctggtttcacctttcccactggcttcctcactgctgtgctgcagtcttcagctcgccaaaacaacgtttcagtggacagcctctcctgggagtttatcgtttccactgtggatgacagcaacctagtgtatccccccaaggatggtgtctgggtccggggcctgtacctggaaggtgctggctgggaccggaagaactcctgcttggtggaggcagagcccatgcagcttgtctgcctcatgcccacgatccacttccggcctgcagagagccgcaagaagagcgccaagggcatgtactcctgcccctgctattactatcccaaccgggcaggcagctcagaccgagcctcctttgtcatcggcattgacctgcggtctggggccatgacacctgatcattggatcaagaggggcactgctctactcatgagcctggacagctgagacctcctcctcttctccgcttgagagagagggtcagggactccaggagctaagacagatgttgcacctaggactgaggccggacctcactcagactttgaccttggccgaatttgtgtgatgtggccctggagatacctagttgtgttagccataaaagtgaaagagttgtattggagctcagtgctgtaaaacacccgcgacaac

SEQ ID NO: 42976 - DNA, 368 bp, Homo sapiens
tcaaggcaatccctatcgagttaccaatgtcatttttcacagaattaggggaataaatcataaaattaatatggaaccaaaaaagagcttaaatagtcaaagcaatcctaagcaaaaagaacaatgctggaggcattatattacctgacttcaaattatactactaagctatagtgactaaaacagaaggtactagtataaaaataaaaatagtcacatagatcaatggaacacaatggagaacccagaaatagagccacatacctacaaccaactgatctttgatgaagtcaacaaaaatatatgctcaggaaagaacattctattcaataaatgatgccgggaaagttggataaccatctgcagaa

SEQ ID NO: 42977 - DNA, 363 bp, Homo sapiens
caagggtcacttgaggccaaccatggtggagcttaaagcacacaactgggattggtgccacctggagggagatgggggtggtgcatgaggtgatgcatggtggatgacttcagtccagtggcttctcattaagatcaggccaacgcctccctggcaggccatttagatctttaaaaattgatatataataaactgcacatatttaaaatatgtggaatttgatatgttttgacatagatatatacctgggaaactgtcaccaccatcaagataatgaactcacctgtcacccaccaaagtttcactgttcccctttgttatctctccccccgctgctccgtactgccccactctctccccagg

SEQ ID NO: 42978 - DNA, 578 bp, Homo sapiens
  misc_feature (578)..(578): n is a, c, g, or t
cgttcctgtcagctggtcaccgttgcatgcatgtctgtgattaaccacccggcgccggccccggccctccagccacatcctcactaactgtgtttgtgcgtgcatggggctgtggcacacactggcagcagtacttccgttagccacgtcatgagtgggaaggaggatgagacacctgctcctcaccggctggagtgcatgtggtcattttgttccaggttcctcgggtcgggacacagctgccgctgtggggctgggcaccccagagaggggcagttcagcagccctcagctctgatcagcaaggtgcagcgctgaaacaccactgatgacccttagggactgactgttcaggggaccctctgtcatttgagctcttcgagtgaagattatgagtatagaccccaagtcatgtttgtcttctttgaagtctataaaagttttcttgttggccaggtatggtggctcacacctgtaatcccagcattttgggaggctgaagtgggagaatcacttaagcccaggagattaagaccagcttgggcaatataacgagatcccgtctctgcaaaaaaaaan

SEQ ID NO: 42979 - DNA, 626 bp, Homo sapiens
ttctcaagttctctgctctgttttggacctccctgcatctctccctgcgtcaccatccctgggcgctcagggctgctcctctgccctctgcagggcctccgtggtgtgctctgtccttccctcctgccgttcaaaggcatctgcatcctttgttgtagccagatttctcactctgtattgcttttcttcctaggcacttaaatatcctcatctatctccaagtgccttccttgacaccttgcatctccaatagaacgttctgtgacaatggccatgttcttatatttgcactgtccactatggtagccactagccacgtgtcgctgctgaagccttgaactgtggctagtgcgactgaggaatggaatttaacattgtatcttattgtagtggttaccatattgaatggcatagcttaagacctgtcctgtctccttcctcaacccagttagttagatgtctcttcaagggttgttattctagagctagggcccacctgtagtcccagctacttggagaggctgagtcaggggggttacttgagcctaggagttttgagactgcagtgagtgcctgtgaatagccactgcactccagctgggcaacagagtgagacctcatattta

SEQ ID NO: 42980 - DNA, 366 bp, Homo sapiens
gtgttggatgtggttttctatatcacatcaattgaaaagataatatgaaaattatataattcagagcaatacactttctcctagaacatgatctgtaggcctctatttgttttaagaaaacctcagtactttatgaattcaagtattagatataagttagaagcataaataactttgaacactgtatgccatcctcttgcttattagaatactatatccctttcaaagaacatctagaataccacctcttccaggaatgtttttgtgttcatcccatccattcaccaggcccctgatacctgccaggccctgaggttataatgatgaacagaaaatctcttcttcctttgcctttgtttctctctg

SEQ ID NO: 42981 - DNA, 590 bp, Homo sapiens
cacgagcttggcgtctactacctgcccgacgccgagggtgccttccgccgcggcccgggcctgaacttgaccagcggccagtacagggcgcccgtggctggcttctacgctctcgccgccacgctgcacgtggcgctcggggagccgccgaggagggggccgccgcgcccccgggaccacctgcgcctgctcatctgcatccagtcccggtgccagcgcaacgcgtgagtgtaccccggcccggaccccacacccgcattcgctcggcctccacaagctggaggtggttaaacaggcactggacggggcttccgcccgttcacaccccaccgtggcctaggtgaccccacaccttcttccaggtctcccggtctacttctgcccctatcaggccttcccttcacagcaactgggagctgttaaaaatgacctttccagctgggcgcggtggctcacgcctgtaatcgcagcactttgggaggccgaggcgggcggatcacgaggtcaggagatcgagaccatcctggctaacatggtgaaaccccgtctctactaaaaatacaaaaaattacccgggcgtggtgggtgcc

SEQ ID NO: 42982 - DNA, 377 bp, Homo sapiens
gaggacggaacttggcccatccccaagcctggggggcaccacctgcggctgctggtgcccctttcagtccctgctgccacatcctgtgaaccaggacagggtaaggcctcctctgagcactgcctagcctgggccagaggggcactggacaagggcctttgggggacagtaagtctgggcccagcttctagttctaatgtgtgcaagattaactcactttgtatccactgggcacagatattctagagaacttatctttcactcttgtaaaagccacatatccacatctctttcattttctcagtgtgttatgcagcaatttattaaagtatttattgtctaataaatactgccaagtggaatatatttatataact

SEQ ID NO: 42983 - DNA, 2115 bp, Homo sapiens
cacgagcttggcgtctactacctgcccgacgccgagggtgccttccgccgcggcccgggcctgaacttgaccagcggccagtacagggcgcccgtggctggcttctacgctctcgccgccacgctgcacgtggcgctcggggagccgccgaggagggggccgccgcgcccccgggaccacctgcgcctgctcatctgcatccagtcccggtgccagcgcaacgcctccctggaggccatcatgggcctggagagcagcagtgagctcttcaccatctctgtgaatggcgtcctgtacctgcaggttcagtgctgtcctcctgggcgtgtgagcggccaccacaggcccttcctctcaggggcaaatggagcacagatctagacaatgtgtggacagtgtcagagtagcagtggccacatggaggaggaggcccacccggaactctgcccacactggccactgcagttcagcccacagagccactgcaggcaggcctacggacgtgacacgcacgctggtggtcccggagccagggttgattcaggacaccatcttggactctttcctggcctgctcagcacctgcccagatggcctctgcgtctttcctgtgcccagccccaccttttccacctctcttcatgttctcatggagtgcaaagtgcaccagccagggcccctacctgggagagggtcagctgacgcagggctgagggggctgccacagggacgtacgctgtgtgttcttactgcttagaagggacggggtcactcaccactcccctggtctccatctgggctccttggtcttccctgcccctcccctaaccgtgttctacctgccagtggagctgagcactgcctagcctgggccagaggggcactggacaagggcctttgggggacagtaagtctgggcccagcttctagttctaatgtgtgcaagattaactcacaaattcacctcagaaggcctttccaaatgggagctccactcttcccctcctctgcaaatcttcacagccaaggccccttccaccctctccagaggtggatgagatcccttttcccctcccctctgaggtgctgactcactggtaggagccacccaccagaggaaagatctagaacgtctttacagattggagacagccgggcctgctgacccatcatccgaatagctgaagcagagtcttccaccaggggtgccagggcctggctgggtccagcggctctgggatgagcctcccaagcatctttcccacttgggtggccatgcggcgctgacattggacaggtggtggacgagagatggtcccgagaaagggtggtcttgggagggctggtcccaagcctgctgtgctcctgtggcagtgatggggcctggggatggggacggcagctctcatgaggacacacaggctgtgagcccgcagcctcctcaaatgtagcctcccacattttccccaaagtacaggactgtcccagagtaggtagtgaagaggacaaggccctcggcagcgacctccagggcctcctacctgctgaggaagagttaacccactgcctccccacacaacaggctacgaagaacctggtgcctcaggacctcctgggagccaagctggtctggcaagggcgctcaggcctgggagagaagggagcaatggccagtcaccttcaccttctaactaactagcctccggatgaggtggctgccaccaggcccgaatgatccccaggagcccagcttccaaaccccaacatcgaatcaaacatctccatccccaagtgcagtaacacacaaaaaccaaacactctgccctgggaaaggcctggtgcgattctcagtaggactcacacccaccctacctagaagtactgggctggcctgggtactgcatccgtgtgttttgataagggggtgatgtggccacgcccttatctagatttcactttgtatccactgggcacagatattctagagaacttatctttcactcttgtaaaagccacatatccacatctctttcattttctcagtgtgttatgcagcaatttattaaagtatttattgtctaataaatactgccaagtggaatatatttatataact

SEQ ID NO: 42984 - DNA, 545 bp, Homo sapiens
ggcgtgcctgggggcacctgctagtctccagctgcaggccgactctttcctggcctgctcagcacctgcccagatggcctctgcgtctttcctgtgcccagccccaccttttccacctctcttcatgttctcatggagtgcaaagtgcaccagccagggcccctacctgggagagggtcagctgacgcagggctgagggggctgccacagggacgtacgctgtgtgttcttactgcttagaagggacggggtcactcaccactcccctggtctccatctgggctccttggtcttccctgcccctcccctaaccgtgttctacctgccagtggagctgagcactgcctagcctgggccagaggggcactggacaagggcctttgggggacagtaagtctgggcccagcttctagttctaatgtgtgcaagattaactcacaaattcacctcagaaggcctttccaaatgggagctccactcttcccctcctctgcaaatcttcacagccaaggccccttccaccctctccagaggtggatgagatc

SEQ ID NO: 42985 - DNA, 531 bp, Homo sapiens
cccacacaacaggctacgaagaacctggtgcctcaggacctcctgggagccaagctggtctggcaagggcgctcaggcctgggagagaagggagcaatggccagtcaccttcaccttctaactaactagcctccggatgaggtggctgccaccaggcccgaatgatccccaggagcccagcttccaaaccccaacatcgaatcaaacatctccatccccaagtgcagtaacacacaaaaaccaaacactctgccctgggaaaggcctggtgcgattctcagtaggactcacacccaccctacctagaagtactgggctggcctgggtactgcatccgtgtgttttgataagggggtgatgtggccacgcccttatctagatttcactttgtatccactgggcacagatattctagagaacttatctttcactcttgtaaaagccacatatccacatctctttcattttctcagtgtgttatgcagcaatttattaaagtatttattgtctaataaatactgccaagtggaa

SEQ ID NO: 42986 - DNA, 2199 bp, Homo sapiens
ggcgggagccggggtgaccatccgtgcccctcgcagcccgacgccgagggtgccttccgccgcggcccgggcctgaacttgaccagcggccagtacagggcgcccgtggctggcttctacgctctcgccgccacgctgcacgtggcgctcggggagccgccgaggagggggccgccgcgcccccgggaccacctgcgcctgctcatctgcatccagtcccggtgccagcgcaacgcctccctggaggccatcatgggcctggagagcagcagtgagctcttcaccatctctgtgaatggcgtcctgtacctgcaggatggggcagtggacctccgtgttcttggacaacgccagcggctgctccctcacagtgcgcagtggctcccacttcagtgctgtcctcctgggcgtgtgagcggccaccacaggcccttcctctcaggggcaaatggagcacagatctagacaatgtgtggacagtgtcagagtagcagtggccacatggaggaggaggcccacccggaactctgcccacactggccactgcagttcagcccacagagccactgcaggcaggcctacggacgtgacacgcacgctggtggtcccggagccagggttgattcaggacaccatcttggactctttcctggcctgctcagcacctgcccagatggcctctgcgtctttcctgtgcccagccccaccttttccacctctcttcatgttctcatggagtgcaaagtgcaccagccagggcccctacctgggagagggtcagctgacgcagggctgagggggctgccacagggacgtacgctgtgtgttcttactgcttagaagggacggggtcactcaccactcccctggtctccatctgggctccttggtcttccctgcccctcccctaaccgtgttctacctgccagtggagctgagcactgcctagcctgggccagaggggcactggacaagggcctttgggggacagtaagtctgggcccagcttctagttctaatgtgtgcaagattaactcacaaattcacctcagaaggcctttccaaatgggagctccactcttcccctcctctgcaaatcttcacagccaaggccccttccaccctctccagaggtggatgagatcccttttcccctcccctctgaggtgctgactcactggtaggagccacccaccagaggaaagatctagaacgtctttacagattggagacagccgggcctgctgacccatcatccgaatagctgaagcagagtcttccaccaggggtgccagggcctggctgggtccagcggctctgggatgagcctcccaagcatctttcccacttgggtggccatgcggcgctgacattggacaggtggtggacgagagatggtcccgagaaagggtggtcttgggagggctggtcccaagcctgctgtgctcctgtggcagtgatggggcctggggatggggacggcagctctcatgaggacacacaggctgtgagcccgcagcctcctcaaatgtagcctcccacattttccccaaagtacaggactgtcccagagtaggtagtgaagaggacaaggccctcggcagcgacctccagggcctcctacctgctgaggaagagttaacccactgcctccccacacaacaggctacgaagaacctggtgcctcaggacctcctgggagccaagctggtctggcaagggcgctcaggcctgggagagaagggagcaatggccagtcaccttcaccttctaactaactagcctccggatgaggtggctgccaccaggcccgaatgatccccaggagcccagcttccaaaccccaacatcgaatcaaacatctccatccccaagtgcagtaacacacaaaaaccaaacactctgccctgggaaaggcctggtgcgattctcagtaggactcacacccaccctacctagaagtactgggctggcctgggtactgcatccgtgtgttttgataagggggtgatgtggccacgcccttatctagatttcactttgtatccactgggcacagatattctagagaacttatctttcactcttgtaaaagccacatatccacatctctttcattttctcagtgtgttatgcagcaatttattaaagtatttattgtctaataaatactgccaagtggaatatatttatataact

SEQ ID NO: 42987 - DNA, 219 bp, Homo sapiens
ggcgggtgagtccggccgggcgggagccggggtgaccatccgtgcccctcgcagcccgacgccgagggtgccttccgccgcggcccgggcctgaacttgaccagcggccagtacagggcgcccgtggctggcttctacgctctcgccgccacgctgcacgtgggtgaggcccggggcgtgggaggatcgcccgctctgtcgcccaccccgccgcccgcc

SEQ ID NO: 42988 - DNA, 239 bp, Homo sapiens
agtaagtcagtagctggctatcagggagactttagagacccagagagctttatgcctaaggggagaaaaagaacatttttcttgtcttgaggcaggtcacagaaaatgtacacatggtgctggggacaaaggtctaggagaaaagcaaaaggcagtcacccctgccagatatctaatagaatgccagagttagacatgaatgccataagaataatgaaaaactgagagccatgggcctt

SEQ ID NO: 42989 - DNA, 1041 bp, Homo sapiens
cacagatggaaatttccaggttctctaggtggtaggcagaggcctccctttttaagaaactccccactccacccctgccaatgaggacgttgcttagaggtatttctatcagtgttgagtagaagagatcatttcttggtgttgaatttcaggtaaggatgccagcttctgcatatcagggtgatgatgtttgggctgcgacaggtctagacagcagtctgaaagggggctcaaggaagtagctgtgaaaggcccctgggatgttttctgctcccctttctgcaaatcccctggagggagatcctgttagtcactacaggatgtgtgtgtgtgtgtgtgtgtgtgtgtgttcatcacttgttgcttgggggtgggaagagacaacaacaacctacagaatccagagttctcagttcatctcccatcctagtccaatcatggcctaacatccttagctaccgatcgcagaggagactgcgcatttgtgttcatgtggccttggatgttggcagattcagattggtgccccaggcatctgtgcctgtaactgcagtttcagcgggctcaggaccaggctaaagggcctccaagcttcctccagtttcctggtgcatgcatgtgcaatatgctcccctggcctgggtctttcctgctgcttcttgccagttgggtcagaactagcttattaaccagtttttcttctgagctttaatcgaactggctccaaccagttggaggcttgaaaagggctacgtgctagttatagatttttaaagatatattattattttagagtagttttgagtgtacagcaaaatggagtgcagagtccagagatctcatatgccctcaattcctgtatactctcgggtcactccaccaacaacctcctacaccagagccactttgaaacattagaaaatatatttgagcattcagaaatgtataaactaggcagccccagactgcaagcagctcagaggtcccacagagaggcttagggagggtgggggaagaattttatatggtgaatgtggaaga

SEQ ID NO: 42990 - DNA, 430 bp, Homo sapiens
aacagcctcacgggcttttgagaagggcagggaggatcaactcctgacctggtgacactgatggagcaaagctgcttccccactccacacctcagtttccccactccttccagtggagataatgacctctgtgtgctcagtgctactgtgagtcagggttaattagcattagtcatagacttgggaatcctcacaagaaaagggtcatctggtgggtctgggctgtgccctggctgtgatgagacaccactcatgcccctgtgagtgtgtcatcatgcttcattagtggcttgcctaactttgcaggtcggccctggggtggcccagccctgagtgcgggtgctgagatcagccaaaggatgacacctggggagggctgcatgtgtcccagggtggctgccaatggctcacagtcccctggatttccctt

SEQ ID NO: 42991 - DNA, 1302 bp, Homo sapiens
cagcattgtctacaagtccgaaaggtaggtgacaaatatctaagaatcagtattgaaatcagtgaatttcaggaatagaggaaaggactatgatcagatcttgattttatctactttaaattgtctatttatttgatcccaaccttttgtacttctgaagtgtaactgtcttttattcaacagaacatgaactaggaagagagattagaaaacagaatgtgaacatttttcttttaataattgtaacaaagatttgttgggagagaaatttccaaataatgagtagtgtatagtgtaaggaataattgacctggaattattggccccaaactctgattcttgctgaagcatctatgagaagtgtgattttagccaagtctgtgccgcattctttatatgtaggaattaagttttgatttaatgatttctgaattttctttcagctctactcaattaaggggtatcagtatgtgaaatggaatatagaaaagtaggcaattctttacttttctatattcagtttcataaattaataccccataattgcccattatataccaaagacaatatctcaagttatctcattgtagcagtgtctgtgagtcaaaacttcaattttagtagagtcacactttctttatatagaaaaattcatgtactcactactcatgtagttactgtatctttaccttcagtttgtaaaaatgactaaaagtagggaaaacaagtgttaaaacataatggataagaaaaggttggaaatcatatggcaaatcacatgttcctcagcctcaaggtgtgtttagttgtgaaagaaagaataaaattgtttaaatatttcactttttgggaatgacttctcccctactcccccagaaaatgcgatgtatacctttgcccattcaactttagtccatatttttaggaacacacaaatttactttaaggaattacctttaaagttgactatataatagcaaaagagaaagtattgagactgtcagtgttgataaagcttctagcaagattaggttgactagaagtgcatcacagttctttatacttttagaactaaaagccttataattttgaaaaatatccagttacagaaattgtaccttatcagttatactttttttctgagtaagaaaacaagctatagctttctggttaatttcttatttttcgttgtttggtttttgtctttttgagtggaacgttaaagtttattaccttcatgttaaggaatatccagcttcacagacaattaacttgcaataaatctctgaaataatcaaaaat

SEQ ID NO: 42992 - DNA, 263 bp, Homo sapiens
gaacacctctgattaattcttcagcttcttgatatacagaaagttattaatccaggcaggcaaggactcagaagcctcaattctactcagctcatctcaatgcttcagaattaagcaggacattgttccagctcagactccatggagagagctcagcattagcagtgtcttctaagaatctaaaaatgttctttaaaatgaaaattcataggtatttagtgatggactagatttcaatagttttgaaagcccatataaaaaca

SEQ ID NO: 42993 - DNA, 893 bp, Homo sapiens
ctggacacctttcttaacaaatcataactgcgtttaatagttacgtggtggtctgtgacttcgttgttcaacaaaatcgtttgtgtgcatttcagagacaacgtgtcctaattttgcctcccaaaagtggttctccacaatagataaaaccaatgggagccaaaaggcaagcattagaattattctgtgtttatcctcaagatgttgttattagcatcatcaagattcagacaaaattctacagattaaattattaaatctcctgcaacccatcttagacagcttcaaataaaggagacaatttcatcaggtcttatgggcatctgtaaatatagctaagagcattctcttgctcccaggctcttacgagataccaaaataatgttacctttcttttttgcattattcatttattggctccctttctgagagtaaagacttttcctcctttctcctgttgttagttttttacccagaccttgatccctgagttaggagaccatcagattcggcaagaggacttacctgtggagctgacagcaatgtgagactggccagtgcttttccccttcgtccattcccagtcacatgatgttgaggtggataactacaagtttataggactgtcttgtccacatgtgaggaaagatgaaaaaaaaacattaattccaagcttagataggtgaaaataaaaacagtccattccatcattcctcagacagttatatttagaggtattatcttcatgtcatgtttgcaactgatccgtcttcctgagcttgtaaatgtaatccatatccatgttctacatgatcagtcagagaaaaagaaaaatgttcagaaatatggaggaaattgttatcagttcctgtgttattactccacccctccct

SEQ ID NO: 42994 - DNA, 377 bp, Homo sapiens
ttaccaaccctttaagaatgtaaaactcatagctcacaggccatacaaaaacaggcaatgggacagatttaacccatcagccaccgtttgccaacccctcatataaggtaatcagggtggtttcatttcctttgccaaagattggttttagcatggacgtatagttaagtcctgacagatgtgatctgcagatgttccttagttcaaaaaagaggcctatgagaaggaacagtccttttattgccttggatatggctgtgtaatgcataatgcccggagctgctgcagccatcctgaggacatgcggtttctcacctttagcagagaatagcagaaaagagaaaggaatctgactgaatctccatgacattactgaa

SEQ ID NO: 42995 - DNA, 524 bp, Homo sapiens
cagggactgttatctgctttgttcagggctatatcctcaggacctggtacctagtaggccctcaatcagtatctgatagatgaatggatggatgaaattgcgactgtctgcagtgggcctggtacctagtaggccctcactcaatatctgatagatgaatggatggatgaaattgcgactgtctgcagtggacctggtgtcaaggcagatgccaccagggctcctcaggacatctctgggcccctcccactgagccctgcatttgccctcttaggtggtttcttcacttatctttccttggcctcccaagatatctttcctcccctcctcttccctcccctcccctcctgctgactccctccctgcagagccatctctcagccaggtgtgtgggctggtcacaggggatacatatgaaagtgtaaatctcctagaaaaaaatgggtcttcatcagcacaggactgcatgggctcctgccttctggtccagccttgggagctgtgagggtcatcctaattcagct

SEQ ID NO: 42996 - DNA, 426 bp, Homo sapiens
tggtgggcacctgtagtcccagctccttgggaggctgaggcaggagaatggcatgaacccaggaggcagagcttgcagtaagccgagatcgcgccactgcactccagcctaggcgagagagcgagactccgtctcaaaaaaaaaaaaaatgagctgagcgtggtggcatatgcctgtaatcccagctactctagaggccgaggcaggagaattgcttgagcccggaaggtggaggttacagtgagccaagattgtgccactgcactccagcctgggtgacaaagactctgtctcaaaaaaaaaaaaaatatatagtaagtgcaatggagaaaataattcacagaaagagctagagtgtcgaggtagaggtagcaattttaaatggagatgttagggaaatcctcactgagaaggtaacatttggtg

SEQ ID NO: 42997 - DNA, 496 bp, Homo sapiens
tactattaatattttcagttgcctctcagacatccgcagtttctcttagtaggaaaaaaaaaaaaaacccacgtgtcaaatgctccatcatttgacacagagcagtgtcctttgtcaaaaacccttccattgtacctctaaaacctgtcattctaacctttttgttgttcttattaacagttcatggacaggcacggtggctcaagcctgtaatcccagcactttgggaggctgaggcaggcaaatggcttgagcccagaagttttaagaccagcctgggtaacatggggaaatcccgactctacaaaaaaatacaaaaattagccaggcatggtgatgcacatctgtaattccaactactcaatttttttcatatatatatatatatatatatacacacacacacatatatatcatatgtatatgattttagtaactttgaaatcataaaaactaaagatgcctcagcaggaattaaatccatgttatttctcaa

SEQ ID NO: 42998 - DNA, 139 bp, Homo sapiens
tgaattacatttaatttacattttgatcctaaatattttcactgtaatatcaagttttgtttcctggtaccgtccccccagtagggttaaaaacttttaaaagtaatgtataatactgaggcaatgagagcagcagact

SEQ ID NO: 42999 - DNA, 340 bp, Homo sapiens
gagtaagaaacagatgagacagacagaaaccaaattgcaaaatccagctattcaagcaaatacattaagtatgaataatagctaaacactccaatcaaaaggtagagattgtcagactaatttaaaagaaaaaaaattgctatatggtatctacaagacacactttaaatacaaagacacaaaaaaagcctgaaattaaaaggatgaagatatattatggagacagtaaccataagaaagctgaaatggctgttttaagattagacaaagtagacttctctatgagtattactaaaaacacagcagaatgctttgttatgacgaaagggtcagttgtgtt

SEQ ID NO: 43000 - DNA, 494 bp, Homo sapiens
tgggcccagagacttctgcagacctcatcctcccatgtcgctaggactacctaaacatgccaccacatctggctaatttttaaattttctgtagaagatgtggtctcactatgttgcccaggctggtctcaaactccttgcctcaagcgatcctcctgccttccaaagtgcttggattacagacgtgaaccaccacacctggctgactgccttttggaatggcggcatccatagcagctatcctatgctgtcctccctatcgtaggttgcatgtggagagcagataaattgtatctttagctcgcaagtctttagattgagaagaagtagcctctggagctctgaaccactgtgtaagaagctgaggttgccctgcttgtgaggaaacagaaactaatcaggaagagagaccacaccaagagagagatgcctcacccatgcctgcatgcatcagcacaccgctgatcccacggcagccaccatcacactgcaac

SEQ ID NO: 43001 - DNA, 1358 bp, Homo sapiens
ggcaagggggttgcttaagcctaggaggttgaggctgcagtgagctatgatcaaaccactgcactctagcctgggcaaaagaccctgtcttataaaaacaaaacatttatacaaaatcttgcaaaataagtagagagagaaaaaacactgacctcactgtcatcccctatagcctgttagtatagctgtttgtagtcttttttctaaacaatgtattttcaaagaaaaaacagccaaaacaaaacaagccagacccaaacagagcaaaaacatggctttcatcccagcatgtacggctagaagaggtatctccagaccctctcaacctcatgtggtttgaaggcagagctacctctgcctttcccatgagtatgcccctgagtagttttctcaggttctcaggacgggctcttaactggcagaggaagactctaagacgcagcccatagcagctcctgtgagcccaccttccacctcgggctgcctaccaggcccttgagagcactctgttagcatagagaggcaacctcaaagcctttattcaggaacctggctcaggttcccagccactgggtattgagagagctttaaaaccacaaagtggagaatttgggaaatcaagttaaaggtgtgtgcacgtgcacactcgaatgcgtgtgctgaaagtcacctggcctgccctcctgaggcttaactcttgacaggttggtgcagaggccaaaagacatggcctgccgagccgctgctgccttagtggagcccctggaactctgaacagcccttcacagcacccatgggacaagtgcatgcgctttttcctttttctccctttccccctgaggttaaagatattttttttaccataaaagaaaaatgtacagagtgcataaaacaaaaaagagaagagaaaacactggaatagtacagaagatactaaagatgaaaaaatacaggtatcacttttgtagacgtgaatacttcatttctactatcctactgttaatggcctcttaattttcctctagaaattttctgtgcataggcaagcatgcatagcctacacatacacatgcaaagacagacctttaggaaacctgtaagtggggtcatgctggacatgtgttccctgcaccttccttttttctgttaatagtatgtctcagactttttttgtaacagctcacatagagagctgcctctcgtttggtggctgcatgatgtgtcatcgaatgggtatgctttggcttatctgcccagtctcctgttggtgagcattcagagtctttccattttggataatgcagtcagtgctgttaggagaatccttgtgcatgtaacctgccctgtggaaagtatcc

SEQ ID NO: 43002 - DNA, 207 bp, Homo sapiens
  misc_feature (15)..(15): n is a, c, g, or t
ggcagataagccaanagcataccattcgatgacacatcatgcagccaccaaacgagaggctgcatgatgtgtcatcgaatgggtatgctttggcttatctgcccagtctcctgttggtgagcattcagagtctttccattttggataatgcagtcagtgctgttaggagaatccttgtgcatgtaacctgccctgtggaaagtatcc

SEQ ID NO: 43003 - DNA, 1608 bp, Homo sapiens
cgcgcagaatcagttctgagcctcctcgcctcccggctctcccgcctgttgcgggtgtttatccggctgctgggcgacctttcccgggaaggaggctgtgccttcattcggtcacgccccggtctggggaggctcctccctggtgcgcagaaaccgcaggggcggggaggagccgggctctgcctgcgcccggggcagagcggggctggcaccgcgcaaggggccctgtttccggggagactgatttcggcctcctgacctcgggaccccttgactgtggagtgtcagacggaggaggacttagtgatcttgtccaaccccctccccgcttttcacaggttggggagatgggcgcctggagaatggaaatccagttatcaaaattgactccagaagagagaaactaacagaacaataacaatggaggaaattgagaacattatcaaaaagctatcatcctgccaaactccaggctcagattgtcttacaggttaaaaaaagttagtccttcatgaaaatgaaagaccttaagcaacacgatggattcagaagctcatgaaaagaggccaccaacactaacatcttcagaacaagatatatcacctcgtattacaaatgttggtgaaatgaagcattacttgtgtggctgctgcgcagccttcaacaacatcgcaatcacatatcccattcagacggtcctctttcgacaacagctgtatggcatcaaaacccgggatgcaatattttagttgagaagggatggatttcgaaacttgtatcctggaatccttcccccattgatgcagaagacagctacacttgcacttacgttcggtctctatgaggatttatcctgccttctccacaagcatgtcagtgctccagagtttgcaacctgttgcatggcggcagtgctcgcagggacaacagaagcaattttcactccaccggaaatagttcagacgttgattcaagaccacaagcatcatgacagatttaccaacacttatcaggccttcaaggcactgaaatgtcatggaattggagagtattatcgaggcttggtgcccattcttttccagaatggactcagtaatgtcttgttttgcgggctttgaggtcccattaaggagcatctgcctacagaaacgactcacagtgctcatttggtcaataattttatctgtggaggtccactgggtgccatgttgggattcttgtttttttccaattaatgtaaaaactcgcatacagtctcagattggtggggaatttcagtctttccccaaggttttccaaaaaatctggctggaacgggacagaaaactgataaatcttttcagaggtgcccatttgaattaccatcagtcccttatctcttagagcataatcaatgcaacttatgagtaaaggttatatgaaaaaaaccaacagtttagtgccatttatcaactgaatagaccttctaagaagaatgcagtttggcctctttcttagttggccaaatacaagttggtgtcataactccaggccacagtgagttatgggcaaagctgttttgcttaagcctcaataaaacagaataaaagattccaataggaaaataaa

SEQ ID NO: 43004 - DNA, 1361 bp, Homo sapiens
aaataaataaaatttaaaaacgcagaaggccactcccagagaggcctaggagtaccttggtcattttttcttgcctcaaatattataaacctccaacttgctcagaatcagggtgcttttattgtctgttttctggctctgaggcccttgccccaaatttaagtcagatacagactgaatttccattctgttctgtttataatatgaatgatattaatactcttgtttgcttaatgttatgttggaattttctgtttaatctgcagtagagcaagatggagagccatctggaattgacttccttctgtctttcttctgtgttcgcttactacttgggcccatgtgggaaaaaaactttaaaaggaaggaagtcttcttagggatccagttcaaagctatttgggggcatcaaactgaaactctcttctccactactcaagacttcgtgcctcagtccaagtaggtaagagcaaaagggaaatgcatctctacacaatggcccatggtcagggccaccagagcaagctgggcctagatctccacctgtcagtgactggccattctaagaggtgaaacagcagatcgttgaggctgtgagggaggatctttgaattcccatgagacatagcataagaagggtatcattaaagccctgggctctaaagttacagagcctggttttgagtcctggctccaccactgccaactgggtaaatttgagcaaatggtattctctttcttatctcagctcctgcgtttctaaaatgagggtctgcgttatgaatagttaggaggattaagtgagaggatgtataacccatgggttacttaaaagtatatttcctaccttccaaacatgagatttttctagttatagtttcttttctagcttgattgctttgtggtcagagaaaatgacccatatggtttccatccttcaaaatttgttgaaacttggttgttggcctagtatgagatcaatgttgtaaatgtgccatgtatgtttaaaaagactatatattctgaaaaaaaaaatggcttgctcttttactcaagaacacatcatagatttctgtcttttttttttgagatgcagtctcactctgtcacccagactggagtgcagtagcatgatctcggcttactgcaaccttcgcctcccagattcaagcaattctcctgtctcagccttctgagaagctgggactacaagtgcacgccaccacacccagctaatttttgtatttttttagtagagatggggtttcaccatattggtcaggctggtcgcaaactcctgacctcagatgatccacctgcctcggcctcccaaagggctgggattacaggcatgagccacc

SEQ ID NO: 43005 - DNA, 2548 bp, Homo sapiens
ccacgcgtccgcggacgcgtgggcgagaagtgcttccaagcgtccattttgagccttggaaactacgacgaccaaagggccacgggttcctgggtcgtttctcatttccgtcgagttaaacgtctggggctgcttctgaggaatcagcttggctggccagcaagttcagctccggcaagtcatttgattcacccggtgatgaaatgggggtcaaccagtctgtgggctttccacctgtcacaggaccccacctcgtaggctgtggggatgtgatggagggtcagaatctccaggggagcttctttcgactcttctacccctgccaaaaggcagaggagaccatggagcagcccctgtggattccccgctatgagtactgcactggcctggccgagtacctgcagtttaataagcgctgcgggggcttgctgttcaacctggcggtgggatcttgtcgcctgcctgttagctggaatggcccctttaagacaaaggactctggataccccttgatcatcttctcccatggcctaggagccttcaggactttgtattcagccttctgcatggagctggcctcacgtggctttgtggttgctgtgccagagcacagggaccggtcagcggcaaccacctatttctgcaagcaggccccagaagagaaccagcccaccaatgaatcgctgcaggaggaatggatccctttccgtcgagttgaggaaggggagaaggaatttcatgttcggaatccccaggtgcatcagcgggtaagcgagtgtttacgggtgttgaagatcctgcaagaggtcactgctgggcagactgtcttcaacatcttgcctggtggcttggatctgatgactttgaagggcaacattgacatgagccgtgtggctgtgatgggacattcatttggaggggccacagctattctggctttggccaaggagacccaatttcggtgtgcggtggctctggatgcttggatgtttcctctggaacgtgacttttaccccaaggcccgaggacctgtgttctttatcaatactgagaaattccagacaatggagagtgtcaatttgatgaagaagatatgtgcccagcatgaacagtctaggatcataaccgttcttggttctgttcatcggagtcaaactgactttgcttttgtgactggcaacttgattggtaaattcttctccactgaaacccgtgggagcctggacccctatgaagggcaggaggttatggtacgggccatgttggccttcctgcagaagcacctcgacctgaaagaagactataatcaatggaacaaccttattgaaggcattggaccgtcgctcaccccaggggccccccaccatctgtccagcctgtaggcacaactggccatttgtaaagtcacttcagccaagttttcatttgggagctacccaagggcacccatgagctcctatcaagaagtgatcaacgtgaccccttttcacagattgaaaggtgtaatcacactgctgcttggataactgggtactttgatcttagatttgatcttaaaatcactttgggactgggatcccttgctgattgacaaacagactttctgggaccttgatggagtggggaacaagcagtagagtgggactgggggagacccaggccccgggctgagcactgtgaggcctggatgtgaagactcagcccagcgaagctcattcccttacccccggccagtgctgctgcttcagtggaagagatgaagccaaaggacagaatgaaaatccctaccttcagagactctagcccagcccaacaccatctcttcctacctctcagccttctccctccccagggccacttgttgaagtctgagcactttatgtaaatttctaggtgtgagccgtgatcacattttctatttatttccaagtcttctcattgtatggaacatagtactacttatacttacagtagtaagttatacttgtgagcccacagagtggcagacagcatggctctcacagcacagggagaaaaactgaggtacacagaggtacctcagaagctctggatgtctttgggggttttgctaagtgtatcttgataggaaacaacaaaagcaggttgagatggggaagatgacagaacaacagtgttaaatggccatttgcacaggcctttgccacaacagagaagtagtttggtcagctaaaactcagctgcagcctggacagtagagcgagaccccatcttaaaaataaagaaggctgggcgtggtggctcatgcctgtaatcccaacactttgggaggccaaggcaggcagatcacttaaggccaggagttcaagaccacctggccaacatggtgaaaccccgtctctactaaaaatacaaaaaattagcctggcgtaatggcaggcgcctataatcccagctactcaggaggctgaagcagaagaatcacttgaacctaggaggcggaggttgcagtgagtcaagatcgcgccactgcactccagcctgggtgacagagcaagactctgtctta

SEQ ID NO: 43006 - DNA, 2467 bp, Homo sapiens
  misc_feature (1)..(1): n is a, c, g, or t
  misc_feature (4)..(4): n is a, c, g, or t
  misc_feature (10)..(10): n is a, c, g, or t
  misc_feature (12)..(13): n is a, c, g, or t
  misc_feature (15)..(15): n is a, c, g, or t
nganaacacntnncnggcaacaggaagccgagaggaaaccagcaagcggctgctgttctgtgttcccccatccagccagcaagttcagctccggcaagtcatttgattcacccggtgatgaaatgggggtcaaccagtctgtgggctttccacctgtcacaggaccccacctcgtaggctgtggggatgtgatggagggtcagaatctccaggggagcttctttcgactcttctacccctgccaaaaggcagaggagaccatggagcagcccctgtggattccccgctatgagtactgcactggcctggccgagtacctgcagtttaataagcgctgcgggggcttgctgttcaacctggcggtgggatcttgtcgcctgcctgttagctggaatggcccctttaagacaaaggactctggataccccttgatcatcttctcccatggcctaggagccttcaggactttgtattcagccttctgcatggagctggcctcacgtggctttgtggttgctgtgccagagcacagggaccggtcagcggcaaccacctatttctgcaagcaggccccagaagagaaccagcccaccaatgaatcgctgcaggaggaatggatccctttccgtcgagttgaggaaggggagaaggaatttcatgttcggaatccccaggtgcatcagcgggtaagcgagtgtttacgggtgttgaagatcctgcaagaggtcactgctgggcagactgtcttcaacatcttgcctggtggcttggatctgatgactttgaagggcaacattgacatgagccgtgtggctgtgatgggacattcatttggaggggccacagctattctggctttggccaaggagacccaatttcggtgtgcggtggctctggatgcttggatgtttcctctggaacgtgacttttaccccaaggcccgaggacctgtgttctttatcaatactgagaaattccagacaatggagagtgtcaatttgatgaagaagatatgtgcccagcatgaacagtctaggatcataaccgttcttggttctgttcatcggagtcaaactgactttgcttttgtgactggcaacttgattggtaaattcttctccactgaaacccgtgggagcctggacccctatgaagggcaggaggttatggtacgggccatgttggccttcctgcagaagcacctcgacctgaaagaagactataatcaatggaacaaccttattgaaggcattggaccgtcgctcaccccaggggccccccaccatctgtccagcctgtaggcacaactggccatttgtaaagtcacttcagccaagttttcatttgggagctacccaagggcacccatgagctcctatcaagaagtgatcaacgtgaccccttttcacagattgaaaggtgtaatcacactgctgcttggataactgggtactttgatcttagatttgatcttaaaatcactttgggactgggatcccttgctgattgacaaacagactttctgggaccttgatggagtggggaacaagcagtagagtgggactgggggagacccaggccccgggctgagcactgtgaggcctggatgtgaagactcagcccagcgaagctcattcccttacccccggccagtgctgctgcttcagtggaagagatgaagccaaaggacagaatgaaaatccctaccttcagagactctagcccagcccaacaccatctcttcctacctctcagccttctccctccccagggccacttgttgaagtctgagcactttatgtaaatttctaggtgtgagccgtgatcacattttctatttatttccaagtcttctcattgtatggaacatagtactacttatacttacagtagtaagttatacttgtgagcccacagagtggcagacagcatggctctcacagcacagggagaaaaactgaggtacacagaggtacctcagaagctctggatgtctttgggggttttgctaagtgtatcttgataggaaacaacaaaagcaggttgagatggggaagatgacagaacaacagtgttaaatggccatttgcacaggcctttgccacaacagagaagtagtttggtcagctaaaactcagctgcagcctggacagtagagcgagaccccatcttaaaaataaagaaggctgggcgtggtggctcatgcctgtaatcccaacactttgggaggccaaggcaggcagatcacttaaggccaggagttcaagaccacctggccaacatggtgaaaccccgtctctactaaaaatacaaaaaattagcctggcgtaatggcaggcgcctataatcccagctactcaggaggctgaagcagaagaatcacttgaacctaggaggcggaggttgcagtgagtcaagatcgcgccactgcactccagcctgggtgacagagcaagactctgtctta

SEQ ID NO: 43007 - DNA, 678 bp, Homo sapiens
gggcaggatcaggccggggtgaatcggccgaggtgatcacattttctatttatttccaagtcttctcattgtatggaacatagtactacttatacttacagtagtaagttatacttgtgagcccacagagtggcagacagcatggctctcacagcacagggagaaaaactgaggtacacagaggtacctcagaagctctggatgtctttgggggttttgctaagtgtatcttgataggaaacaacaaaagcaggttgagatggggaagatgacagaacaacagtgttaaatggccatttgcacaggcctttgccacaacagagaagtagtttggtcagctaaaactcagctgcagcctggacagtagagcgagaccccatcttaaaaataaagaaggctgggcgtggtggctcatgcctgtaatcccaacactttgggaggccaaggcaggcagatcacttaaggccaggagttcaagaccacctggccaacatggtgaaaccccgtctctactaaaaatacaaaaaattagcctggcgtaatggcaggcgcctataatcccagctactcaggaggctgaagcagaagaatcacttgaacctaggaggcggaggttgcagtgagtcaagatcgcgccactgcactccagcctgggtgacagagcaagactctgtctta

SEQ ID NO: 43008 - DNA, 2900 bp, Homo sapiens
ggcacgagcttctgaggaatcagcttgactggccagcaagttcagctccggcaagtcatttgattcacccggtgatgaaatgggggtcaaccagtctgtgggctttccacctgtcacaggaccccacctcgtaggctgtggggatgtgatggagggtcagaatctccaggggagcttctttcgactcttctacccctgccaaaaggcagaggagaccatggagcagcccctgtggattccccgctatgagtactgcactggcctggccgagtacctgcagtttaataagcgctgcgggggcttgctgttcaacctggcggtgggatcttgtcgcctgcctgttagctggaatggcccctttaagacaaaggactctggataccccttgatcatcttctcccatggcctaggagccttcaggactttgtattcagccttctgcatggagctggcctcacgtggctttgtggttgctgtgccagagcacagggaccggtcagcggcaaccacctatttctgcaagcaggccccagaagagaaccagcccaccaatgaatcgctgcaggaggaatggatccctttccgtcgagttgaggaaggggagaaggaatttcatgttcggaatccccaggtgcatcagcgggtaagcgagtgtttacgggtgttgaagatcctgcaagaggtcactgctgggcagactgtcttcaacatcttgcctggtggcttggatctgatgactttgaagggcaacattgacatgagccgtgtggctgtgatgggacattcatttggaggggccacagctattctggctttggccaaggagacccaatttcggtgtgcggtggctctggatgcttggatgtttcctctggaacgtgacttttaccccaaggcccgaggacctgtgttctttatcaatactgagaaattccagacaatggagagtgtcaatttgatgaagaagatatgtgcccagcatgaacagtctaggatcataaccgttcttggttctgttcatcggagtcaaactgactttgcttttgtgactggcaacttgattggtaaattcttctccactgaaacccgtgggagcctggacccctatgaagggcaggaggttatggtacgggccatgttggccttcctgcagaagcacctcgacctgaaagaagactataatcaatggaacaaccttattgaaggcattggaccgtcgctcaccccaggggccccccaccatctgtccagcctgtaggcacaactggccatttgtaaagtcacttcagccaagttttcatttgggagctacccaagggcacccatgagctcctatcaagaagtgatcaacgtgaccccttttcacagattgaaaggtgtaatcacactgctgcttggataactgggtactttgatcttagatttgatcttaaaatcactttgggactgggatcccttgctgattgacaaacagactttctgggaccttgatggagtggggaacaagcagtagagtgggactgggggagacccaggccccgggctgagcactgtgaggcctggatgtgaagactcagcccagcgaagctcattcccttacccccggccagtgctgctgcttcagtggaagagatgaagccaaaggacagaatgaaaatccctaccttcagagactctagcccagcccaacaccatctcttcctacctctcagccttctccctccccagggccacttgttgaagtctgagcactttatgtaaatttctaggtgtgagccgtgatcacattttctatttatttccaagtcttctcattgtatggaacatagtactacttatacttacagtagtaagttatacttgtgagcccacagagtggcagacagcatggctctcacagcacagggagaaaaactgaggtacacagaggtacctcagaagctctggatgtctttgggggttttgctaagtgtatcttgataggaaacaacaaaagcaggttgagatggggaagatgacagaacaacagtgttaaatggccatttgcacaggcctttgccacaacagagaagtagtttggtcagctaaaactcagctgcagcctggacagtagagcgagaccccatcttaaaaataaagaaggctgggcgtggtggctcatgcctgtaatcccaacactttgggaggccaaggcaggcagatcattacagagcctggttttgagtcctggctccaccactgccaactgggtaaatttgagcaaatggtattctctttcttatctcagctcctgcgtttctaaaatgagggtctgcgttatgaatagttaggaggattaagtgagaggatgtataacccatgggttacttaaaagtatatttcctaccttccaaacatgagatttttctagttatagtttcttttctagcttgattgctttgtggtcagagaaaatgacccatatggtttccatccttcaaaatttgttgaaacttggttgttggcctagtatgagatcaatgttgtaaatgtgccatgtatgtttaaaaagactatatattctgaaaaaaaaaatggcttgctcttttactcaagaacacatcatagatttctgtcttttttttttgagatgcagtctcactctgtcacccagactggagtgcagtagcatgatctcggcttactgcaaccttcgcctcccagattcaagcaattctcctgtctcagccttctgagaagctgggactacaagtgcacgccaccacacccagctaatttttgtatttttttagtagagatggggtttcaccatattggtcaggctggtcgcaaactcctgacctcagatgatccacctgcctcggcctcccaaagggctgggattacaggcatgagccacc

SEQ ID NO: 43009 - DNA, 2493 bp, Homo sapiens
ggcacgagcttctgaggaatcagcttgactggccagcaagttcagctccggcaagtcatttgattcacccggtgatgaaatgggggtcaaccagtctgtgggctttccacctgtcacaggaccccacctcgtaggctgtggggatgtgatggagggtcagaatctccaggggagcttctttcgactcttctacccctgccaaaaggcagaggagaccatggagcagcccctgtggattccccgctatgagtactgcactggcctggccgagtacctgcagtttaataagcgctgcgggggcttgctgttcaacctggcggtgggatcttgtcgcctgcctgttagctggaatggcccctttaagacaaaggactctggataccccttgatcatcttctcccatggcctaggagccttcaggactttgtattcagccttctgcatggagctggcctcacgtggctttgtggttgctgtgccagagcacagggaccggtcagcggcaaccacctatttctgcaagcaggccccagaagagaaccagcccaccaatgaatcgctgcaggaggaatggatccctttccgtcgagttgaggaaggggagaaggaatttcatgttcggaatccccaggtgcatcagcgggtaagcgagtgtttacgggtgttgaagatcctgcaagaggtcactgctgggcagactgtcttcaacatcttgcctggtggcttggatctgatgactttgaagggcaacattgacatgagccgtgtggctgtgatgggacattcatttggaggggccacagctattctggctttggccaaggagacccaatttcggtgtgcggtggctctggatgcttggatgtttcctctggaacgtgacttttaccccaaggcccgaggacctgtgttctttatcaatactgagaaattccagacaatggagagtgtcaatttgatgaagaagatatgtgcccagcatgaacagtctaggatcataaccgttcttggttctgttcatcggagtcaaactgactttgcttttgtgactggcaacttgattggtaaattcttctccactgaaacccgtgggagcctggacccctatgaagggcaggaggttatggtacgggccatgttggccttcctgcagaagcacctcgacctgaaagaagactataatcaatggaacaaccttattgaaggcattggaccgtcgctcaccccaggggccccccaccatctgtccagcctgtaggcacaactggccatttgtaaagtcacttcagccaagttttcatttgggagctacccaagggcacccatgagctcctatcaagaagtgatcaacgtgaccccttttcacagattgaaaggtgtaatcacactgctgcttggataactgggtactttgatcttagatttgatcttaaaatcactttgggactgggatcccttgctgattgacaaacagactttctgggaccttgatggagtggggaacaagcagtagagtgggactgggggagacccaggccccgggctgagcactgtgaggcctggatgtgaagactcagcccagcgaagctcattcccttacccccggccagtgctgctgcttcagtggaagagatgaagccaaaggacagaatgaaaatccctaccttcagagactctagcccagcccaacaccatctcttcctacctctcagccttctccctccccagggccacttgttgaagtctgagcactttatgtaaatttctaggtgtgagccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaagaaacaaaagaagaaaagagcgaagagagacacaaggagcgacgacgactaagaagaccggcggaaagaacgacaacacagggccaacgagagaagacatcaggagaagagaaacagacaaaaggaggacgtgagaaacacaagcgaacgaagggaacgccgcgaagacgaaggaggcaggaagtgagagaccacgagagatgacagtgacagcagaagtggagagaaagaagagcgaacagagagagaaagcgaacgagacgaaagaagacaagcgacaaggagcgcaagaaaaagaagaagaaggagatagaggaaagaggtgtcagtgacgcgacagacgagacgagagggtaccatgacggagagggaagaagagtgagcagaagaaagcaaggagagagaaggagacagggagggaagaggaaaaagagaaaggagagggaaggagacagaacaagcaaggaaacgaaagaaggaaaggagaagacaagaaagagagagaaagagagagacagcgaaggagagagcgaagggaaagcagaaaggaagaagcgaagagaagacagagagaagaaaaaaagaacacgagcggaaa

SEQ ID NO: 43010 - DNA, 2696 bp, Homo sapiens
  misc_feature (1)..(1): n is a, c, g, or t
  misc_feature (4)..(4): n is a, c, g, or t
  misc_feature (10)..(10): n is a, c, g, or t
  misc_feature (12)..(13): n is a, c, g, or t
  misc_feature (15)..(15): n is a, c, g, or t
nganaacacntnncnggcaacaggaagccgagaggaaaccagcaagcggctgctgttctgtgttcccccatccagccagcaagttcagctccggcaagtcatttgattcacccggtgatgaaatgggggtcaaccagtctgtgggctttccacctgtcacaggaccccacctcgtaggctgtggggatgtgatggagggtcagaatctccaggggagcttctttcgactcttctacccctgccaaaaggcagaggagaccatggagcagcccctgtggattccccgctatgagtactgcactggcctggccgagtacctgcagtttaataagcgctgcgggggcttgctgttcaacctggcggtgggatcttgtcgcctgcctgttagctggaatggcccctttaagacaaaggactctggataccccttgatcatcttctcccatggcctaggagccttcaggactttgtattcagccttctgcatggagctggcctcacgtggctttgtggttgctgtgccagagcacagggaccggtcagcggcaaccacctatttctgcaagcaggccccagaagagaaccagcccaccaatgaatcgctgcaggaggaatggatccctttccgtcgagttgaggaaggggagaaggaatttcatgttcggaatccccaggtgcatcagcgggtaagcgagtgtttacgggtgttgaagatcctgcaagaggtcactgctgggcagactgtcttcaacatcttgcctggtggcttggatctgatgactttgaaggtgtgcggtggctctggatgcttggatgtttcctctggaacgtgacttttaccccaaggcccgaggacctgtgttctttatcaatactgagaaattccagacaatggagagtgtcaatttgatgaagaagatatgtgcccagcatgaacagtctaggatcataaccgttctacctgaaagaagactataatcaatggaacaaccttattgaaggcattggaccgtcgctcaccccaggggccccccaccatctgtccagcctgtaggcacaactggccatttgtaaagtcacttcagccaagttttcatttgggagctacccaagggcacccatgagctcctatcaagaagtgatcaacgtgaccccttttcacagattgaaaggtgtaatcacactgctgcttggataactgggtactttgatcttagatttgatcttaaaatcactttgggactgggatcccttgctgattgacaaacagactttctgggaccttgatggagtggggaacaagcagtagagtgggactgggggagacccaggccccgggctgagcactgtgaggcctggatgtgaagactcagcccagcgaagctcattcccttacccccggccagtgctgctgcttcagtggaagagatgaagccaaaggacagaatgaaaatccctaccttcagagactctagcccagcccaacaccatctcttcctacctctcagccttctccctccccagggccacttgttgaagtctgagcactttatgtaaatttctaggtgtgagccgtgatcacattttctatttatttccaagtcttctcattgtatggaacatagtactacttatacttacagtagtaagttatacttgtgagcccacagagtggcagacagcatggctctcacagcacagggagaaaaactgaggtacacagaggtacctcagaagctctggatgtctttgggggttttgctaagtgtatcttgataggaaacaacaaaagcaggttgagatggggaagatgacagaacaacagtgttaaatggccatttgcacaggcctttgccacaacagagaagtagtttggtcagctaaaactcagctgcagcctggacagtagagcgagaccccatcttaaaaataaagaaggctgggcgtggtggctcatgcctgtaatcccaacactttgggaggccaaggcaggcagatcattacagagcctggttttgagtcctggctccaccactgccaactgggtaaatttgagcaaatggtattctctttcttatctcagctcctgcgtttctaaaatgagggtctgcgttatgaatagttaggaggattaagtgagaggatgtataacccatgggttacttaaaagtatatttcctaccttccaaacatgagatttttctagttatagtttcttttctagcttgattgctttgtggtcagagaaaatgacccatatggtttccatccttcaaaatttgttgaaacttggttgttggcctagtatgagatcaatgttgtaaatgtgccatgtatgtttaaaaagactatatattctgaaaaaaaaaatggcttgctcttttactcaagaacacatcatagatttctgtcttttttttttgagatgcagtctcactctgtcacccagactggagtgcagtagcatgatctcggcttactgcaaccttcgcctcccagattcaagcaattctcctgtctcagccttctgagaagctgggactacaagtgcacgccaccacacccagctaatttttgtatttttttagtagagatggggtttcaccatattggtcaggctggtcgcaaactcctgacctcagatgatccacctgcctcggcctcccaaagggctgggattacaggcatgagccacc

SEQ ID NO: 43011 - DNA, 2242 bp, Homo sapiens
tgatgaatgactttctattttttctgatgagtgatagataatacaatctaaagtgactttagcaatgtgcttgacttttacttctctctctcaggggatggactatttgggttctcggcaatacgttcaccgggacttggcagcaagaaatgtccttgttgagagtgaacaccaagtgagtgtgcggtggctctggatgcttggatgtttcctctggaacgtgacttttaccccaaggcccgaggacctgtgttctttatcaatactgagaaattccagacaatggagagtgtcaatttgatgaagaagatatgtgcccagcatgaacagtctaggatcataaccgttcttggttctgttcatcggagtcaaactgactttgcttttgtgactggcaacttgattggtaaattcttctccactgaaacccgtgggagcctggacccctatgaagggcaggaggttatggtacgggccatgttggccttcctgcagaagcacctcgacctgaaagaagactataatcaatggaacaaccttattgaaggcattggaccgtcgctcaccccaggggccccccaccatctgtccagcctgtaggcacaactggccatttgtaaagtcacttcagccaagttttcatttgggagctacccaagggcacccatgagctcctatcaagaagtgatcaacgtgaccccttttcacagattgaaaggtgtaatcacactgctgcttggataactgggtactttgatcttagatttgatcttaaaatcactttgggactgggatcccttgctgattgacaaacagactttctgggaccttgatggagtggggaacaagcagtagagtgggactgggggagacccaggccccgggctgagcactgtgaggcctggatgtgaagactcagcccagcgaagctcattcccttacccccggccagtgctgctgcttcagtggaagagatgaagccaaaggacagaatgaaaatccctaccttcagagactctagcccagcccaacaccatctcttcctacctctcagccttctccctccccagggccacttgttgaagtctgagcactttatgtaaatttctaggtgtgagccgtgatcacattttctatttatttccaagtcttctcattgtatggaacatagtactacttatacttacagtagtaagttatacttgtgagcccacagagtggcagacagcatggctctcacagcacagggagaaaaactgaggtacacagaggtacctcagaagctctggatgtctttgggggttttgctaagtgtatcttgataggaaacaacaaaagcaggttgagatggggaagatgacagaacaacagtgttaaatggccatttgcacaggcctttgccacaacagagaagtagtttggtcagctaaaactcagctgcagcctggacagtagagcgagaccccatcttaaaaataaagaaggctgggcgtggtggctcatgcctgtaatcccaacactttgggaggccaaggcaggcagatcattacagagcctggttttgagtcctggctccaccactgccaactgggtaaatttgagcaaatggtattctctttcttatctcagctcctgcgtttctaaaatgagggtctgcgttatgaatagttaggaggattaagtgagaggatgtataacccatgggttacttaaaagtatatttcctaccttccaaacatgagatttttctagttatagtttcttttctagcttgattgctttgtggtcagagaaaatgacccatatggtttccatccttcaaaatttgttgaaacttggttgttggcctagtatgagatcaatgttgtaaatgtgccatgtatgtttaaaaagactatatattctgaaaaaaaaaatggcttgctcttttactcaagaacacatcatagatttctgtcttttttttttgagatgcagtctcactctgtcacccagactggagtgcagtagcatgatctcggcttactgcaaccttcgcctcccagattcaagcaattctcctgtctcagccttctgagaagctgggactacaagtgcacgccaccacacccagctaatttttgtatttttttagtagagatggggtttcaccatattggtcaggctggtcgcaaactcctgacctcagatgatccacctgcctcggcctcccaaagggctgggattacaggcatgagccacc

SEQ ID NO: 43012 - DNA, 1061 bp, Homo sapiens
agtagtggctttaaaaagactggatctcgaaaagatgtcacaagaacgcttccgaaacagacgttagagcttccaggggggagtatggttcaaagctatttgggggcatcaaactgaaactctcttctccactactcaagacttcgtgcctcagtccaagtaggtaagagcaaaagggaaatgcatctctacacaatggcccatggtcagggccaccagagcaagctgggcctagatctccacctgtcagtgactggccattctaagaggtgaaacagcagatcgttgaggctgtgagggaggatctttgaattcccatgagacatagcataagaagggtatcattaaagccctgggctctaaagttacagagcctggttttgagtcctggctccaccactgccaactgggtaaatttgagcaaatggtattctctttcttatctcagctcctgcgtttctaaaatgagggtctgcgttatgaatagttaggaggattaagtgagaggatgtataacccatgggttacttaaaagtatatttcctaccttccaaacatgagatttttctagttatagtttcttttctagcttgattgctttgtggtcagagaaaatgacccatatggtttccatccttcaaaatttgttgaaacttggttgttggcctagtatgagatcaatgttgtaaatgtgccatgtatgtttaaaaagactatatattctgaaaaaaaaaatggcttgctcttttactcaagaacacatcatagatttctgtcttttttttttgagatgcagtctcactctgtcacccagactggagtgcagtagcatgatctcggcttactgcaaccttcgcctcccagattcaagcaattctcctgtctcagccttctgagaagctgggactacaagtgcacgccaccacacccagctaatttttgtatttttttagtagagatggggtttcaccatattggtcaggctggtcgcaaactcctgacctcagatgatccacctgcctcggcctcccaaagggctgggattacaggcatgagccacc

SEQ ID NO: 43013 - DNA, 1837 bp, Homo sapiens
ctacctcgcgggtgccttctacctcgcgggtgcctggacccctatgaagggcaggaggttatggtacgggccatgttggccttcctgcagaagcacctcgacctgaaagaagactataatcaatggaacaaccttattgaaggcattggaccgtcgctcaccccaggggccccccaccatctgtccagcctgtaggcacaactggccatttgtaaagtcacttcagccaagttttcatttgggagctacccaagggcacccatgagctcctatcaagaagtgatcaacgtgaccccttttcacagattgaaaggtgtaatcacactgctgcttggataactgggtactttgatcttagatttgatcttaaaatcactttgggactgggatcccttgctgattgacaaacagactttctgggaccttgatggagtggggaacaagcagtagagtgggactgggggagacccaggccccgggctgagcactgtgaggcctggatgtgaagactcagcccagcgaagctcattcccttacccccggccagtgctgctgcttcagtggaagagatgaagccaaaggacagaatgaaaatccctaccttcagagactctagcccagcccaacaccatctcttcctacctctcagccttctccctccccagggccacttgttgaagtctgagcactttatgtaaatttctaggtgtgagccgtgatcacattttctatttatttccaagtcttctcattgtatggaacatagtactacttatacttacagtagtaagttatacttgtgagcccacagagtggcagacagcatggctctcacagcacagggagaaaaactgaggtacacagaggtacctcagaagctctggatgtctttgggggttttgctaagtgtatcttgataggaaacaacaaaagcaggttgagatggggaagatgacagaacaacagtgttaaatggccatttgcacaggcctttgccacaacagagaagtagtttggtcagctaaaactcagctgcagcctggacagtagagcgagaccccatcttaaaaataaagaaggctgggcgtggtggctcatgcctgtaatcccaacactttgggaggccaaggcaggcagatcattacagagcctggttttgagtcctggctccaccactgccaactgggtaaatttgagcaaatggtattctctttcttatctcagctcctgcgtttctaaaatgagggtctgcgttatgaatagttaggaggattaagtgagaggatgtataacccatgggttacttaaaagtatatttcctaccttccaaacatgagatttttctagttatagtttcttttctagcttgattgctttgtggtcagagaaaatgacccatatggtttccatccttcaaaatttgttgaaacttggttgttggcctagtatgagatcaatgttgtaaatgtgccatgtatgtttaaaaagactatatattctgaaaaaaaaaatggcttgctcttttactcaagaacacatcatagatttctgtcttttttttttgagatgcagtctcactctgtcacccagactggagtgcagtagcatgatctcggcttactgcaaccttcgcctcccagattcaagcaattctcctgtctcagccttctgagaagctgggactacaagtgcacgccaccacacccagctaatttttgtatttttttagtagagatggggtttcaccatattggtcaggctggtcgcaaactcctgacctcagatgatccacctgcctcggcctcccaaagggctgggattacaggcatgagccacc

SEQ ID NO: 43014 - DNA, 274 bp, Homo sapiens
acctgatctccctgtatcaattggaaattgggcaagttgtatttaacagaaaactcccaaataatagtgacttaaatatggtaatgtttatttctctctcaagtgaaaggaagccagaggtagacagttaaggttgatgtggtaattccacaagatggctgctagcagagcattgttggaatgagggtgaaggctgggctgttcttttgatcccttttccttgttcctttttgaatctccaggactttgtattcagccttctgcatggagctgg

SEQ ID NO: 43015 - DNA, 239 bp, Homo sapiens
gctgtgttcactcgagttgcctccacccctcccccaggagatggagccctggtagcaggaatccccattctcagacctcagatgccctctgcacctgggcactgagagcacagtcaaacagggctaagcagcttgtgccgcctggctttccccgggaacacctggcccactgtgtgccctagccctggacctgtctccgagtacatagacgtttcctgtgtgcctcctgccagggagta

SEQ ID NO: 43016 - DNA, 483 bp, Homo sapiens
gcaataggccacaccatatagcataggtgtgtagtaggctataccatgtaggttgggtaagtacactttgatgctcagaaaatggtgaaatcacctaaggatgcatttctcagaatgtatccttgttaagtgacacatgagtgtgcttatgtgtgtaaggtcaataaaaaatgtcacaggggctttatcaaaggcagcattattttatatggactatgggtcctattgaatatttttgtcctcttccttgcccaccacccacccccataaacattacccacattgcagccagggcaaacatttagaaattgaaatctgatttatgatcccttgttaagacatcccaataaaaggcttttcaggctgggattggtggctcatgcctgtaatcccagcactttgggagaatgaagcaggtgaattgcttgagcccagaagtttgagaccagcctgagcaacaaattgagacccccatcgctacca

SEQ ID NO: 43017 - DNA, 436 bp, Homo sapiens
catatgcatttgtacaggctgtttattctccctggaaagtacacagcccccgatacagctcgccctgcattttacccatcattgtaatgcgttcttagaagatacagtggaagttcactggtgtgacattattcatgaaccctgtcacctccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtga

SEQ ID NO: 43018 - DNA, 575 bp, Homo sapiens
tggctgacacaatacctttttaaaaaataaaatagtgggatcttctggctatacttagtatttttatattccttgcatctgagtgagattaaatagtaatgccttaaggtaaggagtgatgtttcaacttttgctgtttctccttcaccagcctgggagctcccatcgaccatggcagtcctactttgacttgatcttggtggatgcacggaaaccactcttttttggagaaggcacagtactgcgtcaggtggatactaaaactggcaagctgaaaattggtacctacacagggcccctacagcatggtatcgtctactcaggaggtaagtcacagacttccctttatttaatgtctttgctcagacctcacagtgaaagctttggtaatctctcagcaaagtgccacatatactgtttagtagtctaagatgtcatctactgaaggtaaatagtttagtcacctcttaatgcaataggagtctgggtttgagcagttgttagtatatcctaatgaatctgattttcactaaaatgatcagttttttttttaaatcctattggaggctttttct

SEQ ID NO: 43019 - DNA, 526 bp, Homo sapiens
taattagccgtatctctcttttgaaattaagagttttggtcttaactgaaacagtcaaacaaacccactaattgaaaagagtaagtgccattcatttggctgtctggccaagtagcactggtggtggggggtgggatgggagggttgtggggtgaggggaggattgtgataggatgataaagtattacaaaatccatattcttcatacagaaaactggcaagctgaaaattggtacctacacagggcccctacagcatggtatcgtctactcaggaggtaagtcacagacttccctttatttaatgtctttgctcagacctcacagtgaaagctttggtaatctctcagcaaagtgccacatatactgtttagtagtctaagatgtcatctactgaaggtaaatagtttagtcacctcttaatgcaataggagtctgggtttgagcagttgttagtatatcctaatgaatctgattttcactaaaatgatcagttttttttttaaatcctattggaggctttttct

SEQ ID NO: 43020 - DNA, 613 bp, Homo sapiens
tgcggtggctcacgtctgtaatcccagcactttgggaggccaaggtgggcagatcacctgaggtcaagagtttgagaccagcctggccaacatggtgaaaccccatctctactaaaaatacaaaaattagctgagtgtggtggcacatgcctgtaatcccagctaattagggtggctgaggcaggagaatcgcttgaagctgggaggcagaggttgcagtgagccgcgatcacacccctgcactccagcctgagtgacagaatgagactgtcttaaagaataaaaaaaagctcttcccagagattttcactgagtttttcttttatctttaggcatcttgacagcagtagcaatgagcgtccagacatcagttccatccagagacgtattaagaaagtaactcatgacatggacatgtgctatgggatgatgggaagcctgtttcgcagtggctcccggcagaccctttttgccagtcaagtgatgcgttatgctgacctctatgcagcatctttcatcaacctgctgtattaccctttcagctacctcttcagggctgcccatgtcttgctcctgatccctcatgacatcaatcgttggaacacacacatcc

SEQ ID NO: 43021 - DNA, 4004 bp, Homo sapiens
gggcgcaggcagaatgccaagggatggagaccctcagaagggcaaagccggtgttccatcgtttgaagatctccagacccgcgggacagacagacgcagcgcggtcagggagcgtcggcttcgccgaactctgcggcggagctgggggacggaacagcgcgccggtccctggccgggcgcgagcagaggggcggcgcggggcggtgccgggcggcgggggcggggagggcgcgcgttgaggcggctgcggcagttgcgcgctgggattgttgcggtgcgctggagccgaatacaaaatacagttaaaataaaatgtcaacctcctggagtgatcggttacagaatgcagcagatatgcctgctaacatggataagcatgccctgaaaaagtatcgtcgagaagcctatcatcgggtgtttgtgaaccgaagtttagcaatggaaaagataaagtgttttggttttgatatggattatacccttgctgtgtacaagtccccagagtatgagtcccttggttttgagcttactgtggagagattagtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggaccagaaactagagaacagtatccaaataaatttatccagcgagatgatactgaaagattttacattctgaacacactattcaacctaccagagacctacctgttggcctgcctagtagatttttttactaattgtcccagatataccagttgtgaaacaggatttaaagatggggacctcttcatgtcctaccggagtatgttccaggatgtaagagatgctgttgactgggttcattacaagggctcccttaaggaaaagacagttgaaaatcttgagaagtatgtagtcaaagatggaaaactgcctttgcttctgagccggatgaaggaagtagggaaagtatttcttgctaccaacagtgactataaatatacagataaaattatgacttacctgtttgacttcccacatggccccaagcctgggagctcccatcgaccatggcagtcctactttgacttgatcttggtggatgcacggaaaccactcttttttggagaaggcacagtactgcgtcaggtggatactaaaactggcaagctgaaaattggtacctacacagggcccctacagcatggtatcgtctactcaggaggttcttctgatacgatctgtgacctgttgggagccaagggaaaagacattttgtatattggagatcacatttttggggacattttaaaatcaaagaaacggcaagggtggcgaacttttttggtgattcctgaactcgcacaggagctacatgtctggactgacaagagttcacttttcgaagaacttcagagcttggatattttcttggctgaactctacaagcatcttgacagcagtagcaatgagcgtccagacatcagttccatccagagacgtattaagaaagtaactcatgacatggacatgtgctatgggatgatgggaagcctgtttcgcagtggctcccggcagaccctttttgccagtcaagtgatgcgttatgctgacctctatgcagcatctttcatcaacctgctgtattaccctttcagctacctcttcagggctgcccatgtcttgatgcctcatgaatcaacggtggagcacacacacgtagatatcaatgagatggagtctcctcttgccacccggaaccgcacatcagtggatttcaaagacactgactacaagcggcaccagctgacacggtcaattagtgagattaaacctcccaacctcttcccactggccccccaggaaattacacactgccatgacgaagatgatgatgaagaggaggaggaggaggaagaataaggaggaaaaccaaaaccccaagcacccattaaacaagtcctggcaggactcacaggaacaaacgaggtccctgttagggttctactcgggggagggagggggctccatgaaaggtacgtctgaaaagtttctgaagattttattatcatagatacttgttttggttttgtgtatctgtactctctgcagatggtccaaaattgtaatggagtctgtattagaagaaaataagggtaaaatcaggctgaactgcatgtatatggctccactgtggcttgtgacacttttaaaatcatccgtatgtcagtgtatctggatacacgaggaaaaggaaagagtctcagagtggaacaaagagtgggaagaggtgatctgtaatgttacaaattgtgctattactccaaggtccaacttttccagtgcattacatggtattgtatatcagtggagaaatgtattatttccatgatcaaatgtagtctctgttaaggtcaagttttcttttataagcctttaattcatcctcagtgactctggcaaggctgcttctctatcactggctttgcacagaagtatgctctacttgcgttgctttagggcaggattctattttgagggaaaagacagtatccttattaccttttgtttgtttaatagcacaaatgcttatttgttatccaaaaacaacctccttcttatctgtgataaatctatagaaagaatttagctgcaagtggacaaaggaacaagcccccagaaaagaaagggaagaactgccttcttatactacagaacatgcattagtgtgggctatatagctgtggctcatgctacccaattccagatttctttgtcctctaagagttgattgctgtatattaaaattgaacatcagaggatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtgactttgacctattctgtagtacaactgtaatagctattggtcttcaagtgggtttagatttggtgacatcagtttgatattctcttaaaggaaataaatattcaagaactgattataaaaacaacaaaacaacaaaacaaaaaaaaaaaaaaaaaaaaaaaaagggggggggaaaaaaaaattccggggggggacaaatatacgcagcaccacaggttctttgaaaacacaaggcggccacccaataggaggagcgtattaaaaacagaaagacggagcgcgacattaaaacaacgaccgcagcagggaaactcttcgatgcgccatccggggagaagaccacaacctggggggggacacataggggccaccccacaagaacatacaccgcataggaccaaacaacaccgacgtatacggcgaagcaccgcacagcgctgcgggaacatccgtagcgataggtaaaattagggcgaaacaaagg

SEQ ID NO: 43022 - DNA, 4312 bp, Homo sapiens
gggcgcaggcagaatgccaagggatggagaccctcagaagggcaaagccggtgttccatcgtttgaagatctccagacccgcgggacagacagacgcagcgcggtcagggagcgtcggcttcgccgaactctgcggcggagctgggggacggaacagcgcgccggtccctggccgggcgcgagcagaggggcggcgcggggcggtgccgggcggcgggggcggggagggcgcgcgttgaggcggctgcggcagttgcgcgctgggattgttgcggtgcgctggagccgaatacaaaatacagttaaaataaaatgtcaacctcctggagtgatcggttacagaatgcagcagatatgcctgctaacatggataagcatgccctgaaaaagtatcgtcgagaagcctatcatcgggtgtttgtgaaccgaagtttagcaatggaaaagataaagtgttttggttttgatatggattatacccttgctgtgtacaagtccccagagtatgagtcccttggttttgagcttactgtggagagattagtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggaccagaaactagagaacagtatccaaataaatttatccagcgagatgatactgaaagattttacattctgaacacactattcaacctaccagagacctacctgttggcctgcctagtagatttttttactaattgtcccagatataccagttgtgaaacaggatttaaagatggggacctcttcatgtcctaccggagtatgttccaggatgtaagagatgctgttgactgggttcattacaagggctcccttaaggaaaagacagttgaaaatcttgagaagtatgtagtcaaagatggaaaactgcctttgcttctgagccggatgaaggaagtagggaaagtatttcttgctaccaacagtgactataaatatacagataaaattatgacttacctgtttgacttcccacatggccccaagcctgggagctcccatcgaccatggcagtcctactttgacttgatcttggtggatgcacggaaaccactcttttttggagaaggcacagtactgcgtcaggtggatactaaaactggcaagctgaaaattggtacctacacagggcccctacagcatggtatcgtctactcaggaggttcttctgatacgatctgtgacctgttgggagccaagggaaaagacattttgtatattggagatcacatttttggggacattttaaaatcaaagaaacggcaagggtggcgaacttttttggtgattcctgaactcgcacaggagctacatgtctggactgacaagagttcacttttcgaagaacttcagagcttggatattttcttggctgaactctacaagcatcttgacagcagtagcaatgagcgtccagacatcagttccatccagagacgtattaagaaagtaactcatgacatggacatgtgctatgggatgatgggaagcctgtttcgcagtggctcccggcagaccctttttgccagtcaagtgatgcgttatgctgacctctatgcagcatctttcatcaacctgctgtattaccctttcagctacctcttcagggctgcccatgtcttgatgcctcatgaatcaacggtggagcacacacacgtagatatcaatgagatggagtctcctcttgccacccggaaccgcacatcagtggatttcaaagacactgactacaagcggcaccagctgacacggtcaattagtgagattaaacctcccaacctcttcccactggccccccaggaaattacacactgccatgacgaagatgatgatgaagaggaggaggaggaggaagaataaggaggaaaaccaaaaccccaagcacccattaaacaagtcctggcaggactcacaggaacaaacgaggtccctgttagggttctactcgggggagggagggggctccatgaaaggtacgtctgaaaagtttctgaagattttattatcatagatacttgttttggttttgtgtatctgtactctctgcagatggtccaaaattgtaatggagtctgtattagaagaaaataagggtaaaatcaggctgaactgcatgtatatggctccactgtggcttgtgacacttttaaaatcatccgtatgtcagtgtatctggatacacgaggaaaaggaaagagtctcagagtggaacaaagagtgggaagaggtgatctgtaatgttacaaattgtgctattactccaaggtccaacttttccagtgcattacatggtattgtatatcagtggagaaatgtattatttccatgatcaaatgtagtctctgttaaggtcaagttttcttttataagcctttaattcatcctcagtgactctggcaaggctgcttctctatcactggctttgcacagaagtatgctctacttgcgttgctttagggcaggattctattttgagggaaaagacagtatccttattaccttttgtttgtttaatagcacaaatgcttatttgttatccaaaaacaacctccttcttatctgtgataaatctatagaaagaatttagctgcaagtggacaaaggaacaagcccccagaaaagaaagggaagaactgccttcttatactacagaacatgcattagtgtgggctatatagctgtggctcatgctacccaattccagatttctttgtcctctaagagttgattgctgtatattaaaattgaacatcagaggatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtgactttgacctattctgtagtacaactgtaatagctattggtcttcaagtgggtttagatttggtgacatcagtttgatattctcttaaaggaaataaatattcaagaactgattataaaaacaacaaaacaacaaaacaaaaaaaaaaaaaaaaaaaaaaaaggagaggagagaagagagagagaagcagaaacggcggggggcggcgctgctactactagacgatgtagaggggtcgggcgcggcgagctagtgatggggggagggcggcgggcgtaggagtgatgatggcccactacgcgagaggggggggggggagtagagcggagcgcggggcgggtgtctccaaacaagaaagagagacagagaggaagaacaggagaataagacgacagagagagagaactaaaagaagcaggatgggagcaatatgatagaggagggggaagaaggagggaggaccagtaacactagggaaggaaggaagagcaaaaggaggataatacaggaaagagacgacgggggagatagaagggaagcagagaggaggacggagggagtagaaggaggaagtaggaggagaaggggggagaccgaagaggggagcgaacgtgaagacggagggatgaagaggagaagaggagggcgaggaagggaggggggagaagaagaagagagaggggggcagagtcgaagaggggggagcagcaaagcgaacgaagcgagagaaagcagaggaaagcagcagagaggcacgaaaaggtaaaaaaagaaagaaaaaggaaaagaacg

SEQ ID NO: 43023 - DNA, 3665 bp, Homo sapiens
gggcgcaggcagaatgccaagggatggagaccctcagaagggcaaagccggtgttccatcgtttgaagatctccagacccgcgggacagacagacgcagcgcggtcagggagcgtcggcttcgccgaactctgcggcggagctgggggacggaacagcgcgccggtccctggccgggcgcgagcagaggggcggcgcggggcggtgccgggcggcgggggcggggagggcgcgcgttgaggcggctgcggcagttgcgcgctgggattgttgcggtgcgctggagccgagtttcgctctgctgcccaggctggagtacagtgatgtgatctcctgacgtcaagtgatccattcgcctcggcctcccaaagttctgggattacaagtgtgagccactgccactggctgaaaaagtcttattgtggcataattgaatacaaaatacagttaaaataaaatgtcaacctcctggagtgatcggttacagaatgcagcagatatgcctgctaacatggataagcatgccctgaaaaagtatcgtcgagaagcctatcatcgggtgtttgtgaaccgaagtttagcaatggaaaagataaagtgttttggttttgatatggattatacccttgctgtgtacaagtccccagagtatgagtcccttggttttgagcttactgtggagagattagtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggaccagaaactagagaacagtatccaaataaatttatccagcgagatgatactgaaagattttacattctgaacacactattcaacctaccagagacctacctgttggcctgcctagtagatttttttactaattgtcccagatataccagttgtgaaacaggatttaaagatggggacctcttcatgtcctaccggagtatgttccaggatgtaagagatgctgttgactgggttcattacaagggctcccttaaggaaaagacagttgaaaatcttgagaagtatgtagtcaaagatggaaaactgcctttgcttctgagccggatgaaggaagtagggaaagtatttcttgctaccaacagtgactataaatatacagataaaattatgacttacctgtttgacttcccacatggccccaagcctgggagctcccatcgaccatggcagtcctactttgacttgatcttggtggatgcacggaaaccactcttttttggagaaggcacagtactgcgtcaggtggatactaaaactggcaagctgaaaattggtacctacacagggcccctacagcatggtatcgtctactcaggaggttcttctgatacgatctgtgacctgttgggagccaagggaaaagacattttgtatattggagatcacatttttggggacattttaaaatcaaagaaacggcaagggtggcgaacttttttggtgattcctgaactcgcacaggagctacatgtctggactgacaagagttcacttttcgaagaacttcagagcttggatattttcttggctgaactctacaagcatcttgacagcagtagcaatgagcgtccagacatcagttccatccagagacgtattaagaaagtaactcatgacatggacatgtgctatgggatgatgggaagcctgtttcgcagtggctcccggcagaccctttttgccagtcaagtgatgcgttatgctgacctctatgcagcatctttcatcaacctgctgtattaccctttcagctacctcttcagggctgcccatgtcttgatgcctcatgaatcaacggtggagcacacacacgtagatatcaatgagatggagtctcctcttgccacccggaaccgcacatcagtggatttcaaagacactgactacaagcggcaccagctgacacggtcaattagtgagattaaacctcccaacctcttcccactggccccccaggaaattacacactgccatgacgaagatgatgatgaagaggaggaggaggaggaagaataaggaggaaaaccaaaaccccaagcacccattaaacaagtcctggcaggactcacaggaacaaacgaggtccctgttagggttctactcgggggagggagggggctccatgaaaggtacgtctgaaaagtttctgaagattttattatcatagatacttgttttggttttgtgtatctgtactctctgcagatggtccaaaattgtaatggagtctgtattagaagaaaataagggtaaaatcaggctgaactgcatgtatatggctccactgtggcttgtgacacttttaaaatcatccgtatgtcagtgtatctggatacacgaggaaaaggaaagagtctcagagtggaacaaagagtgggaagaggtgatctgtaatgttacaaattgtgctattactccaaggtccaacttttccagtgcattacatggtattgtatatcagtggagaaatgtattatttccatgatcaaatgtagtctctgttaaggtcaagttttcttttataagcctttaattcatcctcagtgactctggcaaggctgcttctctatcactggctttgcacagaagtatgctctacttgcgttgctttagggcaggattctattttgagggaaaagacagtatccttattaccttttgtttgtttaatagcacaaatgcttatttgttatccaaaaacaacctccttcttatctgtgataaatctatagaaagaatttagctgcaagtggacaaaggaacaagcccccagaaaagaaagggaagaactgccttcttatactacagaacatgcattagtgtgggctatatagctgtggctcatgctacccaattccagatttctttgtcctctaagagttgattgctgtatattaaaattgaacatcagaggatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtga

SEQ ID NO: 43024 - DNA, 3726 bp, Homo sapiens
gggcgcaggcagaatgccaagggatggagaccctcagaagggcaaagccggtgttccatcgtttgaagatctccagacccgcgggacagacagacgcagcgcggtcagggagcgtcggcttcgccgaactctgcggcggagctgggggacggaacagcgcgccggtccctggccgggcgcgagcagaggggcggcgcggggcggtgccgggcggcgggggcggggagggcgcgcgttgaggcggctgcggcagttgcgcgctgggattgttgcggtgcgctggagccgagtttcgctctgctgcccaggctggagtacagtgatgtgatctcctgacgtcaagtgatccattcgcctcggcctcccaaagttctgggattacaagtgtgagccactgccactggctgaaaaagtcttattgtggcataattgaatacaaaatacagttaaaataaaatgtcaacctcctggagtgatcggttacagaatgcagcagatatgcctgctaacatggataagcatgccctgaaaaagtatcgtcgagaagcctatcatcgggtgtttgtgaaccgaagtttagcaatggaaaagataaagtgttttggttttgatatggattatacccttgctggagagccagtgtaactccttcaagactggagtgacacacactgcatctgcatctgcctcattgtacaagtccccagagtatgagtcccttggttttgagcttactgtggagagattagtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggaccagaaactagagaacagtatccaaataaatttatccagcgagatgatactgaaagattttacattctgaacacactattcaacctaccagagacctacctgttggcctgcctagtagatttttttactaattgtcccagatataccagttgtgaaacaggatttaaagatggggacctcttcatgtcctaccggagtatgttccaggatgtaagagatgctgttgactgggttcattacaagggctcccttaaggaaaagacagttgaaaatcttgagaagtatgtagtcaaagatggaaaactgcctttgcttctgagccggatgaaggaagtagggaaagtatttcttgctaccaacagtgactataaatatacagataaaattatgacttacctgtttgacttcccacatggccccaagcctgggagctcccatcgaccatggcagtcctactttgacttgatcttggtggatgcacggaaaccactcttttttggagaaggcacagtactgcgtcaggtggatactaaaactggcaagctgaaaattggtacctacacagggcccctacagcatggtatcgtctactcaggaggttcttctgatacgatctgtgacctgttgggagccaagggaaaagacattttgtatattggagatcacatttttggggacattttaaaatcaaagaaacggcaagggtggcgaacttttttggtgattcctgaactcgcacaggagctacatgtctggactgacaagagttcacttttcgaagaacttcagagcttggatattttcttggctgaactctacaagcatcttgacagcagtagcaatgagcgtccagacatcagttccatccagagacgtattaagaaagtaactcatgacatggacatgtgctatgggatgatgggaagcctgtttcgcagtggctcccggcagaccctttttgccagtcaagtgatgcgttatgctgacctctatgcagcatctttcatcaacctgctgtattaccctttcagctacctcttcagggctgcccatgtcttgatgcctcatgaatcaacggtggagcacacacacgtagatatcaatgagatggagtctcctcttgccacccggaaccgcacatcagtggatttcaaagacactgactacaagcggcaccagctgacacggtcaattagtgagattaaacctcccaacctcttcccactggccccccaggaaattacacactgccatgacgaagatgatgatgaagaggaggaggaggaggaagaataaggaggaaaaccaaaaccccaagcacccattaaacaagtcctggcaggactcacaggaacaaacgaggtccctgttagggttctactcgggggagggagggggctccatgaaaggtacgtctgaaaagtttctgaagattttattatcatagatacttgttttggttttgtgtatctgtactctctgcagatggtccaaaattgtaatggagtctgtattagaagaaaataagggtaaaatcaggctgaactgcatgtatatggctccactgtggcttgtgacacttttaaaatcatccgtatgtcagtgtatctggatacacgaggaaaaggaaagagtctcagagtggaacaaagagtgggaagaggtgatctgtaatgttacaaattgtgctattactccaaggtccaacttttccagtgcattacatggtattgtatatcagtggagaaatgtattatttccatgatcaaatgtagtctctgttaaggtcaagttttcttttataagcctttaattcatcctcagtgactctggcaaggctgcttctctatcactggctttgcacagaagtatgctctacttgcgttgctttagggcaggattctattttgagggaaaagacagtatccttattaccttttgtttgtttaatagcacaaatgcttatttgttatccaaaaacaacctccttcttatctgtgataaatctatagaaagaatttagctgcaagtggacaaaggaacaagcccccagaaaagaaagggaagaactgccttcttatactacagaacatgcattagtgtgggctatatagctgtggctcatgctacccaattccagatttctttgtcctctaagagttgattgctgtatattaaaattgaacatcagaggatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtga

SEQ ID NO: 43025 - DNA, 3287 bp, Homo sapiens
tcggacgagggatgtgcgtgcgctggagccgagtttcgctctgctgcccaggctggagtacagtgatgtgatctcctgacgtcaagtgatccattcgcctcggcctcccaaagttctgggattacaagtaatacaaaatacagttaaaataaaatgtcaacctcctggagtgatcggttacagaatgcagcagatatgcctgctaacatggataagcatgccctgaaaaagtatcgtcgagaagcctatcatcgggtgtttgtgaaccgaagtttagcaatggaaaagataaagtgttttggttttgatatggattatacccttgctgtgtacaagtccccagagtatgagtcccttggttttgagcttactgtggagagattagtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggaccagaaactagagaacagtatccaaataaatttatccagcgagatgatactgaaagattttacattctgaacacactattcaacctaccagagacctacctgttggcctgcctagtagatttttttactaattgtcccagatataccagttgtgaaacaggatttaaagatggggacctcttcatgtcctaccggagtatgttccaggatgtaagagatgctgttgactgggttcattacaagggctcccttaaggaaaagacagttgaaaatcttgagaagtatgtagtcaaagatggaaaactgcctttgcttctgagccggatgaaggaagtagggaaagtatttcttgctaccaacagtgactataaatatacagattttgacttgatcttggtggatgcacggaaaccactcttttttggagaaggcacagtactgcgtcaggtggatactaaaactggcaagctgaaaattggtacctacacagggcccctacagcatggtatcgtctactcaggaggttcttctgatacgatctgtgacctgttgggagccaagggaaaagacattttgtatattggagatcacatttttggggacattttaaaatcaaagaaacggcaagggtggcgaacttttttggtgattcctgaactcgcacaggagctacatgtctggactgacaagagttcacttttcgaagaacttcagagcttggatattttcttggctgaactctacaagcatcttgacagcagtagcaatgagcgtccagacatcagttccatccagagacgtattaagaaagtaactcatgacatggacatgtgctatgggatgatgggaagcctgtttcgcagtggctcccggcagaccctttttgccagtcaagtgatgcgttatgctgacctctatgcagcatctttcatcaacctgctgtattaccctttcagctacctcttcagggctgcccatgtcttgatgcctcatgaatcaacggtggagcacacacacgtagatatcaatgagatggagtctcctcttgccacccggaaccgcacatcagtggatttcaaagacactgactacaagcggcaccagctgacacggtcaattagtgagattaaacctcccaacctcttcccactggccccccaggaaattacacactgccatgacgaagatgatgatgaagaggaggaggaggaggaagaataaggaggaaaaccaaaaccccaagcacccattaaacaagtcctggcaggactcacaggaacaaacgaggtccctgttagggttctactcgggggagggagggggctccatgaaaggtacgtctgaaaagtttctgaagattttattatcatagatacttgttttggttttgtgtatctgtactctctgcagatggtccaaaattgtaatggagtctgtattagaagaaaataagggtaaaatcaggctgaactgcatgtatatggctccactgtggcttgtgacacttttaaaatcatccgtatgtcagtgtatctggatacacgaggaaaaggaaagagtctcagagtggaacaaagagtgggaagaggtgatctgtaatgttacaaattgtgctattactccaaggtccaacttttccagtgcattacatggtattgtatatcagtggagaaatgtattatttccatgatcaaatgtagtctctgttaaggtcaagttttcttttataagcctttaattcatcctcagtgactctggcaaggctgcttctctatcactggctttgcacagaagtatgctctacttgcgttgctttagggcaggattctattttgagggaaaagacagtatccttattaccttttgtttgtttaatagcacaaatgcttatttgttatccaaaaacaacctccttcttatctgtgataaatctatagaaagaatttagctgcaagtggacaaaggaacaagcccccagaaaagaaagggaagaactgccttcttatactacagaacatgcattagtgtgggctatatagctgtggctcatgctacccaattccagatttctttgtcctctaagagttgattgctgtatattaaaattgaacatcagaggatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtga

SEQ ID NO: 43026 - DNA, 3545 bp, Homo sapiens
gggcgcaggcagaatgccaagggatggagaccctcagaagggcaaagccggtgttccatcgtttgaagatctccagacccgcgggacagacagacgcagcgcggtcagggagcgtcggcttcgccgaactctgcggcggagctgggggacggaacagcgcgccggtccctggccgggcgcgagcagaggggcggcgcggggcggtgccgggcggcgggggcggggagggcgcgcgttgaggcggctgcggcagttgcgcgctgggattgttgcggtgcgctggagccgaatacaaaatacagttaaaataaaatgtcaacctcctggagtgatcggttacagaatgcagcagatatgcctgctaacatggataagcatgccctgaaaaagtatcgtcgagaagcctatcatcgggtgtttgtgaaccgaagtttagcaatggaaaagataaagtgttttggttttgatatggattatacccttgctgtgtacaagtccccagagtatgagtcccttggttttgagcttactgtggagagattagtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggttctcaggtagctgttcagaagagaccagaaactagagaacagtatccaaataaatttatccagcgagatgatactgaaagattttacattctgaacacactattcaacctaccagagacctacctgttggcctgcctagtagatttttttactaattgtcccagatataccagttgtgaaacaggatttaaagatggggacctcttcatgtcctaccggagtatgttccaggatgtaagagatgctgttgactgggttcattacaagggctcccttaaggaaaagacagttgaaaatcttgagaagtatgtagtcaaagatggaaaactgcctttgcttctgagccggatgaaggaagtagggaaagtatttcttgctaccaacagtgactataaatatacagataaaattatgacttacctgtttgacttcccacatggccccaagcctgggagctcccatcgaccatggcagtcctactttgacttgatcttggtggatgcacggaaaccactcttttttggagaaggcacagtactgcgtcaggtggatactaaaactggcaagctgaaaattggtacctacacagggcccctacagcatggtatcgtctactcaggaggttcttctgatacgatctgtgacctgttgggagccaagggaaaagacattttgtatattggagatcacatttttggggacattttaaaatcaaagaaacggcaagggtggcgaacttttttggtgattcctgaactcgcacaggagctacatgtctggactgacaagagttcacttttcgaagaacttcagagcttggatattttcttggctgaactctacaagcatcttgacagcagtagcaatgagcgtccagacatcagttccatccagagacgtattaagaaagtaactcatgacatggacatgtgctatgggatgatgggaagcctgtttcgcagtggctcccggcagaccctttttgccagtcaagtgatgcgttatgctgacctctatgcagcatctttcatcaacctgctgtattaccctttcagctacctcttcagggctgcccatgtcttgatgcctcatgaatcaacggtggagcacacacacgtagatatcaatgagatggagtctcctcttgccacccggaaccgcacatcagtggatttcaaagacactgactacaagcggcaccagctgacacggtcaattagtgagattaaacctcccaacctcttcccactggccccccaggaaattacacactgccatgacgaagatgatgatgaagaggaggaggaggaggaagaataaggaggaaaaccaaaaccccaagcacccattaaacaagtcctggcaggactcacaggaacaaacgaggtccctgttagggttctactcgggggagggagggggctccatgaaaggtacgtctgaaaagtttctgaagattttattatcatagatacttgttttggttttgtgtatctgtactctctgcagatggtccaaaattgtaatggagtctgtattagaagaaaataagggtaaaatcaggctgaactgcatgtatatggctccactgtggcttgtgacacttttaaaatcatccgtatgtcagtgtatctggatacacgaggaaaaggaaagagtctcagagtggaacaaagagtgggaagaggtgatctgtaatgttacaaattgtgctattactccaaggtccaacttttccagtgcattacatggtattgtatatcagtggagaaatgtattatttccatgatcaaatgtagtctctgttaaggtcaagttttcttttataagcctttaattcatcctcagtgactctggcaaggctgcttctctatcactggctttgcacagaagtatgctctacttgcgttgctttagggcaggattctattttgagggaaaagacagtatccttattaccttttgtttgtttaatagcacaaatgcttatttgttatccaaaaacaacctccttcttatctgtgataaatctatagaaagaatttagctgcaagtggacaaaggaacaagcccccagaaaagaaagggaagaactgccttcttatactacagaacatgcattagtgtgggctatatagctgtggctcatgctacccaattccagatttctttgtcctctaagagttgattgctgtatattaaaattgaacatcagaggatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtga

SEQ ID NO: 43027 - DNA, 3056 bp, Homo sapiens
gcacgagggggctcattaggggtgtacaagtccccagagtatgagtcccttggttttgagcttactgtggagagattagtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggaccagaaactagagaacagtatccaaataaatttatccagcgagatgatactgaaagattttacattctgaacacactattcaacctaccagagacctacctgttggcctgcctagtagatttttttactaattgtcccagatataccagttgtgaaacaggatttaaagatggggacctcttcatgtcctaccggagtatgttccaggatgtaagagatgctgttgactgggttcattacaagggctcccttaaggaaaagacagttgaaaatcttgagaagtatgtagtcaaagatggaaaactgcctttgcttctgagccggatgaaggaagtagggaaagtatttcttgctaccaacagtgactataaatatacagataaaattatgacttacctgtttgacttcccacatggccccaagcctgggagctcccatcgaccatggcagtcctactttgacttgatcttggtggatgcacggaaaccactcttttttggagaaggcacagtactgcgtcaggtggatactaaaactggcaagctgaaaattggtacctacacagggcccctacagcatggtatcgtctactcaggaggttcttctgatacgatctgtgacctgttgggagccaagggaaaagacattttgtatattggagatcacatttttggggacattttaaaatcaaagaaacggcaagggtggcgaacttttttggtgattcctgaactcgcacaggagctacatgtctggactgacaagagttcacttttcgaagaacttcagagcttggatattttcttggctgaactctacaagcatcttgacagcagtagcaatgagcgtccagacatcagttccatccagagacgtattaagaaagtaactcatgacatggacatgtgctatgggatgatgggaagcctgtttcgcagtggctcccggcagaccctttttgccagtcaagtgatgcgttatgctgacctctatgcagcatctttcatcaacctgctgtattaccctttcagctacctcttcagggctgcccatgtcttgatgcctcatgaatcaacggtggagcacacacacgtagatatcaatgagatggagtctcctcttgccacccggaaccgcacatcagtggatttcaaagacactgactacaagcggcaccagctgacacggtcaattagtgagattaaacctcccaacctcttcccactggccccccaggaaattacacactgccatgacgaagatgatgatgaagaggaggaggaggaggaagaataaggaggaaaaccaaaaccccaagcacccattaaacaagtcctggcaggactcacaggaacaaacgaggtccctgttagggttctactcgggggagggagggggctccatgaaaggtacgtctgaaaagtttctgaagattttattatcatagatacttgttttggttttgtgtatctgtactctctgcagatggtccaaaattgtaatggagtctgtattagaagaaaataagggtaaaatcaggctgaactgcatgtatatggctccactgtggcttgtgacacttttaaaatcatccgtatgtcagtgtatctggatacacgaggaaaaggaaagagtctcagagtggaacaaagagtgggaagaggtgatctgtaatgttacaaattgtgctattactccaaggtccaacttttccagtgcattacatggtattgtatatcagtggagaaatgtattatttccatgatcaaatgtagtctctgttaaggtcaagttttcttttataagcctttaattcatcctcagtgactctggcaaggctgcttctctatcactggctttgcacagaagtatgctctacttgcgttgctttagggcaggattctattttgagggaaaagacagtatccttattaccttttgtttgtttaatagcacaaatgcttatttgttatccaaaaacaacctccttcttatctgtgataaatctatagaaagaatttagctgcaagtggacaaaggaacaagcccccagaaaagaaagggaagaactgccttcttatactacagaacatgcattagtgtgggctatatagctgtggctcatgctacccaattccagatttctttgtcctctaagagttgattgctgtatattaaaattgaacatcagaggatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtga

SEQ ID NO: 43028 - DNA, 3508 bp, Homo sapiens
gggcgcaggcagaatgccaagggatggagaccctcagaagggcaaagccggtgttccatcgtttgaagatctccagacccgcgggacagacagacgcagcgcggtcagggagcgtcggcttcgccgaactctgcggcggagctgggggacggaacagcgcgccggtccctggccgggcgcgagcagaggggcggcgcggggcggtgccgggcggcgggggcggggagggcgcgcgttgaggcggctgcggcagttgcgcgctgggattgttgcggtgcgctggagccgaatacaaaatacagttaaaataaaatgtcaacctcctggagtgatcggttacagaatgcagcagatatgcctgctaacatggataagcatgccctgaaaaagtatcgtcgagaagcctatcatcggagagccagtgtaactccttcaagactggagtgacacacactgcatctgcatctgcctcattgtacaagtccccagagtatgagtcccttggttttgagcttactgtggagagattagtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggaccagaaactagagaacagtatccaaataaatttatccagcgagatgatactgaaagattttacattctgaacacactattcaacctaccagagacctacctgttggcctgcctagtagatttttttactaattgtcccagatataccagttgtgaaacaggatttaaagatggggacctcttcatgtcctaccggagtatgttccaggatgtaagagatgctgttgactgggttcattacaagggctcccttaaggaaaagacagttgaaaatcttgagaagtatgtagtcaaagatggaaaactgcctttgcttctgagccggatgaaggaagtagggaaagtatttcttgctaccaacagtgactataaatatacagataaaattatgacttacctgtttgacttcccacatggccccaagcctgggagctcccatcgaccatggcagtcctactttgacttgatcttggtggatgcacggaaaccactcttttttggagaaggcacagtactgcgtcaggtggatactaaaactggcaagctgaaaattggtacctacacagggcccctacagcatggtatcgtctactcaggaggttcttctgatacgatctgtgacctgttgggagccaagggaaaagacattttgtatattggagatcacatttttggggacattttaaaatcaaagaaacggcaagggtggcgaacttttttggtgattcctgaactcgcacaggagctacatgtctggactgacaagagttcacttttcgaagaacttcagagcttggatattttcttggctgaactctacaagcatcttgacagcagtagcaatgagcgtccagacatcagttccatccagagacgtattaagaaagtaactcatgacatggacatgtgctatgggatgatgggaagcctgtttcgcagtggctcccggcagaccctttttgccagtcaagtgatgcgttatgctgacctctatgcagcatctttcatcaacctgctgtattaccctttcagctacctcttcagggctgcccatgtcttgatgcctcatgaatcaacggtggagcacacacacgtagatatcaatgagatggagtctcctcttgccacccggaaccgcacatcagtggatttcaaagacactgactacaagcggcaccagctgacacggtcaattagtgagattaaacctcccaacctcttcccactggccccccaggaaattacacactgccatgacgaagatgatgatgaagaggaggaggaggaggaagaataaggaggaaaaccaaaaccccaagcacccattaaacaagtcctggcaggactcacaggaacaaacgaggtccctgttagggttctactcgggggagggagggggctccatgaaaggtacgtctgaaaagtttctgaagattttattatcatagatacttgttttggttttgtgtatctgtactctctgcagatggtccaaaattgtaatggagtctgtattagaagaaaataagggtaaaatcaggctgaactgcatgtatatggctccactgtggcttgtgacacttttaaaatcatccgtatgtcagtgtatctggatacacgaggaaaaggaaagagtctcagagtggaacaaagagtgggaagaggtgatctgtaatgttacaaattgtgctattactccaaggtccaacttttccagtgcattacatggtattgtatatcagtggagaaatgtattatttccatgatcaaatgtagtctctgttaaggtcaagttttcttttataagcctttaattcatcctcagtgactctggcaaggctgcttctctatcactggctttgcacagaagtatgctctacttgcgttgctttagggcaggattctattttgagggaaaagacagtatccttattaccttttgtttgtttaatagcacaaatgcttatttgttatccaaaaacaacctccttcttatctgtgataaatctatagaaagaatttagctgcaagtggacaaaggaacaagcccccagaaaagaaagggaagaactgccttcttatactacagaacatgcattagtgtgggctatatagctgtggctcatgctacccaattccagatttctttgtcctctaagagttgattgctgtatattaaaattgaacatcagaggatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtga

SEQ ID NO: 43029 - DNA, 3392 bp, Homo sapiens
cacaactggtccacctagcctttaaggcccagctcatataccagcacgtgcatgaatccttcctagattttcctctccttagtcctcacatttgcttctctctacctcttaagttgaaatggtgttcccttctttggttttctcataaatgtttgcacctttcttgtagtagttgtgattttttaccttataattatatgtgtatgtgacccacctcgcccaccacactgacaactcttttaagagctggaacctaagctggacatcacacctgtaatcccagctacttgggaggctgaggtgggaagattgcttgagcaatcttcaggagtttgagtccagcctggacttaaaatagcaagactgtcttaaaaaaaaaaaaaattaaaattaaaaaaaataaagagctggaacctgaactcgttcatcttcatagctatccatgcgtaatattcggaattctgtcttgcacatagccatcaaaatatttgagttaatttttgaataatgctatttcccaattattataatgttattttaaaaatcagttaatttttaaatttttctttcagaccagaaactagagaacagtatccaaataaatttatccagcgagatgatactgaaagattttacattctgaacacactattcaacctaccagagacctacctgttggcctgcctagtagatttttttactaattgtcccagatataccagttgtgaaacaggatttaaagatggggacctcttcatgtcctaccggagtatgttccaggatgtaagagatgctgttgactgggttcattacaagggctcccttaaggaaaagacagttgaaaatcttgagaagtatgtagtcaaagatggaaaactgcctttgcttctgagccggatgaaggaagtagggaaagtatttcttgctaccaacagtgactataaatatacagataaaattatgacttacctgtttgacttcccacatggccccaagcctgggagctcccatcgaccatggcagtcctactttgacttgatcttggtggatgcacggaaaccactcttttttggagaaggcacagtactgcgtcaggtggatactaaaactggcaagctgaaaattggtacctacacagggcccctacagcatggtatcgtctactcaggaggttcttctgatacgatctgtgacctgttgggagccaagggaaaagacattttgtatattggagatcacatttttggggacattttaaaatcaaagaaacggcaagggtggcgaacttttttggtgattcctgaactcgcacaggagctacatgtctggactgacaagagttcacttttcgaagaacttcagagcttggatattttcttggctgaactctacaagcatcttgacagcagtagcaatgagcgtccagacatcagttccatccagagacgtattaagaaagtaactcatgacatggacatgtgctatgggatgatgggaagcctgtttcgcagtggctcccggcagaccctttttgccagtcaagtgatgcgttatgctgacctctatgcagcatctttcatcaacctgctgtattaccctttcagctacctcttcagggctgcccatgtcttgatgcctcatgaatcaacggtggagcacacacacgtagatatcaatgagatggagtctcctcttgccacccggaaccgcacatcagtggatttcaaagacactgactacaagcggcaccagctgacacggtcaattagtgagattaaacctcccaacctcttcccactggccccccaggaaattacacactgccatgacgaagatgatgatgaagaggaggaggaggaggaagaataaggaggaaaaccaaaaccccaagcacccattaaacaagtcctggcaggactcacaggaacaaacgaggtccctgttagggttctactcgggggagggagggggctccatgaaaggtacgtctgaaaagtttctgaagattttattatcatagatacttgttttggttttgtgtatctgtactctctgcagatggtccaaaattgtaatggagtctgtattagaagaaaataagggtaaaatcaggctgaactgcatgtatatggctccactgtggcttgtgacacttttaaaatcatccgtatgtcagtgtatctggatacacgaggaaaaggaaagagtctcagagtggaacaaagagtgggaagaggtgatctgtaatgttacaaattgtgctattactccaaggtccaacttttccagtgcattacatggtattgtatatcagtggagaaatgtattatttccatgatcaaatgtagtctctgttaaggtcaagttttcttttataagcctttaattcatcctcagtgactctggcaaggctgcttctctatcactggctttgcacagaagtatgctctacttgcgttgctttagggcaggattctattttgagggaaaagacagtatccttattaccttttgtttgtttaatagcacaaatgcttatttgttatccaaaaacaacctccttcttatctgtgataaatctatagaaagaatttagctgcaagtggacaaaggaacaagcccccagaaaagaaagggaagaactgccttcttatactacagaacatgcattagtgtgggctatatagctgtggctcatgctacccaattccagatttctttgtcctctaagagttgattgctgtatattaaaattgaacatcagaggatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtga

SEQ ID NO: 43030 - DNA, 2330 bp, Homo sapiens
  misc_feature (28)..(28): n is a, c, g, or t
ctgagctcgtaccattagcgcgttctgngtcaggtggatactaaaactggcaagctgaaaattggtacctacacagggcccctacagcatggtatcgtctactcaggaggttcttctgatacgatctgtgacctgttgggagccaagggaaaagacattttgtatattggagatcacatttttggggacattttaaaatcaaagaaacggcaagggtggcgaacttttttggtgattcctgaactcgcacaggagctacatgtctggactgacaagagttcacttttcgaagaacttcagagcttggatattttcttggctgaactctacaagcatcttgacagcagtagcaatgagcgtccagacatcagttccatccagagacgtattaagaaagtaactcatgacatggacatgtgctatgggatgatgggaagcctgtttcgcagtggctcccggcagaccctttttgccagtcaagtgatgcgttatgctgacctctatgcagcatctttcatcaacctgctgtattaccctttcagctacctcttcagggctgcccatgtcttgatgcctcatgaatcaacggtggagcacacacacgtagatatcaatgagatggagtctcctcttgccacccggaaccgcacatcagtggatttcaaagacactgactacaagcggcaccagctgacacggtcaattagtgagattaaacctcccaacctcttcccactggccccccaggaaattacacactgccatgacgaagatgatgatgaagaggaggaggaggaggaagaataaggaggaaaaccaaaaccccaagcacccattaaacaagtcctggcaggactcacaggaacaaacgaggtccctgttagggttctactcgggggagggagggggctccatgaaaggtacgtctgaaaagtttctgaagattttattatcatagatacttgttttggttttgtgtatctgtactctctgcagatggtccaaaattgtaatggagtctgtattagaagaaaataagggtaaaatcaggctgaactgcatgtatatggctccactgtggcttgtgacacttttaaaatcatccgtatgtcagtgtatctggatacacgaggaaaaggaaagagtctcagagtggaacaaagagtgggaagaggtgatctgtaatgttacaaattgtgctattactccaaggtccaacttttccagtgcattacatggtattgtatatcagtggagaaatgtattatttccatgatcaaatgtagtctctgttaaggtcaagttttcttttataagcctttaattcatcctcagtgactctggcaaggctgcttctctatcactggctttgcacagaagtatgctctacttgcgttgctttagggcaggattctattttgagggaaaagacagtatccttattaccttttgtttgtttaatagcacaaatgcttatttgttatccaaaaacaacctccttcttatctgtgataaatctatagaaagaatttagctgcaagtggacaaaggaacaagcccccagaaaagaaagggaagaactgccttcttatactacagaacatgcattagtgtgggctatatagctgtggctcatgctacccaattccagatttctttgtcctctaagagttgattgctgtatattaaaattgaacatcagaggatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtga

SEQ ID NO: 43031 - DNA, 2547 bp, Homo sapiens
tggctgacacaatacctttttaaaaaataaaatagtgggatcttctggctatacttagtatttttatattccttgcatctgagtgagattaaatagtaatgccttaaggtaaggagtgatgtttcaacttttgctgtttctccttcaccagcctgggagctcccatcgaccatggcagtcctactttgacttgatcttggtggatgcacggaaaccactcttttttggagaaggcacagtactgcgtcaggtggatactaaaactggcaagctgaaaattggtacctacacagggcccctacagcatggtatcgtctactcaggaggttcttctgatacgatctgtgacctgttgggagccaagggaaaagacattttgtatattggagatcacatttttggggacattttaaaatcaaagaaacggcaagggtggcgaacttttttggtgattcctgaactcgcacaggagctacatgtctggactgacaagagttcacttttcgaagaacttcagagcttggatattttcttggctgaactctacaagcatcttgacagcagtagcaatgagcgtccagacatcagttccatccagagacgtattaagaaagtaactcatgacatggacatgtgctatgggatgatgggaagcctgtttcgcagtggctcccggcagaccctttttgccagtcaagtgatgcgttatgctgacctctatgcagcatctttcatcaacctgctgtattaccctttcagctacctcttcagggctgcccatgtcttgatgcctcatgaatcaacggtggagcacacacacgtagatatcaatgagatggagtctcctcttgccacccggaaccgcacatcagtggatttcaaagacactgactacaagcggcaccagctgacacggtcaattagtgagattaaacctcccaacctcttcccactggccccccaggaaattacacactgccatgacgaagatgatgatgaagaggaggaggaggaggaagaataaggaggaaaaccaaaaccccaagcacccattaaacaagtcctggcaggactcacaggaacaaacgaggtccctgttagggttctactcgggggagggagggggctccatgaaaggtacgtctgaaaagtttctgaagattttattatcatagatacttgttttggttttgtgtatctgtactctctgcagatggtccaaaattgtaatggagtctgtattagaagaaaataagggtaaaatcaggctgaactgcatgtatatggctccactgtggcttgtgacacttttaaaatcatccgtatgtcagtgtatctggatacacgaggaaaaggaaagagtctcagagtggaacaaagagtgggaagaggtgatctgtaatgttacaaattgtgctattactccaaggtccaacttttccagtgcattacatggtattgtatatcagtggagaaatgtattatttccatgatcaaatgtagtctctgttaaggtcaagttttcttttataagcctttaattcatcctcagtgactctggcaaggctgcttctctatcactggctttgcacagaagtatgctctacttgcgttgctttagggcaggattctattttgagggaaaagacagtatccttattaccttttgtttgtttaatagcacaaatgcttatttgttatccaaaaacaacctccttcttatctgtgataaatctatagaaagaatttagctgcaagtggacaaaggaacaagcccccagaaaagaaagggaagaactgccttcttatactacagaacatgcattagtgtgggctatatagctgtggctcatgctacccaattccagatttctttgtcctctaagagttgattgctgtatattaaaattgaacatcagaggatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtga

SEQ ID NO: 43032 - DNA, 2345 bp, Homo sapiens
ggtactttacaagctcagaatgagcgtgcagctggaagggaaagttgtcatcatggtgtttaagcaggaggaaaggcagttaaagagaaggtgatggtgttcatctgttgtcagactccaagcaggtatcagtgagttatcctgaagaggggaagaggaggtaactgtacactcagcatgttagtcccaggttctactttccagtcacatctgcaaccttttagtttagcagcagttaagaactaggtgcttatttatttaaaatgtcttccttttccttccaaaccttaactagcacttttcgaagaacttcagagcttggatattttcttggctgaactctacaagcatcttgacagcagtagcaatgagcgtccagacatcagttccatccagagacgtattaagaaagtaactcatgacatggacatgtgctatgggatgatgggaagcctgtttcgcagtggctcccggcagaccctttttgccagtcaagtgatgcgttatgctgacctctatgcagcatctttcatcaacctgctgtattaccctttcagctacctcttcagggctgcccatgtcttgatgcctcatgaatcaacggtggagcacacacacgtagatatcaatgagatggagtctcctcttgccacccggaaccgcacatcagtggatttcaaagacactgactacaagcggcaccagctgacacggtcaattagtgagattaaacctcccaacctcttcccactggccccccaggaaattacacactgccatgacgaagatgatgatgaagaggaggaggaggaggaagaataaggaggaaaaccaaaaccccaagcacccattaaacaagtcctggcaggactcacaggaacaaacgaggtccctgttagggttctactcgggggagggagggggctccatgaaaggtacgtctgaaaagtttctgaagattttattatcatagatacttgttttggttttgtgtatctgtactctctgcagatggtccaaaattgtaatggagtctgtattagaagaaaataagggtaaaatcaggctgaactgcatgtatatggctccactgtggcttgtgacacttttaaaatcatccgtatgtcagtgtatctggatacacgaggaaaaggaaagagtctcagagtggaacaaagagtgggaagaggtgatctgtaatgttacaaattgtgctattactccaaggtccaacttttccagtgcattacatggtattgtatatcagtggagaaatgtattatttccatgatcaaatgtagtctctgttaaggtcaagttttcttttataagcctttaattcatcctcagtgactctggcaaggctgcttctctatcactggctttgcacagaagtatgctctacttgcgttgctttagggcaggattctattttgagggaaaagacagtatccttattaccttttgtttgtttaatagcacaaatgcttatttgttatccaaaaacaacctccttcttatctgtgataaatctatagaaagaatttagctgcaagtggacaaaggaacaagcccccagaaaagaaagggaagaactgccttcttatactacagaacatgcattagtgtgggctatatagctgtggctcatgctacccaattccagatttctttgtcctctaagagttgattgctgtatattaaaattgaacatcagaggatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtga

SEQ ID NO: 43033 - DNA, 1422 bp, Homo sapiens
acccactactggctgacccactactggcgacccactactggctatcatagatacttgttttggttttgtgtatctgtactctctgcagatggtccaaaattgtaatggagtctgtattagaagaaaataagggtaaaatcaggctgaactgcatgtatatggctccactgtggcttgtgacacttttaaaatcatccgtatgtcagtgtatctggatacacgaggaaaaggaaagagtctcagagtggaacaaagagtgggaagaggtgatctgtaatgttacaaattgtgctattactccaaggtccaacttttccagtgcattacatggtattgtatatcagtggagaaatgtattatttccatgatcaaatgtagtctctgttaaggtcaagttttcttttataagcctttaattcatcctcagtgactctggcaaggctgcttctctatcactggctttgcacagaagtatgctctacttgcgttgctttagggcaggattctattttgagggaaaagacagtatccttattaccttttgtttgtttaatagcacaaatgcttatttgttatccaaaaacaacctccttcttatctgtgataaatctatagaaagaatttagctgcaagtggacaaaggaacaagcccccagaaaagaaagggaagaactgccttcttatactacagaacatgcattagtgtgggctatatagctgtggctcatgctacccaattccagatttctttgtcctctaagagttgattgctgtatattaaaattgaacatcagaggatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtga

SEQ ID NO: 43034 - DNA, 1373 bp, Homo sapiens
  misc_feature (15)..(15): n is a, c, g, or t
  misc_feature (22)..(22): n is a, c, g, or t
  misc_feature (30)..(30): n is a, c, g, or t
tgcccgactaggganagcgtantgatccgnagaggggtgatggtccaaaattgtaatggagtctgtattagaagaaaataagggtaaaatcaggctgaactgcatgtatatggctccactgtggcttgtgacacttttaaaatcatccgtatgtcagtgtatctggatacacgaggaaaaggaaagagtctcagagtggaacaaagagtgggaagaggtgatctgtaatgttacaaattgtgctattactccaaggtccaacttttccagtgcattacatggtattgtatatcagtggagaaatgtattatttccatgatcaaatgtagtctctgttaaggtcaagttttcttttataagcctttaattcatcctcagtgactctggcaaggctgcttctctatcactggctttgcacagaagtatgctctacttgcgttgctttagggcaggattctattttgagggaaaagacagtatccttattaccttttgtttgtttaatagcacaaatgcttatttgttatccaaaaacaacctccttcttatctgtgataaatctatagaaagaatttagctgcaagtggacaaaggaacaagcccccagaaaagaaagggaagaactgccttcttatactacagaacatgcattagtgtgggctatatagctgtggctcatgctacccaattccagatttctttgtcctctaagagttgattgctgtatattaaaattgaacatcagaggatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtga

SEQ ID NO: 43035 - DNA, 1182 bp, Homo sapiens
gatccccaccaacatgcaacacagaggtgatctgtaatgttacaaattgtgctattactccaaggtccaacttttccagtgcattacatggtattgtatatcagtggagaaatgtattatttccatgatcaaatgtagtctctgttaaggtcaagttttcttttataagcctttaattcatcctcagtgactctggcaaggctgcttctctatcactggctttgcacagaagtatgctctacttgcgttgctttagggcaggattctattttgagggaaaagacagtatccttattaccttttgtttgtttaatagcacaaatgcttatttgttatccaaaaacaacctccttcttatctgtgataaatctatagaaagaatttagctgcaagtggacaaaggaacaagcccccagaaaagaaagggaagaactgccttcttatactacagaacatgcattagtgtgggctatatagctgtggctcatgctacccaattccagatttctttgtcctctaagagttgattgctgtatattaaaattgaacatcagaggatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtga

SEQ ID NO: 43036 - DNA, 2298 bp, Homo sapiens
tcggacgagggatgtgcgtgcgctggagccgagtttcgctctgctgcccaggctggagtacagtgatgtgatctcctgacgtcaagtgatccattcgcctcggcctcccaaagttctgggattacaagtaatacaaaatacagttaaaataaaatgtcaacctcctggagtgatcggttacagaatgcagcagatatgcctgctaacatggataagcatgccctgaaaaagtatcgtcgagaagcctatcatcgggtgtttgtgaaccgaagtttagcaatggaaaagataaagtgttttggttttgatatggattatacccttgctgtgtacaagtccccagagtatgagtcccttggttttgagcttactgtggagagattagtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggaccagaaactagagaacagtatccaaataaatttatccagcgagatgatactgaaagattttacattctgaacacactattcaacctaccagagacctacctgttggcctgcctagtagatttttttactaattgtcccagatataccagttgtgaaacaggatttaaagatggggacctcttcatgtcctaccggagtatgttccaggatgtaagagatgctgttgactgggttcattacaagggctcccttaaggaaaagacagttgaaaatcttgagaagtatgtagtcaaagatggaaaactgcctttgcttctgagccggatgaaggaagtagggaaagtatttcttgctaccaacagtgactataaatatacagataaaattatgacttacctgtttgacttcccacatggccccaagcctgggagctcccatcgaccatggcagtcctactttgacttgatcttggtggatgcacggaaaccactcttttttggagaaggcacagtactgcgtcaggtggatactaaaactggcaagctgaaaattggtacctacacagggcccctacagcatggtatcgtctactcaggaggttcttctgatacgatctgtgacctgttgggagccaagggaaaagacattttgtatattggagatcacatttttggggacattttaaaatcaaagaaacggcaagggtggcgaacttttttggtgattcctgaactcgcacaggagctacatgtctggactgacaagagttcacttttcgaagaacttcagagcttggatattttcttggctgaactctacaagcatcttgacagcagtagcaatgagcgtccagacatcagttccatccagagacgtattaagaaagtaactcatgacatggacatgtgctatgggatgatgggaagcctgtttcgcagtggctcccggcagaccctttttgccagtcaagtgatgcgttatgctgacctctatgcagcatctttcatcaacctgctgtattaccctttcagctacctcttcagggctgcccatgtcttgatgcctcatgaatcaacggtggagcacacacacgtagatatcaatgagatggagtctcctcttgccacccggaaccgcacatcagtggatttcaaagacactgactacaagcggcaccagctgacacggtcaattagtgagattaaacctcccaacctcttcccactggccccccaggaaattacacactgccatgacgaagatgatgatgaagaggaggaggaggaggaagaataaggaggaaaaccaaaaccccaagcacccattaaacaagtcctggcaggactcacaggaacaaacgaggtccctgttagggttctactcgggggagggagggggctccatgaaaggtacgtctgaaaagtttctgaagattttattatcatagatacttgttttggttttgtgtatctgtactctctgcagatggtccaaaattgtaatggagtctgtattagaagaaaataagggtaaaatcaggctgaactgcatgtatatggctccactgtggcttgtgacacttttaaaatcatccgtatgtcagtgtatctggatacacgaggaaaaggaaagagtctcagagtggaacaaagagtgggaagctggattccacgcaccgatcagtactgggaaaagatcttatctaccgtgggcctgtcgtgcagtcctgggcggtcgagatctggtgtagcagat

SEQ ID NO: 43037 - DNA, 1964 bp, Homo sapiens
gggcgcaggcagaatgccaagggatggagaccctcagaagggcaaagccggtgttccatcgtttgaagatctccagacccgcgggacagacagacgcagcgcggtcagggagcgtcggcttcgccgaactctgcggcggagctgggggacggaacagcgcgccggtccctggccgggcgcgagcagaggggcggcgcggggcggtgccgggcggcgggggcggggagggcgcgcgttgaggcggctgcggcagttgcgcgctgggattgttgcggtgcgctggagccgaatacaaaatacagttaaaataaaatgtcaacctcctggagtgatcggttacagaatgcagcagatatgcctgctaacatggataagcatgccctgaaaaagtatcgtcgagaagcctatcatcgggtgtttgtgaaccgaagtttagcaatggaaaagataaagtgttttggttttgatatggattatacccttgctgtgtacaagtccccagagtatgagtcccttggttttgagcttactgtggagagattagtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggttctcaggtagctgttcagaagagaccagaaactagagaacagtatccaaataaatttatccagcgagatgatactgaaagattttacattctgaacacactattcaacctaccagagacctacctgttggcctgcctagtagatttttttactaattgtcccagatataccagttgtgaaacaggatttaaagatggggacctcttcatgtcctaccggagtatgttccaggatgtaagagatgctgttgactgggttcattacaagggctcccttaaggaaaagacagttgaaaatcttgagaagtatgtagtcaaagatagtaaaagtagcagaatacagtattttctcaaagtactgtggtaaagatttcttgttttcagtttttgtgcttcctattttcacccacctcccttatttcaagaaagaacactgaatggggagggtccgggagaatttgagtgaaggaatctatttgctatgcgagaaggaaaagatatttttctttccaggcacatgaggggttagaatttcctcatttaagcgcacgtgggtgtgggtatttctaggtagcatctgcacatgtcatttcattctgcaaggtgttttataaaaccatagtgtacacactgaaagccatatctaataatctctatgtagagcatgtttaaatcagcttctgctgacctttaacacacctcacatacttcaagaaatctcaaggtaatttaaactctttcctgaggcagacatcatgaggaaggtagagatatgttgttaacagccatataacccctataaatatgtgtataattttacatgtaaatctattacatacactgtgtatactacatatgttaatactttattcatttatagtgataatgtgggcttttaagtgcaaaattctgaaatcagctaacccttaaaaggttcccccattcctgttgtggacagaaatccagtatttgacaatccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtga

SEQ ID NO: 43038 - DNA, 1381 bp, Homo sapiens
tcggacgagggatgtgcgtgcgctggagccgagtttcgctctgctgcccaggctggagtacagtgatgtgatctcctgacgtcaagtgatccattcgcctcggcctcccaaagttctgggattacaagtaatacaaaatacagttaaaataaaatgtcaacctcctggagtgatcggttacagaatgcagcagatatgcctgctaacatggataagcatgccctgaaaaagtatcgtcgagaagcctatcatcgggtgtttgtgaaccgaagtttagcaatggaaaagataaagtgttttggttttgatatggattatacccttgctgtgtacaagtccccagagtatgagtcccttggttttgagcttactgtggagagattagtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggaccagaaactagagaacagtatccaaataaatttatccagcgagatgatactgaaagattttacattctgaacacactattcaacctaccagagacctacctgttggcctgcctagtagatttttttactaattgtcccagatataccagttgtgaaacaggatttaaagatggggacctcttcatgtcctaccggagtatgttccaggatgtaagagatgctgttgactgggttcattacaagggctcccttaaggaaaagacagttgaaaatcttgagaagtatgtagtcaaagatgtaagtaatataggggaaaatagatctgcataatagctcattttacctattagggaaattaataacaagctgatttataatgaaatggacaaaagaagagatttgtcttggcatagtatgtgtcgggtataatcaccaagaatattcagctagagcataggtcttagtagagtttttcctgtttcttgataggcaagaagactcagtatttcatttttcctgtttcttgataggcaagaagactcagtattgcatttgttcgcttagcttcaattataatagcagttagaggtttactgtatgcacatcatcaccatgctaagtgattacatgcattatgccatttaatcttctgtatgaccttgagttaggtattattgttgcctctgttttatagataaaaaacctgagaaatagagggattaaataacttgccagaggtcacacagttagtaagtagtaaagctaagtcacatgccaaatcataactactgcactcagatcatctcaaaaatgtgcatatatgttactgttatttaaa

SEQ ID NO: 43039 - DNA, 2034 bp, Homo sapiens
gggcgcaggcagaatgccaagggatggagaccctcagaagggcaaagccggtgttccatcgtttgaagatctccagacccgcgggacagacagacgcagcgcggtcagggagcgtcggcttcgccgaactctgcggcggagctgggggacggaacagcgcgccggtccctggccgggcgcgagcagaggggcggcgcggggcggtgccgggcggcgggggcggggagggcgcgcgttgaggcggctgcggcagttgcgcgctgggattgttgcggtgcgctggagccgagtttcgctctgctgcccaggctggagtacagtgatgtgatctcctgacgtcaagtgatccattcgcctcggcctcccaaagttctgggattacaagtgtgagccactgccactggctgaaaaagtcttattgtggcataattgaatacaaaatacagttaaaataaaatgtcaacctcctggagtgatcggttacagaatgcagcagatatgcctgctaacatggataagcatgccctgaaaaagtatcgtcgagaagcctatcatcgtgtacaagtccccagagtatgagtcccttggttttgagcttactgtggagagattagtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggttctcaggtagctgttcagaagagaccagaaactagagaacagtatccaaataaatttatccagcgagatgatactgaaagattttacattctgaacacactattcaacctaccagagacctacctgttggcctgcctagtagatttttttactaattgtcccagatataccagttgtgaaacaggatttaaagatggggacctcttcatgtcctaccggagtatgttccaggatgtaagagatgctgttgactgggttcattacaagggctcccttaaggaaaagacagttgaaaatcttgagaagtatgtagtcaaagatagtaaaagtagcagaatacagtattttctcaaagtactgtggtaaagatttcttgttttcagtttttgtgcttcctattttcacccacctcccttatttcaagaaagaacactgaatggggagggtccgggagaatttgagtgaaggaatctatttgctatgcgagaaggaaaagatatttttctttccaggcacatgaggggttagaatttcctcatttaagcgcacgtgggtgtgggtatttctaggtagcatctgcacatgtcatttcattctgcaaggtgttttataaaaccatagtgtacacactgaaagccatatctaataatctctatgtagagcatgtttaaatcagcttctgctgacctttaacacacctcacatacttcaagaaatctcaaggtaatttaaactctttcctgaggcagacatcatgaggaaggtagagatatgttgttaacagccatataacccctataaatatgtgtataattttacatgtaaatctattacatacactgtgtatactacatatgttaatactttattcatttatagtgataatgtgggcttttaagtgcaaaattctgaaatcagctaacccttaaaaggttcccccattcctgttgtggacagaaatccagtatttgacaatccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtga

SEQ ID NO: 43040 - DNA, 997 bp, Homo sapiens
taaaaattaaacacacatagtgccccaagatgacatacttctttcttttcctacagagtaaaagtagcagaatacagtattttctcaaagtactgtggtaaagatttcttgttttcagtttttgtgcttcctattttcacccacctcccttatttcaagaaagaacactgaatggggagggtccgggagaatttgagtgaaggaatctatttgctatgcgagaaggaaaagatatttttctttccaggcacatgaggggttagaatttcctcatttaagcgcacgtgggtgtgggtatttctaggtagcatctgcacatgtcatttcattctgcaaggtgttttataaaaccatagtgtacacactgaaagccatatctaataatctctatgtagagcatgtttaaatcagcttctgctgacctttaacacacctcacatacttcaagaaatctcaaggtaatttaaactctttcctgaggcagacatcatgaggaaggtagagatatgttgttaacagccatataacccctataaatatgtgtataattttacatgtaaatctattacatacactgtgtatactacatatgttaatactttattcatttatagtgataatgtgggcttttaagtgcaaaattctgaaatcagctaacccttaaaaggttcccccattcctgttgtggacagaaatccagtatttgacaatccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtga

SEQ ID NO: 43041 - DNA, 773 bp, Homo sapiens
tcggacgagggatgtgcgtgcgctggagccgagtttcgctctgctgcccaggctggagtacagtgatgtgatctcctgacgtcaagtgatccattcgcctcggcctcccaaagttctgggattacaagtaatacaaaatacagttaaaataaaatgtcaacctcctggagtgatcggttacagaatgcagcagatatgcctgctaacatggataagcatgccctgaaaaagtatcgtcgagaagcctatcatcgggtgtttgtgaaccgaagtttagcaatggaaaagataaagtgttttggttttgatatggattatacccttgctgtgtacaagtccccagagtatgagtcccttggttttgagcttactgtggagagattagtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggaccagaaactagagaacagtatccaaataaatttatccagcgagatgatactgaaagattttacattctgaacacactattcaacctaccagagacctacctgttggcctgcctagtagatttttttactaattgtcccagatataccagtgaatttagtgctagtgagagatgccacattgccaacctgagagatgggacagcaccagcagctccatgcaggctctcacc

SEQ ID NO: 43042 - DNA, 345 bp, Homo sapiens
ctccaaagtgtaaagataaaaatgttttcgtgtttcactcattatccaattacatttcagggaaaactgcctttgcttctgagccggatgaaggaagtagggaaagtatttcttgctaccaacagtgactataaatatacagatagtgcttcatgtgtatatttatttatgcagtggaattattttggcctaaagaactgtgaagacaatgaggaagatagaagtttattaagtgaaaatagtttcttgccttctcattttcaaagagtaaaaaggcaaaaatatacaggataacagtggttctcaaatttttctagaaatttattttaaccattttcactgatt

SEQ ID NO: 43043 - DNA, 567 bp, Homo sapiens
gaacctttagcctctttctaatgttaaagtcaaacaatgtgaagatgacatcatctccccagatgtaatatatttccctattacttttcatcattaaagagcaaattcccttacataaggttagttaacagttatttattaggcagttggaacccaaactgacatatagttagcaattacattttgtttaaattaagtgccttccaattatacagcatacaacaaaactaatcttaaaacttgcccagaagaactttagtagttttgacttatttgaaattctaagatttttattttcttctttctaatacagttctcaggtagctgttcagaagaggtatgtatataaaaatgctttgaaaaaattttaaactatagcaatttaaatgattaagagatttttaatagccaatacgttttttagattctaatgaatctaaactttgaatcctgacatttgattgtgtcattaaaaaaatgtaaacataaggttaaagtgaatatgtgctaataatattttaaacaaataagaataagctttattttcaaaataaaaatatttccact

SEQ ID NO: 43044 - DNA, 338 bp, Homo sapiens
caaccttttagtttagcagcagttaagaactaggtgcttatttatttaaaatgtcttccttttccttccaaaccttaactagcacttttcgaagaacttcagagcttggatattttcttggctgaactctacaagtaagttttctaaaaatttctttcccaaaaacttactcaggaatcacttagatataagaaatgttctttccaggccagtaatcccagctatttgggaggctgaggcaggagaatcgtttgaaccggggaaatggaggttgcagtgagctgagattgcaccattgcactccagcctgggcgacaagagtgaaactccgtctcaaa

SEQ ID NO: 43045 - DNA, 3362 bp, Homo sapiens
tcggacgagggatgtgcgtgcgctggagccgagtttcgctctgctgcccaggctggagtacagtgatgtgatctcctgacgtcaagtgatccattcgcctcggcctcccaaagttctgggattacaagtaatacaaaatacagttaaaataaaatgtcaacctcctggagtgatcggttacagaatgcagcagatatgcctgctaacatggataagcatgccctgaaaaagtatcgtcgagaagcctatcatcgggtgtttgtgaaccgaagtttagcaatggaaaagataaagtgttttggttttgatatggattatacccttgctgtgtacaagtccccagagtatgagtcccttggttttgagcttactgtggagagattagtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggaccagaaactagagaacagtatccaaataaatttatccagcgagatgatactgaaagattttacattctgaacacactattcaacctaccagagacctacctgttggcctgcctagtagatttttttactaattgtcccagatataccagttgtgaaacaggatttaaagatggggacctcttcatgtcctaccggagtatgttccaggatgtaagagatgctgttgactgggttcattacaagggctcccttaaggaaaagacagttgaaaatcttgagaagtatgtagtcaaagatggaaaactgcctttgcttctgagccggatgaaggaagtagggaaagtatttcttgctaccaacagtgactataaatatacagataaaattatgacttacctgtttgacttcccacatggccccaagcctgggagctcccatcgaccatggcagtcctactttgacttgatcttggtggatgcacggaaaccactcttttttggagaaggcacagtactgcgtcaggtggatactaaaactggcaagctgaaaattggtacctacacagggcccctacagcatggtatcgtctactcaggaggttcttctgatacgatctgtgacctgttgggagccaagggaaaagacattttgtatattggagatcacatttttggggacattttaaaatcaaagaaacggcaagggtggcgaacttttttggtgattcctgaactcgcacaggagctacatgtctggactgacaagagttcacttttcgaagaacttcagagcttggatattttcttggctgaactctacaagcatcttgacagcagtagcaatgagcgtccagacatcagttccatccagagacgtattaagaaagtaactcatgacatggacatgtgctatgggatgatgggaagcctgtttcgcagtggctcccggcagaccctttttgccagtcaagtgatgcgttatgctgacctctatgcagcatctttcatcaacctgctgtattaccctttcagctacctcttcagggctgcccatgtcttgatgcctcatgaatcaacggtggagcacacacacgtagatatcaatgagatggagtctcctcttgccacccggaaccgcacatcagtggatttcaaagacactgactacaagcggcaccagctgacacggtcaattagtgagattaaacctcccaacctcttcccactggccccccaggaaattacacactgccatgacgaagatgatgatgaagaggaggaggaggaggaagaataaggaggaaaaccaaaaccccaagcacccattaaacaagtcctggcaggactcacaggaacaaacgaggtccctgttagggttctactcgggggagggagggggctccatgaaaggtacgtctgaaaagtttctgaagattttattatcatagatacttgttttggttttgtgtatctgtactctctgcagatggtccaaaattgtaatggagtctgtattagaagaaaataagggtaaaatcaggctgaactgcatgtatatggctccactgtggcttgtgacacttttaaaatcatccgtatgtcagtgtatctggatacacgaggaaaaggaaagagtctcagagtggaacaaagagtgggaagaggtgatctgtaatgttacaaattgtgctattactccaaggtccaacttttccagtgcattacatggtattgtatatcagtggagaaatgtattatttccatgatcaaatgtagtctctgttaaggtcaagttttcttttataagcctttaattcatcctcagtgactctggcaaggctgcttctctatcactggctttgcacagaagtatgctctacttgcgttgctttagggcaggattctattttgagggaaaagacagtatccttattaccttttgtttgtttaatagcacaaatgcttatttgttatccaaaaacaacctccttcttatctgtgataaatctatagaaagaatttagctgcaagtggacaaaggaacaagcccccagaaaagaaagggaagaactgccttcttatactacagaacatgcattagtgtgggctatatagctgtggctcatgctacccaattccagatttctttgtcctctaagagttgattgctgtatattaaaattgaacatcagaggatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtga

SEQ ID NO: 43046 - DNA, 3521 bp, Homo sapiens
gggcgcaggcagaatgccaagggatggagaccctcagaagggcaaagccggtgttccatcgtttgaagatctccagacccgcgggacagacagacgcagcgcggtcagggagcgtcggcttcgccgaactctgcggcggagctgggggacggaacagcgcgccggtccctggccgggcgcgagcagaggggcggcgcggggcggtgccgggcggcgggggcggggagggcgcgcgttgaggcggctgcggcagttgcgcgctgggattgttgcggtgcgctggagccgaatacaaaatacagttaaaataaaatgtcaacctcctggagtgatcggttacagaatgcagcagatatgcctgctaacatggataagcatgccctgaaaaagtatcgtcgagaagcctatcatcgggtgtttgtgaaccgaagtttagcaatggaaaagataaagtgttttggttttgatatggattatacccttgctgtgtacaagtccccagagtatgagtcccttggttttgagcttactgtggagagattagtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggaccagaaactagagaacagtatccaaataaatttatccagcgagatgatactgaaagattttacattctgaacacactattcaacctaccagagacctacctgttggcctgcctagtagatttttttactaattgtcccagatataccagttgtgaaacaggatttaaagatggggacctcttcatgtcctaccggagtatgttccaggatgtaagagatgctgttgactgggttcattacaagggctcccttaaggaaaagacagttgaaaatcttgagaagtatgtagtcaaagatggaaaactgcctttgcttctgagccggatgaaggaagtagggaaagtatttcttgctaccaacagtgactataaatatacagataaaattatgacttacctgtttgacttcccacatggccccaagcctgggagctcccatcgaccatggcagtcctactttgacttgatcttggtggatgcacggaaaccactcttttttggagaaggcacagtactgcgtcaggtggatactaaaactggcaagctgaaaattggtacctacacagggcccctacagcatggtatcgtctactcaggaggttcttctgatacgatctgtgacctgttgggagccaagggaaaagacattttgtatattggagatcacatttttggggacattttaaaatcaaagaaacggcaagggtggcgaacttttttggtgattcctgaactcgcacaggagctacatgtctggactgacaagagttcacttttcgaagaacttcagagcttggatattttcttggctgaactctacaagcatcttgacagcagtagcaatgagcgtccagacatcagttccatccagagacgtattaagaaagtaactcatgacatggacatgtgctatgggatgatgggaagcctgtttcgcagtggctcccggcagaccctttttgccagtcaagtgatgcgttatgctgacctctatgcagcatctttcatcaacctgctgtattaccctttcagctacctcttcagggctgcccatgtcttgatgcctcatgaatcaacggtggagcacacacacgtagatatcaatgagatggagtctcctcttgccacccggaaccgcacatcagtggatttcaaagacactgactacaagcggcaccagctgacacggtcaattagtgagattaaacctcccaacctcttcccactggccccccaggaaattacacactgccatgacgaagatgatgatgaagaggaggaggaggaggaagaataaggaggaaaaccaaaaccccaagcacccattaaacaagtcctggcaggactcacaggaacaaacgaggtccctgttagggttctactcgggggagggagggggctccatgaaaggtacgtctgaaaagtttctgaagattttattatcatagatacttgttttggttttgtgtatctgtactctctgcagatggtccaaaattgtaatggagtctgtattagaagaaaataagggtaaaatcaggctgaactgcatgtatatggctccactgtggcttgtgacacttttaaaatcatccgtatgtcagtgtatctggatacacgaggaaaaggaaagagtctcagagtggaacaaagagtgggaagaggtgatctgtaatgttacaaattgtgctattactccaaggtccaacttttccagtgcattacatggtattgtatatcagtggagaaatgtattatttccatgatcaaatgtagtctctgttaaggtcaagttttcttttataagcctttaattcatcctcagtgactctggcaaggctgcttctctatcactggctttgcacagaagtatgctctacttgcgttgctttagggcaggattctattttgagggaaaagacagtatccttattaccttttgtttgtttaatagcacaaatgcttatttgttatccaaaaacaacctccttcttatctgtgataaatctatagaaagaatttagctgcaagtggacaaaggaacaagcccccagaaaagaaagggaagaactgccttcttatactacagaacatgcattagtgtgggctatatagctgtggctcatgctacccaattccagatttctttgtcctctaagagttgattgctgtatattaaaattgaacatcagaggatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtga

SEQ ID NO: 43047 - DNA, 4403 bp, Homo sapiens
gggcgcaggcagaatgccaagggatggagaccctcagaagggcaaagccggtgttccatcgtttgaagatctccagacccgcgggacagacagacgcagcgcggtcagggagcgtcggcttcgccgaactctgcggcggagctgggggacggaacagcgcgccggtccctggccgggcgcgagcagaggggcggcgcggggcggtgccgggcggcgggggcggggagggcgcgcgttgaggcggctgcggcagttgcgcgctgggattgttgcggtgcgctggagccgaatacaaaatacagttaaaataaaatgtcaacctcctggagtgatcggttacagaatgcagcagatatgcctgctaacatggataagcatgccctgaaaaagtatcgtcgagaagcctatcatcgggtgtttgtgaaccgaagtttagcaatggaaaagataaagtgttttggttttgatatggattatacccttgctgtgtacaagtccccagagtatgagtcccttggttttgagcttactgtggagagattagtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggaccagaaactagagaacagtatccaaataaatttatccagcgagatgatactgaaagattttacattctgaacacactattcaacctaccagagacctacctgttggcctgcctagtagatttttttactaattgtcccagatataccagttgtgaaacaggatttaaagatggggacctcttcatgtcctaccggagtatgttccaggatgtaagagatgctgttgactgggttcattacaagggctcccttaaggaaaagacagttgaaaatcttgagaagtatgtagtcaaagatggaaaactgcctttgcttctgagccggatgaaggaagtagggaaagtatttcttgctaccaacagtgactataaatatacagataaaattatgacttacctgtttgacttcccacatggccccaagcctgggagctcccatcgaccatggcagtcctactttgacttgatcttggtggatgcacggaaaccactcttttttggagaaggcacagtactgcgtcaggtggatactaaaactggcaagctgaaaattggtacctacacagggcccctacagcatggtatcgtctactcaggaggttcttctgatacgatctgtgacctgttgggagccaagggaaaagacattttgtatattggagatcacatttttggggacattttaaaatcaaagaaacggcaagggtggcgaacttttttggtgattcctgaactcgcacaggagctacatgtctggactgacaagagttcacttttcgaagaacttcagagcttggatattttcttggctgaactctacaagcatcttgacagcagtagcaatgagcgtccagacatcagttccatccagagacgtattaagaaagtaactcatgacatggacatgtgctatgggatgatgggaagcctgtttcgcagtggctcccggcagaccctttttgccagtcaagtgatgcgttatgctgacctctatgcagcatctttcatcaacctgctgtattaccctttcagctacctcttcagggctgcccatgtcttgatgcctcatgaatcaacggtggagcacacacacgtagatatcaatgagatggagtctcctcttgccacccggaaccgcacatcagtggatttcaaagacactgactacaagcggcaccagctgacacggtcaattagtgagattaaacctcccaacctcttcccactggccccccaggaaattacacactgccatgacgaagatgatgatgaagaggaggaggaggaggaagaataaggaggaaaaccaaaaccccaagcacccattaaacaagtcctggcaggactcacaggaacaaacgaggtccctgttagggttctactcgggggagggagggggctccatgaaaggtacgtctgaaaagtttctgaagattttattatcatagatacttgttttggttttgtgtatctgtactctctgcagatggtccaaaattgtaatggagtctgtattagaagaaaataagggtaaaatcaggctgaactgcatgtatatggctccactgtggcttgtgacacttttaaaatcatccgtatgtcagtgtatctggatacacgaggaaaaggaaagagtctcagagtggaacaaagagtgggaagaggtgatctgtaatgttacaaattgtgctattactccaaggtccaacttttccagtgcattacatggtattgtatatcagtggagaaatgtattatttccatgatcaaatgtagtctctgttaaggtcaagttttcttttataagcctttaattcatcctcagtgactctggcaaggctgcttctctatcactggctttgcacagaagtatgctctacttgcgttgctttagggcaggattctattttgagggaaaagacagtatccttattaccttttgtttgtttaatagcacaaatgcttatttgttatccaaaaacaacctccttcttatctgtgataaatctatagaaagaatttagctgcaagtggacaaaggaacaagcccccagaaaagaaagggaagaactgccttcttatactacagaacatgcattagtgtgggctatatagctgtggctcatgctacccaattccagatttctttgtcctctaagagttgattgctgtatattaaaattgaacatcagaggatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtgactttgacctattctgtagtacaactgtaatagctattggtcttcaagtgggtttagatttggtgacatcagtttgatattctcttaaaggaaataaatattcaagaactgattatcatgcaacaaacacaaaaaacaaaaaacaaaaaaaacacaaaacaaaaaaacacaaacaacaacaaaaaaaaacacacacacaaaaaacaaaaaaacaacaaaacaacaaaacaaaaaaaaaaaaaaaaaaaaaaaaggagaggagagaagagagagagaagcagaaacggcggggggcggcgctgctactactagacgatgtagaggggtcgggcgcggcgagctagtgatggggggagggcggcgggcgtaggagtgatgatggcccactacgcgagaggggggggggggagtagagcggagcgcggggcgggtgtctccaaacaagaaagagagacagagaggaagaacaggagaataagacgacagagagagagaactaaaagaagcaggatgggagcaatatgatagaggagggggaagaaggagggaggaccagtaacactagggaaggaaggaagagcaaaaggaggataatacaggaaagagacgacgggggagatagaagggaagcagagaggaggacggagggagtagaaggaggaagtaggaggagaaggggggagaccgaagaggggagcgaacgtgaagacggagggatgaagaggagaagaggagggcgaggaagggaggggggagaagaagaagagagaggggggcagagtcgaagaggggggagcagcaaagcgaacgaagcgagagaaagcagaggaaagcagcagagaggcacgaaaaggtaaaaaaagaaagaaaaaggaaaagaacg

SEQ ID NO: 43048 - DNA, 3619 bp, Homo sapiens
gggcgcaggcagaatgccaagggatggagaccctcagaagggcaaagccggtgttccatcgtttgaagatctccagacccgcgggacagacagacgcagcgcggtcagggagcgtcggcttcgccgaactctgcggcggagctgggggacggaacagcgcgccggtccctggccgggcgcgagcagaggggcggcgcggggcggtgccgggcggcgggggcggggagggcgcgcgttgaggcggctgcggcagttgcgcgctgggattgttgcggtgcgctggagccgagtttcgctctgctgcccaggctggagtacagtgatgtgatctcctgacgtcaagtgatccattcgcctcggcctcccaaagttctgggattacaagtaatacaaaatacagttaaaataaaatgtcaacctcctggagtgatcggttacagaatgcagcagatatgcctgctaacatggataagcatgccctgaaaaagtatcgtcgagaagcctatcatcgggtgtttgtgaaccgaagtttagcaatggaaaagataaagtgttttggttttgatatggattatacccttgctgtgtacaagtccccagagtatgagtcccttggttttgagcttactgtggagagattagtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggaccagaaactagagaacagtatccaaataaatttatccagcgagatgatactgaaagattttacattctgaacacactattcaacctaccagagacctacctgttggcctgcctagtagatttttttactaattgtcccagatataccagttgtgaaacaggatttaaagatggggacctcttcatgtcctaccggagtatgttccaggatgtaagagatgctgttgactgggttcattacaagggctcccttaaggaaaagacagttgaaaatcttgagaagtatgtagtcaaagatggaaaactgcctttgcttctgagccggatgaaggaagtagggaaagtatttcttgctaccaacagtgactataaatatacagataaaattatgacttacctgtttgacttcccacatggccccaagcctgggagctcccatcgaccatggcagtcctactttgacttgatcttggtggatgcacggaaaccactcttttttggagaaggcacagtactgcgtcaggtggatactaaaactggcaagctgaaaattggtacctacacagggcccctacagcatggtatcgtctactcaggaggttcttctgatacgatctgtgacctgttgggagccaagggaaaagacattttgtatattggagatcacatttttggggacattttaaaatcaaagaaacggcaagggtggcgaacttttttggtgattcctgaactcgcacaggagctacatgtctggactgacaagagttcacttttcgaagaacttcagagcttggatattttcttggctgaactctacaagcatcttgacagcagtagcaatgagcgtccagacatcagttccatccagagacgtattaagaaagtaactcatgacatggacatgtgctatgggatgatgggaagcctgtttcgcagtggctcccggcagaccctttttgccagtcaagtgatgcgttatgctgacctctatgcagcatctttcatcaacctgctgtattaccctttcagctacctcttcagggctgcccatgtcttgatgcctcatgaatcaacggtggagcacacacacgtagatatcaatgagatggagtctcctcttgccacccggaaccgcacatcagtggatttcaaagacactgactacaagcggcaccagctgacacggtcaattagtgagattaaacctcccaacctcttcccactggccccccaggaaattacacactgccatgacgaagatgatgatgaagaggaggaggaggaggaagaataaggaggaaaaccaaaaccccaagcacccattaaacaagtcctggcaggactcacaggaacaaacgaggtccctgttagggttctactcgggggagggagggggctccatgaaaggtacgtctgaaaagtttctgaagattttattatcatagatacttgttttggttttgtgtatctgtactctctgcagatggtccaaaattgtaatggagtctgtattagaagaaaataagggtaaaatcaggctgaactgcatgtatatggctccactgtggcttgtgacacttttaaaatcatccgtatgtcagtgtatctggatacacgaggaaaaggaaagagtctcagagtggaacaaagagtgggaagaggtgatctgtaatgttacaaattgtgctattactccaaggtccaacttttccagtgcattacatggtattgtatatcagtggagaaatgtattatttccatgatcaaatgtagtctctgttaaggtcaagttttcttttataagcctttaattcatcctcagtgactctggcaaggctgcttctctatcactggctttgcacagaagtatgctctacttgcgttgctttagggcaggattctattttgagggaaaagacagtatccttattaccttttgtttgtttaatagcacaaatgcttatttgttatccaaaaacaacctccttcttatctgtgataaatctatagaaagaatttagctgcaagtggacaaaggaacaagcccccagaaaagaaagggaagaactgccttcttatactacagaacatgcattagtgtgggctatatagctgtggctcatgctacccaattccagatttctttgtcctctaagagttgattgctgtatattaaaattgaacatcagaggatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtga

SEQ ID NO: 43049 - DNA, 3306 bp, Homo sapiens
tcggacgagggatgtgcgtgcgctggagccgagtttcgctctgctgcccaggctggagtacagtgatgtgatctcctgacgtcaagtgatccattcgcctcggcctcccaaagttctgggattacaagtaatacaaaatacagttaaaataaaatgtcaacctcctggagtgatcggttacagaatgcagcagatatgcctgctaacatggataagcatgccctgaaaaagtatcgtcgagaagcctatcatcgggtgtttgtgaaccgaagtttagcaatggaaaagataaagtgttttggttttgatatggattatacccttgctgtgtacaagtccccagagtatgagtcccttggttttgagcttactgtggagagattagtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggaccagaaactagagaacagtatccaaataaatttatccagcgagatgatactgaaagattttacattctgaacacactattcaacctaccagagacctacctgttggcctgcctagtagatttttttactaattgtcccagatataccagttgtgaaacaggatttaaagatggggacctcttcatgtcctaccggagtatgttccaggatgtaagagatgctgttgactgggttcattacaagggctcccttaaggaaaagacagttgaaaatcttgagaagtatgtagtcaaagatggaaaactgcctttgcttctgagccggatgaaggaagtagggaaagtatttcttgctaccaacagtgactataaatatacagataaaattatgacttacctgtttgacttcccacatggccccaagcctgggagctcccatcgaccatggcagtcctactttgacttgatcttggtggatgcacggaaaccactcttttttggagaaggcacagtactgcgtcaggtggatactaaaactggcaagctgaaaattggtacctacacagggcccctacagcatggtatcgtctactcaggaggttcttctgatacgatctgtgacctgttgggagccaagggaaaagacattttgtatattggagatcacatttttggggacattttaaaatcaaagaaacggcaagggtggcgaacttttttggtgattcctgaactcgcacaggagctacatgtctggactgacaagagttcacttttcgaagaacttcagagcttggatattttcttggctgaactctacaagcatcttgacagcagtagcaatgagcgtccagacatcagttccatccagagacgtattaagaaagtaactcatgacatggacatgtgctatgggatgatgggaagcctgtttcgcagtggctcccggcagaccctttttgccagtcaagtgatgcgttatgctgacctctatgcagcatctttcatcaacctgctgtattaccctttcagctacctcttcagggctgcccatgtcttgatgcctcatgaatcaacggtggagcacacacacgtagatatcaatgagatggagtctcctcttgccacccggaaccgcacatcagtggatttcaaagacactgactacaagcggcaccagctgacacggtcaattagtgagattaaacctcccaacctcttcccactggccccccaggaaattacacactgccatgacgaagatgatgatgaagaggaggaggaggaggaagaataaggaggaaaaccaaaaccccaagcacccattaaacaagtcctggcaggactcacaggaacaaacgaggtccctgttagggttctactcgggggagggagggggctccatgaaaggtacgtctgaaaagtttctgaagattttattatcatagatacttgttttggttttgtgtatctgtactctctgcagatggtccaaaattgtaatggagtctgtattagaagaaaataagggtaaaatcaggctgaactgcatgtatatggctccactgtggcttgtgacacttttaaaatcatccgtatgtcagtgtatctggatacacgaggaaaaggaaagagtctcagagtggaacaaagagtgggaagaggtgatctgtaatgttacaaattgtgctattactccaaggtccaacttttccagtgcattacatggtattgtatatcagtggagaaatgtattatttccatgatcaaatgtagtctctgttaaggtcaagttttcttttataagcctttaattcatcctcagtgactctggcaaggctgcttctctatcactggctttgcacagaagtatgctctacttgcgttgctttagggcaggattctattttgagggaaaagacagtatccttattaccttttgtttgtttaatagcacaaatgcttatttgttatccaaaaacaacctccttcttatctgtgataaatctatagaaagaatttagctgcaagtggacaaaggaacaagcccccagaaaagaaagggaagaactgccttcttatactacagaacatgcattagtgtgggctatatagctgtggctcatgctacccaattccagatttctttgtcctctaagagttgattgctgtatatttagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtga

SEQ ID NO: 43050 - DNA, 3447 bp, Homo sapiens
gggcgcaggcagaatgccaagggatggagaccctcagaagggcaaagccggtgttccatcgtttgaagatctccagacccgcgggacagacagacgcagcgcggtcagggagcgtcggcttcgccgaactctgcggcggagctgggggacggaacagcgcgccggtccctggccgggcgcgagcagaggggcggcgcggggcggtgccgggcggcgggggcggggagggcgcgcgttgaggcggctgcggcagttgcgcgctgggattgttgcggtgcgctggagccgaatacaaaatacagttaaaataaaatgtcaacctcctggagtgatcggttacagaatgcagcagatatgcctgctaacatggataagcatgccctgaaaaagtatcgtcgagaagcctatcatcgtgtacaagtccccagagtatgagtcccttggttttgagcttactgtggagagattagtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggaccagaaactagagaacagtatccaaataaatttatccagcgagatgatactgaaagattttacattctgaacacactattcaacctaccagagacctacctgttggcctgcctagtagatttttttactaattgtcccagatataccagttgtgaaacaggatttaaagatggggacctcttcatgtcctaccggagtatgttccaggatgtaagagatgctgttgactgggttcattacaagggctcccttaaggaaaagacagttgaaaatcttgagaagtatgtagtcaaagatggaaaactgcctttgcttctgagccggatgaaggaagtagggaaagtatttcttgctaccaacagtgactataaatatacagataaaattatgacttacctgtttgacttcccacatggccccaagcctgggagctcccatcgaccatggcagtcctactttgacttgatcttggtggatgcacggaaaccactcttttttggagaaggcacagtactgcgtcaggtggatactaaaactggcaagctgaaaattggtacctacacagggcccctacagcatggtatcgtctactcaggaggttcttctgatacgatctgtgacctgttgggagccaagggaaaagacattttgtatattggagatcacatttttggggacattttaaaatcaaagaaacggcaagggtggcgaacttttttggtgattcctgaactcgcacaggagctacatgtctggactgacaagagttcacttttcgaagaacttcagagcttggatattttcttggctgaactctacaagcatcttgacagcagtagcaatgagcgtccagacatcagttccatccagagacgtattaagaaagtaactcatgacatggacatgtgctatgggatgatgggaagcctgtttcgcagtggctcccggcagaccctttttgccagtcaagtgatgcgttatgctgacctctatgcagcatctttcatcaacctgctgtattaccctttcagctacctcttcagggctgcccatgtcttgatgcctcatgaatcaacggtggagcacacacacgtagatatcaatgagatggagtctcctcttgccacccggaaccgcacatcagtggatttcaaagacactgactacaagcggcaccagctgacacggtcaattagtgagattaaacctcccaacctcttcccactggccccccaggaaattacacactgccatgacgaagatgatgatgaagaggaggaggaggaggaagaataaggaggaaaaccaaaaccccaagcacccattaaacaagtcctggcaggactcacaggaacaaacgaggtccctgttagggttctactcgggggagggagggggctccatgaaaggtacgtctgaaaagtttctgaagattttattatcatagatacttgttttggttttgtgtatctgtactctctgcagatggtccaaaattgtaatggagtctgtattagaagaaaataagggtaaaatcaggctgaactgcatgtatatggctccactgtggcttgtgacacttttaaaatcatccgtatgtcagtgtatctggatacacgaggaaaaggaaagagtctcagagtggaacaaagagtgggaagaggtgatctgtaatgttacaaattgtgctattactccaaggtccaacttttccagtgcattacatggtattgtatatcagtggagaaatgtattatttccatgatcaaatgtagtctctgttaaggtcaagttttcttttataagcctttaattcatcctcagtgactctggcaaggctgcttctctatcactggctttgcacagaagtatgctctacttgcgttgctttagggcaggattctattttgagggaaaagacagtatccttattaccttttgtttgtttaatagcacaaatgcttatttgttatccaaaaacaacctccttcttatctgtgataaatctatagaaagaatttagctgcaagtggacaaaggaacaagcccccagaaaagaaagggaagaactgccttcttatactacagaacatgcattagtgtgggctatatagctgtggctcatgctacccaattccagatttctttgtcctctaagagttgattgctgtatattaaaattgaacatcagaggatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtga

SEQ ID NO: 43051 - DNA, 3253 bp, Homo sapiens
atgcctgtaatcccaggactttgagaggccgagataggagggttgcttgagcccaggagttcaagatgagccagagcaacatagggtgtttgtgaaccgaagtttagcaatggaaaagataaagtgttttggttttgatatggattatacccttgctggagagccagtgtaactccttcaagactggagtgacacacactgcatctgcatctgcctcattgtacaagtccccagagtatgagtcccttggttttgagcttactgtggagagattagtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggaccagaaactagagaacagtatccaaataaatttatccagcgagatgatactgaaagattttacattctgaacacactattcaacctaccagagacctacctgttggcctgcctagtagatttttttactaattgtcccagatataccagttgtgaaacaggatttaaagatggggacctcttcatgtcctaccggagtatgttccaggatgtaagagatgctgttgactgggttcattacaagggctcccttaaggaaaagacagttgaaaatcttgagaagtatgtagtcaaagatggaaaactgcctttgcttctgagccggatgaaggaagtagggaaagtatttcttgctaccaacagtgactataaatatacagataaaattatgacttacctgtttgacttcccacatggccccaagcctgggagctcccatcgaccatggcagtcctactttgacttgatcttggtggatgcacggaaaccactcttttttggagaaggcacagtactgcgtcaggtggatactaaaactggcaagctgaaaattggtacctacacagggcccctacagcatggtatcgtctactcaggaggttcttctgatacgatctgtgacctgttgggagccaagggaaaagacattttgtatattggagatcacatttttggggacattttaaaatcaaagaaacggcaagggtggcgaacttttttggtgattcctgaactcgcacaggagctacatgtctggactgacaagagttcacttttcgaagaacttcagagcttggatattttcttggctgaactctacaagcatcttgacagcagtagcaatgagcgtccagacatcagttccatccagagacgtattaagaaagtaactcatgacatggacatgtgctatgggatgatgggaagcctgtttcgcagtggctcccggcagaccctttttgccagtcaagtgatgcgttatgctgacctctatgcagcatctttcatcaacctgctgtattaccctttcagctacctcttcagggctgcccatgtcttgatgcctcatgaatcaacggtggagcacacacacgtagatatcaatgagatggagtctcctcttgccacccggaaccgcacatcagtggatttcaaagacactgactacaagcggcaccagctgacacggtcaattagtgagattaaacctcccaacctcttcccactggccccccaggaaattacacactgccatgacgaagatgatgatgaagaggaggaggaggaggaagaataaggaggaaaaccaaaaccccaagcacccattaaacaagtcctggcaggactcacaggaacaaacgaggtccctgttagggttctactcgggggagggagggggctccatgaaaggtacgtctgaaaagtttctgaagattttattatcatagatacttgttttggttttgtgtatctgtactctctgcagatggtccaaaattgtaatggagtctgtattagaagaaaataagggtaaaatcaggctgaactgcatgtatatggctccactgtggcttgtgacacttttaaaatcatccgtatgtcagtgtatctggatacacgaggaaaaggaaagagtctcagagtggaacaaagagtgggaagaggtgatctgtaatgttacaaattgtgctattactccaaggtccaacttttccagtgcattacatggtattgtatatcagtggagaaatgtattatttccatgatcaaatgtagtctctgttaaggtcaagttttcttttataagcctttaattcatcctcagtgactctggcaaggctgcttctctatcactggctttgcacagaagtatgctctacttgcgttgctttagggcaggattctattttgagggaaaagacagtatccttattaccttttgtttgtttaatagcacaaatgcttatttgttatccaaaaacaacctccttcttatctgtgataaatctatagaaagaatttagctgcaagtggacaaaggaacaagcccccagaaaagaaagggaagaactgccttcttatactacagaacatgcattagtgtgggctatatagctgtggctcatgctacccaattccagatttctttgtcctctaagagttgattgctgtatattaaaattgaacatcagaggatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtga

SEQ ID NO: 43052 - DNA, 3185 bp, Homo sapiens
tcggacgagggatgtgcgtgcgctggagccgagtttcgctctgctgcccaggctggagtacagtgatgtgatctcctgacgtcaagtgatccattcgcctcggcctcccaaagttctgggattacaagtaatacaaaatacagttaaaataaaatgtcaacctcctggagtgatcggttacagaatgcagcagatatgcctgctaacatggataagcatgccctgaaaaagtatcgtcgagaagcctatcatcgggtgtttgtgaaccgaagtttagcaatggaaaagataaagtgttttggttttgatatggattatacccttgctgtgtacaagtccccagagtatgagtcccttggttttgagcttactgtggagagattagtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggaccagaaactagagaacagtatccaaataaatttatccagcgagatgatactgaaagattttacattctgaacacactattcaacctaccagagacctacctgttggcctgcctagtagatttttttactaattgtcccagatataccagttgtgaaacaggatttaaagatggggacctcttcatgtcctaccggagtatgttccaggatgtaagagatgctgttgactgggttcattacaagggctcccttaaggaaaagacagttgaaaatcttgagaagtatgtagtcaaagatggaaaactgcctttgcttctgagccggatgaaggaagtagggaaagtatttcttgctaccaacagtgactataaatatacagataaaattatgacttacctgtttgacttcccacatggccccaagcctgggagctcccatcgaccatggcagtcctactttgacttgatcttggtggatgcacggaaaccactcttttttggagaaggcacagtactgcgtcaggtggatactaaaactggcaagctgaaaattggtacctacacagggcccctacagcatggtatcgtctactcaggaggttcttctgatacgatctgtgacctgttgggagccaagggaaaagacattttgtatattggagatcacatttttggggacattttaaaatcaaagaaacggcaagggtggcgaacttttttggtgattcctgaactcgcacaggagctacatgtctggactgacaagagttcacttttcgaagaacttcagagcttggatattttcttggctgaactctacaagcatcttgacagcagtagcaatgagcgtccagacatcagttccatccagagacgtattaagatgcctcatgaatcaacggtggagcacacacacgtagatatcaatgagatggagtctcctcttgccacccggaaccgcacatcagtggatttcaaagacactgactacaagcggcaccagctgacacggtcaattagtgagattaaacctcccaacctcttcccactggccccccaggaaattacacactgccatgacgaagatgatgatgaagaggaggaggaggaggaagaataaggaggaaaaccaaaaccccaagcacccattaaacaagtcctggcaggactcacaggaacaaacgaggtccctgttagggttctactcgggggagggagggggctccatgaaaggtacgtctgaaaagtttctgaagattttattatcatagatacttgttttggttttgtgtatctgtactctctgcagatggtccaaaattgtaatggagtctgtattagaagaaaataagggtaaaatcaggctgaactgcatgtatatggctccactgtggcttgtgacacttttaaaatcatccgtatgtcagtgtatctggatacacgaggaaaaggaaagagtctcagagtggaacaaagagtgggaagaggtgatctgtaatgttacaaattgtgctattactccaaggtccaacttttccagtgcattacatggtattgtatatcagtggagaaatgtattatttccatgatcaaatgtagtctctgttaaggtcaagttttcttttataagcctttaattcatcctcagtgactctggcaaggctgcttctctatcactggctttgcacagaagtatgctctacttgcgttgctttagggcaggattctattttgagggaaaagacagtatccttattaccttttgtttgtttaatagcacaaatgcttatttgttatccaaaaacaacctccttcttatctgtgataaatctatagaaagaatttagctgcaagtggacaaaggaacaagcccccagaaaagaaagggaagaactgccttcttatactacagaacatgcattagtgtgggctatatagctgtggctcatgctacccaattccagatttctttgtcctctaagagttgattgctgtatattaaaattgaacatcagaggatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtga

SEQ ID NO: 43053 - DNA, 2498 bp, Homo sapiens
taattagccgtatctctcttttgaaattaagagttttggtcttaactgaaacagtcaaacaaacccactaattgaaaagagtaagtgccattcatttggctgtctggccaagtagcactggtggtggggggtgggatgggagggttgtggggtgaggggaggattgtgataggatgataaagtattacaaaatccatattcttcatacagaaaactggcaagctgaaaattggtacctacacagggcccctacagcatggtatcgtctactcaggaggttcttctgatacgatctgtgacctgttgggagccaagggaaaagacattttgtatattggagatcacatttttggggacattttaaaatcaaagaaacggcaagggtggcgaacttttttggtgattcctgaactcgcacaggagctacatgtctggactgacaagagttcacttttcgaagaacttcagagcttggatattttcttggctgaactctacaagcatcttgacagcagtagcaatgagcgtccagacatcagttccatccagagacgtattaagaaagtaactcatgacatggacatgtgctatgggatgatgggaagcctgtttcgcagtggctcccggcagaccctttttgccagtcaagtgatgcgttatgctgacctctatgcagcatctttcatcaacctgctgtattaccctttcagctacctcttcagggctgcccatgtcttgatgcctcatgaatcaacggtggagcacacacacgtagatatcaatgagatggagtctcctcttgccacccggaaccgcacatcagtggatttcaaagacactgactacaagcggcaccagctgacacggtcaattagtgagattaaacctcccaacctcttcccactggccccccaggaaattacacactgccatgacgaagatgatgatgaagaggaggaggaggaggaagaataaggaggaaaaccaaaaccccaagcacccattaaacaagtcctggcaggactcacaggaacaaacgaggtccctgttagggttctactcgggggagggagggggctccatgaaaggtacgtctgaaaagtttctgaagattttattatcatagatacttgttttggttttgtgtatctgtactctctgcagatggtccaaaattgtaatggagtctgtattagaagaaaataagggtaaaatcaggctgaactgcatgtatatggctccactgtggcttgtgacacttttaaaatcatccgtatgtcagtgtatctggatacacgaggaaaaggaaagagtctcagagtggaacaaagagtgggaagaggtgatctgtaatgttacaaattgtgctattactccaaggtccaacttttccagtgcattacatggtattgtatatcagtggagaaatgtattatttccatgatcaaatgtagtctctgttaaggtcaagttttcttttataagcctttaattcatcctcagtgactctggcaaggctgcttctctatcactggctttgcacagaagtatgctctacttgcgttgctttagggcaggattctattttgagggaaaagacagtatccttattaccttttgtttgtttaatagcacaaatgcttatttgttatccaaaaacaacctccttcttatctgtgataaatctatagaaagaatttagctgcaagtggacaaaggaacaagcccccagaaaagaaagggaagaactgccttcttatactacagaacatgcattagtgtgggctatatagctgtggctcatgctacccaattccagatttctttgtcctctaagagttgattgctgtatattaaaattgaacatcagaggatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtga

SEQ ID NO: 43054 - DNA, 1812 bp, Homo sapiens
  misc_feature (40)..(40): n is a, c, g, or t
aggtgatctagaggatctcctgctgctccctcttcagggnctgccatgtttgatgcctcatgaatcaacggtggagcacacacacgtagatatcaatgagatggagtctcctcttgccacccggaaccgcacatcagtggatttcaaagacactgactacaagcggcaccagctgacacggtcaattagtgagattaaacctcccaacctcttcccactggccccccaggaaattacacactgccatgacgaagatgatgatgaagaggaggaggaggaggaagaataaggaggaaaaccaaaaccccaagcacccattaaacaagtcctggcaggactcacaggaacaaacgaggtccctgttagggttctactcgggggagggagggggctccatgaaaggtacgtctgaaaagtttctgaagattttattatcatagatacttgttttggttttgtgtatctgtactctctgcagatggtccaaaattgtaatggagtctgtattagaagaaaataagggtaaaatcaggctgaactgcatgtatatggctccactgtggcttgtgacacttttaaaatcatccgtatgtcagtgtatctggatacacgaggaaaaggaaagagtctcagagtggaacaaagagtgggaagaggtgatctgtaatgttacaaattgtgctattactccaaggtccaacttttccagtgcattacatggtattgtatatcagtggagaaatgtattatttccatgatcaaatgtagtctctgttaaggtcaagttttcttttataagcctttaattcatcctcagtgactctggcaaggctgcttctctatcactggctttgcacagaagtatgctctacttgcgttgctttagggcaggattctattttgagggaaaagacagtatccttattaccttttgtttgtttaatagcacaaatgcttatttgttatccaaaaacaacctccttcttatctgtgataaatctatagaaagaatttagctgcaagtggacaaaggaacaagcccccagaaaagaaagggaagaactgccttcttatactacagaacatgcattagtgtgggctatatagctgtggctcatgctacccaattccagatttctttgtcctctaagagttgattgctgtatattaaaattgaacatcagaggatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtga

SEQ ID NO: 43055 - DNA, 1781 bp, Homo sapiens
tcggacgagggatgtgcgtgcgctggagccgagtttcgctctgctgcccaggctggagtacagtgatgtgatctcctgacgtcaagtgatccattcgcctcggcctcccaaagttctgggattacaagtaatacaaaatacagttaaaataaaatgtcaacctcctggagtgatcggttacagaatgcagcagatatgcctgctaacatggataagcatgccctgaaaaagtatcgtcgagaagcctatcatcgggtgtttgtgaaccgaagtttagcaatggaaaagataaagtgttttggttttgatatggattatacccttgctgtgtacaagtccccagagtatgagtcccttggttttgagcttactgtggagagattagtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggaccagaaactagagaacagtatccaaataaatttatccagcgagatgatactgaaagattttacattctgaacacactattcaacctaccagagacctacctgttggcctgcctagtagatttttttactaattgtcccagatataccagttgtgaaacaggatttaaagatggggacctcttcatgtcctaccggagtatgttccaggatgtaagagatgctgttgactgggttcattacaagggctcccttaaggaaaagacagttgaaaatcttgagaagtatgtagtcaaagatagtaaaagtagcagaatacagtattttctcaaagtactgtggtaaagatttcttgttttcagtttttgtgcttcctattttcacccacctcccttatttcaagaaagaacactgaatggggagggtccgggagaatttgagtgaaggaatctatttgctatgcgagaaggaaaagatatttttctttccaggcacatgaggggttagaatttcctcatttaagcgcacgtgggtgtgggtatttctaggtagcatctgcacatgtcatttcattctgcaaggtgttttataaaaccatagtgtacacactgaaagccatatctaataatctctatgtagagcatgtttaaatcagcttctgctgacctttaacacacctcacatacttcaagaaatctcaaggtaatttaaactctttcctgaggcagacatcatgaggaaggtagagatatgttgttaacagccatataacccctataaatatgtgtataattttacatgtaaatctattacatacactgtgtatactacatatgttaatactttattcatttatagtgataatgtgggcttttaagtgcaaaattctgaaatcagctaacccttaaaaggttcccccattcctgttgtggacagaaatccagtatttgacaatccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtga

SEQ ID NO: 43056 - DNA, 1162 bp, Homo sapiens
tcggacgagggatgtgcgtgcgctggagccgagtttcgctctgctgcccaggctggagtacagtgatgtgatctcctgacgtcaagtgatccattcgcctcggcctcccaaagttctgggattacaagtaatacaaaatacagttaaaataaaatgtcaacctcctggagtgatcggttacagaatgcagcagatatgcctgctaacatggataagcatgccctgaaaaagtatcgtcgagaagcctatcatcgggtgtttgtgaaccgaagtttagcaatggaaaagataaagtgttttggttttgatatggattatacccttgctgtgtacaagtccccagagtatgagtcccttggttttgagcttactgtggagagattagtttctattggctatccccaggagttgctcagctttgcttatgattctacattccctaccaggggacttgtctttgacacactgtatggaaatcttttgaaagtcgatgcctatggaaacctcttggtctgtgcacatggatttaactttataaggggaccagaaactagagaacagtatccaaataaatttatccagcgagatgatactgaaagattttacattctgaacacactattcaacctaccagagacctacctgttggcctgcctagtagatttttttactaattgtcccagatataccagttgtgaaacaggatttaaagatggggacctcttcatgtcctaccggagtatgttccaggatgtaagagatgctgttgactgggttcattacaagggctcccttaaggaaaagacagttgaaaatcttgagaagtatgtagtcaaagatggaaaactgcctttgcttctgagccggatgaaggaagtagggaaagtatttcttgctaccaacagtgactataaatatacagataacaatttcatgacgttacctgtttggatttcccacatgggcccaagcctgggagctcccattcgaaccatgggcagtccttacttgacttgatcttggtggatgcagggaaaccactctttattgggagagggaagcagcgtcaggggtcactaaatggcagtggatgggcctacacgaggcctacggtggaggcacccgaggcctagaagacgaactgtggagcggaaaatgggag

SEQ ID NO: 43057 - DNA, 1445 bp, Homo sapiens
cgtacgttgtaatccgaagctcacatgtgtcaaactataccagacatcacggttctcccagcccgtcagcatccctgtagcccacgagaagacgtctttcccccagaggttacaccatgaaattcaatctaacctcattttcctttaaaaacctattctggctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtgactttgacctattctgtagtacaactgtaatagctattggtcttcaagtgggtttagatttggtgacatcagtttgatattctcttaaaggaaataaatattcaagaactgattatcatgcaacaaacacaaaaaacaaaaaacaaaaaaaacacaaaacaaaaaaacacaaacaacaacaaaaaaaaacacacacacaaaaaacaaaaaaacaacaaaacaacaaaacaaaaaaaaaaaaaaaaaaaaaaaaggagaggagagaagagagagagaagcagaaacggcggggggcggcgctgctactactagacgatgtagaggggtcgggcgcggcgagctagtgatggggggagggcggcgggcgtaggagtgatgatggcccactacgcgagaggggggggggggagtagagcggagcgcggggcgggtgtctccaaacaagaaagagagacagagaggaagaacaggagaataagacgacagagagagagaactaaaagaagcaggatgggagcaatatgatagaggagggggaagaaggagggaggaccagtaacactagggaaggaaggaagagcaaaaggaggataatacaggaaagagacgacgggggagatagaagggaagcagagaggaggacggagggagtagaaggaggaagtaggaggagaaggggggagaccgaagaggggagcgaacgtgaagacggagggatgaagaggagaagaggagggcgaggaagggaggggggagaagaagaagagagaggggggcagagtcgaagaggggggagcagcaaagcgaacgaagcgagagaaagcagaggaaagcagcagagaggcacgaaaaggtaaaaaaagaaagaaaaaggaaaagaacg

SEQ ID NO: 43058 - DNA, 726 bp, Homo sapiens
gggcgcaggcagaatgccaagggatggagaccctcagaagggcaaagccggtgttccatcgtttgaagatctccagacccgcgggacagacagacgcagcgcggtcagggagcgtcggcttcgccgaactctgcggcggagctgggggacggaacagcgcgccggtccctggccgggcgcgagcagaggggcggcgcggggcggtgccgggcggcgggggcggggagggcgcgcgttgaggcggctgcggcagttgcgcgctgggattgttgcggtgcgctggagccgagtttcgctctgctgcccaggctggagtacagtgatgtgatctcctgacgtcaagtgatccattcgcctcggcctcccaaagttctgggattacaagtgtgagccactgccactggctgaaaaagtcttattgtggcataattgaatacaaaatacagttaaaataaaatgtcaacctcctggagtgatcggttacagaatgcagcagatatgcctgctaacatggataagcatgccctgaaaaagtatcgtcgagaagcctatcatcgagacaaagtcttgctgtgttacccaggttgatcttgaactcttgttctcaagtgatcctcctgccttgtccttccaaagtgctgggattacaagtgtgagccaccatgccccgtgtttaaaataaagtatatgtgtgcttttagaacaataaaaacattatatatatat

SEQ ID NO: 43059 - DNA, 599 bp, Homo sapiens
tcagcagagaatagatctttattagccacaaattcttctacagaaatcaaatggtcagatcataaaaatcaaattgccagttattgctgccactaatgggaaataacttatcagctgcaaaagaacaaaaaaaaacccataaaattagtagagaagaaaactaaaaatagaaaaacatcatcagcaaatttatattgctgctttggatttacttctggaagccaagacatgctgggcttaaactacccatgagatgcacttctctggtgacagtttacctggtgatatggtttggctgtatccccacccaaatctgctcttgaattgtaatccccataatcccttcatgtctagggagagacctggtgggaggtgactggcacatgggggcagttcccccatgctgttcttgtgatagcaagtgagttctcacaagacctgatggtttttataaggggctctttccccttcgctcctctctctctcacctgctgccatgtaagatgtgccttttcctgttccaccatgattgtaagtttcatgaggcctctccagccattcagaactgtgagtcaattaaacctttcctttataaatta

SEQ ID NO: 43060 - DNA, 1731 bp, Homo sapiens
gagcagagcctactccagcctcccccgtccaatgtatgaaagccccagctgatctgtaagcctgggagcgtgataaatgcttagtagtgcatgccatggagttccagggtggtttattacacggcaatatctagctaaatacatttaacttgctgcagctctctggatccagcctggttaccaggaagacaaaaactgggctccaccaggaaccagtcttctgccttcccaaccatcacctctggctgcatcagcgatctctcccagcgaaatagctgcttggtcttgtgtgaatcctgtactttaacacagtggaccaagtgtcagtcattgaaaatgaccatgagtaaccctgtggactctctgcagcttggttcctttgccccttaacaggtgggtatgaatcgtgtcttcagtgccagggctgaatgagaaagggcattcctttttgaaggaatctgatactaaacacaaagcatgagaaaaatcaggacttgttggagttatatttttaaaatatatattttaacagttatatatattagatataatatataatagtatatataaataatactatattgcccaggctggtctcgaactccttagctcaagtgatcctcctgccttggcttcccaaagtgctaggattacaggtgtgagccactgcgcccggcctgttggagttctttacatttattttataatcaatgctgttttattaaatgcggattttattttggattacaggatgtagaatgccatatttttcttagatcatagggcctttcacatttgtaatttggccttgtatgagttaccctgcaatccctttgttttccccataacccttccaaaggaaggccgcaatagaaatacaaagagaaacaaaataattagaatattttttaacttctaaagttcaaggttttggcataagtctggtttagaagcacatttgcctagccctttccttcccaccaagggggaaagtcttcctctagacaagaggcagagggctcctcagagtcagatcctggtgtgggctctcacgtgctgctgctgaatcccagggaaggagggaggaagggcagttgacacccaaaataagggtggggaactgtcagcagaggaggtctgtgtcatgtttttcagcgctggggttggggggagcccaggagagcaggaagatccagagatccctcgccccagctcggccatgtgtgtctgggacagagcctgaggtggcctgagcttcctgtggctccagagtaacattatagagaagctgaattctcctgtttttctgaaaagggcatgggagttagctgagaagcagacctggtgggcctgagagtctcaatcgtcaggtaaggacagtcagtgggaagtggacgggccgcacaaccaaggttctcatgaggacaaccatgtcttcgggggtgcccttgtgcacagacagctccatagtcctgcctccaatgtcccaacactgcattgtctccctgcacttagcagccctgcagggtgagacttggggaggatcctgaaatgattgtatttaacaagacatgctgtccttgtttacctggaacctagcaatgttgttttctgccacaacttgaatagatacttgaagcagagatgatgttgagttaaaaaaaatatatacataaaaatatgggttcttttcaacctgaatagatggcctaaaaattcaaaaatgcctca

SEQ ID NO: 43061 - DNA, 398 bp, Homo sapiens
cttggatggggcaccaaagaaggaggagggtttagtcttgaggtgggaaggaggaggaggcttttcaggagggagaccaggaacagcgtagggagggaaagcctctacctcagcaggcctggtgcctgtggatctgtgggattgataagggtccccatgctccataacattgatgcaggagtctgaggatcatgctttgggaaaaaaatatcagatctgaaaaggagttgcacgtatgtgttaggaatttaatccacttgtgctgtattcatctgccctctaaacattcactgaagctgactgctgggctaggcctgggggttggggtggggatggaagaggatgagtacaatgatgaatggcagagttgctgccctcaagcaactcacatgagacca

SEQ ID NO: 43062 - DNA, 345 bp, Homo sapiens
aaactgagaatatgttttgtgagagaatacagggaagcaaaaattctgtcacctaaatataagcacactttttaaatgtgttcaaaattgtatggctgtttttgaagtttctttaagcttctggattataaattttgaaataaattcttttggaactatatgggtgaaaattgatgatgtgtaagtgtggaagtcttcaggggtgcctagagcagctagacagatagttaagcttctcaccggaagttgcacctaccagcagctgaaacactgtcagcaaaatacttgtactgtgtgatggatgagcttggggatagcaggattacatgtgatactatccagttt

SEQ ID NO: 43063 - DNA, 399 bp, Homo sapiens
gctagtcttccatttttttctggtgtccaagcaccacccccagagtggagtcctgcctccagagttgagtctggccttctatctcaggagggctttcccctagagcttccagagggagtacggccatgctgacacctaaagtatggacttctggcctccagaactatcagagaataaatttctgttgtttgaaccactcagtctgtggtcatttcctgaagcaaccatagaaaactcaaacaagtcttaactgcagattcttaggagagaatctgattggtttaggctgactcaaatgcaacagatcccttggtccaattatcttctgccagagagatgagtctcatgagattaatatgactgccagggcccagtcctatgtggaggatgggtgtcatt

SEQ ID NO: 43064 - DNA, 500 bp, Homo sapiens
acctacacaaatccattatattttaagagatgctcaatttgcatcctttaagtttctcatgcttccccttctccacttcttaaattcttaaaaagctataaactgcataagttcgaggaacttaggtcgtccataatattgctaatgaccagccttaaactagacaaccactgaagaacctggcctatgagctgagaaacttgggttcttttatggctggccattaacgacaagtggggctgtaccactgtgctggtcacttgaagttctctgagtcacctgaaaatgagggagtaattggagccaaaagaggtctgtcgtcataggcagccaatctagaattctagaatcctccaaatttagtttaatatcacatactatactgggttactcaaaacagtgtcattctggctgggggttggttggctcacgcctgtaatcccaacactttggaaggccgaggcaggtggatcacttgaggtcaggagttccagaccagc

SEQ ID NO: 43065 - DNA, 504 bp, Homo sapiens
aggactaatgagtatattttagtattgattgaggattctgtttttgctgggtaggtgcagtagaaaatatagcagtctaagggaattgaggatgcagtgagagaataataaattgtgatggtgagtgctgaatagggaaagacaagaagccagaaaaagactgagcttcttaggaaaacattaatggatcacaaacttggagggctgtatggtttttcatttaagaaagtaattgtcgtgcaataaagttattaagccttgtttaagaatatttttattttgtacatcaagtggagttggaaatagttggtttcataatgatatatttcaaaagtatcttgaagtcatctggttcatttcactacccagggcacacattcctcctgtaacatcccaagtggttattaagcaaaacagatttattttatttagaaaaaattagtatgactgatttgctattgattttgtacttctataataaatgtgatacatgctatattcact

SEQ ID NO: 43066 - DNA, 1554 bp, Homo sapiens
  misc_feature (1364)..(1364): n is a, c, g, or t
  misc_feature (1462)..(1462): n is a, c, g, or t
aggcttgctgggggatgtcggctgatgcgagctggagagcgcgtgtggcggccgcggcgccagtgtttgtgtgtatgtgagaaagcaaggggcgagcgcgagtgcgagtgaggcaaagatagagcgcatgtctcatccctgcgagcagccactagacgctccaccaccatcttttgcatgtgcaacatttgcagccggacagaaaacctctcccagggctatggagactgcgggaaaaatctggcggctcgcgatggattgctaaggagaactagtcataatcttaaaccaccgaaacctctttccttttttttctttcttttctttcttttctttttttttttttttttggttgattttaattttagcgccatcgtcttcaatgcttctctgaacagcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacaacattgagacagccaacagttttgctgtaacaaacgccttctgttcccagtattctagaggagtatttgccatttttggactctatgataagaggtcggtacataccttgacctcattctgcagcgccttacatatctccctcatcacaccaagtttccctactgagggggagagccagtttgtgctgcaactaagaccttcgttacgaggagcactcttgagtttgctggatcactacgaatggaactgttttgtcttcctgtatgacacagacaggggatactcgatactccaagctattatggaaaaagcaggacaaaatggttggcatgtcagcgctatatgtgtggaaaattttaatgatgtcagctataggcaacttctagaagaacttgacagaagacaagagaagaagtttgtaatagactgtgagatagagagacttcaaaacatattagaacaggtaagtcctagattttatatttttaacctagaccctatacagaaaaatttaacctttgattgacttgtccccatcaacatcttctcccagcttttaatttggagtgtgaggtttgagagttttcattccatgactatcttcaggaccaaatcacaatcttttatcaccaaggacctttttggttcttaagtctcaatgtatttagaaagctatttctcacatattcttaagacntgaatgagtgaaagactctgtgtgaatcttgaagagctcttggcctccagttttcgaaaatattaatgttgaagattaatcccatctaaaaatagtanaaaaattctaaatttgtgggtgcaccatttttagaggcacacttactttagagaagtgctacatgagaaacagcaacataaattactaaagc

SEQ ID NO: 43067 - DNA, 1157 bp, Homo sapiens
agtggcagaagagggctaggctgagagggaagccaggactgtaggagagggaggcagcccgtcctcctcacgaacctgcaaggatgcggcaggggcctgggggcatggggaggtactaaccccccggagcccccgattggggcttgcagacctggcccgtgggcggattttctgcctagcgcagccgagaagcagaggtgccaggaaaaccaagagaggggcgctgggggtgcccatccccagagtcggtccctctgcgaaccgaggaagaaaagaggagggagtcagcgagtggtcagaagggaaaacctgacaccagactggctccggagcgtccgggagactggggcgctccgcgccatcgtcttcaatgcttctctgaacagcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacaacattgagacagccaacagttttgctgtaacaaacgcctgtaagtaaaacataagctatgaaaaattagaagagaactgaaaccaagcaatggagtcctcttcctctttgttatttaatttttttagaaagaatttcaagattcccacagttgcctggtttcaggacaaatcagagttaaaaacaagacttcgtttcagggatatttagttgttttttttttcttttccttaatttatttttcttttctttcttctcctccctctctttgcttcttcctgactttctcttttattcattatctgtctagatcattcaagttaaattttcctttaacattttagtgttattcctatcatccgaatgtcaatttagtgaaaattgtactcaagctagttttttattcttttcctttggtttttcttatttgcttttcacttgagtaagcataggtcttgcttttaaagaagaaacatgaagactatggaaggcttgctaatagtg

SEQ ID NO: 43068 - DNA, 3155 bp, Homo sapiens
agtggcagaagagggctaggctgagagggaagccaggactgtaggagagggaggcagcccgtcctcctcacgaacctgcaaggatgcggcaggggcctgggggcatggggaggtactaaccccccggagcccccgattggggcttgcagacctggcccgtgggcggattttctgcctagcgcagccgagaagcagaggtgccaggaaaaccaagagaggggcgctgggggtgcccatccccagagtcggtccctctgcgaaccgaggaagaaaagaggagggagtcagcgagtggtcagaagggaaaacctgacaccagactggctccggagcgtccgggagactggggcgctccgcgccatcgtcttcaatgcttctctgaacagcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacaacattgagacagccaacagttttgctgtaacaaacgccttctgttcccagtattctagaggagtatttgccatttttggactctatgataagaggtcggtacataccttgacctcattctgcagcgccttacatatctccctcatcacaccaagtttccctactgagggggagagccagtttgtgctgcaactaagaccttcgttacgaggagcactcttgagtttgctggatcactacgaatggaactgttttgtcttcctgtatgacacagacaggggatactcgatactccaagctattatggaaaaagcaggacaaaatggttggcatgtcagcgctatatgtgtggaaaattttaatgatgtcagctataggcaacttctagaagaacttgacagaagacaagagaagaagtttgtaatagactgtgagatagagagacttcaaaacatattagaacagattgtaagtgttggaaagcatgttaaaggctaccattatatcattgcaaacttgggattcaaggatatttctcttgagaggtttatacatggtggagccaatgttactggattccagttggtggattttaatacacctatggtaatcaaactaatggatcgctggaagaaactagatcagagagagtatccaggatctgagactcctccaaagtacacctctgctctgacttatgatggagtccttgtgatggctgaaactttccgaagtcttaggaggcagaaaattgatatctcaaggagaggaaagtctggggattgtctggcaaatcctgctgctccatggggccagggaattgacatggagaggacactcaaacaggttcgaattcaagggctgacagggaatgttcagtttgaccactatggacgtagagtcaattacacaatggatgtgtttgagctgaaaagcacaggacctagaaaggttggttactggaatgatatggataagttagtcttgattcaagatgtaccaactcttggcaatgacacagctgctattgagaacagaacagtggttgtaaccacaattatggaatccccatatgttatgtacaagaaaaatcatgaaatgtttgaaggaaatgacaagtatgaaggatactgtgtagatttggcatctgaaattgcaaaacatattggtatcaagtataaaattgccattgtccctgatggaaaatatggagcaagggatgcagacacaaaaatctggaatgggatggtaggagaacttgtttatgggaaagcagagattgctattgcccctctgacaatcactttggtacgagaggaggtcattgacttttctaagcccttcatgagtttgggcatatctatcatgatcaaaaagcctcagaaatccaaaccaggagtgttttccttcttggatcctctggcctatgagatttggatgtgcatagtctttgcctacattggtgtcagcgtggtcttattcctagttagtagatttagtccatatgagtggcacacagaagagccagaggacggaaaggaaggacccagcgaccagcctcccaatgagtttggcatctttaacagcctctggttttccctgggtgcttttatgcagcaaggatgtgacatttcacccagatccctctcaggtcgaattgttggaggtgtttggtggttctttacactcatcattatatcatcttatactgctaacctggctgctttcctgacggttgagcgaatggtctctcccatagaaagtgcagaagacctggccaaacaaacagaaattgcctatggaacactggattcaggatcaacaaaagaattcttcagaagatcaaaaatagcagtgtatgaaaagatgtggacctacatgcgatcagcagagccatcagtattcactaggactacagctgagggagtagctcgtgtccgcaaatccaagggcaaatttgcctttctcctggagtccactatgaatgataacattgagcagcgaaagccatgtgacacgatgaaagtgggaggaaatctggattccaaaggctatggagtagcaacgcccaagggttcctcattaagaactcctgtaaaccttgccgttttgaaactcagtgaggcaggcgtcttagacaagctgaaaaacaaatggtggtacgataaaggtgaatgtggacccaaagactctggaagcaaggacaagacgagtgccttgagcctgagcaatgtagcaggcgtcttctacattctggttggcggcttgggcttggcaatgctggtggctttgatagagttctgttacaagtccagggcagaagcgaagagaatgaagctgaccttttctgaagccataagaaacaaagccagattatccatcactgggagtgtgggagagaatggccgcgtcttgacgcctgactgcccaaaggctgtacacactggaactgcaatcagacaaagttcaggattggctgtcattgcatcggacctaccataa

SEQ ID NO: 43069 - DNA, 3167 bp, Homo sapiens
aggcttgctgggggatgtcggctgatgcgagctggagagcgcgtgtggcggccgcggcgccagtgtttgtgtgtatgtgagaaagcaaggggcgagcgcgagtgcgagtgaggcaaagatagagcgcatgtctcatccctgcgagcagccactagacgctccaccaccatcttttgcatgtgcaacatttgcagccggacagaaaacctctcccagggctatggagactgcgggaaaaatctggcggctcgcgatggattgctaaggagaactagtcataatcttaaaccaccgaaacctctttccttttttttctttcttttctttcttttctttttttttttttttttggttgattttaattttagcgccatcgtcttcaatgcttctctgaacagcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacaacattgagacagccaacagttttgctgtaacaaacgccttctgttcccagtattctagaggagtatttgccatttttggactctatgataagaggtcggtacataccttgacctcattctgcagcgccttacatatctccctcatcacaccaagtttccctactgagggggagagccagtttgtgctgcaactaagaccttcgttacgaggagcactcttgagtttgctggatcactacgaatggaactgttttgtcttcctgtatgacacagacaggggatactcgatactccaagctattatggaaaaagcaggacaaaatggttggcatgtcagcgctatatgtgtggaaaattttaatgatgtcagctataggcaacttctagaagaacttgacagaagacaagagaagaagtttgtaatagactgtgagatagagagacttcaaaacatattagaacagattgtaagtgttggaaagcatgttaaaggctaccattatatcattgcaaacttgggattcaaggatatttctcttgagaggtttatacatggtggagccaatgttactggattccagttggtggattttaatacacctatggtaatcaaactaatggatcgctggaagaaactagatcagagagagtatccaggatctgagactcctccaaagtacacctctgctctgacttatgatggagtccttgtgatggctgaaactttccgaagtcttaggaggcagaaaattgatatctcaaggagaggaaagtctggggattgtctggcaaatcctgctgctccatggggccagggaattgacatggagaggacactcaaacaggttcgaattcaagggctgacagggaatgttcagtttgaccactatggacgtagagtcaattacacaatggatgtgtttgagctgaaaagcacaggacctagaaaggttggttactggaatgatatggataagttagtcttgattcaagatgtaccaactcttggcaatgacacagctgctattgagaacagaacagtggttgtaaccacaattatggaatccccatatgttatgtacaagaaaaatcatgaaatgtttgaaggaaatgacaagtatgaaggatactgtgtagatttggcatctgaaattgcaaaacatattggtatcaagtataaaattgccattgtccctgatggaaaatatggagcaagggatgcagacacaaaaatctggaatgggatggtaggagaacttgtttatgggaaagcagagattgctattgcccctctgacaatcactttggtacgagaggaggtcattgacttttctaagcccttcatgagtttgggcatatctatcatgatcaaaaagcctcagaaatccaaaccaggagtgttttccttcttggatcctctggcctatgagatttggatgtgcatagtctttgcctacattggtgtcagcgtggtcttattcctagttagtagatttagtccatatgagtggcacacagaagagccagaggacggaaaggaaggacccagcgaccagcctcccaatgagtttggcatctttaacagcctctggttttccctgggtgcttttatgcagcaaggatgtgacatttcacccagatccctctcaggtcgaattgttggaggtgtttggtggttctttacactcatcattatatcatcttatactgctaacctggctgctttcctgacggttgagcgaatggtctctcccatagaaagtgcagaagacctggccaaacaaacagaaattgcctatggaacactggattcaggatcaacaaaagaattcttcagaagatcaaaaatagcagtgtatgaaaagatgtggacctacatgcgatcagcagagccatcagtattcactaggactacagctgagggagtagctcgtgtccgcaaatccaagggcaaatttgcctttctcctggagtccactatgaatgataacattgagcagcgaaagccatgtgacacgatgaaagtgggaggaaatctggattccaaaggctatggagtagcaacgcccaagggttcctcattaagaactcctgtaaaccttgccgttttgaaactcagtgaggcaggcgtcttagacaagctgaaaaacaaatggtggtacgataaaggtgaatgtggacccaaagactctggaagcaaggacaagacgagtgccttgagcctgagcaatgtagcaggcgtcttctacattctggttggcggcttgggcttggcaatgctggtggctttgatagagttctgttacaagtccagggcagaagcgaagagaatgaagctgaccttttctgaagccataagaaacaaagccagattatccatcactgggagtgtgggagagaatggccgcgtcttgacgcctgactgcccaaaggctgtacacactggaactgcaatcagacaaagttcaggattggctgtcattgcatcggacctaccataa

SEQ ID NO: 43070 - DNA, 2405 bp, Homo sapiens
  misc_feature (19)..(19): n is a, c, g, or t
gatgtccttgctcttctgncatgattgtgaggcctctccagccatgtggaactgaaagtgaagtttcaggtctgctgaggctgagatcaaccaattggtgaaggactcaagaattcttactgcatatctgttcctggaagaatatgatgctaagagaaaaagaaccaaatttttgaatgacctgatactcgatactccaagctattatggaaaaagcaggacaaaatggttggcatgtcagcgctatatgtgtggaaaattttaatgatgtcagctataggcaacttctagaagaacttgacagaagacaagagaagaagtttgtaatagactgtgagatagagagacttcaaaacatattagaacagattgtaagtgttggaaagcatgttaaaggctaccattatatcattgcaaacttgggattcaaggatatttctcttgagaggtttatacatggtggagccaatgttactggattccagttggtggattttaatacacctatggtaatcaaactaatggatcgctggaagaaactagatcagagagagtatccaggatctgagactcctccaaagtacacctctgctctgacttatgatggagtccttgtgatggctgaaactttccgaagtcttaggaggcagaaaattgatatctcaaggagaggaaagtctggggattgtctggcaaatcctgctgctccatggggccagggaattgacatggagaggacactcaaacaggttcgaattcaagggctgacagggaatgttcagtttgaccactatggacgtagagtcaattacacaatggatgtgtttgagctgaaaagcacaggacctagaaaggttggttactggaatgatatggataagttagtcttgattcaagatgtaccaactcttggcaatgacacagctgctattgagaacagaacagtggttgtaaccacaattatggaatccccatatgttatgtacaagaaaaatcatgaaatgtttgaaggaaatgacaagtatgaaggatactgtgtagatttggcatctgaaattgcaaaacatattggtatcaagtataaaattgccattgtccctgatggaaaatatggagcaagggatgcagacacaaaaatctggaatgggatggtaggagaacttgtttatgggaaagcagagattgctattgcccctctgacaatcactttggtacgagaggaggtcattgacttttctaagcccttcatgagtttgggcatatctatcatgatcaaaaagcctcagaaatccaaaccaggagtgttttccttcttggatcctctggcctatgagatttggatgtgcatagtctttgcctacattggtgtcagcgtggtcttattcctagttagtagatttagtccatatgagtggcacacagaagagccagaggacggaaaggaaggacccagcgaccagcctcccaatgagtttggcatctttaacagcctctggttttccctgggtgcttttatgcagcaaggatgtgacatttcacccagatccctctcaggtcgaattgttggaggtgtttggtggttctttacactcatcattatatcatcttatactgctaacctggctgctttcctgacggttgagcgaatggtctctcccatagaaagtgcagaagacctggccaaacaaacagaaattgcctatggaacactggattcaggatcaacaaaagaattcttcagaagatcaaaaatagcagtgtatgaaaagatgtggacctacatgcgatcagcagagccatcagtattcactaggactacagctgagggagtagctcgtgtccgcaaatccaagggcaaatttgcctttctcctggagtccactatgaatgataacattgagcagcgaaagccatgtgacacgatgaaagtgggaggaaatctggattccaaaggctatggagtagcaacgcccaagggttcctcattaagaactcctgtaaaccttgccgttttgaaactcagtgaggcaggcgtcttagacaagctgaaaaacaaatggtggtacgataaaggtgaatgtggacccaaagactctggaagcaaggacaagacgagtgccttgagcctgagcaatgtagcaggcgtcttctacattctggttggcggcttgggcttggcaatgctggtggctttgatagagttctgttacaagtccagggcagaagcgaagagaatgaagctgaccttttctgaagccataagaaacaaagccagattatccatcactgggagtgtgggagagaatggccgcgtcttgacgcctgactgcccaaaggctgtacacactggaactgcaatcagacaaagttcaggattggctgtcattgcatcggacctaccataa

SEQ ID NO: 43071 - DNA, 538 bp, Homo sapiens
actgtaaagacatttcatgacaaggaaatactatttaaagaatgttgtcaaacataaaagagcttttaagctcatccagaagtactaagatatacagtgcagcaagttaaaagatgtttcctgcccagatttactaacagtagttaaatattataattttagaattagtttttccacaagtaggaccacaaactctagacagattcattcttcggtgtagttaagctttcctttccctggataagcagttttcatatgaccaaaagaacatggaaaaaatgcagatgtctaattatttatatttcggtgtttgttgtggaacatattgttgaagaaacagaaatatggtaacactccgcgttctttctgcttcctttccatgcaacccagctgaccttttctgaagccataagaaacaaagccagattatccatcactgggagtgtgggagagaatggccgcgtcttgacgcctgactgcccaaaggctgtacacactggaactgcaatcagacaaagttcaggattggctgtcattg

SEQ ID NO: 43072 - DNA, 410 bp, Homo sapiens
cgccatcgtcttcaatgcttctctgaacagcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtaaggtgtgctccgatggggtgtgcatgtggctggttgtagcagatatccgaaagtgagttaaatgagttgctgataagcaattcagggaaaccttcagcagttcccttcccctctgtttccctcctcttcctttctctcctttgcaaaaagacttcctctttagtgcaggttccgttggaatacacccagggcagcccacccatgcgttctcagcccatagccctatttc

SEQ ID NO: 43073 - DNA, 213 bp, Homo sapiens
aaaaaccatcctctgtgttcaaccctcaatctaactttctatccagaatttatccaggtcaccagataaactgacaaccactgaggtgttataaccagaaataaaaactgtgctggtggaaaggaaactacaatgaagaaagatgctaagccaatagttacactgtcttgtaatgtcagggtttgtggagctgagtacaactttccttttgag

SEQ ID NO: 43074 - DNA, 320 bp, Homo sapiens
atcacactctgttgcccaggctggagtgcaatggcatgatcatatcttactgtagcctcaaactccggggctcaagggatcctcccacctcagcctaagtagccagggctacaggcatgtggtagccaccatgcctggctaattttttaaagttttttttgtagagacagagtcttcctatgttatccagactattctcaaactcctggcctcaagcagtccccctgcctcgacctcccaagcgcaatcaattatatctttattttgggtgctgttcacaactctgtaatccccaacatctttgtagcaagcagcacact

SEQ ID NO: 43075 - DNA, 269 bp, Homo sapiens
aaagtcccacgttgatgctaccatgtttgtaataccttctagcacgctacaaagagaaagcaggccctaggctcatcacctcaaccacaccaagctgcatttcagtgatagggctggagcttcttcagtttcactgaagtggtgtttgtgatcaccttctatttatggcaaaggatacagattttccatttctagaggagatacgaagttttctttctacacaaatttgtggaagtaaaaatataaaagagatgatttaaagaaaatgt

SEQ ID NO: 43076 - DNA, 392 bp, Homo sapiens
tgacctcgtgatccgcctgccttggtctcccaaagtgctgggattataggcgtgagccaccgtgcccagccccttcttctgttaatctcactgggctcctgcccaggtacagaaaaccactgaaatagaggattggaaagatcgctgtcctctggccacatgttccttcaattgctatgtgaatctgagagcctcaggctgccctctccaatcagttgtgaggaccagtaacaggcagtttaagatagacaccaagaactgaaaacaggccgggcatggtggctcacgcctgtaatcccagcactttgtgaggccgaggccggtggatcacctcaagtcaggagttgaagaccagctgggctaacatggtgaacccgtctctactaaaaata

SEQ ID NO: 43077 - DNA, 123 bp, Homo sapiens
ccccagccattgagcctgcctctactgggggtcatgggcctcactcagggtcttccttcttgggggtatatctttgaaaacaagagagagagaattttctgggaacctgggtgaatgctccaa

SEQ ID NO: 43078 - DNA, 649 bp, Homo sapiens
tattgactacacttttgctgtaattagaggtaaaaaggtatgtgtgagcactaagaaagaaccaaggcccagatactagagaatcagtttgagtttttctctgaaatgacctgtggtcacctgtatgctcagccctctccagggtggaacaggctggacagaagagagtgaaggatctttaagcctgctctctgcctgggtgatctgctgagcaatgagatgcatgtggcaggacaggatgtttgatttcaggagacgatacaggattaaatctaaggggcacatctcacactgaagagcaaaacacatcaataccaatctcctgagcattatgttcattgtggagattttttcatgaccagtgtttctcgaagtatgctcctacgctaggtaagtcttgaatttattaattactttgccagttagcaaaaataatgggtaacctctacactggaagccgagagaagatggcagatgatttagtttacaattatatatttaaagcttaacggattgcttttttcattttggtgtgcttggaacacagccctcctacccctatccctgccgcttgttttccatcctgagcaagtttgagagctgcagagggaggtatgggcactcttgcatcaggatgtgagttttctaa

SEQ ID NO: 43079 - DNA, 584 bp, Homo sapiens
taataattgtatgaaactttactatggagaattttgaacacaggcaaaagtaaattgaaaagcgtaatgaacttggcacacatccgtcacctctttcaacaattaattcatggccaattgcttttaatttataaccccattaacttaccacttctgtattattttaagcaaattccattctgccatttcatctgtaagtatgtaatatttctaaaagataacttttgttctaatataatcacaaaatcattgtcagaccaaaatggaacaaacaaaaacagtaattctctaataatatcatcgtatttgattactgttcaagctccccattgtcttgtggatatcacgatggctttttcctagtgcaattgtttgaatcagtatccaattagagtccacatattgtgattggatggtctgtttcttaactctcttagattccaggtttatacttcatctcttttttcgcttgcaatatattgaagataggggattgtcttagggagttcctacaacatagattatgctgatgatgtcagcacatatgattgttcaacattgttcacataagctgttcaacatta

SEQ ID NO: 43080 - DNA, 455 bp, Homo sapiens
tacacggtaactgatagttagacaacagtcacgttgccccttgtgtttctggaaaccctgggaataaaggtgatctggctcagctcatatccttgggagctttagcacacaagcagacccagagatacaggcttggatctgaatctaggaggcccagcaggaatggacgggaaaacattcatttctctcggaacgtctcatgaaagctctatttctagggccatgttcactgtgtattcagggaactctgcctgttgttttcatgtccatttctgtaactgtcagaactatgatcccattttaaaatttgcctgagtgcttcctcaaatgcaatggataatttccttaactatactattagcataaatttgcatatttatttcataattaaaatgagtaagaataaaaggctaattacaccaaaattgcatgagtcaccataattaaaactgtag

SEQ ID NO: 43081 - DNA, 364 bp, Homo sapiens
tgagtaataaagtcccttttccctcttttagaagtctcatatgttctgtcagcagccaccaagctgtgtcaggctaaattgctgtcttgcaagtagaataaaatcccagaccctttgcaatctttttcataaaaaaaattttaaataccatatatttaccgcatacagttcagaattatttattaatagtatattcacagagttgtgcaaccaccaccacaatccaattttagatcatttcaacaactcaaaaagaaaccttgtacacgttaagtgtcattcctgtacccactccctgaaaatctgcttgctctagctgtgttggattgatgtcagaacacaggagggaagggcaaatgcaagg

SEQ ID NO: 43082 - DNA, 581 bp, Homo sapiens
aaactactaaaataaaacattagggaaactctctaggacattggacggagcaaaggtttcttgagtaatgtcccataagcatgggcaacaaaagcaaaaatggacaaatgggatcccatcaagttagaaggcttctgcacagcaaatgaaacaatcaacaaagtgaagagacaactgacagaatgggagaaaatatttgcaaactatccatctgacaggggctgataaccagaatgtataagaagcttaaacaactctataagaaacaatctaagttaaatcaggcgtgatttaactcacgtctgtaatcccagcagtttgggaggccgaaacaggtggatcacctgaggtcaggagttcgagaccagccagacccacatggtgaaaccctgtctctactaaaaatacaaaaatcagctgggtgtcatggcaggtgcctgtaatcccagctacttgggaggctgaggcaggagaatcacttgaacctaggaggcagaggttgcagtaagctgagattgtgccattgcactgcagcctgggtgaaagagtgagactccaactcaaaacaacaaaacaaacaa

SEQ ID NO: 43083 - DNA, 315 bp, Homo sapiens
cgtcggccaccacactggctaatttttgtatttttagtagagacagggtttcactgtgttggtcaggctggtctcaaactcctgatctcaaatgatccccacgcctcgacctcccaaagtgtgagccactgcacctggcctgaaggtgacatttgaacagagccttgaagaatgctgtgtagaaagtttgacaggtggccaggcatagtgactcctgcgtgtaatcccagcactttgggagtccgaggtgagaggatagtttgaggccttgagtttgagaccagcctgggcagcacagtgagactccatctctta

SEQ ID NO: 43084 - DNA, 1640 bp, Homo sapiens
atagccaagggagctctcactggaggaacagagctatctatacttccgtgtacaacaaatgctctgggaaatggagaaccagttgccagcccatatgtggttacctcacaccaatcaaaagtgactgtggagagcacccccaatttggaaaaccaaatgaaaatggagtatctctgttcagaatgaaaattttgaagaaattataaatttacccattggatcgaaaccatccagattagatgtcactaacagtaagagcccagaaattcctttgaatccagttttggcctttgatgatgaagggacgcttgggcccctggctcaggtagatggtgttcaaacacaacagactgcagaagttaaatgcgtattttttctgaagaaccaacgtcaaaatttaacgagaatttctataattaatggaattcctttcatgctataaaagagcatcccctcttccagttttctaaagatttcttgaccatcattttgaaaagatttatttaaactagctaaagacaacagacaggatagctttcctaataattttcatcagtagaaaaaaaatactcctcattcttcagtactttcaaatggctttttccagtgtgctccttcttagcaaattagtatttttctgcgttatttaaaagacaagaggatttggctataaaatgattgactaggattgactaggcatgattttttttcacatagtttggtcttaaagcttaacagcttaaaattggcaaaaaaaacttgtgccttttaccatgtaatacttgaaaagtaagtacctctttgctacaagtagaatgaatagggaaaagtttaagcctgtttttttaaaaatattattttaaagagctctatttgtagaggcaaattataggcagattaccagtttcttataaatacaaacttgtacatggacattctgcaaacccagctgtcatattcttgcaactacttttgcaaaagcatactaaaaggttttaaaatgtgaaaaaacattattttttcagagcaagaaaataatttactgttgtcttcaataatgtgtaaagtttttccagataaactaatcaaataaattagaacaatgtgacaacattgcaaatttgtcattagatgcattccttctaacgttaccaggggaggatgttactgatgattcaaggctgtttctgaagtctgtgtgttgctactgtccccagtgatggtgggacttacctctgtcctacttgatcacaaattatgttagggggaaataaagatttaatatttcattaaataaaaaagaaatttggttttgctcatttaagagcaacaagaaaatggtggtgtgttgactgtgtttggccgcagggcacagacctttatggaagtcctcgctctgcatggcatccaccagcttttcacctttcattcttattcttcacttttgctgctgagcctagctgtacaaatttgcactttcatttgctaatgtaaattcaatttattttaccattttagagactactaatgattaaatgtaagagaggacacatgtttttatgtggagtgttaaaaaagataaatttataccactgtaatgtgctggatttattaaaagagattggttaaactgctcggtt

SEQ ID NO: 43085 - DNA, 122 bp, Homo sapiens
agcctctctgagccccaatttcctcacctgtaaagtgagggaataacatctacctcgcaaggttgttgtgaggacgaaatgagagaacatgggcaaacatgaatgttcttgaattcaccacc

SEQ ID NO: 43086 - DNA, 432 bp, Homo sapiens
tcacctgctaggatatcactgctaagtgagttagcatttgccagccattctgctgattaatggtgtgtaaagtggctgtctcatggtggctgggtcaccgtgactcaagcttgggaaacgctgcagtaacagcagagagctcatctcatgggcagaggtgggactctgagagggttaaatctcagttgctactgtttggggcatccatgaactcttcgcagcaggatgtccattgcccggtctcccctctctgcttcctccagtgtcccctatgaaggacacctttgaaatgagggatgagatgtaatgaagctagatacaaaattaatcaaatatgacacgagaattgatgtggaatgcaatcccgtcagcagatgattcacctccttggagtggagttgcttgtttactgtttgcagcatttctgaagga

SEQ ID NO: 43087 - DNA, 406 bp, Homo sapiens
cagaaaacagaatatttgccctcgagtgtttacagaagaggtgtgctgatacttgctctggggttggtaagtctggaaagagagtgtgtggagggtcctttgggagtgatgctgcacatcacttcctcccacactccattggtcacagatggtcacatgaccccagcaggctacaaggaggctgggaaatgtagtcttcctggatgctcaggaggaaaatgaagtaggtcccacagacacatagctttgtctgtccatttacatcgtaaatagctacttaggccgatcgtggtggctcacgcctgtaatcccaacactgtgggaggctgaggcaggcagatcacttgagtccaggagtttgagaccagcctgggcaacatggcaaaaccccatctctacgaaaata

SEQ ID NO: 43088 - DNA, 349 bp, Homo sapiens
acatttcctagtttggtaattctaactatatcgtttagaattatgaaatgatgctttgaatgataggatttacttcttcacattaagacatatttttaggaacatagaccattttgacaagtgaatttcacagtttaagttccttaaataaaatgttaatacatattccacactctttgtttggatcctcttttgctggttttctgtaaccagtttctgctttgcctgatctagtagctgtccacatattcaggtaatctattcctaagtagctttcaagcagtcagaaacaggattgcattgcttgtacttttttgggcgggtgtaggttatggagaaaggaaattgg

SEQ ID NO: 43089 - DNA, 712 bp, Homo sapiens
  misc_feature (1)..(1): n is a, c, g, or t
  misc_feature (6)..(7): n is a, c, g, or t
  misc_feature (9)..(9): n is a, c, g, or t
  misc_feature (489)..(489): n is a, c, g, or t
ntggcnnangaactttgttagaaatgccctcaattggcctttcccgttgtagctgctggagactgactgtgtctgaaaggagggtctcttgatgctgacagggaaaagctgatcagcacctctgtgtcctagaaggggaacttccagaaagggggcatagaagaaggtattattagtatttattgaatgctttcatggggccaggtactgtgctgggggctagcaccttcccttgctagtaggtaaaaacccagctgtaattttaaaggaattgctatgctgagatacacttttattgaagaccttgcatagttcaaataacgtgaaaagtattgatggtcaaaaatattttgtgtaggaatcaatgccaccaaaatgttagtgataaccgtacaaacaaattgaaacaaaactgagacaggattcagataattctgacaaataaagaaaaagcagccacaacactgaccccccaacatgttcttaatnccctttggggctgtttctagaaaaggcatatttcaccctgaatgctaaatttagttctctactctgttagtttagacctgccttccatcaaaatattgttgtcaaagatttatgtaacttgtgatttgagccttgtatgaaattctttcaagttttgattactaaacagttatgtgtcattaatctctccattgaaaattaaaatggcacaagaagcaaaaaa

SEQ ID NO: 43090 - DNA, 410 bp, Homo sapiens
ttggtggctcctgtgttagcttctcttggctctgacttttggtggggggctggatgctctccctcccactcttggcctggctaatgtcttctcatccttcagaactcagggctccaggagaccttcccatacccaagtgaggtgaggactccaggcttgtgatcttggagctccctgtgcttatcctcagtccttgccccaggggtgaggtgcttgttggggtgatcagtaactcaatgtctgtctctcccagcaagctccctgaggccaggaaccatgtctttcggtcactgctgtatctccagtgcccaccataatgtctggctcatagtacatgctcaataaatgttcacaggataaatgagcccttctcctaggctgtggctgatatcctagaagagttccttctg

SEQ ID NO: 43091 - DNA, 352 bp, Homo sapiens
ggcacgagggtaggaaaagtcaactggtcttattttgagcaacaccgtcctggtcactagggttgtatgagagtttcagggtcgtctatagcctggaacagctatgaaaggggtctgtaatcagccatccgtgctgttcaccatctgtatggtcctatgaaggcaaacaattcacctgcttccatatgaagcgtagcctcacgggactttgtagagataggaagccttggacctggaagtcggtcttattgggtatccattcaaagctgtattccagcaggatgctgaaccactgtcactccaggaccacacaggcctccaccctctggaaggggattccttaaagctgtct

SEQ ID NO: 43092 - DNA, 194 bp, Homo sapiens
catataatattttttccttttttataaaatatttttaaaatataaaagtgtcttatacgttatttatagtataagttgatttatagtacaggcttatttatagtagtgacattcatattgcaatgtttaaactattatatatagaaacatacaaatttatatgtatttccttatatgaaaataaacatttatat

SEQ ID NO: 43093 - DNA, 326 bp, Homo sapiens
ccagagctacatttgcataatgatgttctgttaaatctaattgctttaaaatacccattctttgcacctgtctgatgagaatctgccccagtagttcctaaaatctagataacttaagagcttcattcaacagattgcatataattcaacagattgtctatcaagcacctgctgtgtcaggtatttggctggggctatccaggaatatagtgactagtgtgactcctgacctcttggagtttacattctaccactgaataagcaaactaataaaagtggttagagtgttaaagaaagcaggctctggtctaagaatgctgaaggcc

SEQ ID NO: 43094 - DNA, 604 bp, Homo sapiens
cagaggcagaaatggattactcaaattgggaacctgatgccccctcttctcactttaatggagttgtagtagttgagcttcaaagaaaggagcgtcctccagtgaggttcctgccccttcctgggcctctctaccacagcaagagccagggccagctggcagttttcaccaccctgctcatgtttttctggagacaccagcttaaccacagccaccacagatcggagggtgctggccccagcctgctgcctgctggttcttctccttcctccctcccttcctcactcattcctcccaggagctggaatgggccagagtttcaatgacactgaaggaaaacagtcttctgcagccccactctgagctggggtgccatgttgctgcggtctccctggagtccaccttcctgctggctcagctcactgaattttgggggactggggcatccagggagctgtcaggacgtcagcaggttagctgggccatggcaggaacgctaccattgtttgggcctaatgccagtgtagaggaagaaaaacagtttttcttccaactctcctaagctcttagttggaacagacccctgtaacacattaacaggaga

SEQ ID NO: 43095 - DNA, 494 bp, Homo sapiens
attccagtgttttgggaggccaaggcaggaagatcacttgaggccaggagctcaaggtcagcctgggcaacatagtgagacccccatctctacagaaaacgaaaacaaattagccaggcatggtggtgtgcacctgtaatctcggctactcaggaggctgaggtggggggatcacttgagctcaggagttccaggctgcagtgaattatgatcgtgccattcattgcactcctgcctggacaacaaagagaccttatcacaaaacaacaacaacaaaaagtctatcagccaatcacctagggatagccacttgacattacggataattagcctttcatattttttctggtatttgataaccaagatgaaatgcagaagaaatttgaatacatattctctagcatttcctgtaatgcttcttcctccaggatttcaaatgtgggaagccatcacccaaaaatatggtttcgaccatgttagtactggagttggga

SEQ ID NO: 43096 - DNA, 410 bp, Homo sapiens
accttttttcatgattccctgttagcggtacctgtgcctgttaacatgtcaaggctttccccatctctcttcattcatgtgttttctataataactgcatctgttttctgtctgcagagctactgaagtaacaacctatcgcttttgggtgatagcctgctatgtgatcgcccctgtactcgatattttacttcttttaatgttaatcttaaccacatctgtgagacagtgacatcctcattttacaaaggaagaatctaaggttctttagaggttaagtaactttcttagagccagtcagctggaaagtagcaggtccaggtttcaagtaggtataactccagtgtccaggctcctaaccgtggctatccttaccaaaagatttttgttgttgtggtaaaaaaaaaaaa

SEQ ID NO: 43097 - DNA, 337 bp, Homo sapiens
aactccaagcctgatatttctgcccaggctcccttttttatactttatttaaatcgcctcacccgagtggaacagggacgtgagccatgtcagtgtctgtaaatagaggcagttgcaggttcacgtatcttgggaagttattggtggagagcactggtgttcctggctaatgtggggtctgtgattcagtgttctcccaggtcagtgctgcttccgttgtaaataaaccattagctgggggcctcacctcaggaagcaatttaaggcccaagagaggtggccaaagaagtcagcttgcagcctctaggaggagacgcttggctttgcccacagccct

SEQ ID NO: 43098 - DNA, 1412 bp, Homo sapiens
accatcgtcggcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcattggaaaaga

SEQ ID NO: 43099 - DNA, 1184 bp, Homo sapiens
accatcgtcggcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcattggaaaaga

SEQ ID NO: 43100 - DNA, 706 bp, Homo sapiens
ctgtgctgcttgcagcagattactgtatgcttgttcctgggcccatttcctgtttctattctagtcgctggtggctcagctctgcttcctgcctgtgtgtctcacacagattcctcttgctggaaccttttgtttccttcggaacagcctcaatctttgaaaagcaactgagccttaactctagtatgatggctcttgagtcacttagtcctacagaggtctggctggaagtacctcttccccattaagcacaccgtttgaattttaccttgtttttcagtttgtcgtcagccctgctgtagaagttaagttgggccaaacttgtcctcacttattagtacacagagctatcgggactggtatgtcctgattcttttgtacctggagcttttaaatgtatttcctactactcaagaagacacttggtatcctctctggcccaagcttccctgaagcccaggtgatacttattttgagttgggcaggttatgccatcctcagcagaataacaggctgcagaaaacatagggatggaaaagaaagcgtgtgctgactcaaccctccatcctgtgtgagcaattcaaaccccccacccaccccctcagagcttagggtgagagagagaaagtacagtgaggttgtaaaaagggaagaagtgaaggaggttgtcctggacaaatgtatttaaaggcctaaggctcccccc

SEQ ID NO: 43101 - DNA, 679 bp, Homo sapiens
gcacctgtagtcctacctacttggggtggctgaggtggtagggtcgtttgagcccaggggttcaaggtttgtgtgagccatgattgagtcaccacactgcagcctgggtgacaaagcaagatcctttctctaaaaaaagaagaggcgaattttggatgatcttgcctgcgtctgagtactgactcctccactcactgaaagtcactttggccaagtgacttcgtgtttttgtgtctctgctcccacaccagtaaaatgggaataataataagatatcttgatggactgttgtgataaatgagaaaatcagtgtaaagtgcttggagatgtgcctagtgcagagtgggcacttgctgaatgttaattatttgtataacttgctggtgtgggaagcctgactcttctccggctggaatcccacaggcctgcacaacagtaaatggccccgctgctaacccccaagatctatagtgaatacacagggaggatggtgagttatatccttctgaaagtggctcaactgtgccacagaactgatgtttatgatttctttggaataaacgtcgaaattaactctcctagtcttgaaattcgagaaagttatatttgtcttatctgagttcctttctcaggaaaccaaccatcaggcatctccaatagtatcaaaaagccagcagtg

SEQ ID NO: 43102 - DNA, 250 bp, Homo sapiens
atgatacttagcacagagtgaacacttggtaaatagttattgttagctaaaaggcgtagtttccttgatgcccaaatggaagattccatttcagttccacagctcttgaacacttccctgtgcagggcattgtaagggatagatacacaagtaggacataattgctagattataatttgggaataaactaaatacagaaatgtctacaatacaagagggaatagggagtttgttagggaagatgaagggc

SEQ ID NO: 43103 - DNA, 147 bp, Homo sapiens
caactcttgcaaacatctgttgaagaaggaaagaaaaacaatgtcaacagggttaagactgttatatgtctgatttttttgcgggggggggcactaagtgattgtttcaataaggcctcataggaatgggtctcctaagagttatat

SEQ ID NO: 43104 - DNA, 686 bp, Homo sapiens
catgtctagtgcatcatccgtgcctctcttgttaggagatcatctgaagaactagggttacggtgctgccagctgactaatgactgtttttcagttttgtcaggaaacagaattaccactcaccttaattttgtagcttgtacccaagtttgtgatgtcaattgccaagactaaggaatgaaacatcttcatacgaggtcatcccggagccaactcattgcctgctttttttctgtgtatgttggtggtgtggcggggacaggattgataagcactgtcatcacagctgtatgaacatgatattttagaaacatgttttagttgatgagattggcatatcatgacttactaactctttttcaaagacatgcaaggtagttctcatgatttatatacactttcaactcaaatcattatgaaaagaaagttacaattatatctaaactgaacctgatgagaaaatattacactcaagttgcacagtatgataatttattaatgaaaggtttttactaacttttcaagatgtgtagccctataattgttagattaatttaggtaaatctaagtatgacattgaatttaaaaaaggaagcgttaaaatataaaccattttgatttttcccctataatagtgaataatattttgagcccattttacgagataatcatttccagatgctgga

SEQ ID NO: 43105 - DNA, 238 bp, Homo sapiens
aataaaattcctgggaattttcctgtaagtgccctcctttgtgcccaatagaagtcctagggatgggtcctcaggctgaaagactgctttcctacccattcaggaatgaagcttgcaggactggaggttgctttcaggccccttaaggcctttgtccgttgtcgtcaggactaggtaggtctcgcccaatggcgacagagtggtcacccgggaaccggatctgcgcggctccgtggcc

SEQ ID NO: 43106 - DNA, 542 bp, Homo sapiens
cggaataactgtctactgtttactagcatataaaataagtatgatcattattattgaactctatcagctatgaagctaaattttaaagtcaactgctcttcctactgactcaaatagtttattttttaaaaatacttatataatacatgcagagacaagatacacaatgattataagtattaatctccataagagaaaatatttatgaactatatttctcattgcactctgtaataaaaagcagttagttgttacttacctaagagttaccacttccgtagcctataacatcaaaacgtagtttttgcatgttttcaattttataaatatatattttatcagacatcatgaattattttgtgtcttgcttatttcactcaattttttaagatctgtacattattgcatgtggcagtagtgtattttcattttgcatactattccattttaagaatatattgctgtttatcctattgatggatatttgtattttttatacttttgtgtaataataaaaatactgctgtaaatattcttgttta

SEQ ID NO: 43107 - DNA, 209 bp, Homo sapiens
gaggagggaagagggaagaaggaagaaggaagaaggagaagataaagctaggtgcagtgacatgtacctgtaatcccagatacacgggaagctgaagtagtaggatcacttgagtccaggagttcaaggctgtagtaagctatgattgtgcctgtgaatagccgctgcactccatcctgagcaacaagaaagaccctgcctctatttaa

SEQ ID NO: 43108 - DNA, 322 bp, Homo sapiens
tttcaaaaacccactttgtaactgacaaaatgaggaacttatatttcctggcataacatgaactgggagtgtcattcacgttcgattagttaagcactaaaaaaattaggcttatgtttttagcctctttttcttactttaaaaggaatttttctaacaaatacagtttaagtgtaaatacaactcttaattgtccacaacaacagggaatggaaaattgggatctacagataattcaaaattttactttaaagagcacattcaacctttgttcccaatgagctcttaacattgcttagagctaagaattaatttgtgtgga

SEQ ID NO: 43109 - DNA, 249 bp, Homo sapiens
tgattccatttatgtgaaattccagaaaatgtaaacgaatctatagtgacagaaagcagaccagtagttgtctagggttgagggatatatttaaaagggcataagctaacctttgggggatggaaattcattatcttggttatgtcaatggttttataggtgtgtacatatgtcaaaacctatcaaattgtacactttaaatatgtgctgtttgtggcatgtaaattatatctcaataaagctatttgt

SEQ ID NO: 43110 - DNA, 433 bp, Homo sapiens
ccaggcattatgctaaatgttttgtgtgcattatcccatttcatcaccacaactgcactatgaggtaacacaattattatacccatttaaaatataaagaaactgaagtacaagtggttacataaatcacccaatgtcaccagccaggcagggctgaagtttgaacctcagtctgtctgactcagaaccagagctcttaaacactggctaaactgtatgagtaatggctctttggccacaatgatcaacaactcacaaagtgggtgagactagtatgggggggaggggtggctgcaatggagccaaaagcccattgatcccagagcaccttcagccttcagaagtctttaaaactagagatgtattcttttagagtaaggcattgtgtcttcaaccttttacttccagaattggcagcacagaatgattatta

SEQ ID NO: 43111 - DNA, 311 bp, Homo sapiens
ggaattctaatcaccaatttcacatctcctattggatgtccagtaggcatctctaacttggtatgtccaaaactgtgctgttgatattctgcctacaccttctctgttgtctgtcaagacctgttaaaagtctgaaattttaccctactaagtctccttccccgggggaagacttattacccattaaagattctgattctctaaactcagggttgttttcatgtaatgcaacccactgcatatgaaggtatcacctggcccttttccataaccctgtagttccagctatttgggaggctgaggtgggagga

SEQ ID NO: 43112 - DNA, 436 bp, Homo sapiens
ttggctttgaggattggctgaactgaggctggactggaatgttctgcctggctctcatccctcctcagcctaggttagggcttcccatgccatgtgataccacatgaggcactcctggcctgggctcccactgggccaagtccctctcctgtggccttggtgatgctgctggtctcagcatcagtgtggaaaccagcacacctgagcagggacatcacaggtacagtcaccttggaccaggggcctgagtctcagtcttcctacctagtgacacagagacaacttactcaaaaaggatgaggcctggaaggagtccccaggtgtgctgagggctctccctacccctccgtgcctttcctgggatggttgccatggtgatgtgtctgcagcgcccagtgaaggaggagaaacagccaaggaggagcagctgccgtgg

SEQ ID NO: 43113 - DNA, 404 bp, Homo sapiens
ccataggggttgaactaatttgcattcccaccaacagagtataagtgttcccttttctctgcatccttgccaacgtctattattttatgactttcataataatagccattctgactggtatgagatggtatctcattgtagttttaatttgcatttctctgatgactagtgatgtggagcttttttttttaaagtttgctgggcacttttgtgtcttcccaaagcatttttaaatctctagaatgatctcacgtaattgcagtgctatattatttggagtagaaatttctaaaggcgaataatgctccttggacttaaagaatgtttgctctaaattagacagtatataaaaccgaaaatgctttcctgttcaaaagcatgaaacactataatctccatgcacc

SEQ ID NO: 43114 - DNA, 435 bp, Homo sapiens
ccccatatgtttaaatttacttttgaatttttatttcatttcttatggacaaacctttttaaaaatattactagtgttttttccagttaaaaaatttatacgtttattgaaaaatttagaaaatataggaaagtgtaaatatgaaatccttcataatcctcctacctactgttaacattttggtgaatttcctttgtctttttttctgttttaaataaaatcaaaggtaggttttatatatctatagctttatcctgcttttttaaacttaatattactacttttgaaatttatagtattctttgaaaatatggtttttaactcttacataatactccattgtttcttgttttatttactcattccccaattcatagacattcagaatcttttttatatctattttaaaaattataaatagtggccaggcatggt

SEQ ID NO: 43115 - DNA, 416 bp, Homo sapiens
gtttcaccttgttagccaggatggtttgatctcctgacctcgtgatccgcccttctcggcctcccaaagtgctgggattacaggcatgagccactgcgcccagcctaatttaaaaaatttaaaaaggaatgaaaaccaaaatttaaaacttttgtggttcaatactatcaagaaagtgaaaagacagctcagagtgcaaggaaaatttttgcaaatctgggtaagagacatatctaggaatatattaaaggtactcctacactttcaacggattaaaaggacaaccaacttaaaaatggggggcaagggttgttaatggggttaaagggttttaccaattggccccttaaatacggtggaaagggtggctccattttccttttaccgggggttccgccaattccaaaccccctggg

SEQ ID NO: 43116 - DNA, 186 bp, Homo sapiens
gaagcgccccttgtctggtggacacgtgactcgcgtgactttacctatcattggagacgactcacactccttaccctgccctcttgccttgtatacaataaataacggcgcagccaggtattcggagccactacaggtctccatatcttgatggttccctgggcccagctgtcttttcttccgtct

SEQ ID NO: 43117 - DNA, 738 bp, Homo sapiens
aaaattctatagatattctctgccagactccagcctatttgtgtgagacatctggggaggctcccctttttttcaccatttgaggactgaaagtaaatttagcttcctcagcagaaagaaaagaagctgttttggaggttgggaagagctttagaaaatgcggcatcacgtctgttgccccatttgaagaaagcagctctggaaaaggcctaggacattagttgctacaaagttctagatcattctgtgtggtaaagaagtgcctttcacctcccactgtgattctgaggcctccccagccatgtggaactgggtcaagcaatggaatggaaatgtgtcatgtcctttcaaggtcatctgtggagcaatgtttaacagcctgcccaagaaatatttaattacctagaggaaatcatccatcccactgatgcaaaaagaaggtggtttccattttcactctggatctatctaattgactatttaattgatgtggactttagtagaggcagtgattgcttccagttggtgggcccaggaagactgtgaaaaaggagtcacagaaggcctggaatggctgcgatggagataaaggatgaagggtagtcccctcagggtgttatccaaaaagtcaccttggaagaggaagaaactcctaccaatatcagaagagcaacaaacatttttttttctagaagataagtggctaatttcaaaataattattttatcaactgccaaa

SEQ ID NO: 43118 - DNA, 482 bp, Homo sapiens
gtgtgaaagctacacaggattacagaggcatctatattatcacttttgctctttgactaatcctatgctgtttttgttatagagagaaacaaggacatggatgaagtgattttttttttaaataaaaggacaaatttgccacacaacagaacaatctgagtatgatctgtcctcagggtatctttatatcctttccatgtgaaagagatataaagaattctgacagcaaaactactttaaaaatcaaatcaaatcaaatccacaagcacactcccattcctcccctgccgcaatggttcttgctctcaatgtttagtagagaaattaagagccacattcaaagatggaaaataagatttgtcattagaagcttgccaaggtaacagattgtacaacttgagatgaattcatgttgtttaagaagttcagaaaggttggaagatgggtttataaataaagaagtggagtccattgaaaaactg

SEQ ID NO: 43119 - DNA, 535 bp, Homo sapiens
tggacttggacttaactcttcatcaagggcactgcttttcacacaaccaggctttatgacgaaaacgtagaaattaattgctttctggtcttgtttcattttttttctctagattaaacctcatgcatttttaaatcctctattttggagttggtgacaaacacagacaagctgacatctgtttttcatggtaaatcctttccctgttaactaatagaacaataagtcattcatttatagatttactaaatttgtaagtttctcatatgtatcaggttatacaaaccacacctaagtggtctgctaacttctgaagcactcccagccactttaagaaacattttatgcaagtcaatgtgttgatcgtagatgatgcttacctgcacatttagtcacttggagtcaactattagcaatttttttcaactgaaatatctgtactaaaaaaatgcgtttggcctgagatctaagttagtgtacggcacaaggggggaactcaatacatatttgttgattgaaagaatacataaaagaa

SEQ ID NO: 43120 - DNA, 366 bp, Homo sapiens
gttttgttctttcggtattaaaaatcatcactatgagttttactgaaatgcaaaatatgtcacagcactgcttaaaaatcttcaaagactggctgggcgcagtggctgacgcctgtaatcccagcactttgggaggccaaggcaggcagatcacctgaggtcgggagttcgagaccagcctgaccaacgtggagaaaccccatctctactaaaaatacaaaattagccgggcatggtggtgcatgcctgtagtcccagctactagggaggctgaggcaggagaactgcttgaacccgggacgtggaggttgcagtgagccaagattgtgccaccgcactccagcctgggcaacaagagtgaaactc

SEQ ID NO: 43121 - DNA, 434 bp, Homo sapiens
aataaacaaatcctttgcctattcacaattaatactaaaaaaagatgtttcttgagggaagaggaagtccattttattaaaaatataactttttctaaaaactgtaacatgttttcttttctgttatataatctcttaattgtgatctatcacaaatggcattttctatcctactgatggccacttgaagcctgtaattgattcaaaagtatgttgcacataggaaatggacagttatctattttgctcaatgtaacacccaagtccacactaaagcacaaatgctatgacacctatgacagtgtccttcaccagaaaatgttttttagaaagagtagatatggcttgaacctgggaggcgaaggctgcagttagccaagattgtgtcactgcactccagcctgggcagcagagcaacagcccgtctcaaaaaa

SEQ ID NO: 43122 - DNA, 506 bp, Homo sapiens
atggtgtctccgtctttcctcactgactcaaaagccgctgtaccttagggcaacctgaaggataagtgagtgacccttgaccggtgattctctggggacaagtatatacagtctccagtgtctactgtcttttcttatcccacaggtggattgtacacataatgagcatcattgctacccaccatgtttaaacattcttggctcactacatcgtatcattaaacaatttatttcttgagaaattgcacaaaagctgtataatacctttgatcactccattttctcttaaaaagtttttggtgtgttaccattaaaaatgtcttttttcatatataacattttaattgccaaagttgtaatcccatcttttataaaatgtacagttaaacctaaaagtgtacttacagaattcttccacgtatcgagaagtttcatcatcatcatctaattattttcttttaaaaacctgccctcaggacaaataaaaacactattttatctgtcag

SEQ ID NO: 43123 - DNA, 400 bp, Homo sapiens
tacacaaaagtaagcatatttatcacactgttctgtaccttgtttcacacagtagtatatgttggatcttttcttgtaagtacaaagagagcttcctcattctttcctgcatttgcaagtaatgcatagtgtgtatgaaccccaacttattaactagtcccccattgatgggcacttagttgtttctagtcttttgctcttataaacattaatgcagggaatgaccttatcataagtcactttgcatgtgtgcaagtatatctgtgggataaatttcctagaagaaggctactcaaccaaggataatttgataattttgtaatgtttaacattttttttttgcattttaacaatttattcttagttacatttaattttaatttttaacagttgtaatttt

SEQ ID NO: 43124 - DNA, 312 bp, Homo sapiens
ctttctcttgtctattaaacctccactcctaaactcctcgtgagtgtctgtgtcctaattttcctggggcgagaagacaaactccaggtatttaccccagacaatgtagccacttcactttgatgtgtctgttttctgatgagactttaatgtactttaagttagcacaaggtcccatcttcaatggtaatgcaaccatcattccagtttctttcgagtgtatctttccagatattgtattcatatagaagtttattggtatatatattctctcccctccttttactaaatggtagcacactctaccttatc

SEQ ID NO: 43125 - DNA, 1187 bp, Homo sapiens
acaattgaaataattcttcacatggtgtgtaccattatgcatgtaggtctaatcatggacttgaatgaagggagaaaatttacaatgtgccagatatgtattttagtacttggaatagaaagacataacttccttaatgtatttgcatcttcattttaagctttgtatcttttttaaaaaacaaactctgtgtgagtttttattctcatttcagtttatggctctatcaaaatttataaattagccttgattccttacttttcccacttcccctttacagtcttatcagcaaatctataatctaccttcaaaaaattttcaaaatctcaccttttattaatcatttcccccattaacaccctaatccaagccaccataaacaacccttatcatctgtgtagcctattgttgatctccttcattccatctgttcttgttcctctttagtcaagttctttttccacacagcagccaggctaattttaaagtttaagtgatactaaattaagtcactgttcccttgcttaaaactgtttagtgctttccatttcattgagaataaaattgaagctcttttcatggtctctaatattctacatagacttacccctgtatacctcttgatggtcttttttaatgtctgttgattacagccacactggccctgatattacttgaacaagccagtcattctggtgtttgctattccttctgcctggactgtttttcctccaggtgttagtacagccagcttcatttcattaaggtacttgtcccagtgccttctaatcaatctaagtattgtctctttgccttttctaatttctttatggtgctcatggctctaattgtataaaattatgtttttattatttgtctcctcctcctgcaaaatataaattgtatgaggctagaaactttgtcttcattgctttatttgtagtgcctggaacattgcctaatctaaatatctctgaaggctttaaaacttttatgacgtattcctcctggtactgagtgttatagtgaaattagaagtaacatattgagaactatagttctttcccaatttttgaagcattctataagctgatggtggtatctccttaatagaattacgtttgaaaagagaaaatattattctagtgttctgttttcaataaaatctctagttaaaagttctcatg

SEQ ID NO: 43126 - DNA, 735 bp, Homo sapiens
ggagagatggccgagtcagcccctgcccaggcctcagtctctccgggaccctcccagtcagggctgagcctgggggcacacggctgatggtaggggctctgggaagaaagctttgctgggagctggagggagctctggacccagaggtgaggtgtggatggagggaatggacacagacctccctcttttccaccacgtgggcccggaggtctgtctgtgtgcagttcctgacttctccctctccttttctccccttctgtctgcctgaggacacaggccccagggacgccccaggagagaaggggaacagagagcggggtgcttctatctcctacgagacagagctgttcattaggcttggcccagttcccctctgactgggggccgcccctaggtggggagcagtccctctgagcctctggtcccaggtagagagtggtctctgtgtgcctctggccccaggtggggagtggcccttctgagcccctggcccccagtggggagtggtctctctgagtctctggccccaggtggtgagtggcccctctgagtctctggccccaggtggggagtggcctctctgtgtctctggccccaggtgggcagtggtccctctgctctctgtgcttgtcttggggagcaccttgccagtcatcagcccctctgaccactgctctggggcccagagaagagctgaacaccagttctgcctccccagacctcacaggtattggt

SEQ ID NO: 43127 - DNA, 393 bp, Homo sapiens
cccctggttcctgtgaacaggactgaacaaataaataatgaatttgaaaagtaagcggaaaagcaaaatttatattcctgtcgccaaggcagtatcttataattcagggatatttctgggctagatagagttgtatgggtgcctggtccggttctgtcactttccaaaagccagttggaaccttatttttctccgctgtaaaatgaaagaatttacctaaaatgaggttctttaaattctttctcagcttgagaatcctccaatacagttaaagaaatacttacaaagaaaagtttactaggcagtacagcaaatcacagagaatccttataggacagtataagcaattcattgtttaggaagtcaagaataaaaactgtttcaggcttcatc

SEQ ID NO: 43128 - DNA, 400 bp, Homo sapiens
gcagttgcatctcccagcacaacatctgatgtggtgccctacccctagggatccagaggctccattgactcacatagctgtgctttctagagccaagaatatgtgttgcctcacatcccaggaaatagaagcttgacttagtggtgccactccagtcatcaggccaaatggccccagcaccccacctacctggaacttgactagctccccatagtctgagctgctgaggcaccttgcctctctggggagtggagtcattgctgtgctgttccccacccgctggagcccaagtcacagtggcatcttgccattcctgggtccttgctgcttctgcatctgcctcacagagcctaggctactgccacgtcccaccattccagggtccagattcctcactgtt

SEQ ID NO: 43129 - DNA, 550 bp, Homo sapiens
agtttatcattaagccctaacaagactgcaaagttgcttagcaacagaatcaggcacccttaacaggaacatgcatgggaacaatggtgaaacataattgagccttaaaaaggcaaattctttgaattaaatcgtgaaaagacaatgtgtcatgggaagaatgagtattttaacctaagacttgttctctaagcattattttatagctagacctaagtgtctttccatagaataaataatgatacttttagtctttatataatttaaggcacttaaaaaagattgtttatccaagttagctcaacaatgcataatatctctattttgacccattaattatcttcaacattgtagagatacataaagaaaggaaggctcttacaaaaataaacactacaaaatatttgatgactgcaagggtttaattttgatgttatgtataatttaaactatcagaaactcaaaaactgtacttttattttttaaatttgaatatacatttacatatacacacataacgtatctaattcccatttgcaggaaaaaaaaa

SEQ ID NO: 43130 - DNA, 417 bp, Homo sapiens
gcgtcgacctctcatgtaatatattttccaatgaaaagaggcaggaggcagaaaagaaattatcacaatgtaagtgctagaaagaattaagccgggcaagagagagtgatgggtaaaggcaggggactttattttatctggggtggttcaacaaagcctttctggttaggtgacatttggcaggatgtggaggaatcgatggagtgagacactgggtagcgcagggaagaggatcagagtcattggaagggtcttgggggcagggctgtgttgggaggtctggaggaataagaaagaggcagtgtggttggagcagagggacagtgaagatgctggaggtaggagatgaggaacctgcagggccattgtaaagagtgtgagcttttattccgagtcccatgggaagccattgaacag

SEQ ID NO: 43131 - DNA, 604 bp, Homo sapiens
ggctgatataaactgtgcatgtatgtgggagcctataagtgcctggagaaaagcaacaactagaaagctaaaagagctgaacagatacattagatgaagaggagacaaagttaggagtttgagtttacaaagttagaagggtttggtaaatgtctcaggctttatgaatcccagaaggatcaaaccttagaaatatagatgatagctaagaactaagaaattaattatagaaagagagacaaacctgaagcattgaaagtttctgtcaaataataaaaccagtcctcttcaaatcaaagtggtcgactagtaatttaataacctgctagaagaaaaatgcattgcattagagaaagataaccaaacccagagtttgtataaatatcatgcacaatgttcaactgtaattcaaaaattaccagtgatggatacagaaaaatgtgacatgtaatttttttttaaagtccatggaaatagattcctcgatgattcagaagttgtagacaaggactttaaagcagaaattataaatatattcaggattttaaaaaaatatgttttcaggcccggtgcggtagctcacgcctataatccaccagatgtg

SEQ ID NO: 43132 - DNA, 585 bp, Homo sapiens
gtgtggttgcctgtttcggccatgtatccactgcgaagtggtcatttagggtcacatgtataagtagcagtctatgtgattgttagtaacccctgaagctgtgcagtgcctgaagttaaattccattactcctaatgcaggattctggaagcctgagagcagggaggaaagaaagctgaaaacttgctttctcagagcctcctccccctatcattgtgagagtgtgatgtaatgcttctcggtctggtgggctgaaaggattgtagtttgtgatgtggcgggtaaattgcccccacccctgggtaaattactccacccccctgagcacatccctggctctgagaggccttgttttcttttctctttttttcctaatttgtatcctcctgatttatgctgtggcatattggcatgagaaagagactgttcttctaaatctgttacaaagtatagtttagaaaaggcatttaaaatatgcaaatgggttgaattgtcatatccccatcattaaatatgtagacgtggattaaagctaattaagcataaatggaataattttgatcagaagggagcagtgttttttgt

SEQ ID NO: 43133 - DNA, 609 bp, Homo sapiens
cagaatatgtattttgtgtttattcagctcctgtcaagtggttctgcttggtttgccataatcctcatggttgttacatgtctatttcttgatatcataaagaaggtctttgacgagcacctccaccctacaagtactgaaaaggcacagatgtactccaacacagttgctttaagtgacgagttcatcgcactgcagccattgtcgagggcaaggaatcagctgagcaaacttagcttactgaaacaaatgcaggtatcaagtgcttggactccatgtgctgtttcccggaaggagaagcagcgtgtgcatctgttggaagaatgctggaacgagttataggaagatgtagtccaacccacatcagcaggtgtgaaatctctctaagtagcctttgctgcagatgagtatcctatctggaacaggatgaacctgccgctctagatacctaataaatcagcagctggttttaccaactgaagcaggaagtctgctatttattagcactctttggtggtagatttcactttgtggctttggggtaagggctttttcactcacaaaggaagagaaagcacctttgaagagacttcatctaatgaacaaaaa

SEQ ID NO: 43134 - DNA, 6150 bp, Homo sapiens
agcactatcttgaagtatacatggcaagctgaagaaaaatgggatgaaccttggtataaccaaaaaacagaacatcaaagaaatagcagtaagattctgagatttatttcagacttccttgcttttttggttctctacaatttcatcattccaatttcattatatgtgacagtcgaaatgcagaaatttcttggatcattttttattggctgggatcttgatctgtatcatgaagaatcagatcagaaagctcaagtcaatacttccgatctgaatgaagagcttggacaggtagagtacgtgtttacagataaaactggtacactgacagaaaatgagatgcagtttcgggaatgttcaattaatggcatgaaataccaagaaattaatggtagacttgtacccgaaggaccaacaccagactcttcagaaggaaacttatcttatcttagtagtttatcccatcttaacaacttatcccatcttacaaccagttcctctttcagaaccagtcctgaaaatgaaactgaactaattaaagaacatgatctcttctttaaagcagtcagtctctgtcacactgtacagattagcaatgttcaaactgactgcactggtgatggtccctggcaatccaacctggcaccatcgcagttggagtactatgcatcttcaccagatgaaaaggctctagtagaagctgctgcaaggattggtattgtgtttattggcaattctgaagaaactatggaggttaaaactcttggaaaactggaacggtacaaactgcttcatattctggaatttgattcagatcgtaggagaatgagtgtaattgttcaggcaccttcaggtgagaagttattatttgctaaaggagctgagtcatcaattctccctaaatgtataggtggagaaatagaaaaaaccagaattcatgtagatgaatttgctttgaaagggctaagaactctgtgtatagcatatagaaaatttacatcaaaagagtatgaggaaatagataaacgcatatttgaagccaggactgccttgcagcagcgggaagagaaattggcagctgttttccagttcatagagaaagacctgatattacttggagccacagcagtagaagacagactacaagataaagttcgagaaactattgaagcattgagaatggctggtatcaaagtatgggtacttactggggataaacatgaaacagctgttagtgtgagtttatcatgtggccattttcatagaaccatgaacatccttgaacttataaaccagaaatcagacagcgagtgtgctgaacaattgaggcagcttgccagaagaattacagaggatcatgtgattcagcatgggctggtagtggatgggaccagcctatctcttgcactcagggagcatgaaaaactatttatggaagtttgcagaaattgttcagctgtattatgctgtcgtatggctccactgcagaaagcaaaagtaataagactaataaaaatatcacctgagaaacctataacattggctgttggtgatggtgctaatgacgtaagcatgatacaagaagcccatgttggcataggaatcatgggtaaagaaggaagacaggctgcaagaaacagtgactatgcaatagccagatttaagttcctctccaaattgctttttgttcatggtcatttttattatattagaatagctacccttgtacagtattttttttataagaatgtgtgctttatcacaccccagtttttatatcagttctactgtttgttttctcagcaaacattgtatgacagcgtgtacctgactttatacaatatttgttttacttccctacctattctgatatatagtcttttggaacagcatgtagaccctcatgtgttacaaaataagcccaccctttatcgagacattagtaaaaaccgcctcttaagtattaaaacatttctttattggaccatcctgggcttcagtcatgcctttattttcttttttggatcctatttactaatagggaaagatacatctctgcttggaaatggccagatgtttggaaactggacatttggcactttggtcttcacagtcatggttattacagtcacagtaaagatggctctggaaactcatttttggacttggatcaaccatctcgttacctggggatctattatattttattttgtattttccttgttttatggagggattctctggccatttttgggctcccagaatatgtattttgtgtttattcagctcctgtcaagtggttctgcttggtttgccataatcctcatggttgttacatgtctatttcttgatatcataaagaaggtctttgaccgacacctccaccctacaagtactgaaaaggcacagcttactgaaacaaatgcaggtatcaagtgcttggactccatgtgctgtttcccggaaggagaagcagcgtgtgcatctgttggaagaatgctggaacgagttataggaagatgtagtccaacccacatcagcagatcatggagtgcatcggatcctttctataccaacgacaggagcatcttgactctctccacaatggactcatctacttgttaaaggggcagtagtactttgtgggagccagttcacctcctttcctaaaattcagtgtgatcaccctgttaatggccacactagctctgaaattaatttccaaaatctttgtagtagttcatacccactcagagttataatggcaaacaaacagaaagcattagtacaagcccctcccaacacccttaatttgaatctgaacatgttaaaatttgagaataaagagacatttttcatctctttgtctggtttgtcccttgtgcttatgggactcctaatggcatttcagtctgttgctgaggccattatattttaatataaatgtagaaaaaagagagaaatcttagtaaagagtattttttagtattagcttgattattgactcttctatttaaatctgcttctgtaaattatgctgaaagtttgccttgagaactctatttttttattagagttatatttaaagcttttcatgggaaaagttaatgtgaatactgaggaattttggtccctcagtgacctgtgttgttaattcattaatgcattctgagttcacagagcaaattaggagaatcatttccaaccattatttactgcagtatggggagtaaatttataccaattcctctaactgtactgtaacacagcctgtaaagttagccatataaatgcaagggtatatcatatatacaaatcaggaatcaggtccgttcaccgaacttcaaattgatgtttactaatatttttgtgacagagtataaagaccctatagtgggtaaattagatactattagcatattattaatttaatgtctttatcattggatcttttgcatgctttaatctggttaacatatttaaatttgctttttttctctttacctgaaggctctgtgtatagtatttcatgacatcgttgtacagtttaactatatcaataaaaagtttggacagtatttaaatattgcaaatatgtttaattatacaaatcagaatagtatgggtaattaaatgaatacaaaaagaagagcctctttctgcagccgacttagacatgctcttccctttctataagctagattttagaataaagggtttcagttaataatcttattttcaggttatgtcatctaacttatagcaaactaccacaatacagtgagttctgccagtgtcccagtacaaggcatatttcaggtgtggctgtggaatgtaaaaatgctcaacttgtatcaggtaatgttagcaataaattaaatgctaagaatgattaatcgggtacatgttactgtaattaactcattgcacttcaaaacctaacttccatcctgaatttatcaagtagttcagtattgtcatttgtttttgttttattgaaaagtaatgttgtcttaagatttagaagtgattattagcttgagaactattacccagctctaagcaaataatgattgtatacatattaagataatggttaaatgcggttttaccaagttttcccttgaaaatgtaattcctttatggagatttattgtgcagccctaagcttccttcccatttcatgaatataaggcttctagaattggactggcaggggaaagaatggtagagacagaaattaagactttatccttgtttgcttgtaaactattattttcttgctaatgtaacatttgtctgttccagtgatgtaaggatattaagttattaagctaaatattaattttcaaaaatagtccttctttaacttagatatttcatagctggatttaggaagatctgttattctggaagtactaaaaagaataatacaacgtacaatgtctgcattcactaattcatgttccagaagaggaaataatgaagatatactcagtagagtactaggtgggaggatatggaaatttgctcataaaatctcttataaaacgtgcatataacaaaatgacacccagtaggcctgcattacatttacatgaccgtgtttatttgccatcaaataaactgagtactgacaccagacaaagactccaaagtcataaaatagcctatgaccaactgcagcaagacaggaggtcagctcgcctataatggtgcttaaagtgtgattgatgtaattttctgtactcaccatttgaagttagttaaggagaactttatttttttaaaaaaagtaaatggcaaccactagtgtgctcatcctgaactgttactccaaatccactccgtttttaaagcaaaattatcttgtgattttaagaaaagagttttctatttatttaagaaagtaacaatgcagtctgcaagctttcagtagttttctagtgctatattcatcctgtaaaactcttactacgtaaccagtaatcacaaggaaagtgtcccctttgcatatttctttaaaattctttctttggaaagtatgatgttgataattaacttacccttatctgccaaaaccagagcaaaatgctaaatacgttattgctaatcagtggtctcaaatcgatttgcctccctttgcctcgtctgagggctgtaagcctgaagatagtggcaagcaccaagtcagtttccaaaattgcccctcagctgctttaagtgactcagcaccctgcctcagcttcagcaggcgtaggctcaccctgggcggagcaaagtatgggccagggagaactacagctacgaagacctgctgtcgagttgagaaaaggggagaatttatggtctgaattttctaactgtcctctttcttgggtctaaagctcataatacacaaaggcttccagacctgagccacacccaggccctatcctgaacaggagactaaacagaggcaaatcaaccctaggaaatacttgcattctgccctacggttagtaccaggactgaggtcatttctactggaaaagattgtgagattgaacttatctgatcgcttgagactcctaataggcaggagtcaaggccactagaaaattgacagttaagagccaaaagtttttaaaatatgctactctgaaaaatctcgtgaaggctgtaggaaaagggagaatcttccatgttggtgtttttcctgtaaagatcagtttggggtatgatataagcaggtattaataaaaataacacaccaaagagttacgtaaaacatgttttattaattttggtccccacgtacagacattttatttctattttgaaatgagttatctattttcataaaagtaaaacactattaaagtgctgttttatgtgaaataacttgaatgttgttcctataaaaaatagatcataactcatgatatgtttgtaatcatggtaatttagatttttatgaggaatgagtatctggaaatattgtagcaatacttggtttaaaattttggacctgagacactgtggctgtctaatgtaatcctttaaaaattctctgcattgtcagtaaatgtagtatattattgtacagctactcataattttttaaagtttatgaagttatatttatcaaataaaaactttcctatataa

SEQ ID NO: 43135 - DNA, 6570 bp, Homo sapiens
agcactatcttgaagtatacatggcaagctgaagaaaaatgggatgaaccttggtataaccaaaaaacagaacatcaaagaaatagcagtaagattctgagatttatttcagacttccttgcttttttggttctctacaatttcatcattccaatttcattatatgtgacagtcgaaatgcagaaatttcttggatcattttttattggctgggatcttgatctgtatcatgaagaatcagatcagaaagctcaagtcaatacttccgatctgaatgaagagcttggacaggtagagtacgtgtttacagataaaactggtacactgacagaaaatgagatgcagtttcgggaatgttcaattaatggcatgaaataccaagaaattaatggtagacttgtacccgaaggaccaacaccagactcttcagaaggaaacttatcttatcttagtagtttatcccatcttaacaacttatcccatcttacaaccagttcctctttcagaaccagtcctgaaaatgaaactgaactaattaaagaacatgatctcttctttaaagcagtcagtctctgtcacactgtacagattagcaatgttcaaactgactgcactggtgatggtccctggcaatccaacctggcaccatcgcagttggagtactatgcatcttcaccagatgaaaaggctctagtagaagctgctgcaaggattggtattgtgtttattggcaattctgaagaaactatggaggttaaaactcttggaaaactggaacggtacaaactgcttcatattctggaatttgattcagatcgtaggagaatgagtgtaattgttcaggcaccttcaggtgagaagttattatttgctaaaggagctgagtcatcaattctccctaaatgtataggtggagaaatagaaaaaaccagaattcatgtagatgaatttgctttgaaagggctaagaactctgtgtatagcatatagaaaatttacatcaaaagagtatgaggaaatagataaacgcatatttgaagccaggactgccttgcagcagcgggaagagaaattggcagctgttttccagttcatagagaaagacctgatattacttggagccacagcagtagaagacagactacaagataaagttcgagaaactattgaagcattgagaatggctggtatcaaagtatgggtacttactggggataaacatgaaacagctgttagtgtgagtttatcatgtggccattttcatagaaccatgaacatccttgaacttataaaccagaaatcagacagcgagtgtgctgaacaattgaggcagcttgccagaagaattacagaggatcatgtgattcagcatgggctggtagtggatgggaccagcctatctcttgcactcagggagcatgaaaaactatttatggaagtttgcagaaattgttcagctgtattatgctgtcgtatggctccactgcagaaagcaaaagtaataagactaataaaaatatcacctgagaaacctataacattggctgttggtgatggtgctaatgacgtaagcatgatacaagaagcccatgttggcataggaatcatgggtaaagaaggaagacaggctgcaagaaacagtgactatgcaatagccagatttaagttcctctccaaattgctttttgttcatggtcatttttattatattagaatagctacccttgtacagtattttttttataagaatgtgtgctttatcacaccccagtttttatatcagttctactgtttgttttctcagcaaacattgtatgacagcgtgtacctgactttatacaatatttgttttacttccctacctattctgatatatagtcttttggaacagcatgtagaccctcatgtgttacaaaataagcccaccctttatcgagacattagtaaaaaccgcctcttaagtattaaaacatttctttattggaccatcctgggcttcagtcatgcctttattttcttttttggatcctatttactaatagggaaagatacatctctgcttggaaatggccagatgtttggaaactggacatttggcactttggtcttcacagtcatggttattacagtcacagtaaagatggctctggaaactcatttttggacttggatcaaccatctcgttacctggggatctattatattttattttgtattttccttgttttatggagggattctctggccatttttgggctcccagaatatgtattttgtgtttattcagctcctgtcaagtggttctgcttggtttgccataatcctcatggttgttacatgtctatttcttgatatcataaagaaggtctttgaccgacacctccaccctacaagtactgaaaaggcacagcttactgaaacaaatgcaggtatcaagtgcttggactccatgtgctgtttcccggaaggagaagcagcgtgtgcatctgttggaagaatgctggaacgagttataggaagatgtagtccaacccacatcagcagatcatggagtgcatcggatcctttctataccaacgacaggagcatcttgactctctccacaatggactcatctacttgttaaaggggcagtagtactttgtgggagccagttcacctcctttcctaaaattcagtgtgatcaccctgttaatggccacactagctctgaaattaatttccaaaatctttgtagtagttcatacccactcagagttataatggcaaacaaacagaaagcattagtacaagcccctcccaacacccttaatttgaatctgaacatgttaaaatttgagaataaagagacatttttcatctctttgtctggtttgtcccttgtgcttatgggactcctaatggcatttcagtctgttgctgaggccattatattttaatataaatgtagaaaaaagagagaaatcttagtaaagagtattttttagtattagcttgattattgactcttctatttaaatctgcttctgtaaattatgctgaaagtttgccttgagaactctatttttttattagagttatatttaaagcttttcatgggaaaagttaatgtgaatactgaggaattttggtccctcagtgacctgtgttgttaattcattaatgcattctgagttcacagagcaaattaggagaatcatttccaaccattatttactgcagtatggggagtaaatttataccaattcctctaactgtactgtaacacagcctgtaaagttagccatataaatgcaagggtatatcatatatacaaatcaggaatcaggtccgttcaccgaacttcaaattgatgtttactaatatttttgtgacagagtataaagaccctatagtgggtaaattagatactattagcatattattaatttaatgtctttatcattggatcttttgcatgctttaatctggttaacatatttaaatttgctttttttctctttacctgaaggctctgtgtatagtatttcatgacatcgttgtacagtttaactatatcaataaaaagtttggacagtatttaaatattgcaaatatgtttaattatacaaatcagaatagtatgggtaattaaatgaatacaaaaagaagagcctctttctgcagccgacttagacatgctcttccctttctataagctagattttagaataaagggtttcagttaataatcttattttcaggttatgtcatctaacttatagcaaactaccacaatacagtgagttctgccagtgtcccagtacaaggcatatttcaggtgtggctgtggaatgtaaaaatgctcaacttgtatcaggtaatgttagcaataaattaaatgctaagaatgattaatcgggtacatgttactgtaattaactcattgcacttcaaaacctaacttccatcctgaatttatcaagtagttcagtattgtcatttgtttttgttttattgaaaagtaatgttgtcttaagatttagaagtgattattagcttgagaactattacccagctctaagcaaataatgattgtatacatattaagataatggttaaatgcggttttaccaagttttcccttgaaaatgtaattcctttatggagatttattgtgcagccctaagcttccttcccatttcatgaatataaggcttctagaattggactggcaggggaaagaatggtagagacagaaattaagactttatccttgtttgcttgtaaactattattttcttgctaatgtaacatttgtctgttccagtgatgtaaggatattaagttattaagctaaatattaattttcaaaaatagtccttctttaacttagatatttcatagctggatttaggaagatctgttattctggaagtactaaaaagaataatacaacgtacaatgtctgcattcactaattcatgttccagaagaggaaataatgaagatatactcagtagagtactaggtgggaggatatggaaatttgctcataaaatctcttataaaacgtgcatataacaaaatgacacccagtaggcctgcattacatttacatgaccgtgtttatttgccatcaaataaactgagtactgacaccagacaaagactccaaagtcataaaatagcctatgaccaactgcagcaagacaggaggtcagctcgcctataatggtgcttaaagtgtgattgatgtaattttctgtactcaccatttgaagttagttaaggagaactttatttttttaaaaaaagtaaatggcaaccactagtgtgctcatcctgaactgttactccaaatccactccgtttttaaagcaaaattatcttgtgattttaagaaaagagttttctatttatttaagaaagtaacaatgcagtctgcaagctttcagtagttttctagtgctatattcatcctgtaaaactcttactacgtaaccagtaatcacaaggaaagtgtcccctttgcatatttctttaaaattctttctttggaaagtatgatgttgataattaacttacccttatctgccaaaaccagagcaaaatgctaaatacgttattgctaatcagtggtctcaaatcgatttgcctccctttgcctcgtctgagggctgtaagcctgaagatagtggcaagcaccaagtcagtttccaaaattgcccctcagctgctttaagtgactcagcaccctgcctcagcttcagcaggcgtaggctcaccctgggcggagcaaagtatgggccagggagaactacagctacgaagacctgctgtcgagttgagaaaaggggagaatttatggtctgaattttctaactgtcctctttcttgggtctaaagctcataatacacaaaggcttccagacctgagccacacccaggccctatcctgaacaggagactaaacagaggcaaatcaaccctaggaaatacttgcattctgccctacggttagtaccaggactgaggtcatttctactggaaaagattgtgagattgaacttatctgatcgcttgagactcctaataggcaggagtcaaggccactagaaaattgacagttaagagccaaaagtttttaaaatatgctactctgaaaaatctcgtgaaggctgtaggaaaagggagaatcttccatgttggtgtttttcctgtaaagatcagtttggggtatgatataagcaggtattaataaaaataacacaccaaagagttacgtaaaacatgttttattaattttggtccccacgtacagacattttatttctattttgaaatgagttatctattttcataaaagtaaaacactattaaagtgctgttttatgtgaaataacttgaatgttgttcctataaaaaatagatcataactcatgatatgtttgtaatcatggtaatttagatttttatgaggaatgagtatctggaaatattgtagcaatacttggtttaaaattttggacctgagacactgtggctgtctaatgtaatcctttaaaaattctctgcattgtcagtaaatgtagtatattattgtacagctactcataattttttaaagtttatgaagttatatttatcaaataaaaactttcctatataaaaaaaaaaaaaaaacaaaaaaaaaaaaaacaaaaaaaacacaaaaaaaaaaaaaaaacaacaaaaaataaaaacaaacaaaaaaaacaaaataacaaaacagaaaatccctacccaaacaactcaccacccgcgcagttgtcccaattttaatatatactaacgcagcagagacgacaatcagacacgcatcagacctagcttgttactataacaaaaaggcgcacatacaatgaatattgactatatatagaaccaaagccgacagtaactaatcaactaatagagtcaaatacattactcgtgcttatcacttgagaaaaacacacttatagtgggtgcgatataacgtgacacacactcaaaatataagcaaaaataaaaatatgtgagtggtgcaaaacacaccttgtgagggaga

SEQ ID NO: 43136 - DNA, 6363 bp, Homo sapiens
agcactatcttgaagtatacatggcaagctgaagaaaaatgggatgaaccttggtataaccaaaaaacagaacatcaaagaaatagcagtaagattctgagatttatttcagacttccttgcttttttggttctctacaatttcatcattccaatttcattatatgtgacagtcgaaatgcagaaatttcttggatcattttttattggctgggatcttgatctgtatcatgaagaatcagatcagaaagctcaagtcaatacttccgatctgaatgaagagcttggacaggtagagtacgtgtttacagataaaactggtacactgacagaaaatgagatgcagtttcgggaatgttcaattaatggcatgaaataccaagaaattaatggtagacttgtacccgaaggaccaacaccagactcttcagaaggaaacttatcttatcttagtagtttatcccatcttaacaacttatcccatcttacaaccagttcctctttcagaaccagtcctgaaaatgaaactgaactaattaaagaacatgatctcttctttaaagcagtcagtctctgtcacactgtacagattagcaatgttcaaactgactgcactggtgatggtccctggcaatccaacctggcaccatcgcagttggagtactatgcatcttcaccagatgaaaaggctctagtagaagctgctgcaaggattggtattgtgtttattggcaattctgaagaaactatggaggttaaaactcttggaaaactggaacggtacaaactgcttcatattctggaatttgattcagatcgtaggagaatgagtgtaattgttcaggcaccttcaggtgagaagttattatttgctaaaggagctgagtcatcaattctccctaaatgtataggtggagaaatagaaaaaaccagaattcatgtagatgaatttgctttgaaagggctaagaactctgtgtatagcatatagaaaatttacatcaaaagagtatgaggaaatagataaacgcatatttgaagccaggactgccttgcagcagcgggaagagaaattggcagctgttttccagttcatagagaaagacctgatattacttggagccacagcagtagaagacagactacaagataaagttcgagaaactattgaagcattgagaatggctggtatcaaagtatgggtacttactggggataaacatgaaacagctgttagtgtgagtttatcatgtggccattttcatagaaccatgaacatccttgaacttataaaccagaaatcagacagcgagtgtgctgaacaattgaggcagcttgccagaagaattacagaggatcatgtgattcagcatgggctggtagtggatgggaccagcctatctcttgcactcagggagcatgaaaaactatttatggaagtttgcagaaattgttcagctgtattatgctgtcgtatggctccactgcagaaagcaaaagtaataagactaataaaaatatcacctgagaaacctataacattggctgttggtgatggtgctaatgacgtaagcatgatacaagaagcccatgttggcataggaatcatgggtaaagaaggaagacaggctgcaagaaacagtgactatgcaatagccagatttaagttcctctccaaattgctttttgttcatggtcatttttattatattagaatagctacccttgtacagtattttttttataagaatgtgtgctttatcacaccccagtttttatatcagttctactgtttgttttctcagcaaacattgtatgacagcgtgtacctgactttatacaatatttgttttacttccctacctattctgatatatagtcttttggaacagcatgtagaccctcatgtgttacaaaataagcccaccctttatcgagacattagtaaaaaccgcctcttaagtattaaaacatttctttattggaccatcctgggcttcagtcatgcctttattttcttttttggatcctatttactaatagggaaagatacatctctgcttggaaatggccagatgtttggaaactggacatttggcactttggtcttcacagtcatggttattacagtcacagtaaagatggctctggaaactcatttttggacttggatcaaccatctcgttacctggggatctattatattttattttgtattttccttgttttatggagggattctctggccatttttgggctcccagaatatgtattttgtgtttattcagctcctgtcaagtggttctgcttggtttgccataatcctcatggttgttacatgtctatttcttgatatcataaagaaggtctttgaccgacacctccaccctacaagtactgaaaaggcacagcttactgaaacaaatgcaggtatcaagtgcttggactccatgtgctgtttcccggaaggagaagcagcgtgtgcatctgttggaagaatgctggaacgagttataggaagatgtagtccaacccacatcagcagatcatggagtgcatcggatcctttctataccaacgacaggagcatcttgactctctccacaatggactcatctacttgttaaaggggcagtagtactttgtgggagccagttcacctcctttcctaaaattcagtgtgatcaccctgttaatggccacactagctctgaaattaatttccaaaatctttgtagtagttcatacccactcagagttataatggcaaacaaacagaaagcattagtacaagcccctcccaacacccttaatttgaatctgaacatgttaaaatttgagaataaagagacatttttcatctctttgtctggtttgtcccttgtgcttatgggactcctaatggcatttcagtctgttgctgaggccattatattttaatataaatgtagaaaaaagagagaaatcttagtaaagagtattttttagtattagcttgattattgactcttctatttaaatctgcttctgtaaattatgctgaaagtttgccttgagaactctatttttttattagagttatatttaaagcttttcatgggaaaagttaatgtgaatactgaggaattttggtccctcagtgacctgtgttgttaattcattaatgcattctgagttcacagagcaaattaggagaatcatttccaaccattatttactgcagtatggggagtaaatttataccaattcctctaactgtactgtaacacagcctgtaaagttagccatataaatgcaagggtatatcatatatacaaatcaggaatcaggtccgttcaccgaacttcaaattgatgtttactaatatttttgtgacagagtataaagaccctatagtgggtaaattagatactattagcatattattaatttaatgtctttatcattggatcttttgcatgctttaatctggttaacatatttaaatttgctttttttctctttacctgaaggctctgtgtatagtatttcatgacatcgttgtacagtttaactatatcaataaaaagtttggacagtatttaaatattgcaaatatgtttaattatacaaatcagaatagtatgggtaattaaatgaatacaaaaagaagagcctctttctgcagccgacttagacatgctcttccctttctataagctagattttagaataaagggtttcagttaataatcttattttcaggttatgtcatctaacttatagcaaactaccacaatacagtgagttctgccagtgtcccagtacaaggcatatttcaggtgtggctgtggaatgtaaaaatgctcaacttgtatcaggtaatgttagcaataaattaaatgctaagaatgattaatcgggtacatgttactgtaattaactcattgcacttcaaaacctaacttccatcctgaatttatcaagtagttcagtattgtcatttgtttttgttttattgaaaagtaatgttgtcttaagatttagaagtgattattagcttgagaactattacccagctctaagcaaataatgattgtatacatattaagataatggttaaatgcggttttaccaagttttcccttgaaaatgtaattcctttatggagatttattgtgcagccctaagcttccttcccatttcatgaatataaggcttctagaattggactggcaggggaaagaatggtagagacagaaattaagactttatccttgtttgcttgtaaactattattttcttgctaatgtaacatttgtctgttccagtgatgtaaggatattaagttattaagctaaatattaattttcaaaaatagtccttctttaacttagatatttcatagctggatttaggaagatctgttattctggaagtactaaaaagaataatacaacgtacaatgtctgcattcactaattcatgttccagaagaggaaataatgaagatatactcagtagagtactaggtgggaggatatggaaatttgctcataaaatctcttataaaacgtgcatataacaaaatgacacccagtaggcctgcattacatttacatgaccgtgtttatttgccatcaaataaactgagtactgacaccagacaaagactccaaagtcataaaatagcctatgaccaactgcagcaagacaggaggtcagctcgcctataatggtgcttaaagtgtgattgatgtaattttctgtactcaccatttgaagttagttaaggagaactttatttttttaaaaaaagtaaatggcaaccactagtgtgctcatcctgaactgttactccaaatccactccgtttttaaagcaaaattatcttgtgattttaagaaaagagttttctatttatttaagaaagtaacaatgcagtctgcaagctttcagtagttttctagtgctatattcatcctgtaaaactcttactacgtaaccagtaatcacaaggaaagtgtcccctttgcatatttctttaaaattctttctttggaaagtatgatgttgataattaacttacccttatctgccaaaaccagagcaaaatgctaaatacgttattgctaatcagtggtctcaaatcgatttgcctccctttgcctcgtctgagggctgtaagcctgaagatagtggcaagcaccaagtcagtttccaaaattgcccctcagctgctttaagtgactcagcaccctgcctcagcttcagcaggcgtaggctcaccctgggcggagcaaagtatgggccagggagaactacagctacgaagacctgctgtcgagttgagaaaaggggagaatttatggtctgaattttctaactgtcctctttcttgggtctaaagctcataatacacaaaggcttccagacctgagccacacccaggccctatcctgaacaggagactaaacagaggcaaatcaaccctaggaaatacttgcattctgccctacggttagtaccaggactgaggtcatttctactggaaaagattgtgagattgaacttatctgatcgcttgagactcctaataggcaggagtcaaggccactagaaaattgacagttaagagccaaaagtttttaaaatatgctactctgaaaaatctcgtgaaggctgtaggaaaagggagaatcttccatgttggtgtttttcctgtaaagatcagtttggggtatgatataagcaggtattaataaaaataacacaccaaagagttacgtaaaacatgttttattaattttggtccccacgtacagacattttatttctattttgaaatgagttatctattttcataaaagtaaaacactattaaagtgctgttttatgtgaaataacttgaatgttgttcctataaaaaatagatcataactcatgatatgtttgtaatcatggtaatttagatttttatgaggaatgagtatctggaaatattgtagcaatacttggtttaaaattttggacctgagacactgtggctgtctaatgtaatcctttaaaaattctctgcattgtcagtaaatgtagtatattattgtacagctactcataattttttaaagtttatgaagttatatttatcaaataaaaactttcctatataattaaaagtgttcctttatttaagcattttaagcctgtctctgtttatcacaacctgcactgccaaacttgtttcaagttaagttttactgtatttacccttcattatagcacagggatatcatttatgcctttcactgactgcagttttttaaaatgtagtcgacgcggccgcgaatttagtagtagtagtcgacccgggaatttccggaccg

SEQ ID NO: 43137 - DNA, 3577 bp, Homo sapiens
agcactatcttgaagtatacatggcaagctgaagaaaaatgggatgaaccttggtataaccaaaaaacagaacatcaaagaaatagcagtaagattctgagatttatttcagacttccttgcttttttggttctctacaatttcatcattccaatttcattatatgtgacagtcgaaatgcagaaatttcttggatcattttttattggctgggatcttgatctgtatcatgaagaatcagatcagaaagctcaagtcaatacttccgatctgaatgaagagcttggacaggtagagtacgtgtttacagataaaactggtacactgacagaaaatgagatgcagtttcgggaatgttcaattaatggcatgaaataccaagaaattaatggtagacttgtacccgaaggaccaacaccagactcttcagaaggaaacttatcttatcttagtagtttatcccatcttaacaacttatcccatcttacaaccagttcctctttcagaaccagtcctgaaaatgaaactgaactaattaaagaacatgatctcttctttaaagcagtcagtctctgtcacactgtacagattagcaatgttcaaactgactgcactggtgatggtccctggcaatccaacctggcaccatcgcagttggagtactatgcatcttcaccagatgaaaaggctctagtagaagctgctgcaaggattggtattgtgtttattggcaattctgaagaaactatggaggttaaaactcttggaaaactggaacggtacaaactgcttcatattctggaatttgattcagatcgtaggagaatgagtgtaattgttcaggcaccttcaggtgagaagttattatttgctaaaggagctgagtcatcaattctccctaaatgtataggtggagaaatagaaaaaaccagaattcatgtagatgaatttgctttgaaagggctaagaactctgtgtatagcatatagaaaatttacatcaaaagagtatgaggaaatagataaacgcatatttgaagccaggactgccttgcagcagcgggaagagaaattggcagctgttttccagttcatagagaaagacctgatattacttggagccacagcagtagaagacagactacaagataaagttcgagaaactattgaagcattgagaatggctggtatcaaagtatgggtacttactggggataaacatgaaacagctgttagtgtgagtttatcatgtggccattttcatagaaccatgaacatccttgaacttataaaccagaaatcagacagcgagtgtgctgaacaattgaggcagcttgccagaagaattacagaggatcatgtgattcagcatgggctggtagtggatgggaccagcctatctcttgcactcagggagcatgaaaaactatttatggaagtttgcagaaattgttcagctgtattatgctgtcgtatggctccactgcagaaagcaaaagtaataagactaataaaaatatcacctgagaaacctataacattggctgttggtgatggtgctaatgacgtaagcatgatacaagaagcccatgttggcataggaatcatgggtaaagaaggaagacaggctgcaagaaacagtgactatgcaatagccagatttaagttcctctccaaattgctttttgttcatggtcatttttattatattagaatagctacccttgtacagtattttttttataagaatgtgtgctttatcacaccccagtttttatatcagttctactgtttgttttctcagcaaacattgtatgacagcgtgtacctgactttatacaatatttgttttacttccctacctattctgatatatagtcttttggaacagcatgtagaccctcatgtgttacaaaataagcccaccctttatcgagacattagtaaaaaccgcctcttaagtattaaaacatttctttattggaccatcctgggcttcagtcatgcctttattttcttttttggatcctatttactaatagggaaagatacatctctgcttggaaatggccagatgtttggaaactggacatttggcactttggtcttcacagtcatggttattacagtcacagtaaagatggctctggaaactcatttttggacttggatcaaccatctcgttacctggggatctattatattttattttgtattttccttgttttatggagggattctctggccatttttgggctcccagaatatgtattttgtgtttattcagctcctgtcaagtggttctgcttggtttgccataatcctcatggttgttacatgtctatttcttgatatcataaagaaggtctttgaccgacacctccaccctacaagtactgaaaaggcacagcttactgaaacaaatgcaggtatcaagtgcttggactccatgtgctgtttcccggaaggagaagcagcgtgtgcatctgttggaagaatgctggaacgagttataggaagatgtagtccaacccacatcagcagatcatggagtgcatcggatcctttctataccaacgacaggagcatcttgactctctccacaatggactcatctacttgttaaaggggcagtagtactttgtgggagccagttcacctcctttcctaaaattcagtgtgatcaccctgttaatggccacactagctctgaaattaatttccaaaatctttgtagtagttcatacccactcagagttataatggcaaacaaacagaaagcattagtacaagcccctcccaacacccttaatttgaatctgaacatgttaaaatttgagaataaagagacatttttcatctctttgtctggtttgtcccttgtgcttatgggactcctaatggcatttcagtctgttgctgaggccattatattttaatataaatgtagaaaaaagagagaaatcttagtaaagagtattttttagtattagcttgattattgactcttctatttaaatctgcttctgtaaattatgctgaaagtttgccttgagaactctatttttttattagagttatatttaaagcttttcatgggaaaagttaatgtgaatactgaggaattttggtccctcagtgacctgtgttgttaattcattaatgcattctgagttcacagagcaaattaggagaatcatttccaaccattatttactgcagtatggggagtaaatttataccaattcctctaactgtactgtaacacagcctgtaaagttagccatataaatgcaagggtatatcatatatacaaatcaggaatcaggtccgttcaccgaacttcaaattgatgtttactaatatttttgtgacagagtataaagaccctatagtgggtaaattagatactattagcatattattaatttaatgtctttatcattggatcttttgcatgctttaatctggttaacatatttaaatttgctttttttctctttacctgaaggctctgtgtatagtatttcatgacatcgttgtacagtttaactatatcaataaaaagtttggacagt

SEQ ID NO: 43138 - DNA, 3878 bp, Homo sapiens
ctttactacatatagaaactgttttaatgctaatgaatgtttgaattttggctaatatttttatatgatgactagagcattatttttcccaagtttttatataatataaatagaaagtttgggcattcgatactagtatgaagaacctctctttagtatttaaatgaatcaatcagtgattgcatttgggtcctaagttttagagtaaatttttttctcaattaaaacataggtcctggtgagccaaacttttctcttattgttactttagatcatggagtgcatcggatcctttctataccaacgacaggagcatcttgactctctccacaatggactcatctacttgttaaaggggcagtagtactttgtgggagccagttcacctcctttcctaaaattcagtgtgatcaccctgttaatggccacactagctctgaaattaatttccaaaatctttgtagtagttcatacccactcagagttataatggcaaacaaacagaaagcattagtacaagcccctcccaacacccttaatttgaatctgaacatgttaaaatttgagaataaagagacatttttcatctctttgtctggtttgtcccttgtgcttatgggactcctaatggcatttcagtctgttgctgaggccattatattttaatataaatgtagaaaaaagagagaaatcttagtaaagagtattttttagtattagcttgattattgactcttctatttaaatctgcttctgtaaattatgctgaaagtttgccttgagaactctatttttttattagagttatatttaaagcttttcatgggaaaagttaatgtgaatactgaggaattttggtccctcagtgacctgtgttgttaattcattaatgcattctgagttcacagagcaaattaggagaatcatttccaaccattatttactgcagtatggggagtaaatttataccaattcctctaactgtactgtaacacagcctgtaaagttagccatataaatgcaagggtatatcatatatacaaatcaggaatcaggtccgttcaccgaacttcaaattgatgtttactaatatttttgtgacagagtataaagaccctatagtgggtaaattagatactattagcatattattaatttaatgtctttatcattggatcttttgcatgctttaatctggttaacatatttaaatttgctttttttctctttacctgaaggctctgtgtatagtatttcatgacatcgttgtacagtttaactatatcaataaaaagtttggacagtatttaaatattgcaaatatgtttaattatacaaatcagaatagtatgggtaattaaatgaatacaaaaagaagagcctctttctgcagccgacttagacatgctcttccctttctataagctagattttagaataaagggtttcagttaataatcttattttcaggttatgtcatctaacttatagcaaactaccacaatacagtgagttctgccagtgtcccagtacaaggcatatttcaggtgtggctgtggaatgtaaaaatgctcaacttgtatcaggtaatgttagcaataaattaaatgctaagaatgattaatcgggtacatgttactgtaattaactcattgcacttcaaaacctaacttccatcctgaatttatcaagtagttcagtattgtcatttgtttttgttttattgaaaagtaatgttgtcttaagatttagaagtgattattagcttgagaactattacccagctctaagcaaataatgattgtatacatattaagataatggttaaatgcggttttaccaagttttcccttgaaaatgtaattcctttatggagatttattgtgcagccctaagcttccttcccatttcatgaatataaggcttctagaattggactggcaggggaaagaatggtagagacagaaattaagactttatccttgtttgcttgtaaactattattttcttgctaatgtaacatttgtctgttccagtgatgtaaggatattaagttattaagctaaatattaattttcaaaaatagtccttctttaacttagatatttcatagctggatttaggaagatctgttattctggaagtactaaaaagaataatacaacgtacaatgtctgcattcactaattcatgttccagaagaggaaataatgaagatatactcagtagagtactaggtgggaggatatggaaatttgctcataaaatctcttataaaacgtgcatataacaaaatgacacccagtaggcctgcattacatttacatgaccgtgtttatttgccatcaaataaactgagtactgacaccagacaaagactccaaagtcataaaatagcctatgaccaactgcagcaagacaggaggtcagctcgcctataatggtgcttaaagtgtgattgatgtaattttctgtactcaccatttgaagttagttaaggagaactttatttttttaaaaaaagtaaatggcaaccactagtgtgctcatcctgaactgttactccaaatccactccgtttttaaagcaaaattatcttgtgattttaagaaaagagttttctatttatttaagaaagtaacaatgcagtctgcaagctttcagtagttttctagtgctatattcatcctgtaaaactcttactacgtaaccagtaatcacaaggaaagtgtcccctttgcatatttctttaaaattctttctttggaaagtatgatgttgataattaacttacccttatctgccaaaaccagagcaaaatgctaaatacgttattgctaatcagtggtctcaaatcgatttgcctccctttgcctcgtctgagggctgtaagcctgaagatagtggcaagcaccaagtcagtttccaaaattgcccctcagctgctttaagtgactcagcaccctgcctcagcttcagcaggcgtaggctcaccctgggcggagcaaagtatgggccagggagaactacagctacgaagacctgctgtcgagttgagaaaaggggagaatttatggtctgaattttctaactgtcctctttcttgggtctaaagctcataatacacaaaggcttccagacctgagccacacccaggccctatcctgaacaggagactaaacagaggcaaatcaaccctaggaaatacttgcattctgccctacggttagtaccaggactgaggtcatttctactggaaaagattgtgagattgaacttatctgatcgcttgagactcctaataggcaggagtcaaggccactagaaaattgacagttaagagccaaaagtttttaaaatatgctactctgaaaaatctcgtgaaggctgtaggaaaagggagaatcttccatgttggtgtttttcctgtaaagatcagtttggggtatgatataagcaggtattaataaaaataacacaccaaagagttacgtaaaacatgttttattaattttggtccccacgtacagacattttatttctattttgaaatgagttatctattttcataaaagtaaaacactattaaagtgctgttttatgtgaaataacttgaatgttgttcctataaaaaatagatcataactcatgatatgtttgtaatcatggtaatttagatttttatgaggaatgagtatctggaaatattgtagcaatacttggtttaaaattttggacctgagacactgtggctgtctaatgtaatcctttaaaaattctctgcattgtcagtaaatgtagtatattattgtacagctactcataattttttaaagtttatgaagttatatttatcaaataaaaactttcctatataa

SEQ ID NO: 43139 - DNA, 3837 bp, Homo sapiens
ggtcgcccagaggattcaagtatgatatgagtggagcattatttttcccaagtttttatataatataaatagaaagtttgggcattcgatactagtatgaagaacctctctttagtatttaaatgaatcaatcagtgattgcatttgggtcctaagttttagagtaaatttttttctcaattaaaacataggtcctggtgagccaaacttttctcttattgttactttagatcatggagtgcatcggatcctttctataccaacgacaggagcatcttgactctctccacaatggactcatctacttgttaaaggggcagtagtactttgtgggagccagttcacctcctttcctaaaattcagtgtgatcaccctgttaatggccacactagctctgaaattaatttccaaaatctttgtagtagttcatacccactcagagttataatggcaaacaaacagaaagcattagtacaagcccctcccaacacccttaatttgaatctgaacatgttaaaatttgagaataaagagacatttttcatctctttgtctggtttgtcccttgtgcttatgggactcctaatggcatttcagtctgttgctgaggccattatattttaatataaatgtagaaaaaagagagaaatcttagtaaagagtattttttagtattagcttgattattgactcttctatttaaatctgcttctgtaaattatgctgaaagtttgccttgagaactctatttttttattagagttatatttaaagcttttcatgggaaaagttaatgtgaatactgaggaattttggtccctcagtgacctgtgttgttaattcattaatgcattctgagttcacagagcaaattaggagaatcatttccaaccattatttactgcagtatggggagtaaatttataccaattcctctaactgtactgtaacacagcctgtaaagttagccatataaatgcaagggtatatcatatatacaaatcaggaatcaggtccgttcaccgaacttcaaattgatgtttactaatatttttgtgacagagtataaagaccctatagtgggtaaattagatactattagcatattattaatttaatgtctttatcattggatcttttgcatgctttaatctggttaacatatttaaatttgctttttttctctttacctgaaggctctgtgtatagtatttcatgacatcgttgtacagtttaactatatcaataaaaagtttggacagtatttaaatattgcaaatatgtttaattatacaaatcagaatagtatgggtaattaaatgaatacaaaaagaagagcctctttctgcagccgacttagacatgctcttccctttctataagctagattttagaataaagggtttcagttaataatcttattttcaggttatgtcatctaacttatagcaaactaccacaatacagtgagttctgccagtgtcccagtacaaggcatatttcaggtgtggctgtggaatgtaaaaatgctcaacttgtatcaggtaatgttagcaataaattaaatgctaagaatgattaatcgggtacatgttactgtaattaactcattgcacttcaaaacctaacttccatcctgaatttatcaagtagttcagtattgtcatttgtttttgttttattgaaaagtaatgttgtcttaagatttagaagtgattattagcttgagaactattacccagctctaagcaaataatgattgtatacatattaagataatggttaaatgcggttttaccaagttttcccttgaaaatgtaattcctttatggagatttattgtgcagccctaagcttccttcccatttcatgaatataaggcttctagaattggactggcaggggaaagaatggtagagacagaaattaagactttatccttgtttgcttgtaaactattattttcttgctaatgtaacatttgtctgttccagtgatgtaaggatattaagttattaagctaaatattaattttcaaaaatagtccttctttaacttagatatttcatagctggatttaggaagatctgttattctggaagtactaaaaagaataatacaacgtacaatgtctgcattcactaattcatgttccagaagaggaaataatgaagatatactcagtagagtactaggtgggaggatatggaaatttgctcataaaatctcttataaaacgtgcatataacaaaatgacacccagtaggcctgcattacatttacatgaccgtgtttatttgccatcaaataaactgagtactgacaccagacaaagactccaaagtcataaaatagcctatgaccaactgcagcaagacaggaggtcagctcgcctataatggtgcttaaagtgtgattgatgtaattttctgtactcaccatttgaagttagttaaggagaactttatttttttaaaaaaagtaaatggcaaccactagtgtgctcatcctgaactgttactccaaatccactccgtttttaaagcaaaattatcttgtgattttaagaaaagagttttctatttatttaagaaagtaacaatgcagtctgcaagctttcagtagttttctagtgctatattcatcctgtaaaactcttactacgtaaccagtaatcacaaggaaagtgtcccctttgcatatttctttaaaattctttctttggaaagtatgatgttgataattaacttacccttatctgccaaaaccagagcaaaatgctaaatacgttattgctaatcagtggtctcaaatcgatttgcctccctttgcctcgtctgagggctgtaagcctgaagatagtggcaagcaccaagtcagtttccaaaattgcccctcagctgctttaagtgactcagcaccctgcctcagcttcagcaggcgtaggctcaccctgggcggagcaaagtatgggccagggagaactacagctacgaagacctgctgtcgagttgagaaaaggggagaatttatggtctgaattttctaactgtcctctttcttgggtctaaagctcataatacacaaaggcttccagacctgagccacacccaggccctatcctgaacaggagactaaacagaggcaaatcaaccctaggaaatacttgcattctgccctacggttagtaccaggactgaggtcatttctactggaaaagattgtgagattgaacttatctgatcgcttgagactcctaataggcaggagtcaaggccactagaaaattgacagttaagagccaaaagtttttaaaatatgctactctgaaaaatctcgtgaaggctgtaggaaaagggagaatcttccatgttggtgtttttcctgtaaagatcagtttggggtatgatataagcaggtattaataaaaataacacaccaaagagttacgtaaaacatgttttattaattttggtccccacgtacagacattttatttctattttgaaatgagttatctattttcataaaagtaaaacactattaaagtgctgttttatgtgaaataacttgaatgttgttcctataaaaaatagatcataactcatgatatgtttgtaatcatggtaatttagatttttatgaggaatgagtatctggaaatattgtagcaatacttggtttaaaattttggacctgagacactgtggctgtctaatgtaatcctttaaaaattctctgcattgtcagtaaatgtagtatattattgtacagctactcataattttttaaagtttatgaagttatatttatcaaataaaaactttcctatataa

SEQ ID NO: 43140 - DNA, 5083 bp, Homo sapiens
agcactatcttgaagtatacatggcaagctgaagaaaaatgggatgaaccttggtataaccaaaaaacagaacatcaaagaaatagcagtaagattctgagatttatttcagacttccttgcttttttggttctctacaatttcatcattccaatttcattatatgtgacagtcgaaatgcagaaatttcttggatcattttttattggctgggatcttgatctgtatcatgaagaatcagatcagaaagctcaagtcaatacttccgatctgaatgaagagcttggacaggtagagtacgtgtttacagataaaactggtacactgacagaaaatgagatgcagtttcgggaatgttcaattaatggcatgaaataccaagaaattaatggtagacttgtacccgaaggaccaacaccagactcttcagaaggaaacttatcttatcttagtagtttatcccatcttaacaacttatcccatcttacaaccagttcctctttcagaaccagtcctgaaaatgaaactgaactaattaaagaacatgatctcttctttaaagcagtcagtctctgtcacactgtacagattagcaatgttcaaactgactgcactggtgatggtccctggcaatccaacctggcaccatcgcagttggagtactatgcatcttcaccagatgaaaaggctctagtagaagctgctgcaaggattggtattgtgtttattggcaattctgaagaaactatggaggttaaaactcttggaaaactggaacggtacaaactgcttcatattctggaatttgattcagatcgtaggagaatgagtgtaattgttcaggcaccttcaggtgagaagttattatttgctaaaggagctgagtcatcaattctccctaaatgtataggtggagaaatagaaaaaaccagaattcatgtagatgaatttgctttgaaagggctaagaactctgtgtatagcatatagaaaatttacatcaaaagagtatgaggaaatagataaacgcatatttgaagccaggactgccttgcagcagcgggaagagaaattggcagctgttttccagttcatagagaaagacctgatattacttggagccacagcagtagaagacagactacaagataaagttcgagaaactattgaagcattgagaatggctggtatcaaagtatgggtacttactggggataaacatgaaacagctgttagtgtgagtttatcatgtggccattttcatagaaccatgaacatccttgaacttataaaccagaaatcagacagcgagtgtgctgaacaattgaggcagcttgccagaagaattacagaggatcatgtgattcagcatgggctggtagtggatgggaccagcctatctcttgcactcagggagcatgaaaaactatttatggaagtttgcagaaattgttcagctgtattatgctgtcgtatggctccactgcagaaagcaaaagtaataagactaataaaaatatcacctgagaaacctataacattggctgttggtgatggtgctaatgacgtaagcatgatacaagaagcccatgttggcataggaatcatgggtaaagaaggaagacaggctgcaagaaacagtgactatgcaatagccagatttaagttcctctccaaattgctttttgttcatggtcatttttattatattagaatagctacccttgtacagtattttttttataagaatgtgtgctttatcacaccccagtttttatatcagttctactgtttgttttctcagcaaacattgtatgacagcgtgtacctgactttatacaatatttgttttacttccctacctattctgatatatagtcttttggaacagcatgtagaccctcatgtgttacaaaataagcccaccctttatcgagacattagtaaaaaccgcctcttaagtattaaaacatttctttattggaccatcctgggcttcagtcatgcctttattttcttttttggatcctatttactaatagggaaagatacatctctgcttggaaatggccagatgtttggaaactggacatttggcactttggtcttcacagtcatggttattacagtcacagtaaagatggctctggaaactcatttttggacttggatcaaccatctcgttacctggggatctattatattttattttgtattttccttgttttatggagggattctctggccatttttgggctcccagaatatgtattttgtgtttattcagctcctgtcaagtggttctgcttggtttgccataatcctcatggttgttacatgtctatttcttgatatcataaagaaggtctttgaccgacacctccaccctacaagtactgaaaaggcacagcttactgaaacaaatgcaggtatcaagtgcttggactccatgtgctgtttcccggaaggagaagcagcgtgtgcatctgttggaagaatgctggaacgagttataggaagatgtagtccaacccacatcagcagatcatggagtgcatcggatcctttctataccaacgacaggagcatcttgactctctccacaatggactcatctacttgttaaaggggcagtagtactttgtgggagccagttcacctcctttcctaaaattcagtgtgatcaccctgttaatggccacactagctctgaaattaatttccaaaatctttgtagtagttcatacccactcagagttataatggcaaacaaacagaaagcattagtacaagcccctcccaacacccttaatttgaatctgaacatgttaaaatttgagaataaagagacatttttcatctctttgtctggtttgtcccttgtgcttatgggactcctaatggcatttcagtctgttgctgaggccattatattttaatataaatgtagaaaaaagagagaaatcttagtaaagagtattttttagtattagcttgattattgactcttctatttaaatctgcttctgtaaattatgctgaaagtttgccttgagaactctatttttttattagagttatatttaaagcttttcatgggaaaagttaatgtgaatactgaggaattttggtccctcagtgacctgtgttgttaattcattaatgcattctgagttcacagagcaaattaggagaatcatttccaaccattatttactgcagtatggggagtaaatttataccaattcctctaactgtactgtaacacagcctgtaaagttagccatataaatgcaagggtatatcatatatacaaatcaggaatcaggtccgttcaccgaacttcaaattgatgtttactaatatttttgtgacagagtataaagaccctatagtgggtaaattagatactattagcatattattaatttaatgtctttatcattggatcttttgcatgctttaatctggttaacatatttaaatttgctttttttctctttacctgaaggctctgtgtatagtatttcatgacatcgttgtacagtttaactatatcaataaaaagtttggacagtatttaaatattgcaaatatgtttaattatacaaatcagaatagtatgggtaattaaatgaatacaaaaagaagagcctctttctgcagccgacttagacatgctcttccctttctataagctagattttagaataaagggtttcagttaataatcttattttcaggttatgtcatctaacttatagcaaactaccacaatacagtgagttctgccagtgtcccagtacaaggcatatttcaggtgtggctgtggaatgtaaaaatgctcaacttgtatcaggtaatgttagcaataaattaaatgctaagaatgattaatcgggtacatgttactgtaattaactcattgcacttcaaaacctaacttccatcctgaatttatcaagtagttcagtattgtcatttgtttttgttttattgaaaagtaatgttgtcttaagatttagaagtgattattagcttgagaactattacccagctctaagcaaataatgattgtatacatattaagataatggttaaatgcggttttaccaagttttcccttgaaaatgtaattcctttatggagatttattgtgcagccctaagcttccttcccatttcatgaatataaggcttctagaattggactggcaggggaaagaatggtagagacagaaattaagactttatccttgtttgcttgtaaactattattttcttgctaatgtaacatttgtctgttccagtgatgtaaggatattaagttattaagctaaatattaattttcaaaaatagtccttctttaacttagatatttcatagctggatttaggaagatctgttattctggaagtactaaaaagaataatacaacgtacaatgtctgcattcactaattcatgttccagaagaggaaataatgaagatatactcagtagagtactaggtgggaggatatggaaatttgctcataaaatctcttataaaacgtgcatataacaaaatgacacccagtaggcctgcattacatttacatgaccgtgtttatttgccatcaaataaactgagtactgacaccagacaaagactccaaagtcataaaatagcctatgaccaactgcagcaagacaggaggtcagctcgcctataatggtgcttaaagtgtgattgatgtaattttctgtactcaccatttgaagttagttaaggagaactttatttttttaaaaaaagtaaatggcaaccactagtgtgctcatcctgaactgttactccaaatccactccgttttaagccaatacctgggattcagaaagagtccaacatcagaacggacacgcagcggagttcaaagtccagggcaatcaccgaaacctaaaggacagacacaggaggcccctgatccaaaacccctgcaggatccaaccccccttggcgcgacaacccaccaggacggcaaaggccggccggggcgcggaaccatcagcccggaaccaaaacgcgacttggtgtactcgccg

SEQ ID NO: 43141 - DNA, 2843 bp, Homo sapiens
  misc_feature (2833)..(2833): n is a, c, g, or t
agcactatcttgaagtatacatggcaagctgaagaaaaatgggatgaaccttggtataaccaaaaaacagaacatcaaagaaatagcagtaagattctgagatttatttcagacttccttgcttttttggttctctacaatttcatcattccaatttcattatatgtgacagtcgaaatgcagaaatttcttggatcattttttattggctgggatcttgatctgtatcatgaagaatcagatcagaaagctcaagtcaatacttccgatctgaatgaagagcttggacaggtagagtacgtgtttacagataaaactggtacactgacagaaaatgagatgcagtttcgggaatgttcaattaatggcatgaaataccaagaaattaatggtagacttgtacccgaaggaccaacaccagactcttcagaaggaaacttatcttatcttagtagtttatcccatcttaacaacttatcccatcttacaaccagttcctctttcagaaccagtcctgaaaatgaaactgaactaattaaagaacatgatctcttctttaaagcagtcagtctctgtcacactgtacagattagcaatgttcaaactgactgcactggtgatggtccctggcaatccaacctggcaccatcgcagttggagtactatgcatcttcaccagatgaaaaggctctagtagaagctgctgcaaggattggtattgtgtttattggcaattctgaagaaactatggaggttaaaactcttggaaaactggaacggtacaaactgcttcatattctggaatttgattcagatcgtaggagaatgagtgtaattgttcaggcaccttcaggtgagaagttattatttgctaaaggagctgagtcatcaattctccctaaatgtataggtggagaaatagaaaaaaccagaattcatgtagatgaatttgctttgaaagggctaagaactctgtgtatagcatatagaaaatttacatcaaaagagtatgaggaaatagataaacgcatatttgaagccaggactgccttgcagcagcgggaagagaaattggcagctgttttccagttcatagagaaagacctgatattacttggagccacagcagtagaagacagactacaagataaagttcgagaaactattgaagcattgagaatggctggtatcaaagtatgggtacttactggggataaacatgaaacagctgttagtgtgagtttatcatgtggccattttcatagaaccatgaacatccttgaacttataaaccagaaatcagacagcgagtgtgctgaacaattgaggcagcttgccagaagaattacagaggatcatgtgattcagcatgggctggtagtggatgggaccagcctatctcttgcactcagggagcatgaaaaactatttatggaagtttgcagaaattgttcagctgtattatgctgtcgtatggctccactgcagaaagcaaaagtaataagactaataaaaatatcacctgagaaacctataacattggctgttggtgatggtgctaatgacgtaagcatgatacaagaagcccatgttggcataggaatcatgggtaaagaaggaagacaggctgcaagaaacagtgactatgcaatagccagatttaagttcctctccaaattgctttttgttcatggtcatttttattatattagaatagctacccttgtacagtattttttttataagaatgtgtgctttatcacaccccagtttttatatcagttctactgtttgttttctcagcaaacattgtatgacagcgtgtacctgactttatacaatatttgttttacttccctacctattctgatatatagtcttttggaacagcatgtagaccctcatgtgttacaaaataagcccaccctttatcgagacattagtaaaaaccgcctcttaagtattaaaacatttctttattggaccatcctgggcttcagtcatgcctttattttcttttttggatcctatttactaatagggaaagatacatctctgcttggaaatggccagatgtttggaaactggacatttggcactttggtcttcacagtcatggttattacagtcacagtaaagatggctctggaaactcatttttggacttggatcaaccatctcgttacctggggatctattatattttattttgtattttccttgttttatggagggattctctggccatttttgggctcccagaatatgtattttgtgtttattcagctcctgtcaagtggttctgcttggtttgccataatcctcatggttgttacatgtctatttcttgatatcataaagaaggtctttgaccgacacctccaccctacaagtactgaaaaggcacagcttactgaaacaaatgcaggtatcaagtgcttggactccatgtgctgtttcccggaaggagaagcagcgtgtgcatctgttggaagaatgctggaacgagttataggaagatgtagtccaacccacatcagcagatcatggagtgcatcggatcctttctataccaacgacaggagcatcttgactctctccacaatggactcatctacttgttaaaggggcagtagtactttgtgggagccagttcacctcctttcctaaaattcagtgtgatcaccctgttaatggccacactagctctgaaattaatttccaaaatctttgtagtagttcatacccactcagagttataatggcaaacaaacagaaagcattagtacaagcccctcccaacacccttaatttgttcatgacacacgcgggntcctctaggt

SEQ ID NO: 43142 - DNA, 2782 bp, Homo sapiens
agcactatcttgaagtatacatggcaagctgaagaaaaatgggatgaaccttggtataaccaaaaaacagaacatcaaagaaatagcagtaagattctgagatttatttcagacttccttgcttttttggttctctacaatttcatcattccaatttcattatatgtgacagtcgaaatgcagaaatttcttggatcattttttattggctgggatcttgatctgtatcatgaagaatcagatcagaaagctcaagtcaatacttccgatctgaatgaagagcttggacaggtagagtacgtgtttacagataaaactggtacactgacagaaaatgagatgcagtttcgggaatgttcaattaatggcatgaaataccaagaaattaatggtagacttgtacccgaaggaccaacaccagactcttcagaaggaaacttatcttatcttagtagtttatcccatcttaacaacttatcccatcttacaaccagttcctctttcagaaccagtcctgaaaatgaaactgaactaattaaagaacatgatctcttctttaaagcagtcagtctctgtcacactgtacagattagcaatgttcaaactgactgcactggtgatggtccctggcaatccaacctggcaccatcgcagttggagtactatgcatcttcaccagatgaaaaggctctagtagaagctgctgcaaggattggtattgtgtttattggcaattctgaagaaactatggaggttaaaactcttggaaaactggaacggtacaaactgcttcatattctggaatttgattcagatcgtaggagaatgagtgtaattgttcaggcaccttcaggtgagaagttattatttgctaaaggagctgagtcatcaattctccctaaatgtataggtggagaaatagaaaaaaccagaattcatgtagatgaatttgctttgaaagggctaagaactctgtgtatagcatatagaaaatttacatcaaaagagtatgaggaaatagataaacgcatatttgaagccaggactgccttgcagcagcgggaagagaaattggcagctgttttccagttcatagagaaagacctgatattacttggagccacagcagtagaagacagactacaagataaagttcgagaaactattgaagcattgagaatggctggtatcaaagtatgggtacttactggggataaacatgaaacagctgttagtgtgagtttatcatgtggccattttcatagaaccatgaacatccttgaacttataaaccagaaatcagacagcgagtgtgctgaacaattgaggcagcttgccagaagaattacagaggatcatgtgattcagcatgggctggtagtggatgggaccagcctatctcttgcactcagggagcatgaaaaactatttatggaagtttgcagaaattgttcagctgtattatgctgtcgtatggctccactgcagaaagcaaaagtaataagactaataaaaatatcacctgagaaacctataacattggctgttggtgatggtgctaatgacgtaagcatgatacaagaagcccatgttggcataggaatcatgggtaaagaaggaagacaggctgcaagaaacagtgactatgcaatagccagatttaagttcctctccaaattgctttttgttcatggtcatttttattatattagaatagctacccttgtacagtattttttttataagaatgtgtgctttatcacaccccagtttttatatcagttctactgtttgttttctcagcaaacattgtatgacagcgtgtacctgactttatacaatatttgttttacttccctacctattctgatatatagtcttttggaacagcatgtagaccctcatgtgttacaaaataagcccaccctttatcgagacattagtaaaaaccgcctcttaagtattaaaacatttctttattggaccatcctgggcttcagtcatgcctttattttcttttttggatcctatttactaatagggaaagatacatctctgcttggaaatggccagatgtttggaaactggacatttggcactttggtcttcacagtcatggttattacagtcacagtaaagatggctctggaaactcatttttggacttggatcaaccatctcgttacctggggatctattatattttattttgtattttccttgttttatggagggattctctggccatttttgggctcccagaatatgtattttgtgtttattcagctcctgtcaagtggttctgcttggtttgccataatcctcatggttgttacatgtctatttcttgatatcataaagaaggtctttgaccgacacctccaccctacaagtactgaaaaggcacagcttactgaaacaaatgcaggtatcaagtgcttggactccatgtgctgtttcccggaaggagaagcagcgtgtgcatctgttggaagaatgctggaacgagttataggaagatgtagtccaacccacatcagcaggtgtgaaatctctctaagtagcctttgctgcagatgagtatcctatctggaacaggatgaacctgccgctctagatacctaataaatcagcagctggttttaccaactgaagcaggaagtctgctatttattagcactctttggtggtagatttcactttgtggctttggggtaagggctttttcactcacaaaggaagagaaagcacctttgaagagacttcatctaatgaacaaaaa

SEQ ID NO: 43143 - DNA, 402 bp, Homo sapiens
cagaatatgtattttgtgtttattcagctcctgtcaagtggttctgcttggtttgccataatcctcatggttgttacatgtctatttcttgatatcataaagaaggtctttgacgagcacctccaccctacaagtactgaaaaggcacagatgtactccaacacagttgctttaagtgacgagttcatcgcactgcagccattgtcgagggcaaggaatcagctgagcaaacttaggtagagtaggaggagtagagcctcattaactcttctgcatgctaaaggtcaattaaacaatatcaaaagatgggcagaggcataaataaagagcggggcatttttgttagcatggccctgtctctgaataatttgacctttattaacatatacgttaaaacctaaa

SEQ ID NO: 43144 - DNA, 603 bp, Homo sapiens
gtaagtaaatagaaacttgtgttttgtgttttgtccttttagagtaacgtatgtatgttcagattttgatagacgtttgaagggacttttttcatttttcttagtcctgcagggaaccagacagaacttttctgtttagtatatttaaccagcatgacattcagaatatttatttattctggttttcagtttgaggtgagtgttaataccaaaatgtaattctggatgcttttaaaaatagataataacccttaacagcttatgagagaattttgataacttatttgtgatatttctgtaaaatccaaatcaagccaggccagataacttggaggttcacctcatttttatttttgattcgaaatgtcttaggtttggaaggagcagtagtgatttagtccagggatggcatataggttttatctcagaagctacctttaaataattgatggggcacctagagtatattgaaaaggtttctaaagctgcaggctcagagggaaaatgtaatttgttagcaatagttgtaatgggcacaaggtgggtctttgtttgcatgcatgtcacatatttaccagtcctgatctactttgttttaatttc

SEQ ID NO: 43145 - DNA, 366 bp, Homo sapiens
tatacagggtgggagtaccaggaggttggaatcaccttcaagctatagcttccacaatccctgctgatcattttagaggaaagcaatacatgcatatgtttagaaaactcagacagtacataaaggtacaaaatgaaaagttaaagctttctacaacctccaaccttttgtcttgttctttttttcttccctagtgtgtatatataattacatatatttttaaaatgggattacaggcgtgagaaaactcaagtttaatttttgaaactttttgctgtgtaatttactttgatcctggatctccagggtatttaaataataggggaacattattgggtgtggtgatgaatgatggtttaaaaaaga

SEQ ID NO: 43146 - DNA, 3186 bp, Homo sapiens
attgggatggaggatgagattttatatggaaggattaaaacatatttaaccggagcagggacttacagggacaggcaagtcagtaaagggcccaggttacaaacgagttataaccgatcagaccgacgagcgcccgcgtgcagcgcctcctgccgacgcgcgcctcgcagccttcagtcaatgctgacagctgttctccaacacccagctaggggcgggagggtccgcccacttctaccagattttgcacacaaaacagtggaaagaccattctcatggctccaagccgttttctcccttcatcgcctgcaattttagggcttttcggggggtatgactgcagggattttagaggtttttttcctcattctctttttaagaggtgataaaaagcatttaaattagcggcagggcggttaacacccgcagccctagcctctccgcacttctcgtcgctcgtccgtgttcactccacgcctggcctcgggtaggagccgcatagcgccaacggttgcgggtcgcaactactcccaggcggcgcgccttgcgcgccgggcctcccaggaccgcggcgagttcagaaggcgcggggagagaagtgaggtcgagcagcgggcggcttttgacgaacggccctcacagccaatgggaagcccggtcgactttcccgcccctgccaatagggagcagaacccgggccggggggggcgcttcccgcaggctgcggctggattcgatcctgcgcgacggccgcgaaggcgggggcggaggctcggcctgcgcggctgggagcggcttaggggaggagggaagaccggaagccacggttgcgtccccatccttagattcgctcctccgggcagggagcggagacggaggaggaggagggagaggctgaatgttggctcgggagacgtacgaggaggaccgggagtacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatggttgagtttgaatcagtcctttgtgcccagaaagctaaagcagcactcaatggagctgatatatatgctggatgttgcacactaaaaattgaatatgcacggccaactcgtctaaatgttattaggaatgacaatgacagttgggactacactaaaccatatttgggaagacgagatagaggaaagggtcgccagagacaagccattttgggagaacacccttcttcgtttagacatgatggctatggatcccatggtccattattgcctttaccaagtcgttacagaatgggctctcgagatacacctgaacttgttgcttatccattaccacaggcttcttcctcttacatgcatggaggaaatccctctggttcagttgtaatggttagtggattacatcaactaaaaatgaattgttcaagagtcttcaacctgttctgcttatatggaaatattgagaaggtaaaatttatgaagaccattcctggtacagcactggtagaaatgggtgatgagtatgctgtagaaagagctgtcacacaccttaataatgtcaaattatttgggaaaagacttaatgtttgcgtgtctaaacaacattcagttgttccaagtcaaatatttgagctggaggatggtaccagcagctacaaagattttgcaatgagcaaaaataatcgctttacaagtgctggccaagcatctaagaatataatccagccaccctcctgtgttttgcattattataatgttccattgtgtgtcacagaagagaccttcacaaagttgtgtaatgaccatgaagttcttacattcatcaaatataaagtgtttgatgcaaaaccttcagccaaaacactttctgggctattagaatgggagtgcaaaactgatgcagtagaagcccttacggcactgaatcactatcagataagagtgccgaatggttccaatccctatacattgaagctttgcttttctacatcatcccatttataagaagagaagagcatgttagaatttatgttcacctttattacaatttcaaagctacacttcattaaaaaaaaatctaaaatggttgatctcatgttgccttgcttactttaagatcctgttctgtaataaacatattttgccttgagtaaatttgttgtaagcttaaatattgaattgttttcattttaagatagaatatcataatgtagactatctacagcttcattgtagattatacagatatatgatttctaaccttattactggaatttttcttccacagtaaaaatatatttgcattcttaatgctaattatctgcaagtattttttcattgtgtaagagattaatgcaggtgaaagtattgcattttaatatagaattcctattatatgtttagatgtttaagtatgttgcagttactcatattaaacataacttgtatatttattattttaatgaagtttgagaataacgttacatatgttgaattttaagtactacagatttaactgattttatatttctgaaaggctaacagacatggatacacgtgtacagtatgcattcaaacttatttaaattggtgtatttttttttaagtcactgtccatttgtattgacatgcctctgtttctagtccagtttggagattttataaagttataacaatga

SEQ ID NO: 43147 - DNA, 3442 bp, Homo sapiens
attgggatggaggatgagattttatatggaaggattaaaacatatttaaccggagcagggacttacagggacaggcaagtcagtaaagggcccaggttacaaacgagttataaccgatcagaccgacgagcgcccgcgtgcagcgcctcctgccgacgcgcgcctcgcagccttcagtcaatgctgacagctgttctccaacacccagctaggggcgggagggtccgcccacttctaccagattttgcacacaaaacagtggaaagaccattctcatggctccaagccgttttctcccttcatcgcctgcaattttagggcttttcggggggtatgactgcagggattttagaggtttttttcctcattctctttttaagaggtgataaaaagcatttaaattagcggcagggcggttaacacccgcagccctagcctctccgcacttctcgtcgctcgtccgtgttcactccacgcctggcctcgggtaggagccgcatagcgccaacggttgcgggtcgcaactactcccaggcggcgcgccttgcgcgccgggcctcccaggaccgcggcgagttcagaaggcgcggggagagaagtgaggtcgagcagcgggcggcttttgacgaacggccctcacagccaatgggaagcccggtcgactttcccgcccctgccaatagggagcagaacccgggccggggggggcgcttcccgcaggctgcggctggattcgatcctgcgcgacggccgcgaaggcgggggcggaggctcggcctgcgcggctgggagcggcttaggggaggagggaagaccggaagccacggttgcgtccccatccttagattcgctcctccgggcagggagcggagacggaggaggaggagggagaggctgaatgttggctcggtaattgagaggagcggccgctccagagcttcctcccggggcgcccccctcagtccgtccgcgcttctcagccgccagtctcctggccgcgcagtccccgcggacggccgggccgcggagaccctcgcagaagaggcgctgccggcggcgaggactggccggcggcatccgaggcgcgcgccccaccgccacccccacccgcctgccagccggtccctccggccgccgccatgtcctcctcctcttcctcccccagggagacgtacgaggaggaccgggagtacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatggttgagtttgaatcagtcctttgtgcccagaaagctaaagcagcactcaatggagctgatatatatgctggatgttgcacactaaaaattgaatatgcacggccaactcgtctaaatgttattaggaatgacaatgacagttgggactacactaaaccatatttgggaagacgagatagaggaaagggtcgccagagacaagccattttgggagaacacccttcttcgtttagacatgatggctatggatcccatggtccattattgcctttaccaagtcgttacagaatgggctctcgagatacacctgaacttgttgcttatccattaccacaggcttcttcctcttacatgcatggaggaaatccctctggttcagttgtaatggttagtggattacatcaactaaaaatgaattgttcaagagtcttcaacctgttctgcttatatggaaatattgagaaggtaaaatttatgaagaccattcctggtacagcactggtagaaatgggtgatgagtatgctgtagaaagagctgtcacacaccttaataatgtcaaattatttgggaaaagacttaatgtttgcgtgtctaaacaacattcagttgttccaagtcaaatatttgagctggaggatggtaccagcagctacaaagattttgcaatgagcaaaaataatcgctttacaagtgctggccaagcatctaagaatataatccagccaccctcctgtgttttgcattattataatgttccattgtgtgtcacagaagagaccttcacaaagttgtgtaatgaccatgaagttcttacattcatcaaatataaagtgtttgatgcaaaaccttcagccaaaacactttctgggctattagaatgggagtgcaaaactgatgcagtagaagcccttacggcactgaatcactatcagataagagtgccgaatggttccaatccctatacattgaagctttgcttttctacatcatcccatttataagaagagaagagcatgttagaatttatgttcacctttattacaatttcaaagctacacttcattaaaaaaaaatctaaaatggttgatctcatgttgccttgcttactttaagatcctgttctgtaataaacatattttgccttgagtaaatttgttgtaagcttaaatattgaattgttttcattttaagatagaatatcataatgtagactatctacagcttcattgtagattatacagatatatgatttctaaccttattactggaatttttcttccacagtaaaaatatatttgcattcttaatgctaattatctgcaagtattttttcattgtgtaagagattaatgcaggtgaaagtattgcattttaatatagaattcctattatatgtttagatgtttaagtatgttgcagttactcatattaaacataacttgtatatttattattttaatgaagtttgagaataacgttacatatgttgaattttaagtactacagatttaactgattttatatttctgaaaggctaacagacatggatacacgtgtacagtatgcattcaaacttatttaaattggtgtatttttttttaagtcactgtccatttgtattgacatgcctctgtttctagtccagtttggagattttataaagttataacaatga

SEQ ID NO: 43148 - DNA, 4983 bp, Homo sapiens
attgggatggaggatgagattttatatggaaggattaaaacatatttaaccggagcagggacttacagggacaggcaagtcagtaaagggcccaggttacaaacgagttataaccgatcagaccgacgagcgcccgcgtgcagcgcctcctgccgacgcgcgcctcgcagccttcagtcaatgctgacagctgttctccaacacccagctaggggcgggagggtccgcccacttctaccagattttgcacacaaaacagtggaaagaccattctcatggctccaagccgttttctcccttcatcgcctgcaattttagggcttttcggggggtatgactgcagggattttagaggtttttttcctcattctctttttaagaggtgataaaaagcatttaaattagcggcagggcggttaacacccgcagccctagcctctccgcacttctcgtcgctcgtccgtgttcactccacgcctggcctcgggtaggagccgcatagcgccaacggttgcgggtcgcaactactcccaggcggcgcgccttgcgcgccgggcctcccaggaccgcggcgagttcagaaggcgcggggagagaagtgaggtcgagcagcgggcggcttttgacgaacggccctcacagccaatgggaagcccggtcgactttcccgcccctgccaatagggagcagaacccgggccggggggggcgcttcccgcaggctgcggctggattcgatcctgcgcgacggccgcgaaggcgggggcggaggctcggcctgcgcggctgggagcggcttaggggaggagggaagaccggaagccacggttgcgtccccatccttagattcgctcctccgggcagggagcggagacggaggaggaggagggagaggctgaatgttggctcggtaattgagaggagcggccgctccagagcttcctcccggggcgcccccctcagtccgtccgcgcttctcagccgccagtctcctggccgcgcagtccccgcggacggccgggccgcggagaccctcgcagaagaggcgctgccggcggcgaggactggccggcggcatccgaggcgcgcgccccaccgccacccccacccgcctgccagccggtccctccggccgccgccatgtcctcctcctcttcctcccccagggagacgtacgaggaggaccgggagtacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatggttgagtttgaatcagtcctttgtgcccagaaagctaaagcagcactcaatggagctgatatatatgctggatgttgcacactaaaaattgaatatgcacggccaactcgtctaaatgttattaggaatgacaatgacagttgggactacactaaaccatatttgggaagacgagatagaggaaagggtcgccagagacaagccattttgggagaacacccttcttcgtttagacatgatggctatggatcccatggtccattattgcctttaccaagtcgttacagaatgggctctcgagatacacctgaacttgttgcttatccattaccacaggcttcttcctcttacatgcatggaggaaatccctctggttcagttgtaatggttagtggattacatcaactaaaaatgaattgttcaagagtcttcaacctgttctgcttatatggaaatattgagaaggtaaaatttatgaagaccattcctggtacagcactggtagaaatgggtgatgagtatgctgtagaaagagctgtcacacaccttaataatgtcaaattatttgggaaaagacttaatgtttgcgtgtctaaacaacattcagttgttccaagtcaaatatttgagctggaggatggtaccagcagctacaaagattttgcaatgagcaaaaataatcgctttacaagtgctggccaagcatctaagaatataatccagccaccctcctgtgttttgcattattataatgttccattgtgtgtcacagaagagaccttcacaaagttgtgtaatgaccatgaagttcttacattcatcaaatataaagtgtttgatgcaaaaccttcagccaaaacactttctgggctattagaatgggagtgcaaaactgatgcagtagaagcccttacggcactgaatcactatcagataagagtgccgaatggttccaatccctatacattgaagctttgcttttctacatcatcccatttataagaagagaagagcatgttagaatttatgttcacctttattacaatttcaaagctacacttcattaaaaaaaaatctaaaatggttgatctcatgttgccttgcttactttaagatcctgttctgtaataaacatattttgccttgagtaaatttgttgtaagcttaaatattgaattgttttcattttaagatagaatatcataatgtagactatctacagcttcattgtagattatacagatatatgatttctaaccttattactggaatttttcttccacagtaaaaatatatttgcattcttaatgctaattatctgcaagtattttttcattgtgtaagagattaatgcaggtgaaagtattgcattttaatatagaattcctattatatgtttagatgtttaagtatgttgcagttactcatattaaacataacttgtatatttattattttaatgaagtttgagaataacgttacatatgttgaattttaagtactacagatttaactgattttatatttctgaaaggctaacagacatggatacacgtgtacagtatgcattcaaacttatttaaattggtgtatttttttttaagtcactgtccatttgtattgacatgcctctgtttctagtccagtttggagattttataaagttataacaatgagttaatgtgttcattttcatttgttgcatgtgacttaaatacagctagtatttggcattgagattttaatagaggttataattaacagttcctcttatagataataatctgggatccatgggtgggcttcagagaatctgtgtaccccctaaaattgtatgtagaattttggatatttacatttttattttttaactcttggatccatcagtaatatgtatttttctatatggtacaagatttaaggatctaattttatttttattccaaacagatagctatttgtctcaataccatttattaaacattctttctcccactggatctgttttttttttctttttaagataatagattttatacataggcaagtaagatttaaggaccaaacatggtattaagagactatagcacgattgttaccaagttcacagcttttttacaatagaaaaactgatgtggccattttgttttcatctttaaaagaagggagaatatgtgtcatctacctagaataactgatatcagtagttgacaatatcagttttgtaatcctgacacttttaaacaaatttgtaaatgaaagttccatttagatcttttgtaaagactttattttaaattttaatataaaaaatccttttagaaataaggcaggcatttacaattttagagctgtttaataggaagtttagatggaaactaaacacacattaacatttatttcccctcattttgatggcagtggaccagcatttagccctctaaagataaagaaaaaattaaatttaatctagaagtattttagacccttatcacagaacccagtaagttatgccaagggtaactgtgtgaactgtgttcgatactgggctatgtatgtttcttattcattgccaatttaatacctaagtttatctaactttacaataaagctttttttcccctataaatacttttctacctcttttgaaaaattgaaataccttaattttggtttatgtaatagttgtctacgttccttcctcctctgaaaattaatgtgggttgtcagaattacagactttttaatgcctaagattttaagaaataaacctgtaggtgttggcaggacttatttcatttagattttaattagtttagatgtgtagaaatgatttttatctgtaaggctctctctccaccaaaataagtgaattgtttgggagtaaactagttggtaagttgggccttgctgatagatttatacactggtgtgtaagccctatactgctgctgtcactaatgtttttgatagtttacttaggcatgactgctgttaatgaagtttgctttgtgaatactctctctttccttagccttggcaacattcttctctgtgctatctttatgcttttagaagaactagaaaaagcagatttaagaactgtaaagaaataatactagctttgagtttttaaaaaaaatattgaaatcccatctctgtatccaaatcctactacacatttgataataaatctgccaaactgagttatggaata

SEQ ID NO: 43149 - DNA, 3525 bp, Homo sapiens
attgggatggaggatgagattttatatggaaggattaaaacatatttaaccggagcagggacttacagggacaggcaagtcagtaaagggcccaggttacaaacgagttataaccgatcagaccgacgagcgcccgcgtgcagcgcctcctgccgacgcgcgcctcgcagccttcagtcaatgctgacagctgttctccaacacccagctaggggcgggagggtccgcccacttctaccagattttgcacacaaaacagtggaaagaccattctcatggctccaagccgttttctcccttcatcgcctgcaattttagggcttttcggggggtatgactgcagggattttagaggtttttttcctcattctctttttaagaggtgataaaaagcatttaaattagcggcagggcggttaacacccgcagccctagcctctccgcacttctcgtcgctcgtccgtgttcactccacgcctggcctcgggtaggagccgcatagcgccaacggttgcgggtcgcaactactcccaggcggcgcgccttgcgcgccgggcctcccaggaccgcggcgagttcagaaggcgcggggagagaagtgaggtcgagcagcgggcggcttttgacgaacggccctcacagccaatgggaagcccggtcgactttcccgcccctgccaatagggagcagaacccgggccggggggggcgcttcccgcaggctgcggctggattcgatcctgcgcgacggccgcgaaggcgggggcggaggctcggcctgcgcggctgggagcggcttaggggaggagggaagaccggaagccacggttgcgtccccatccttagattcgctcctccgggcagggagcggagacggaggaggaggagggagaggctgaatgttggctcggtaattgagaggagcggccgctccagagcttcctcccggggcgcccccctcagtccgtccgcgcttctcagccgccagtctcctggccgcgcagtccccgcggacggccgggccgcggagaccctcgcagaagaggcgctgccggcggcgaggactggccggcggcatccgaggcgcgcgccccaccgccacccccacccgcctgccagccggtccctccggccgccgccatgtcctcctcctcttcctcccccagggagacgtacgaggaggaccgggagtacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatggttgagtttgaatcagtcctttgtgcccagaaagctaaagcagcactcaatggagctgatatatatgctggatgttgcacactaaaaattgaatatgcacggccaactcgtctaaatgttattaggaatgacaatgacagttgggactacactaaaccatatttgggaagacgaggttgttgttggcttatgctgaaacttcttgaaagaagcccactttgaaaatgtgttgctgttgaagctaatagtatgattcagatagaggaaagggtcgccagagacaagccattttgggagaacacccttcttcgtttagacatgatggctatggatcccatggtccattattgcctttaccaagtcgttacagaatgggctctcgagatacacctgaacttgttgcttatccattaccacaggcttcttcctcttacatgcatggaggaaatccctctggttcagttgtaatggttagtggattacatcaactaaaaatgaattgttcaagagtcttcaacctgttctgcttatatggaaatattgagaaggtaaaatttatgaagaccattcctggtacagcactggtagaaatgggtgatgagtatgctgtagaaagagctgtcacacaccttaataatgtcaaattatttgggaaaagacttaatgtttgcgtgtctaaacaacattcagttgttccaagtcaaatatttgagctggaggatggtaccagcagctacaaagattttgcaatgagcaaaaataatcgctttacaagtgctggccaagcatctaagaatataatccagccaccctcctgtgttttgcattattataatgttccattgtgtgtcacagaagagaccttcacaaagttgtgtaatgaccatgaagttcttacattcatcaaatataaagtgtttgatgcaaaaccttcagccaaaacactttctgggctattagaatgggagtgcaaaactgatgcagtagaagcccttacggcactgaatcactatcagataagagtgccgaatggttccaatccctatacattgaagctttgcttttctacatcatcccatttataagaagagaagagcatgttagaatttatgttcacctttattacaatttcaaagctacacttcattaaaaaaaaatctaaaatggttgatctcatgttgccttgcttactttaagatcctgttctgtaataaacatattttgccttgagtaaatttgttgtaagcttaaatattgaattgttttcattttaagatagaatatcataatgtagactatctacagcttcattgtagattatacagatatatgatttctaaccttattactggaatttttcttccacagtaaaaatatatttgcattcttaatgctaattatctgcaagtattttttcattgtgtaagagattaatgcaggtgaaagtattgcattttaatatagaattcctattatatgtttagatgtttaagtatgttgcagttactcatattaaacataacttgtatatttattattttaatgaagtttgagaataacgttacatatgttgaattttaagtactacagatttaactgattttatatttctgaaaggctaacagacatggatacacgtgtacagtatgcattcaaacttatttaaattggtgtatttttttttaagtcactgtccatttgtattgacatgcctctgtttctagtccagtttggagattttataaagttataacaatga

SEQ ID NO: 43150 - DNA, 2875 bp, Homo sapiens
attgggatggaggatgagattttatatggaaggattaaaacatatttaaccggagcagggacttacagggacaggcaagtcagtaaagggcccaggttacaaacgagttataaccgatcagaccgacgagcgcccgcgtgcagcgcctcctgccgacgcgcgcctcgcagccttcagtcaatgctgacagctgttctccaacacccagctaggggcgggagggtccgcccacttctaccagattttgcacacaaaacagtggaaagaccattctcatggctccaagccgttttctcccttcatcgcctgcaattttagggcttttcggggggtatgactgcagggattttagaggtttttttcctcattctctttttaagaggtgataaaaagcatttaaattagcggcagggcggttaacacccgcagccctagcctctccgcacttctcgtcgctcgtccgtgttcactccacgcctggcctcgggtaggagccgcatagcgccaacggttgcgggtcgcaactactcccaggcggcgcgccttgcgcgccgggcctcccaggaccgcggcgagttcagaaggcgcggggagagaaggagacgtacgaggaggaccgggagtacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatggttgagtttgaatcagtcctttgtgcccagaaagctaaagcagcactcaatggagctgatatatatgctggatgttgcacactaaaaattgaatatgcacggccaactcgtctaaatgttattaggaatgacaatgacagttgggactacactaaaccatatttgggaagacgagatagaggaaagggtcgccagagacaagccattttgggagaacacccttcttcgtttagacatgatggctatggatcccatggtccattattgcctttaccaagtcgttacagaatgggctctcgagatacacctgaacttgttgcttatccattaccacaggcttcttcctcttacatgcatggaggaaatccctctggttcagttgtaatggttagtggattacatcaactaaaaatgaattgttcaagagtcttcaacctgttctgcttatatggaaatattgagaaggtaaaatttatgaagaccattcctggtacagcactggtagaaatgggtgatgagtatgctgtagaaagagctgtcacacaccttaataatgtcaaattatttgggaaaagacttaatgtttgcgtgtctaaacaacattcagttgttccaagtcaaatatttgagctggaggatggtaccagcagctacaaagattttgcaatgagcaaaaataatcgctttacaagtgctggccaagcatctaagaatataatccagccaccctcctgtgttttgcattattataatgttccattgtgtgtcacagaagagaccttcacaaagttgtgtaatgaccatgaagttcttacattcatcaaatataaagtgtttgatgcaaaaccttcagccaaaacactttctgggctattagaatgggagtgcaaaactgatgcagtagaagcccttacggcactgaatcactatcagataagagtgccgaatggttccaatccctatacattgaagctttgcttttctacatcatcccatttataagaagagaagagcatgttagaatttatgttcacctttattacaatttcaaagctacacttcattaaaaaaaaatctaaaatggttgatctcatgttgccttgcttactttaagatcctgttctgtaataaacatattttgccttgagtaaatttgttgtaagcttaaatattgaattgttttcattttaagatagaatatcataatgtagactatctacagcttcattgtagattatacagatatatgatttctaaccttattactggaatttttcttccacagtaaaaatatatttgcattcttaatgctaattatctgcaagtattttttcattgtgtaagagattaatgcaggtgaaagtattgcattttaatatagaattcctattatatgtttagatgtttaagtatgttgcagttactcatattaaacataacttgtatatttattattttaatgaagtttgagaataacgttacatatgttgaattttaagtactacagatttaactgattttatatttctgaaaggctaacagacatggatacacgtgtacagtatgcattcaaacttatttaaattggtgtatttttttttaagtcactgtccatttgtattgacatgcctctgtttctagtccagtttggagattttataaagttataacaatga

SEQ ID NO: 43151 - DNA, 2918 bp, Homo sapiens
attgggatggaggatgagattttatatggaaggattaaaacatatttaaccggagcagggacttacagggacaggcaagtcagtaaagggcccaggttacaaacgagttataaccgatcagaccgacgagcgcccgcgtgcagcgcctcctgccgacgcgcgcctcgcagccttcagtcaatgctgacagctgttctccaacacccagctaggggcgggagggtccgcccacttctaccagattttgcacacaaaacagtggaaagaccattctcatggctccaagccgttttctcccttcatcgcctgcaattttagggcttttcggggggtatgactgcagggattttagaggtttttttcctcattctctttttaagaggtgataaaaagcatttaaattagcggcagggcggttaacacccgcagccctagcctctccgcacttctcgtcgctcgtccgtgttcactccacgcctggcctcgggtaggagccgcatagcgccaacggttgcgggtcgcaactactcccaggcggcgcgccttgcgcgccgggcctcccaggaccgcggcgagttcagaaggcgcggggagagaagtgaggtcgagcagcgggcggcttttgacgaacggccctcacagccaatgggaagcccggtcgactttcccgcccctgccaatagggagcagaacccgggccggggggggcgcttcccgcaggctgcggctggattcgatcctgcgcgacggccgcgaaggcgggggcggaggctcggcctgcgcggctgggagcggcttaggggaggagggaagaccggaagccacggttgcgtccccatccttagattcgctcctccgggcagggagcggagacggaggaggaggagggagaggctgaatgttggctcggtaattgagaggagcggccgctccagagcttcctcccggggcgcccccctcagtccgtccgcgcttctcagccgccagtctcctggccgcgcagtccccgcggacggccgggccgcggagaccctcgcagaagaggcgctgccggcggcgaggactggccggcggcatccgaggcgcgcgccccaccgccacccccacccgcctgccagccggtccctccggccgccgccatgtcctcctcctcttcctcccccagggagacgtacgaggaggaccgggagtacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatggttgagtttgaatcagtcctttgtgcccagaaagctaaagcagcactcaatggagctgatatatatgctggatgttgcacactaaaaattgaatatgcacggccaactcgtctaaatgttattaggaatgacaatgacagttgggactacactaaaccatatttgggaagacgagatagaggaaagggtcgccagagacaagccattttgggagaacacccttcttcgtttagacatgatggctatggatcccatggtccattattgcctttaccaagtcgttacagaatgggctctcgagatacacctgaacttgttgcttatccattaccacaggcttcttcctcttacatgcatggaggaaatccctctggttcagttgtaatggttagtggattacatcaactaaaaatgaattgttcaagagtcttcaacctgttctgcttatatggaaatattgagaaggtaaaatttatgaagaccattcctggtacagcactggtagaaatgggtgatgagtatgctgtagaaagagctgtcacacaccttaataatgtcaaattatttgggaaaagacttaatgtttgcgtgtctaaacaacattcagttgttccaagtcaaatatttgagctggaggatggtaccagcagctacaaagattttgcaatgagcaaaaataatcgctttacaagtgctggccaagcatctaagaatataatccagccaccctcctgtgttttgcattattataatgttccattgtgtgtcacagaagagaccttcacaaagttgtgtaatgaccatgaagttcttacattcatcaaatataaagtgtttgatgcaaaaccttcagccaaaacactttctgggctattagaatgggagtgcaaaactgatgcagtagaagcccttacggcactgaatcactatcagataagagtgccgaatggttccaatccctatacattgaagctttgcttttctacatcatcccatttataagaagagaagagcatgttagaatttatgttcacctttattacaatttcaaagctacacttcattaaaaaaaaatctaaaatggttgatctcatgttgccttgcttactttaagatcctgttctgtaataaacatattttgccttgagtaaa

SEQ ID NO: 43152 - DNA, 3388 bp, Homo sapiens
attgggatggaggatgagattttatatggaaggattaaaacatatttaaccggagcagggacttacagggacaggcaagtcagtaaagggcccaggttacaaacgagttataaccgatcagaccgacgagcgcccgcgtgcagcgcctcctgccgacgcgcgcctcgcagccttcagtcaatgctgacagctgttctccaacacccagctaggggcgggagggtccgcccacttctaccagattttgcacacaaaacagtggaaagaccattctcatggctccaagccgttttctcccttcatcgcctgcaattttagggcttttcggggggtatgactgcagggattttagaggtttttttcctcattctctttttaagaggtgataaaaagcatttaaattagcggcagggcggttaacacccgcagccctagcctctccgcacttctcgtcgctcgtccgtgttcactccacgcctggcctcgggtaggagccgcatagcgccaacggttgcgggtcgcaactactcccaggcggcgcgccttgcgcgccgggcctcccaggaccgcggcgagttcagaaggcgcggggagagaagtgaggtcgagcagcgggcggcttttgacgaacggccctcacagccaatgggaagcccggtcgactttcccgcccctgccaatagggagcagaacccgggccggggggggcgcttcccgcaggctgcggctggattcgatcctgcgcgacggccgcgaaggcgggggcggaggctcggcctgcgcggctgggagcggcttaggggaggagggaagaccggaagccacggttgcgtccccatccttagattcgctcctccgggcagggagcggagacggaggaggaggagggagaggctgaatgttggctcggtaattgagaggagcggccgctccagagcttcctcccggggcgcccccctcagtccgtccgcgcttctcagccgccagtctcctggccgcgcagtccccgcggacggccgggccgcggagaccctcgcagaagaggcgctgccggcggcgaggactggccggcggcatccgaggcgcgcgccccaccgccacccccacccgcctgccagccggtccctccggccgccgccatgtcctcctcctcttcctcccccagggagacgtacgaggaggaccgggagtacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatggttgagtttgaatcagtcctttgtgcccagaaagctaaagcagcactcaatggagctgatatatatgctggatgttgcacactaagttgggactacactaaaccatatttgggaagacgagatagaggaaagggtcgccagagacaagccattttgggagaacacccttcttcgtttagacatgatggctatggatcccatggtccattattgcctttaccaagtcgttacagaatgggctctcgagatacacctgaacttgttgcttatccattaccacaggcttcttcctcttacatgcatggaggaaatccctctggttcagttgtaatggttagtggattacatcaactaaaaatgaattgttcaagagtcttcaacctgttctgcttatatggaaatattgagaaggtaaaatttatgaagaccattcctggtacagcactggtagaaatgggtgatgagtatgctgtagaaagagctgtcacacaccttaataatgtcaaattatttgggaaaagacttaatgtttgcgtgtctaaacaacattcagttgttccaagtcaaatatttgagctggaggatggtaccagcagctacaaagattttgcaatgagcaaaaataatcgctttacaagtgctggccaagcatctaagaatataatccagccaccctcctgtgttttgcattattataatgttccattgtgtgtcacagaagagaccttcacaaagttgtgtaatgaccatgaagttcttacattcatcaaatataaagtgtttgatgcaaaaccttcagccaaaacactttctgggctattagaatgggagtgcaaaactgatgcagtagaagcccttacggcactgaatcactatcagataagagtgccgaatggttccaatccctatacattgaagctttgcttttctacatcatcccatttataagaagagaagagcatgttagaatttatgttcacctttattacaatttcaaagctacacttcattaaaaaaaaatctaaaatggttgatctcatgttgccttgcttactttaagatcctgttctgtaataaacatattttgccttgagtaaatttgttgtaagcttaaatattgaattgttttcattttaagatagaatatcataatgtagactatctacagcttcattgtagattatacagatatatgatttctaaccttattactggaatttttcttccacagtaaaaatatatttgcattcttaatgctaattatctgcaagtattttttcattgtgtaagagattaatgcaggtgaaagtattgcattttaatatagaattcctattatatgtttagatgtttaagtatgttgcagttactcatattaaacataacttgtatatttattattttaatgaagtttgagaataacgttacatatgttgaattttaagtactacagatttaactgattttatatttctgaaaggctaacagacatggatacacgtgtacagtatgcattcaaacttatttaaattggtgtatttttttttaagtcactgtccatttgtattgacatgcctctgtttctagtccagtttggagattttataaagttataacaatga

SEQ ID NO: 43153 - DNA, 2095 bp, Homo sapiens
gaaaccccgtatctctaacattacaaaaattagctaggcatgatggcatgcacctgtaatcccagctactcaggaggctgaggcaggagaattgcttgaacccgggaggtggaggttgcattgagcccaggtcgcgccactgcactcctggtgatagagcaagactccgtctcaaaaacaaaacaaaacaaaaaattctcttaaaattcatcctgaaattggtaaaacatttccagaagtaaaagagctacttctgattattttcaatcctgtcctttgggagtgaataatgattaagtatcagataccttaaaccgaatttccttaatagagctaatgtttgaatcagtcctttgtgcccagaaagctaaagcagcactcaatggagctgatatatatgctggatgttgcacactaaaaattgaatatgcacgggtaaatatttttttcaacaccctacccaagaaatatttatgctttggatatgcagtttgaacttacattattttcaatcttaacagccaactcgtctaaatgttattaggaatgacaatgacagttgggactacactaaaccatatttgggaagacgagatagaggaaagggtcgccagagacaagccattttgggagaacacccttcttcgtttagacatgatggctatggatcccatggtccattattgcctttaccaagtcgttacagaatgggctctcgagatacacctgaacttgttgcttatccattaccacaggcttcttcctcttacatgcatggaggaaatccctctggttcagttgtaatggttagtggattacatcaactaaaaatgaattgttcaagagtcttcaacctgttctgcttatatggaaatattgagaaggtaaaatttatgaagaccattcctggtacagcactggtagaaatgggtgatgagtatgctgtagaaagagctgtcacacaccttaataatgtcaaattatttgggaaaagacttaatgtttgcgtgtctaaacaacattcagttgttccaagtcaaatatttgagctggaggatggtaccagcagctacaaagattttgcaatgagcaaaaataatcgctttacaagtgctggccaagcatctaagaatataatccagccaccctcctgtgttttgcattattataatgttccattgtgtgtcacagaagagaccttcacaaagttgtgtaatgaccatgaagttcttacattcatcaaatataaagtgtttgatgcaaaaccttcagccaaaacactttctgggctattagaatgggagtgcaaaactgatgcagtagaagcccttacggcactgaatcactatcagataagagtgccgaatggttccaatccctatacattgaagctttgcttttctacatcatcccatttataagaagagaagagcatgttagaatttatgttcacctttattacaatttcaaagctacacttcattaaaaaaaaatctaaaatggttgatctcatgttgccttgcttactttaagatcctgttctgtaataaacatattttgccttgagtaaatttgttgtaagcttaaatattgaattgttttcattttaagatagaatatcataatgtagactatctacagcttcattgtagattatacagatatatgatttctaaccttattactggaatttttcttccacagtaaaaatatatttgcattcttaatgctaattatctgcaagtattttttcattgtgtaagagattaatgcaggtgaaagtattgcattttaatatagaattcctattatatgtttagatgtttaagtatgttgcagttactcatattaaacataacttgtatatttattattttaatgaagtttgagaataacgttacatatgttgaattttaagtactacagatttaactgattttatatttctgaaaggctaacagacatggatacacgtgtacagtatgcattcaaacttatttaaattggtgtatttttttttaagtcactgtccatttgtattgacatgcctctgtttctagtccagtttggagattttataaagttataacaatga

SEQ ID NO: 43154 - DNA, 2934 bp, Homo sapiens
attgggatggaggatgagattttatatggaaggattaaaacatatttaaccggagcagggacttacagggacaggcaagtcagtaaagggcccaggttacaaacgagttataaccgatcagaccgacgagcgcccgcgtgcagcgcctcctgccgacgcgcgcctcgcagccttcagtcaatgctgacagctgttctccaacacccagctaggggcgggagggtccgcccacttctaccagattttgcacacaaaacagtggaaagaccattctcatggctccaagccgttttctcccttcatcgcctgcaattttagggcttttcggggggtatgactgcagggattttagaggtttttttcctcattctctttttaagaggtgataaaaagcatttaaattagcggcagggcggttaacacccgcagccctagcctctccgcacttctcgtcgctcgtccgtgttcactccacgcctggcctcgggtaggagccgcatagcgccaacggttgcgggtcgcaactactcccaggcggcgcgccttgcgcgccgggcctcccaggaccgcggcgagttcagaaggcgcggggagagaagtgaggtcgagcagcgggcggcttttgacgaacggccctcacagccaatgggaagcccggtcgactttcccgcccctgccaatagggagcagaacccgggccggggggggcgcttcccgcaggctgcggctggattcgatcctgcgcgacggccgcgaaggcgggggcggaggctcggcctgcgcggctgggagcggcttaggggaggagggaagaccggaagccacggttgcgtccccatccttagattcgctcctccgggcagggagcggagacggaggaggaggagggagaggctgaatgttggctcggtaattgagaggagcggccgctccagagcttcctcccggggcgcccccctcagtccgtccgcgcttctcagccgccagtctcctggccgcgcagtccccgcggacggccgggccgcggagaccctcgcagaagaggcgctgccggcggcgaggactggccggcggcatccgaggcgcgcgccccaccgccacccccacccgcctgccagccggtccctccggccgccgccatgtcctcctcctcttcctcccccagggagacgtacgaggaggaccgggagtacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatggttgagtttgaatcagtcctttgtgcccagaaagctaaagcagcactcaatggagctgatatatatgctggatgttgcacactaaaaattgaatatgcacggccaactcgtctaaatgttattaggaatgacaatgacagttgggactacactaaaccatatttgggaagacgagatagaggaaagggtcgccagagacaagccattttgggagaacacccttcttcgtttagacatgatggctatggatcccatggtccattattgcctttaccaagtcgttacagaatgggctctcgagatacacctgaacttgttgcttatccattaccacaggcttcttcctcttacatgcatggaggaaatccctctggttcagttgtaatggttagtggattacatcaactaaaaatgaattgttcaagagtcttcaacctgttctgcttatatggaaatattgagaaggtaaaatttatgaagaccattcctggtacagcactggtagaaatgggtgatgagtatgctgtagaaagagctgtcacacaccttaataatgtcaaattatttgggaaaagacttaatgtttgcgtgtctaaacaacattcagttgttccaagtcaaatatttgagctggaggatggtaccagcagctacaaagattttgcaatgagcaaaaataatcgctttacaagtgctggccaagcatctaagaatataatccagccaccctcctgtgttttgcattattataatgttccattgtgtgtcacagaagagaccttcacaaagttgtgtaatgaccatgaagttcttacattcatcaaatataaagtgtttgatgcaaaaccttcagccaaaacactttctgggctattagaatgggagtgcaaaactgatgcagtagaagcccttacggcactgaatcactatcagataagagtgccgaagacggggtttcaccacgttggccaggctggtctcgaactcctggacctcatgatctgcccacctccgccttccgaagtgctgggattacaggcgtgagaaaactcaagtttaatttttgaaactttttgctgtgtaatttactttgatcctggatctccagggtatttaaataataggggaacattattgggtgtggtgatgaatgatggtttaaaaaaga

SEQ ID NO: 43155 - DNA, 2523 bp, Homo sapiens
attgggatggaggatgagattttatatggaaggattaaaacatatttaaccggagcagggacttacagggacaggcaagtcagtaaagggcccaggttacaaacgagttataaccgatcagaccgacgagcgcccgcgtgcagcgcctcctgccgacgcgcgcctcgcagccttcagtcaatgctgacagctgttctccaacacccagctaggggcgggagggtccgcccacttctaccagattttgcacacaaaacagtggaaagaccattctcatggctccaagccgttttctcccttcatcgcctgcaattttagggcttttcggggggtatgactgcagggattttagaggtttttttcctcattctctttttaagaggtgataaaaagcatttaaattagcggcagggcggttaacacccgcagccctagcctctccgcacttctcgtcgctcgtccgtgttcactccacgcctggcctcgggtaggagccgcatagcgccaacggttgcgggtcgcaactactcccaggcggcgcgccttgcgcgccgggcctcccaggaccgcggcgagttcagaaggcgcggggagagaagtgaggtcgagcagcgggcggcttttgacgaacggccctcacagccaatgggaagcccggtcgactttcccgcccctgccaatagggagcagaacccgggccggggggggcgcttcccgcaggctgcggctggattcgatcctgcgcgacggccgcgaaggcgggggcggaggctcggcctgcgcggctgggagcggcttaggggaggagggaagaccggaagccacggttgcgtccccatccttagattcgctcctccgggcagggagcggagacggaggaggaggagggagaggctgaatgttggctcgggagacgtacgaggaggaccgggagtacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatggttgagtttgaatcagtcctttgtgcccagaaagctaaagcagcactcaatggagctgatatatatgctggatgttgcacactaaaaattgaatatgcacggccaactcgtctaaatgttattaggaatgacaatgacagttgggactacactaaaccatatttgggaagacgaggtaggtattttatacattttagaatgtacttgatctgctgacaaatttttatatgcagttagattcttttttcctgagatgagctagttaattcaaatgaaaaccttgttgatgaatgcttttgttgcaaaaggccatgtaatgctggaaaataaccttgaacattagtgccccctactggtatgtactgagctatttatatttagttcaacaaggagcccacacattcaggcacgcccgcagttcaaggacttgcatttctccaagcagctctctctctttggaggagaggaaactgattcagaatattccttacaaactgcaaacttgcacactgcttctctatggaaaggactttcccccaagctggacgaggcattaagaaggatagaggactccagcaggctgactctacacttcatcatgcacaacatcggcatcagcaaaaagccctctgaaaaactcagactcgcaattcaccttgactgcatactgcatgcaccatcaccccaagtttttaaaggaggacacttaacagtacttcagaattgcatgggatgaacaccatgatagactgtgcccatttatacaagttgtatgtatatattggtctgatttcccttaaggtttcagttgtagaatttaagactttccactaacggaaactagacttcatctgcaatgttgtaaatcttaatgcccattactgtgactgtgtgcagcttagattcaaattgttaattggcaaataaccaggaccagtttattaacaggtcttgggaattgataatgctcaaccaatccacacagatagaaaaataaaaggattagaaaggtg

SEQ ID NO: 43156 - DNA, 3266 bp, Homo sapiens
attgggatggaggatgagattttatatggaaggattaaaacatatttaaccggagcagggacttacagggacaggcaagtcagtaaagggcccaggttacaaacgagttataaccgatcagaccgacgagcgcccgcgtgcagcgcctcctgccgacgcgcgcctcgcagccttcagtcaatgctgacagctgttctccaacacccagctaggggcgggagggtccgcccacttctaccagattttgcacacaaaacagtggaaagaccattctcatggctccaagccgttttctcccttcatcgcctgcaattttagggcttttcggggggtatgactgcagggattttagaggtttttttcctcattctctttttaagaggtgataaaaagcatttaaattagcggcagggcggttaacacccgcagccctagcctctccgcacttctcgtcgctcgtccgtgttcactccacgcctggcctcgggtaggagccgcatagcgccaacggttgcgggtcgcaactactcccaggcggcgcgccttgcgcgccgggcctcccaggaccgcggcgagttcagaaggcgcggggagagaagtgaggtcgagcagcgggcggcttttgacgaacggccctcacagccaatgggaagcccggtcgactttcccgcccctgccaatagggagcagaacccgggccggggggggcgcttcccgcaggctgcggctggattcgatcctgcgcgacggccgcgaaggcgggggcggaggctcggcctgcgcggctgggagcggcttaggggaggagggaagaccggaagccacggttgcgtccccatccttagattcgctcctccgggcagggagcggagacggaggaggaggagggagaggctgaatgttggctcggtaattgagaggagcggccgctccagagcttcctcccggggcgcccccctcagtccgtccgcgcttctcagccgccagtctcctggccgcgcagtccccgcggacggccgggccgcggagaccctcgcagaagaggcgctgccggcggcgaggactggccggcggcatccgaggcgcgcgccccaccgccacccccacccgcctgccagccggtccctccggccgccgccatgtcctcctcctcttcctcccccagggagacgtacgaggaggaccgggagtacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatggttgagtttgaatcagtcctttgtgcccagaaagctaaagcagcactcaatggagctgatatatatgctggatgttgcacactaaaaattgaatatgcacggccaactcgtctaaatgttattaggaatgacaatgacagttgggactacactaaaccatatttgggaagacgaggtaggtattttatacattttagaatgtacttgatctgctgacaaatttttatatgcagttagattcttttttcctgagatgagctagttaattcaaatgaaaaccttgttgatgaatgcttttgttgcaaaaggccatgtaatgctggaaaataaccttgaacattagtgccccctactggtatgtactgagctatttatatttagttcaacaaggagcccacacattcaggcacgcccgcagttcaaggacttgcatttctccaagcagctctctctctttggaggagaggaaactgattcagaatattccttacaaactgcaaacttgcacactgcttctctatggaaaggactttcccccaagctggacgaggcattaagaaggatagaggactccagcaggctgactctacacttcatcatgcacaacatcggcatcagcaaaaagccctctgaaaaactcagactcgcaattcaccttgactgcatactgcatgcaccatcaccccaagtttttaaaggaggacacttaacagtacttcagaattgcatgggatgaacaccatgatagactgtgcccatttatacaagttgtatgtatatattggtctgatttcccttaaggtttcagttgtagaatttaagactttccactaacggaaactagacttcatctgcaatgttgtaaatcttaatgcccattactgtgactgtgtgcagcttagattcaaattgttaattggcaaataaccaggaccagtttattaacaggtcttgggaattgataatgctcaaccaatccacacagatagaaaaataaaaggattagaaaggtgcacacttgctgcattgtttactttttaaattttttgtttttttctcaattgtggtcactgaacagaaattctaacataatgaaaaggtgcattatatgtgaaagacgttcttctgtgtggtttgatttttgtaaagtggctgtttataagttgtcactttttgtaacaatttaaggttatcactgtcaatttgtgtaactagaaattttgacatttcaaatgtaggtgaaagtaacatgtctgttcaagatagaatatctttaaacttgataaatctgaaaataagagcatttcatttgggatgcatcttcacctataagtgctagatttcgtgaggataaatttgactgataaaattgttcaactaactgtgtggcaattctggaatatacaaattaaaatgtggatcttgtaaaacaagggggctgcagtattggctacatcttaactacaatatcagtgtttgaactacagggtggaaaagctc

SEQ ID NO: 43157 - DNA, 450 bp, Homo sapiens
tataacctaacattggaagtggcataccatcacttaatgttataatttttttggtcacagagaccaaacagtacagtgagtgtaggaggggactatacagggtgggagtaccaggaggttggaatcaccttcaagctatagcttccacaatccctgctgatcattttagaggaaagcaatacatgcatatgtttagaaaactcagacagtacataaaggtacaaaatgaaaagttaaagctttctacaacctccaaccttttgtcttgttctttttttcttccctagtgtgtatatataattacatatatttttaaaacttggctaggcactgtgactcacgcctgtaatcccagcactttgggagactgaggcgggtggatcgtctgaggtcaggagttcgagaccagcttggccaatgtggcgaaaccctgtctctactaaaaataaa

SEQ ID NO: 43158 - DNA, 3322 bp, Homo sapiens
attgggatggaggatgagattttatatggaaggattaaaacatatttaaccggagcagggacttacagggacaggcaagtcagtaaagggcccaggttacaaacgagttataaccgatcagaccgacgagcgcccgcgtgcagcgcctcctgccgacgcgcgcctcgcagccttcagtcaatgctgacagctgttctccaacacccagctaggggcgggagggtccgcccacttctaccagattttgcacacaaaacagtggaaagaccattctcatggctccaagccgttttctcccttcatcgcctgcaattttagggcttttcggggggtatgactgcagggattttagaggtttttttcctcattctctttttaagaggtgataaaaagcatttaaattagcggcagggcggttaacacccgcagccctagcctctccgcacttctcgtcgctcgtccgtgttcactccacgcctggcctcgggtaggagccgcatagcgccaacggttgcgggtcgcaactactcccaggcggcgcgccttgcgcgccgggcctcccaggaccgcggcgagttcagaaggcgcggggagagaagtgaggtcgagcagcgggcggcttttgacgaacggccctcacagccaatgggaagcccggtcgactttcccgcccctgccaatagggagcagaacccgggccggggggggcgcttcccgcaggctgcggctggattcgatcctgcgcgacggccgcgaaggcgggggcggaggctcggcctgcgcggctgggagcggcttaggggaggagggaagaccggaagccacggttgcgtccccatccttagattcgctcctccgggcagggagcggagacggaggaggaggagggagaggctgaatgttggctcggtaattgagaggagcggccgctccagagcttcctcccggggcgcccccctcagtccgtccgcgcttctcagccgccagtctcctggccgcgcagtccccgcggacggccgggccgcggagaccctcgcagaagaggcgctgccggcggcgaggactggccggcggcatccgaggcgcgcgccccaccgccacccccacccgcctgccagccggtccgaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatggttgagtttgaatcagtcctttgtgcccagaaagctaaagcagcactcaatggagctgatatatatgctggatgttgcacactaaaaattgaatatgcacggccaactcgtctaaatgttattaggaatgacaatgacagttgggactacactaaaccatatttgggaagacgaggttgttgttggcttatgctgaaacttcttgaaagaagcccactttgaaaatgtgttgctgttgaagctaatagtatgattcagatagaggaaagggtcgccagagacaagccattttgggagaacacccttcttcgtttagacatgatggctatggatcccatggtccattattgcctttaccaagtcgttacagaatgggctctcgagatacacctgaacttgttgcttatccattaccacaggcttcttcctcttacatgcatggaggaaatccctctggttcagttgtaatggttagtggattacatcaactaaaaatgaattgttcaagagtcttcaacctgttctgcttatatggaaatattgagaaggtaaaatttatgaagaccattcctggtacagcactggtagaaatgggtgatgagtatgctgtagaaagagctgtcacacaccttaataatgtcaaattatttgggaaaagacttaatgtttgcgtgtctaaacaacattcagttgttccaagtcaaatatttgagctggaggatggtaccagcagctacaaagattttgcaatgagcaaaaataatcgctttacaagtgctggccaagcatctaagaatataatccagccaccctcctgtgttttgcattattataatgttccattgtgtgtcacagaagagaccttcacaaagttgtgtaatgaccatgaagttcttacattcatcaaatataaagtgtttgatgcaaaaccttcagccaaaacactttctgggctattagaatgggagtgcaaaactgatgcagtagaagcccttacggcactgaatcactatcagataagagtgccgaatggttccaatccctatacattgaagctttgcttttctacatcatcccatttataagaagagaagagcatgttagaatttatgttcacctttattacaatttcaaagctacacttcattaaaaaaaaatctaaaatggttgatctcatgttgccttgcttactttaagatcctgttctgtaataaacatattttgccttgagtaaatttgttgtaagcttaaatattgaattgttttcattttaagatagaatatcataatgtagactatctacagcttcattgtagattatacagatatatgatttctaaccttattactggaatttttcttccacagtaaaaatatatttgcattcttaatgctaattatctgcaagtattttttcattgtgtaagagattaatgcaggtgaaagtattgcattttaatatagaattcctattatatgtttagatgtttaagtatgttgcagttactcatattaaacataacttgtatatttattattttaatgaagtttgagaataacgttacatatgttgaattttaagtactacagatttaactgattttatatttctgaaaggctaacagacatggatacacgtgtacagtatgcattcaaacttatttaaattggtgtatttttttttaagtcactgtccatttgtattgacatgcctctgtttctagtccagtttggagattttataaagttataacaatga

SEQ ID NO: 43159 - DNA, 3146 bp, Homo sapiens
attgggatggaggatgagattttatatggaaggattaaaacatatttaaccggagcagggacttacagggacaggcaagtcagtaaagggcccaggttacaaacgagttataaccgatcagaccgacgagcgcccgcgtgcagcgcctcctgccgacgcgcgcctcgcagccttcagtcaatgctgacagctgttctccaacacccagctaggggcgggagggtccgcccacttctaccagattttgcacacaaaacagtggaaagaccattctcatggctccaagccgttttctcccttcatcgcctgcaattttagggcttttcggggggtatgactgcagggattttagaggtttttttcctcattctctttttaagaggtgataaaaagcatttaaattagcggcagggcggttaacacccgcagccctagcctctccgcacttctcgtcgctcgtccgtgttcactccacgcctggcctcgggtaggagccgcatagcgccaacggttgcgggtcgcaactactcccaggcggcgcgccttgcgcgccgggcctcccaggaccgcggcgagttcagaaggcgcggggagagaagtgaggtcgagcagcgggcggcttttgacgaacggccctcacagccaatgggaagcccggtcgactttcccgcccctgccaatagggagcagaacccgggccggggggggcgcttcccgcaggctgcggctggattcgatcctgcgcgacggccgcgaaggcgggggcggaggctcggcctgcgcggctgggagcggcttaggggaggagggaagaccggaagccacggttgcgtccccatccttagattcgctcctccgggcagggagcggagacggaggaggaggagggagaggctgaatgttggctcggtaattgagaggagcggccgctccagagcttcctcccggggcgcccccctcagtccgtccgcgcttctcagccgccagtctcctggccgcgcagtccccgcggacggccgggccgcggagaccctcgcagaagaggcgctgccggcggcgaggactggccggcggcatccgaggcgcgcgccccaccgccacccccacccgcctgccagccggtccctccggccgccgccatgtcctcctcctcttcctcccccagggagacgtacgaggaggaccgggagtacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatggttgagtttgaatcagtcctttgtgcccagaaagctaaagcagcactcaatggagctgatatatatgctggatgttgcacactaaaaattgaatatgcacggccaactcgtctaaatgttattaggaatgacaatgacagttgggactacactaaaccatatttgggaagacgagatagaggaaagggtcgccagagacaagccattttgggagaacacccttcttcgtttagacatgatggctatggatcccatggtccattattgcctttaccaagtcgttacagaatgggctctcgagatacacctgaacttgttgcttatccattaccacaggcttcttcctcttacatgcatggaggaaatccctctggttcagttgtaatggttagtggattacatcaactaaaaatgaattgttcaagagtcttcaacctgttctgcttatatggaaatattgagaaggtaaaatttatgaagaccattcctggtacagcactggtagaaatgggtgatgagtatgctgtagaaagagctgtcacacaccttaataatgtcaaattatttgggaaaagacttaatgtttgcgtgtctaaacaacattcagttgttccaagtcaaatatttgagctggaggatggtaccagcagctacaaagattttgcaatgagcaaaaataatcgctttacaagtgctggccaagcatctaagaatataatccagccaccctcctgtgttttgcattattataatgttccattgtgtgtcacagaagagaccttcacaaagttgtgtaatgaccatgaagttcttacattcatcaaatataaagtgtttgatgcaaaaccttcagccaaaacactttctgggctattagaatgggagtgcaaaactgatgcagtagaagcccttacggcactgaatcactatcagataagagtgccgaatggttccaatccctatacattgaagctttgcttttctacatcatcccatttataagaagagaagagcatgttagaatttatgttcacctttattacaatttcaaagctacacttcattaaaaaaaaatctaaaatggttgatctcatgttgccttgcttactttaagatcctgttctgtaataaacatattttgccttgagtaaaaaaaaaaaaaaaaagagaaacagcaacactttggggccggcggggcccaagaaagttttctaacccactccggtgggcgcgcgggccagatggtagtgaactgggccacgcggccaaggaaacggggcgaaccgggcgggtcccccataaaaccgcggggcccggggcttgaaacaacccaagggcgggctccgggcccacagggcccagagcgttaccccccgcgga

SEQ ID NO: 43160 - DNA, 3101 bp, Homo sapiens
attgggatggaggatgagattttatatggaaggattaaaacatatttaaccggagcagggacttacagggacaggcaagtcagtaaagggcccaggttacaaacgagttataaccgatcagaccgacgagcgcccgcgtgcagcgcctcctgccgacgcgcgcctcgcagccttcagtcaatgctgacagctgttctccaacacccagctaggggcgggagggtccgcccacttctaccagattttgcacacaaaacagtggaaagaccattctcatggctccaagccgttttctcccttcatcgcctgcaattttagggcttttcggggggtatgactgcagggattttagaggtttttttcctcattctctttttaagaggtgataaaaagcatttaaattagcggcagggcggttaacacccgcagccctagcctctccgcacttctcgtcgctcgtccgtgttcactccacgcctggcctcgggtaggagccgcatagcgccaacggttgcgggtcgcaactactcccaggcggcgcgccttgcgcgccgggcctcccaggaccgcggcgagttcagaaggcgcggggagagaagtgaggtcgagcagcgggcggcttttgacgaacggccctcacagccaatgggaagcccggtcgactttcccgcccctgccaatagggagcagaacccgggccggggggggcgcttcccgcaggctgcggctggattcgatcctgcgcgacggccgcgaaggcgggggcggaggctcggcctgcgcggctgggagcggcttaggggaggagggaagaccggaagccacggttgcgtccccatccttagattcgctcctccgggcagggagcggagacggaggaggaggagggagaggctgaatgttggctcggtaattgagaggagcggccgctccagagcttcctcccggggcgcccccctcagtccgtccgcgcttctcagccgccagtctcctggccgcgcagtccccgcggacggccgggccgcggagaccctcgcagaagaggcgctgccggcggcgaggactggccggcggcatccgaggcgcgcgccccaccgccacccccacccgcctgccagccggtccctccggccgccgccatgtcctcctcctcttcctcccccagggagacgtacgaggaggaccgggagtacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatggttgagtttgaatcagtcctttgtgcccagaaagctaaagcagcactcaatggagctgatatatatgctggatgttgcacactaaaaattgaatatgcacggccaactcgtctaaatgttattaggaatgacaatgacagttgggactacactaaaccatatttgggaagacgagatagaggaaagggtcgccagagacaagccattttgggagaacacccttcttcgtttagacatgatggctatggatcccatggtccattattgcctttaccaagtcgttacagaatgggctctcgagatacacctgaacttgttgcttatccattaccacaggcttcttcctcttacatgcatggaggaaatccctctggttcagttgtaatggttagtggattacatcaactaaaaatgaattgttcaagagtcttcaacctgttctgcttatatggaaatattgagaaggtaaaatttatgaagaccattcctggtacagcactggtagaaatgggtgatgagtatgctgtagaaagagctgtcacacaccttaataatgtcaaattatttgggaaaagacttaatgtttgcgtgtctaaacaacattcagttgttccaagtcaaatatttgagctggaggatggtaccagcagctacaaagattttgcaatgagcaaaaataatcgctttacaagtgctggccaagcatctaagaatataatccagccaccctcctgtgttttgcattattataatgttccattgtgtgtcacagaagagaccttcacaaagttgtgtaatgaccatgaagttcttacattcatcaaatataaagtgtttgatgcaaaaccttcagccaaaacactttctgggctattagaatgggagtgcaaaactgatgcagtagaagcccttacggcactgaatcactatcagataagagtgccgagtaagtaaaatgctttatttgtgttgtaattatgtagtggcagttaccatcacagaaacattcatggtaatataaaaataacacttaataggcttcttaaaaaatacagataaatacaaaaaagaaaggcatattaattcctgtattagttatctattgctgtataacaaattgccataaaatttagcatcttaaaacagcaaacatttattatcttactgtttctgagggttagtattttgggtgcatttcagctgggcaattcgggcttaggatctcccatgaagttgcagtcaaactgttgtttaagtctgcagtaatctcagggcttgactgaagccagaagatccacccccaggcgcactcatatggttgtgtgtaggctcaat

SEQ ID NO: 43161 - DNA, 2842 bp, Homo sapiens
attgggatggaggatgagattttatatggaaggattaaaacatatttaaccggagcagggacttacagggacaggcaagtcagtaaagggcccaggttacaaacgagttataaccgatcagaccgacgagcgcccgcgtgcagcgcctcctgccgacgcgcgcctcgcagccttcagtcaatgctgacagctgttctccaacacccagctaggggcgggagggtccgcccacttctaccagattttgcacacaaaacagtggaaagaccattctcatggctccaagccgttttctcccttcatcgcctgcaattttagggcttttcggggggtatgactgcagggattttagaggtttttttcctcattctctttttaagaggtgataaaaagcatttaaattagcggcagggcggttaacacccgcagccctagcctctccgcacttctcgtcgctcgtccgtgttcactccacgcctggcctcgggtaggagccgcatagcgccaacggttgcgggtcgcaactactcccaggcggcgcgccttgcgcgccgggcctcccaggaccgcggcgagttcagaaggcgcggggagagaagtgaggtcgagcagcgggcggcttttgacgaacggccctcacagccaatgggaagcccggtcgactttcccgcccctgccaatagggagcagaacccgggccggggggggcgcttcccgcaggctgcggctggattcgatcctgcgcgacggccgcgaaggcgggggcggaggctcggcctgcgcggctgggagcggcttaggggaggagggaagaccggaagccacggttgcgtccccatccttagattcgctcctccgggcagggagcggagacggaggaggaggagggagaggctgaatgttggctcggtaattgagaggagcggccgctccagagcttcctcccggggcgcccccctcagtccgtccgcgcttctcagccgccagtctcctggccgcgcagtccccgcggacggccgggccgcggagaccctcgcagaagaggcgctgccggcggcgaggactggccggcggcatccgaggcgcgcgccccaccgccacccccacccgcctgccagccggtccctccggccgccgccatgtcctcctcctcttcctcccccagggagacgtacgaggaggaccgggagtacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatggttgagtttgaatcagtcctttgtgcccagaaagctaaagcagcactcaatggagctgatatatatgctggatgttgcacactaaaaattgaatatgcacggccaactcgtctaaatgttattaggaatgacaatgacagttgggactacactaaaccatatttgggaagacgagatagaggaaagggtcgccagagacaagccattttgggagaacacccttcttcgtttagacatgatggctatggatcccatggtccattattgcctttaccaagtcgttacagaatgggctctcgagatacacctgaacttgttgcttatccattaccacaggcttcttcctcttacatgcatggaggaaatccctctggttcagttgtaatggttagtggattacatcaactaaaaatgaattgttcaagagtcttcaacctgttctgcttatatggaaatattgagaaggtaaaatttatgaagaccattcctggtacagcactggtagaaatgggtgatgagtatgctgtagaaagagctgtcacacaccttaataatgtcaaattatttgggaaaagacttaatgtttgcgtgtctaaacaacattcagttgttccaagtcaaatatttgagctggaggatggtaccagcagctacaaagattttgcaatgagcaaaaataatcgctttacaagtgctggccaagcatctaagaatataatccagccaccctcctgtgttttgcattattataatgttccattgtgtgtcacagaagagaccttcacaaagttgtgtaatgaccatgaagttcttacattcatcaaatataaagtgtttgatgcaaaaccttcagccaaaacactttctgggctattagaatgggagtgcaaaactgatgcagtagaagcccttacggcactgaatcactatcagataagagtgccgaatggttccaatccctatacaatgaagtgtagctttgaaattgtaataaaggtgaacataaattctaacatgctcttctcttcttataaatgggatgatgtagaaaagcaaagcttcaatgtatagggtcg

SEQ ID NO: 43162 - DNA, 3352 bp, Homo sapiens
attgggatggaggatgagattttatatggaaggattaaaacatatttaaccggagcagggacttacagggacaggcaagtcagtaaagggcccaggttacaaacgagttataaccgatcagaccgacgagcgcccgcgtgcagcgcctcctgccgacgcgcgcctcgcagccttcagtcaatgctgacagctgttctccaacacccagctaggggcgggagggtccgcccacttctaccagattttgcacacaaaacagtggaaagaccattctcatggctccaagccgttttctcccttcatcgcctgcaattttagggcttttcggggggtatgactgcagggattttagaggtttttttcctcattctctttttaagaggtgataaaaagcatttaaattagcggcagggcggttaacacccgcagccctagcctctccgcacttctcgtcgctcgtccgtgttcactccacgcctggcctcgggtaggagccgcatagcgccaacggttgcgggtcgcaactactcccaggcggcgcgccttgcgcgccgggcctcccaggaccgcggcgagttcagaaggcgcggggagagaagtgaggtcgagcagcgggcggcttttgacgaacggccctcacagccaatgggaagcccggtcgactttcccgcccctgccaatagggagcagaacccgggccggggggggcgcttcccgcaggctgcggctggattcgatcctgcgcgacggccgcgaaggcgggggcggaggctcggcctgcgcggctgggagcggcttaggggaggagggaagaccggaagccacggttgcgtccccatccttagattcgctcctccgggcagggagcggagacggaggaggaggagggagaggctgaatgttggctcggtaattgagaggagcggccgctccagagcttcctcccggggcgcccccctcagtccgtccgcgcttctcagccgccagtctcctggccgcgcagtccccgcggacggccgggccgcggagaccctcgcagaagaggcgctgccggcggcgaggactggccggcggcatccgaggcgcgcgccccaccgccacccccacccgcctgccagccggtccctccggccgccgccatgtcctcctcctcttcctcccccagggagacgtacgaggaggaccgggagtacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatggttgagtttgaatcagtcctttgtgcccagaaagctaaagcagcactcaatggagctgatatatatgctggatgttgcacactaaaaattgaatatgcacgggtaaatatttttttcaacaccctacccaagaaatatttatgctttggatatgcagtttgaacttacattattttcaatcttaacagccaactcgtctaaatgttattaggaatgacaatgacagttgggactacactaaaccatatttgggaagacgaggtaggtattttatacattttagaatgtacttgatctgctgacaaatttttatatgcagttagattcttttttcctgagatgagctagttaattcaaatgaaaaccttgttgatgaatgcttttgttgcaaaaggccatgtaatgctggaaaataaccttgaacattagtgccccctactggtatgtactgagctatttatatttagttcaacaaggagcccacacattcaggcacgcccgcagttcaaggacttgcatttctccaagcagctctctctctttggaggagaggaaactgattcagaatattccttacaaactgcaaacttgcacactgcttctctatggaaaggactttcccccaagctggacgaggcattaagaaggatagaggactccagcaggctgactctacacttcatcatgcacaacatcggcatcagcaaaaagccctctgaaaaactcagactcgcaattcaccttgactgcatactgcatgcaccatcaccccaagtttttaaaggaggacacttaacagtacttcagaattgcatgggatgaacaccatgatagactgtgcccatttatacaagttgtatgtatatattggtctgatttcccttaaggtttcagttgtagaatttaagactttccactaacggaaactagacttcatctgcaatgttgtaaatcttaatgcccattactgtgactgtgtgcagcttagattcaaattgttaattggcaaataaccaggaccagtttattaacaggtcttgggaattgataatgctcaaccaatccacacagatagaaaaataaaaggattagaaaggtgcacacttgctgcattgtttactttttaaattttttgtttttttctcaattgtggtcactgaacagaaattctaacataatgaaaaggtgcattatatgtgaaagacgttcttctgtgtggtttgatttttgtaaagtggctgtttataagttgtcactttttgtaacaatttaaggttatcactgtcaatttgtgtaactagaaattttgacatttcaaatgtaggtgaaagtaacatgtctgttcaagatagaatatctttaaacttgataaatctgaaaataagagcatttcatttgggatgcatcttcacctataagtgctagatttcgtgaggataaatttgactgataaaattgttcaactaactgtgtggcaattctggaatatacaaattaaaatgtggatcttgtaaaacaagggggctgcagtattggctacatcttaactacaatatcagtgtttgaactacagggtggaaaagctc

SEQ ID NO: 43163 - DNA, 425 bp, Homo sapiens
tgttctgatttctgcctttggagccgtgtttaggtcataatcaaaggccatgcctcagtgtctcagggaaggtatgtttgcttttattgtcttctaacacttatttctttttttaatgctccaatcctcaacatctagagtgtacttcatggagggatccagctctgcgttgtcccccggtctggatgaccccatgtgacctctagagcatccaatggcctttggagctgcaccccacccctgtgctccccaatgctgtgccagctcctcactccagggtcctgcccagccctgccctgcgtgcccacacctatggctatttatgctgcttactacatgactgtcaacgcatgcgcttgagcgttagctctgtttaccctttaaaggaatctcccaagacactaccaggcagtattgactagcgc

SEQ ID NO: 43164 - DNA, 512 bp, Homo sapiens
  misc_feature (54)..(54): n is a, c, g, or t
  misc_feature (57)..(57): n is a, c, g, or t
  misc_feature (62)..(62): n is a, c, g, or t
ccgcccctcacccaggcccaggcccaggccccgcccccacaagccgggctcacncgnctggnagaccccgccaagcgcctcggagcgcgcaggatgcgctgggcggccgccaccctccgtggcaaggcgaggccccgggggcgggccggggtcaccacgcctgccccagggaaccgcacaggcacgtgcgctaagctgcggctacccccgcaagcaaccttccaagtccttcgtggcaatggtgcttccgtggggaccgtgtcatgtccatggccttcctcacctgctgcctcctcaagtgcgtgaagaagagcaagcggcggcgctccaacaggtcagcccagctgtggtcccagctgaaagatgaggacttggagacggtgcaggccgcataccttggcctcaagcacttcaacaaacccgtgagcgggcccagccaggcgcacgacaaccacagcttcaccaccccagtgtgcaaacttggtgccaccacacgagaccttttggcttca

SEQ ID NO: 43165 - DNA, 1356 bp, Homo sapiens
  misc_feature (54)..(54): n is a, c, g, or t
  misc_feature (57)..(57): n is a, c, g, or t
  misc_feature (62)..(62): n is a, c, g, or t
ccgcccctcacccaggcccaggcccaggccccgcccccacaagccgggctcacncgnctggnagaccccgccaagcgcctcggagcgcgcaggatgcgctgggcggccgccaccctccgtggcaaggcgaggccccgggggcgggccggggtcaccacgcctgccccagggaaccgcacagacggtactcacccttcttgcgatgatgtgagatgataaaatgcctacatgatgagatgaagtgagatgaaaaacataggccttgtgatggaatgggaaattccagagataatttgcacgtgcgctaagctgcggctacccccgcaagcaaccttccaagtccttcgtggcaatggtgcttccgtggggaccgtgctcatgttccgctgcccctccaaccaccagatggtggggtctgggctcctcacctgcacctggaaggggagcatcgctgagtggtcttcagggtccccagtgtgcaaactggtgccaccacacgagacctttggcttcaaggtggccgtgatcgcctccattgtgagctgtgccatcatcctgctcatgtccatggccttcctcacctgctgcctcctcaagtgcgtgaagaagagcaagcggcggcgctccaacaggtcagcccagctgtggtcccagctgaaagatgaggacttggagacggtgcaggccgcataccttggcctcaagcacttcaacaaacccgtgagcgggcccagccaggcgcacgacaaccacagcttcaccacagaccatggtgagagcaccagcaagctggccagtgtgacccgcagcgtggacaaggaccctgggatccccagagctctaagcctcagtggctcctccagctcaccccaagcccaggtgatggtgcacatggcaaaccccagacagcccctgcctgcctctgggctggccacaggaatgccacaacagcccgcagcatatgccctagggtgaccacgcagtgaggctggtgcccatgctccacactgggaggccaggctgaccccaccagccagtcagctacaactccacatcaactccacatgcgcccagctcgagactgatgagtggaatcagcttccaggtgtagggaccccttgaggggccgagctgacatccaaggctgaggaccccagtggggagtgttctgttccggcatatcctggccgtaacgatttttatagttatggactacttgaaaccactactgagggtaatttactagctgtggcctcccactaactagcattcctttaaagagactgggaaatgttttaagcaaatctagttttgtataataaaataagaaaatagcaataaacttcttttcagcaa

SEQ ID NO: 43166 - DNA, 1297 bp, Homo sapiens
  misc_feature (54)..(54): n is a, c, g, or t
  misc_feature (57)..(57): n is a, c, g, or t
  misc_feature (62)..(62): n is a, c, g, or t
ccgcccctcacccaggcccaggcccaggccccgcccccacaagccgggctcacncgnctggnagaccccgccaagcgcctcggagcgcgcaggatgcgctgggcggccgccaccctccgtggcaaggcgaggccccgggggcgggccggggtcaccacgcctgccccagggaaccgcacaggcacgtgcgctaagctgcggctacccccgcaagcaaccttccaagtccttcgtggcaatggtgcttccgtggggaccgtgctcatgttccgctgcccctccaaccaccagatggtggggtctgggctcctcacctgcacctggaaggggagcatcgctgagtggtcttcagggtccccagtgtgcaaactggtgccaccacacgagacctttggcttcaaggtggccgtgatcgcctccattgtgagctgtgccatcatcctgctcatgtccatggccttcctcacctgctgcctcctcaagtgcgtgaagaagagcaagcggcggcgctccaacaggtcagcccagctgtggtcccagctgaaagatgaggacttggagacggtgcaggccgcataccttggcctcaagcacttcaacaaacccgtgagcgggcccagccaggcgcacgacaaccacagcttcaccacagaccatggtgagagcaccagcaagctggccagtgtgacccgcagcgtggacaaggaccctgggatccccagagctctaagcctcagtggctcctccagctcaccccaagcccaggtgatggtgcacatggcaaaccccagacagcccctgcctgcctctgggctggccacaggaatgccacaacagcccgcagcatatgccctagggtgaccacgcagtgaggctggtgcccatgctccacactgggaggccaggctgaccccaccagccagtcagctacaactccacatcaactccacatgcgcccagctcgagactgatgagtggaatcagcttccaggtgtagggaccccttgaggggccgagctgacatccaaggctgaggaccccagtggggagtgttctgttccggcatatcctggccgtaacgatttttatagttatggactacttgaaaccactactgagggtaatttactagctgtggcctcccactaactagcattcctttaaagagactgggaaatgttttaagcaaatctagttttgtataataaaataagaaaatagcaataaacttcttttcagcaaaaaaacacacccaaaacacttttgggccccccgggccccaaaaattttaaccccg

SEQ ID NO: 43167 - DNA, 989 bp, Homo sapiens
  misc_feature (54)..(54): n is a, c, g, or t
  misc_feature (57)..(57): n is a, c, g, or t
  misc_feature (62)..(62): n is a, c, g, or t
ccgcccctcacccaggcccaggcccaggccccgcccccacaagccgggctcacncgnctggnagaccccgccaagcgcctcggagcgcgcaggatgcgctgggcggccgccaccctccgtggcaaggcgaggccccgggggcgggccggggtcaccacgcctgccccagggaaccgcacaggcacgtgcgctaagctgcggctacccccgcaagcaaccttccaagtccttcgtggcaatggtgcttccgtggggaccgtgctcatgttccgctgcccctccaaccaccagatggtggggtctgggctcctcacctgcacctggaaggggagcatcgctgagtggtcttcagggtccccagtgtgcaaactggtgccaccacacgagacctttggcttcaaggtggccgtgatcgcctccattgtgagctgtgccatcatcctgctcatgtccatggccttcctcacctgctgcctcctcaagtgcgtgaagaagagcaagcggcggcgctccaacaggtcagcccagctgtggtcccagctgaaagatgaggacttggagacggtgcaggccgcataccttggcctcaagcacttcaacaaacccgtgagcgggcccagccaggcgcacgacaaccacagcttcaccacagaccatggtgagagcaccagcaagctggccagtgtgacccgcagcgtggacaaggaccctgggatccccagagctctaagcctcagtggctcctccagctcaccccaagcccaggtgatggtgcacatggcaaaccccagacagcccctgcctgcctctgggctggccacaggaatgccacaacagcccgcagcatatgccctagggtgaccacgcagtgaggctggtgcccatgctcccactaactagcattcctttaaagagactgggaaatgttttaagcaaatctagttttgtataataaaataagaaaatagcaataaacttcttttcagcaa

SEQ ID NO: 43168 - DNA, 1242 bp, Homo sapiens
  misc_feature (54)..(54): n is a, c, g, or t
  misc_feature (57)..(57): n is a, c, g, or t
  misc_feature (62)..(62): n is a, c, g, or t
ccgcccctcacccaggcccaggcccaggccccgcccccacaagccgggctcacncgnctggnagaccccgccaagcgcctcggagcgcgcaggatgcgctgggcggccgccaccctccgtggcaaggcgaggccccgggggcgggccggggtcaccacgcctgccccagggaaccgcacaggcacgtgcgctaagctgcggctacccccgcaagcaaccttccaagtccttcgtggcaatggtgcttccgtggggaccgtgctcatgttccgctgcccctccaaccaccagatggtggggtctgggctcctcacctgcacctggaaggggagcatcgctgagtggtcttcagggtccccagtgtgcaaactggtgccaccacacgagacctttggcttcaaggtggccgtgatcgcctccattgtgagctgtgccatcatcctgctcatgtccatggccttcctcacctgctgcctcctcaagtgcgtgaagaagagcaagcggcggcgctccaacaggtcagcccagctgtggtcccagctgaaagatgaggacttggagacggtgcaggccgcataccttggcctcaagcacttcaacaaacccgtgagcgggcccagccaggcgcacgacaaccacagcttcaccacagaccatggtgagagcaccagcaagctggccagtgtgacccgcagcgtggacaaggaccctgggatccccagagctctaagcctcagtggctcctccagctcaccccaagcccaggtgatggtgcacatggcaaaccccagacagcccctgcctgcctctgggctggccacaggaatgccacaacagcccgcagcatatgccctagggtgaccacgcagtgaggctggtgcccatgctccacactgggaggccaggctgaccccaccagccagtcagctacaactccacatcaactccacatgcgcccagctcgagactgatgagtggaatcagcttccaggtgtagggaccccttgaggggccgagctgacatccaaggctgaggaccccagtggggagtgttctgttccggcatatcctggccgtaacgatttttatagttatggactacttgaaaccactactgagggtaatttactagctgtggcctcccactaactagcattcctttaaagagactgggaaatgttttaagcaaatctagttttgtataataaaataagaaaatagcaataaacttcttttcagcaa

SEQ ID NO: 43169 - DNA, 639 bp, Homo sapiens
  misc_feature (54)..(54): n is a, c, g, or t
  misc_feature (57)..(57): n is a, c, g, or t
  misc_feature (62)..(62): n is a, c, g, or t
ccgcccctcacccaggcccaggcccaggccccgcccccacaagccgggctcacncgnctggnagaccccgccaagcgcctcggagcgcgcaggatgcgctgggcggccgccaccctccgtggcaaggcgaggccccgggggcgggccggggtcaccacgcctgccccagggaaccgcacaggtgagggctggggccgagtggccgcgtgcggggctctgcgcccatttcacagacgggaaagccgaggggagggggtcgcggggccgcacagccgtgggtgggggccacagcaacgatctgccccgaggacgaacctcctcgaccctccgccggcccagcaggcgccctagcggagccgaagcctggcagcgagcagttcgaaaccaggcggctgcacgcagcagcccgcgcgcccgttcccgagtggccgcagcgccttggtcccgggcgtctgcggacagcgcggccggccaagcctctccacgccgcaggctccgggcccctccgcgcccctcccggggaagtcgaaaccggcctcacctggcgggcgggtggcgcgggggcgggaggggggagccgggagccctctctgcgcctgagggaggtgtcatcttcacgattccttggtgaccagcgca

SEQ ID NO: 43170 - DNA, 1394 bp, Homo sapiens
  misc_feature (54)..(54): n is a, c, g, or t
  misc_feature (57)..(57): n is a, c, g, or t
  misc_feature (62)..(62): n is a, c, g, or t
ccgcccctcacccaggcccaggcccaggccccgcccccacaagccgggctcacncgnctggnagaccccgccaagcgcctcggagcgcgcaggatgcgctgggcggccgccaccctccgtggcaaggcgaggccccgggggcgggccggggtcaccacgcctgccccagggaaccgcacagacggtactcacccttcttgcgatgatgtgagatgataaaatgcctacatgatgagatgaagtgagatgaaaaacataggccttgtgatggaatgggaaattccagagataatttgtcataatcaaaggccatgcctcagtgtctcagggaaggcacgtgcgctaagctgcggctacccccgcaagcaaccttccaagtccttcgtggcaatggtgcttccgtggggaccgtgctcatgttccgctgcccctccaaccaccagatggtggggtctgggctcctcacctgcacctggaaggggagcatcgctgagtggtcttcagggtccccagtgtgcaaactggtgccaccacacgagacctttggcttcaaggtggccgtgatcgcctccattgtgagctgtgccatcatcctgctcatgtccatggccttcctcacctgctgcctcctcaagtgcgtgaagaagagcaagcggcggcgctccaacaggtcagcccagctgtggtcccagctgaaagatgaggacttggagacggtgcaggccgcataccttggcctcaagcacttcaacaaacccgtgagcgggcccagccaggcgcacgacaaccacagcttcaccacagaccatggtgagagcaccagcaagctggccagtgtgacccgcagcgtggacaaggaccctgggatccccagagctctaagcctcagtggctcctccagctcaccccaagcccaggtgatggtgcacatggcaaaccccagacagcccctgcctgcctctgggctggccacaggaatgccacaacagcccgcagcatatgccctagggtgaccacgcagtgaggctggtgcccatgctccacactgggaggccaggctgaccccaccagccagtcagctacaactccacatcaactccacatgcgcccagctcgagactgatgagtggaatcagcttccaggtgtagggaccccttgaggggccgagctgacatccaaggctgaggaccccagtggggagtgttctgttccggcatatcctggccgtaacgatttttatagttatggactacttgaaaccactactgagggtaatttactagctgtggcctcccactaactagcattcctttaaagagactgggaaatgttttaagcaaatctagttttgtataataaaataagaaaatagcaataaacttcttttcagcaa

SEQ ID NO: 43171 - DNA, 1053 bp, Homo sapiens
  misc_feature (54)..(54): n is a, c, g, or t
  misc_feature (57)..(57): n is a, c, g, or t
  misc_feature (62)..(62): n is a, c, g, or t
ccgcccctcacccaggcccaggcccaggccccgcccccacaagccgggctcacncgnctggnagaccccgccaagcgcctcggagcgcgcaggatgcgctgggcggccgccaccctccgtggcaaggcgaggccccgggggcgggccggggtcaccacgcctgccccagggaaccgcacagtggtgccaccacacgagacctttggcttcaaggtggccgtgatcgcctccattgtgagctgtgccatcatcctgctcatgtccatggccttcctcacctgctgcctcctcaagtgcgtgaagaagagcaagcggcggcgctccaacaggtcagcccagctgtggtcccagctgaaagatgaggacttggagacggtgcaggccgcataccttggcctcaagcacttcaacaaacccgtgagcgggcccagccaggcgcacgacaaccacagcttcaccacagaccatggtgagagcaccagcaagctggccagtgtgacccgcagcgtggacaaggaccctgggatccccagagctctaagcctcagtggctcctccagctcaccccaagcccaggtgatggtgcacatggcaaaccccagacagcccctgcctgcctctgggctggccacaggaatgccacaacagcccgcagcatatgccctagggtgaccacgcagtgaggctggtgcccatgctccacactgggaggccaggctgaccccaccagccagtcagctacaactccacatcaactccacatgcgcccagctcgagactgatgagtggaatcagcttccaggtgtagggaccccttgaggggccgagctgacatccaaggctgaggaccccagtggggagtgttctgttccggcatatcctggccgtaacgatttttatagttatggactacttgaaaccactactgagggtaatttactagctgtggcctcccactaactagcattcctttaaagagactgggaaatgttttaagcaaatctagttttgtataataaaataagaaaatagcaataaacttcttttcagcaa

SEQ ID NO: 43172 - DNA, 1092 bp, Homo sapiens
  misc_feature (54)..(54): n is a, c, g, or t
  misc_feature (57)..(57): n is a, c, g, or t
  misc_feature (62)..(62): n is a, c, g, or t
ccgcccctcacccaggcccaggcccaggccccgcccccacaagccgggctcacncgnctggnagaccccgccaagcgcctcggagcgcgcaggatgcgctgggcggccgccaccctccgtggcaaggcgaggccccgggggcgggccggggtcaccacgcctgccccagggaaccgcacaggcacgtgcgctaagctgcggctacccccgcaagcaaccttccaagtccttcgtggcaatggtgcttccgtggggaccgtgctcatgttccgctgcccctccaaccaccagatggtggggtctgggctcctcacctgcacctggaaggggagcatcgctgagtggtcttcagggtccccagtgtgcaaactggtgccaccacacgagacctttggcttcaaggtggccgtgatcgcctccattgtgagctgtgccatcatcctgctcatgtccatggccttcctcacctgctgcctcctcaagtgcgtgaagaagagcaagcggcggcgctccaacaggtcagcccagctgtggtcccagctgaaagatgaggacttggagacggtgcaggccgcataccttggcctcaagcacttcaacaaacccgtgagcgggcccagccaggcgcacgacaaccacagcttcaccacagaccatggtgagagcaccagcaagctggccagtgtgacccgcagcgtggacaaggaccctgggatccccagagctctaagcctcagtggctcctccagctcaccccaagcccaggtgatggtgcacatggcaaaccccagacagcccctgcctgcctctgggctggccacaggaatgccacaacagcccgcagcatatgccctagggtgaccacgcagtgaggctggtgcccatgctccacactgggaggccaggctgaccccaccagccaggcgcctgccacaacgtctggagacggagtttctccattttggccagtttggtgtcgacctcccgggcttaagcgatccacccacctcagcctcccaaagtgttgggattacaggcgtgagccactgtatccagcttgtgatatacttttaataaatttctcttaaactt

SEQ ID NO: 43173 - DNA, 1017 bp, Homo sapiens
  misc_feature (54)..(54): n is a, c, g, or t
  misc_feature (57)..(57): n is a, c, g, or t
  misc_feature (62)..(62): n is a, c, g, or t
ccgcccctcacccaggcccaggcccaggccccgcccccacaagccgggctcacncgnctggnagaccccgccaagcgcctcggagcgcgcaggatgcgctgggcggccgccaccctccgtggcaaggcgaggccccgggggcgggccggggtcaccacgcctgccccagggaaccgcacaggcacgtgcgctaagctgcggctacccccgcaagcaaccttccaagtccttcgtggcaatggtgcttccgtggggaccgtgctcatgttccgctgcccctccaaccaccagatggtggggtctgggctcctcacctgcacctggaaggggagcatcgctgagtggtcttcagggtccccagtgtgcaaactggtgccaccacacgagacctttggcttcaaggtggccgtgatcgcctccattgtgagctgtgccatcatcctgctcatgtccatggccttcctcacctgctgcctcctcaagtgcgtgaagaagagcaagcggcggcgctccaacaggtcagcccagctgtggtcccagctgaaagatgaggacttggagacggtgcaggccgcataccttggcctcaagcacttcaacaaacccgtgagcgggcccagccaggcgcacgacaaccacagcttcaccacagaccatggtgagagcaccagcaagctggccagtgtgacccgcagcgtggacaaggaccctgggatccccagagctctaagcctcagtggctcctccagctcaccccaagcccaggtgatggtgcacatggcaaaccccagacagcccctgcctgcctctgggctggccacaggaatgccacaacagcccgcagcatatgccctagggtgaccacgcagtgaggctggtgcccatgctccacactgggaggccaggctgaccccaccagccagtcagctacaactccacatcaactccacatgcgcccagctcgagactgatgagtggaatcagcttccacccttcggtcgaaagatcctctaagtc

SEQ ID NO: 43174 - DNA, 776 bp, Homo sapiens
tacaggcatgagccacctgcccggccacctcaattttttttctgagtttcatgttacacagaacataccttttggtttgggagctagctacagggaagcacaggcttctctagagtggaatgtacaattcttatcaaggcaaaaagttaaagactacttgctttttaaaattagggagaatgaaaaatatccagcacttttccccagcccagttccctaatatctccttcctctccgggggcagagctgcagagctgtcattccttgctgtggcttcttgccctccctgggtgtgaaggtaatgaaacaagtgtgttgaagctgccagatcttctgccttggtaacttaggtgttcaggttccaaatctaaaaatgaaaggagaatctacacagatatatagtggaatcaaattctctttctgtctcatgaacaccatgagactctttggctttggcccttttattctacacagcaagaaaacccagaggaatggttagcaagcttgccatcaactatagtacaatacaacttgcatgttctacgattccttagtaaacaggactaagaatctcagaaattaatagagcacaaccaaggcagcagtagattaggactcagaaatgcgtcttcatctcccccatgtttttaaggtaaaaatattcagaggccaggtgtggtggtttgcatctgtagttccggctactcgggaggctgaggcaagaggattgcttgagtccaggagttccagaccagcctgggcaacataacaagacc

SEQ ID NO: 43175 - DNA, 349 bp, Homo sapiens
gtgattggtggggtttccagaaagactcacccagaaggtgctcctctttgggagttttggttcttcctcccttatgctgcctagaacacagatggaatggctgtattacagcagccatgttgtgacactgagatgactttgagaatggaagccaaggactaaaaatggtggaaaagaaagaagcagcctggggtgcctgacaatttgaaactactaagttatccctgtacctcccagctccagattcattttataagaaaaaaaccaacttctatcttaagtaagtgactgtgatttgagactgaagatattgtgagaaagactcttcaagccatttccaaatatgtcc

SEQ ID NO: 43176 - DNA, 575 bp, Homo sapiens
attccttcaaagatttgtgcaataagtatatatatatatatatatatatatatatatatatatatatctccccaaaacaaacctcagttagttttgctggtttttaagcttcctgtatagcaaattcctactgcatgtattttcccatgatgcacattatgtgtaggagttatctgtggtgtgggaggctgtcattcattcatttttactgctgaaggcttacatatcgttttaccacaatttcaccagtttcctattgatgtacatgtggccgattccagtttttgccataaatattagtgtgcatgtctcctgtgcacataggcaagaaagccccaaagcccccagagtggatgattaggaatgggttggttgcatgatacattgtatggactttaaccatactagataatgataatatgatttccaaagtaattgtggctacttaaacttttacaataaatgtgtaatacttgatgttgatgatgtgttctgaaaacactgagttgaaggaattgtgttaaaagtcaccgtcttggtggtagaattatagcaagcatttttattctgttaaa

SEQ ID NO: 43177 - DNA, 853 bp, Homo sapiens
tcgagacggagtcttgctctgttgcccaggctggagttcagccgagatcgtgccactgcaatccagcctgggcagcagaacgagactccatctcaaataaataaataaataaaatgaatttcagctagaagagccttattccattttcctttttattaaacatctggcataagttggtaagtatgtgaagtttatcatatattcttatgcgaattattattttcgccttttttttataattctgtctgggatttgaatagtagagtttgaattcaggaaggacacctgtgataggacaataaaatctagagctggacgtggccctcctgctacctgtcgacacaggtaaatttcctagaatctgttccctttatagatccatgttgaaattcacttatagcctcacttgcatgagatttgccaggcagaagtgaagaagacattagtcaggtattggaaccccaccatacagggagacagcctgcttcctgctcattttcctggttattttctctgccaatcaaaagtatcctgaaaacaccctgagctgcttgacttccattctcaaagagatgtgttggtttccacagttgtctccacaagctccgcatcaaagatccacgtacagtttggattttccttctagccttcatgtgtggcccaagcatctatttcagactgtcatggttggcattgttctctgaggttctgtcttccctttgtgtttctatgagctttaatttgtatggttcttgttctgttaatgccactagggactatgtattcctgattccaccatgacagctacagtaaaacagtaaaaaaaaaaaaacaactatatgggagtttgttc

SEQ ID NO: 43178 - DNA, 1804 bp, Homo sapiens
gtgtacagtaacatcctgggccttcgcattcactcaccactcaactgactcacccagagcaacttctagtcctgcaagctatgttcatggagtgtcctatgcaggtgcatccttttttatcttttatactgcatgtttactctgtgtattttctgtgtttagactcataaatacttaacattttgttacaatttcctacagtgttcagtacaacaacatgttgtatggtttatagcctagtagcaatagactgtaccatatagtctagatgtgttgtagctataccatctagatttgtgtaagttcactttgtgatgtttgtaccatgaggaaatcacctacaacacgtttctcagaacatatacccatgattaagcaatctctgcctgtaaaatgctccagaaaattcacaccatgatataaattcatcacacacgatataaaagttaaggcaaggcatggtggctcatgcctgtaatcccagcactttgggaggccaaggcaggcagatcacctgaggtcaggagttcgagaccagcctggccaagacggtgaaaccccatctctactaaaaatacaaaaattacctgagcgtggtggcatgcacctgtaattccagctacttgggaggctgaggcaggagaaatgcttgaacctggaagtcagaggttgcagtgagccaagatcacaccactgcactccagcctggacaacagaacgagactccatatcaaaaaaattaaattaaaatataataaatttcttgccgggcgcagtggctcacacctgtaatcccagcactttgggaggccgaggtgggcggatcacgaagtcaggagattgagaccatcctggctaatacagtgaaaccccgtctctactataaatacaaaaaattagctgggcatggtggcgggcgtctgtagtcccagctactcaggagtctgaggcaggagaatggtgtgaacccgggaggcggagcttgcagtgagccgagatcgtgccactgcaatccagcctgggcagcagaacgagactccatctcaaataaataaataaataaaatgaatttcagctagaagagccttattccattttcctttttattaaacatctggcataagttggtaagtatgtgaagtttatcatatattcttatgcgaattattattttcgccttttttttataattctgtctgggatttgaatagtagagtttgaattcaggaaggacacctgtgataggacaataaaatctagagctggacgtggccctcctgctacctgtcgacacaggtaaatttcctagaatctgttccctttatagatccatgttgaaattcacttatagcctcacttgcatgagatttgccaggcagaagtgaagaagacattagtcaggtattggaaccccaccatacagggagacagcctgcttcctgctcattttcctggttattttctctgccaatcaaaagtatcctgaaaacaccctgagctgcttgacttccattctcaaagagatgtgttggtttccacagttgtctccacaagctccgcatcaaagatccacgtacagtttggattttccttctagccttcatgtgtggcccaagcatctatttcagactgtcatggttggcattgttctctgaggttctgtcttccctttgtgtttctatgagctttaatttgtatggttcttgttctgttaatgccactagggactatgtattcctgattccaccatgacagctacagtaaaacagtaaaaaaaaaaaaacaactatatgggagtttgttc

SEQ ID NO: 43179 - DNA, 843 bp, Homo sapiens
ttgagacggagctgctcgctctgtcacccaggcgagatcgtgccactgcaatccagcctgggcagcagaacgagactccatctcaaataaataaataaataaaatgaatttcagctagaagagccttattccattttcctttttattaaacatctggcataagttggtaagtatgtgaagtttatcatatattcttatgcgaattattattttcgccttttttttataattctgtctgggatttgaatagtagagtttgaattcaggaaggacacctgtgataggacaataaaatctagagctggacgtggccctcctgctacctgtcgacacaggtaaatttcctagaatctgttccctttatagatccatgttgaaattcacttatagcctcacttgcatgagatttgccaggcagaagtgaagaagacattagtcaggtattggaaccccaccatacagggagacagcctgcttcctgctcattttcctggttattttctctgccaatcaaaagtatcctgaaaacaccctgagctgcttgacttccattctcaaagagatgtgttggtttccacagttgtctccacaagctccgcatcaaagatccacgtacagtttggattttccttctagccttcatgtgtggcccaagcatctatttcagactgtcatggttggcattgttctctgaggttctgtcttccctttgtgtttctatgagctttaatttgtatggttcttgttctgttaatgccactagggactatgtattcctgattccaccatgacagctacagtaaaacagtaaaaaaaaaaaaacaactatatgggagtttgttc

SEQ ID NO: 43180 - DNA, 1748 bp, Homo sapiens
gtgtacagtaacatcctgggccttcgcattcactcaccactcaactgactcacccagagcaacttctagtcctgcaagctatgttcatggagtgtcctatgcaggtgcatccttttttatcttttatactgcatgtttactctgtgtattttctgtgtttagactcataaatacttaacattttgttacaatttcctacagtgttcagtacaacaacatgttgtatggtttatagcctagtagcaatagactgtaccatatagtctagatgtgttgtagctataccatctagatttgtgtaagttcactttgtgatgtttgtaccatgaggaaatcacctacaacacgtttctcagaacatatacccatgattaagcaatctctgcctgtaaaatgctccagaaaattcacaccatgatataaattcatcacacacgatataaaagttaaggcaaggcatggtggctcatgcctgtaatcccagcactttgggaggccaaggcaggcagatcacctgaggtcaggagttcgagaccagcctggccaagacggtgaaaccccatctctactaaaaatacaaaaattacctgagcgtggtggcatgcacctgtaattccagctacttgggaggctgaggcaggagaaatgcttgaacctggaagtcagaggttgcagtgagccaagatcacaccactgcactccagcctggacaacagaacgagactccatatcaaaaaaattaaattaaaatataataaatttcttgccgggcgcagtggctcacacctgtaatcccagcactttgggaggccgaggtgggcggatcacgaagtcaggagattgagaccatcctggctaatacagtgaaaccccgtctctactataaatacaaaaaattagctgggcatggtggcgggcgtctgtagtcccagctactcaggagtctgaggcaggagaatggtgtgaacccgggaggcggagcttgcagtgagccgagatcgtgccactgcaatccagcctgggcagcagaacgagactccatctcaaataaataaataaataaaatgaatttcagctagaagagccttattccattttcctttttattaaacatctggcataagttggtaagtatgtgaagtttatcatatattcttatgcgaattattattttcgccttttttttataattctgtctgggatttgaatagtagagtttgaattcaggaaggacacctgtgataggacaataaaatctgttccctttatagatccatgttgaaattcacttatagcctcacttgcatgagatttgccaggcagaagtgaagaagacattagtcaggtattggaaccccaccatacagggagacagcctgcttcctgctcattttcctggttattttctctgccaatcaaaagtatcctgaaaacaccctgagctgcttgacttccattctcaaagagatgtgttggtttccacagttgtctccacaagctccgcatcaaagatccacgtacagtttggattttccttctagccttcatgtgtggcccaagcatctatttcagactgtcatggttggcattgttctctgaggttctgtcttccctttgtgtttctatgagctttaatttgtatggttcttgttctgttaatgccactagggactatgtattcctgattccaccatgacagctacagtaaaacagtaaaaaaaaaaaaacaactatatgggagtttgttc

SEQ ID NO: 43181 - DNA, 2033 bp, Homo sapiens
  misc_feature (1275)..(1275): n is a, c, g, or t
ttttacttcatgccaacatgagaaaagacaaatcacatttctttaggaaggaatcctaagtgcctagcaatttggacaggataaatggagtttgggagaagagttttgaagccaattgttacctaaaattgataaactcaataaacaagagggttgtgctagcccacagagatcttatggggattgactgagattataaattcatgagaaagtgatttttaacccacaaaaggctatacatatattagtatgttaggtacattcattacagttagcatacactaatcctgtctttaatttacaacttggccttctccattcaagaatttcttttttttctttttttttttttgctataatactattctttctttaaccagtagtttattgagaaaaactttaacatgtccaattttaaaaatattaaatactatggtaatgtgtcctagaatgtcctgtttgtcatctgtttctgtttactacctgctcagttccaacaggtatttaaatcagctagaacactgataaagcctattgcagctttctgagttacctgtagtgagtcaggacaggtagcagagagggaaggaataaatgtcacaaaaaatgactcattcaaaaccaattttggttttagctgcaggcagtgacataaatgcacagttgcttactactccagatttctgtttccttcttttaactctgaagttgatggcttatagtctatagcaaaaacaaaacaaaacaacaaaaaaactatgctgaacataaaacttatagtgggtaagtaaaacttaactataaagaaaataactttagaatagaggaatgttctagttagcttcaaatgcaagaatcagaaaaccccacattccagaagctcatacaagtagctttgtaatcactagggactcacgttccttctgtcttgacattttgccatttttagcatttgcttgcacctcttagtgtgagacttttgcttcagttccagctatccaatccctattccaaccagcagaaaggaggcacgagaaagaaacctccctgtcctttaagttacacatcccatccattgacatctgagtcatttcacagtttattcaatatttgctgagcatctgctatgtgcaagcactgttctaagccctaggcagttatctaagccctgttcttagtgaacagaaaggactctatgaacaaaaatcctcctgttggtggagcttatattttactagatgtgagaacaagtgtgggggaaggggcccactggcnagggttttaagccacatggtcatacttagcttcaagaccaagcagggaaatatagcctttagctgcattctgggaatccagttctaaggaaggaaaggaaagaatggatattgggggcaattggcagtctctgacaacatgaataaagtgtgaagaaaaataggtcaactggtatgttatgtcacttagcagtaaaaaacaactttgcaattacacctctagtctattcctaacagacatgtatgtgtatgcatgtatgtttagtgcatatctgagttcatttctgggtaccatggttggtagactgtgaggaggcatgtagtgagtgaacaagttgaggtattcctgaaaatctctttgtgctggggatagctgacctataaggggtattaggtccagagaagtccaagaagacagatgcttcttttaactgttaaggaagtgactgtaagaagaaaactgggcttgattcatgctgcctcagatgactgtgctagagttggtaggcaaaatttgagaggaggaagatttttcttttagtgcaaaagaactctgtagcagcaggaacactctcacctgttttgcatgctgcagaggaaattttcatcccaagtgaaaggcaaaggcaatctccaagaccctcctgtatgtaattccactaaataaatgccctgtcacgtagatgaagcttaggaaatgctgggctctttttcgttccttcccttgagggacttaatttgaatgcagaaactctgcca

SEQ ID NO: 43182 - DNA, 448 bp, Homo sapiens
cagaaattcctggaaaacccatgtggttttctttatgagcaatttaaggacacgttcttccaaagagagagatggacaatataaaacataatccacttttaaaaataaattctactctgtgaaaaagttccccctgagtggtgctcagtaaaccctttggtatcagtagtttgtcagctctagcacaattggagcttgtgtgggaagccatttcactcagtggtggttgctctgccaccaccaagaagccagagaacatgggctgtaactgaggagaaggataaccatgagagaagtaataagcagaccttagaaaatctttgaaatggtcctaggtaagatctcttatcctggaatcagattccccttcctccttatcattttgttggaggaacatttgagaaagaaatggattttcagttgactaggaaaatgtaaattgataaaa

SEQ ID NO: 43183 - DNA, 847 bp, Homo sapiens
gtactttatgttgtatcttttagcctaacctttaaatattggattcctaaggtcccttttatcattctgtattctcccttaagaaggtttttatcctctctcattcactgggttatctatttggtgtcacccccaggtaatatctagctcacactttcttcctgagttcaatacctcaaagtatgtttgtatacatgacttacctcatgtgggtgcttcataggtactggaaactcacatttgaaatagaagttatcttcctctcctctaaaatgtcttttaacactgcttctgacttccctgacctcagtatataacattgccattcatctgcctggtccctcaagtgaaaaaacacaaaaaccatcgtatgctcttcctttccctttgttcccctcccctcacatattataagcccctagttcctgctattattaatgtcattaagttctcctaaattcagccatgacccttcccttctgtctcttagctcaaggcttcttccggaacctcatagctgattgtcttcttttgggcattgcttttctcaagtcattttgtacactgcaactagagtgaactttttataaaaggcagcctgatcatctgtcctacttgaaagccccagtagcttcccatttgctcttgggatgaagtcctagtgaagggttatatgctcatctttagttcctctaaacagcttccctgaccctctgcatcttctctgatagatttggtgtgcctttttataagctcctttgtgcttcattacgtactggcatagttggttaaaagctttggttctgaagccagacagctaggtttaaatcctgactgctatttacta

SEQ ID NO: 43184 - DNA, 581 bp, Homo sapiens
tggtctcttggttctctgaggttattctgtgacatgggttcacttttattcttataaccaaatatcatctttaacacatcactagacaagacttgagatagtggtgttttaaccagagaatggttgctttctctttaagttcctaagtttccctaaagtagaagatactaaaggagtttcttttgtcataaatatacgtgatataaaatttaccattttattcacatttaagtgtgtagtttcagatgcattgcatacattcaaattgctgtgtaaccattgccactattcatctccaggacgctttcaacattccaaactgaaactctgttccattatgcaataattccctgttcccccctccttctggcgcctggtaaccacccattctattttctgcctctatgaagttgactattccaggtacctcatataaatagaatcatgctatatttgtgtttctgtgtctggcttatttcatacagtataatgtcttcagagtttaggttgtagcatgaatcagaatttttttcctttttattttattttattttattttttatttttgagacggagtctcg

SEQ ID NO: 43185 - DNA, 344 bp, Homo sapiens
tctgccctttaactgctgggctggtggaacatacttggatggggctgttccttgtttcctctttagtctcctgcctcattcaaggcaaccttcctgtgtctttgcttttttagggctgcctttggtgttacctattgcttctctgaaggttactccatgaattctgatatgtctgtaaaaaaaaaaaaaatccaaatgactttataaaaattgccgtcaataggtaatgtagtaatagtagtagttttgttttggataattgtttttgaaaaagagataatcaggtggggtgcagtgggtcacatctgtaatcctagcactttgggaggccgaggcaggtggat

SEQ ID NO: 43186 - DNA, 471 bp, Homo sapiens
aacatgatgaatccccgtctctactaaaaatactaacattagccgagcgtggtggtgcatgcctgtaatcccagctactcgggaggctgaggcaggagaatcactggaacctgggagatggaggctgcagtgagctgagatcacgccactgcacttcggcctgggcgacagagtgagactccatctcaaaaaaaaagagagaataactcagttttcgaaggaaccacagactcacatgtgaaaataaagagagtaaggcagaacccctgcctcacatcctgcatggtttggtactgcttagctttcataaggggcgtgcctttcctccgaaataatattgttcaggccagacatggtggctcacacctgtaaacccagcacttcgggaggccaaggaaggaggatcacttgaggccaagagttcaagaccagcctgggcaactgagcaagaccccatttctacaaaagtga

SEQ ID NO: 43187 - DNA, 262 bp, Homo sapiens
ggacatacaacctacacatgggaaaacattgttacaactaaagacacaaccacatgtacatgtgcaagtaaaactgtggacatctcagaaaagatcagagaattgcatcagtgtccatatcctgattgtggtagtgtactattattttgtaagatgtcattattgggagaaactgggtagagagtccatgagatctctttgtattatttcttacaaatacatgtacacctctaatcatctcaataaaaactttcagttcaag

SEQ ID NO: 43188 - DNA, 390 bp, Homo sapiens
caggctcgcctggtcatgtgtcctttactctcctctgagtctccctctttccaagccgcctgcactctacttgacacactctcccttaagacaccagagtacacaagcgcaagtccctgcacctcacctttactcccagacatgggagggagatgacatgaagacccaaacgccacttagcaggagatctggggtatgcagaggggcagatcggaggctgtggaagctccaggggctccctgcaggaggccgcatgtaagctggctattgaatgtggctctgagctgagacctctccttgaagctccagaccaggagccagctgctagctggacccctccatttggtgcctcagagaaaccttgcactccatagatctgactctgaaccc

SEQ ID NO: 43189 - DNA, 309 bp, Homo sapiens
atgggcacatggagaagggctcaataatcggctgctaaacggagtaatgagtagggacactgctctattctgtagctagggaaactgaggcagaggtgcgggaactaacccaagtatcccagccttggccgacacaccccaaccctatgcttcctaccatccttttcctggtgcaaaaggacaataagggagagcaggtgggtttgtttcccccccgacctttggttcctgcccttgggtccgtgaaaagaaaaactgcactttggttccgacactggcaggcagggctggcttgttctgactatagct

SEQ ID NO: 43190 - DNA, 380 bp, Homo sapiens
ttcctgtgaaaaatgaccaagtaggactctcacgttcctggcctggaaactgctaacttctaacaagatagataagctcttcagcacctagggcaggccctggctggacatgcaggacacagccccatgtgttgctctgagggctctagcttcttttctggtcgcaatcattttaagaaattaaagcattatttacatacattaaaatgcacagaccctaattgttcgatgttttgacagttgtatacacccatataaccaccatgcaaaacaagatataggacatttccacaatcccagaaagtcccttcacgtgcttcccctcccccccactctctggctgccgttcccatgtagttttgcctgttcttgaaatttat

SEQ ID NO: 43191 - DNA, 301 bp, Homo sapiens
gccttctatggcaagtgcacaccagtaacaagtttaggcttgttggtgtgatgggctttgtagcttgaaatcagtaggtgctacttacttccttttttacacatgaggaaccaagtatattttaatattaaacctctttatagaagaaccaagcaagttggtttggctgtatcaatgcacagtttaatgtgttgattatcgtttgcctctttggcagagaagaatttttttttctctttagttcatttaagttgatttgttgaatgtttccatctatacaaaaaaagaattgctttgtata

SEQ ID NO: 43192 - DNA, 407 bp, Homo sapiens
tgtaaaaataccttgggacggattaaatgtcttggcttagagaaagaacaacagacaataggaaactgtcattgaggagaagccgggattcaggagatgtacattattcaggtagctgagggaggggacaggaacctgaatcttcaacagaagcaaacaaactgggatggagggcccagcctcatgaaggtgaccagaaggacccggtgctgcaggctgtgtgggtagctgagcagagctaagcggcttgacggaccaacatctctccagctggttgaagacaagctctcagaagacaatgctgcatgtcacagccccagcaaccaacaacaccagcctgacaacttgctggggtggccgccttgtggtctgaggtggccgtctaaactatgtggtctgatctcagg

SEQ ID NO: 43193 - DNA, 391 bp, Homo sapiens
gaaaatgttttgcaaaaattgagttttttgttttgttttgttttttgagacagtctcgctctgtcacccaggctggaatgcgctagtgtgatttcactgcaacctttgcttcccaggctaaagcgatcctcccacctcagcctcctgagtagctgggattacaggcatgtgccactgtgcccagctaatttttgtatttttcgtagagatggggttgtaccatgttgccaagcctggtctcgaactcctgtgctcaagtgatctgcctgccttggccttccaaagtgctgggtaattacaggcaagagccacctcgcccagcaaaaatctagtttttaaaggcatcgttaatatactaatagtattcactattgtttgcttgttcttgtga

SEQ ID NO: 43194 - DNA, 413 bp, Homo sapiens
gagtgagaccctttttcaagaaaataaaaataaaaatgtattttccattaaaaaccagcttacattattttcaatgtttttacatttcttgctgtggagaaaagcctagtcccttctctagaattttaatcattcatctggatgccttgatatatgtggtatgatgcttagtaaaatggaatggatatttcttctatctccattagtttttctgtttgtttgtttttctttttacctgcctttatttctgttgttgttattcttcttccatccaccaagaacatgtggtcctcttatctctgggctgaggtgttttcacatgtccttttattctttcttcatctcacaaaaggtatatctaggctttttaaaggtgccaagatactatttaatgaacaatatgatatggattg

SEQ ID NO: 43195 - DNA, 267 bp, Homo sapiens
ttcttgcagagatgtcttgcctcctcaaggcccctaccaccatatttagcaaatcttgggttacttctcagcctggaaaagaccaagatgcatgcaggtcagtcccatggaatggatcatgggctgacttcaagattagaggactaaagaagcaggacctttgatcttttagggtttccagacatctctttctggcacttggaataaaacaaatttttcttatttaaaaaatattttttccaatttcaaagtaatacaatttgcttc

SEQ ID NO: 43196 - DNA, 431 bp, Homo sapiens
gggattgtttatttgctaaaagtgtggccctttcattcagcaagtctgcttctgcctactgaggaatggcctttcgacatccccatgtcaaaccctgcatattcaggcccatctttaaaatccatcctaggccaggtgaggtggctcatgcctgtaatcccagcattttgggaggccaaggcaggcggatcacctgaggtcaggagtccgagaccagcctggccaacatggtgaaactctgtctctactaaaaatacaaaaattagccgggcatggtggcgtgtgcctgtagtcccagcttcttagaaggctagacatgagcattgcttgaacccaggaggcagaggtttcagggagctgagattgtgccacggtaatccagcctgggcaacacagtgagactgtttcaaaaaagtaaataaataagtaaa

SEQ ID NO: 43197 - DNA, 139 bp, Homo sapiens
ttcactggtaagatgctcaagttcctggagacatgcaaaagctttccaagtggtcctctagaaaagcctctccttaaccttaggagagaggattctgcatctaccacattctgccttttttcactattattattattat

SEQ ID NO: 43198 - DNA, 2335 bp, Homo sapiens
  misc_feature (949)..(949): n is a, c, g, or t
tgcttgatttaaaaatttcagtcttgttaaatttatctcataggattctgacttcctcctctgttatcttgaatttcattgggcttgctcaaaacaggtattttgaattctctgaaaggtcaagtatctgtatcactctgggattgtcactggtgccttatttagtttatttggtgaggtcatgtttctcgggatggtctcgatgctttggatgtttgttgatgtccgagcattgaacggttagatatttgttgtggtcttcacagtcttggcttgtttgtacccatctttcttgagaaggctttctaggtattccaagtgtgttgtgtgttgtaatctaagtctttggttactgcagctgcatctgcattagggggcacctcaagccgagtaatgctgtgactcttggcagatgcgtggaagcactgtcttggtgatctggggtaagatccaagagaattccctgcattaccaggcagagactcttttccccttctcttgccttcctgcaaacaaatggagtctctctccatactgagctccctggatcctggggcaggggtgacacaagagcccatatggccaccaccactgggactgcactggatcagacctaaagccagggcaacactgggtcttgcctaaggcccacagtgaccactgcctggctattgctgatgttcacccaaggcccaggggctgttcagtcagcagttggtgaacccagccagacccatgtccttcccttcaaggcaataagcttttctccctgctggcccaaggtgggttcccttctggccctgggtgtgtctggaaatgtcatctgggagctagggcctggatgagtgcatcagggctctgcctggcaccctatcctactgtggctgagctggtgtacaagttgcaagacagtcttctttactcctcctcctcctctcctgtagcaganagaaggaatctctcccaaagctgcgagctgtactgcttggggttgggggaggggtggcacaagcactcccttagccaccctggctggtgtctcactaatttgtgtgcaccccaagtccactggctccaagggcagcgcagcaccagggctttcccaggagttgcactctttgtggcctagactgtctttcaagtttatttaagtttatcaagtttatttaagtgctctggcactttagccctcagtgatggggctagtttgaactcaggttctgactgctaggatgggacagtttccctctggctggggctggtctaaatgttccctccatgggcactggctgaattctgccccatgttgctttctgctgtgacaaggcagcagtgagttacaatgcaaagtctcacaattactgtgctctccctcccctaagcacacagattctctctcggtgtcacgaggctgctgctgggggacgggggtggggtggtgtaggcaattcaagactgtctttcctaccatcttcagtgcctttctccttgatacgctgttaaaaccaggcactgtgattgcttacctgatatttgttttttatgaaggggctttctcgtgtggatagctgttcaatttggcattcctgttggggggtggacagtgattgctggagggttttatttggtcgtcttgctccacctcatttcctgacatagaatttttggttggagatacttttcaactggaattttgaatgggctacttcattgattgtttatgttcattgcagctgttaagatatctgatgcctgtttatcttaatttgggtttcaccaaaagctatgcttagtagatgacgagctgagaaaaggacttgggtgcaagtaattcatttgggaattgacctcggaaattaggggcaggtaagacataaggatgagaaaagtcaataaggaaggatattattgaaaaagttactcctgtgggcaactgcactcagtcctgctgggaccctctcagagcccatgaaacacaccttagaattgtcccatgcaggatcaaggaaactgggatgtctgtctcccaattactgccctttgttgcttgagggttttacttggagaattacctccctggcactccagcccatcccatactcaggctgaacatgcttctctggccagagaagagattcaggcagagaaactcaggaacttgaggtagaaagacctcaaaccatatgagaactgtccaccaaagctgccatagaactttggcttgggctaagaagttacaaaccttatgtgcataacattagtagcaacaaaaaaaagcactgacatctcagatcagaaacaaaggtagagacattctgcagagtagttgaacacc

SEQ ID NO: 43199 - DNA, 1104 bp, Homo sapiens
aacgcacaccttactggattctccatatatatttacattaccagagaacagtggccctagggatgtttaagcactgcttataatggaaaaagtcagcttgagaagtaaacgtatatcagactacaggtaattcctcatcttgaagccatgcaacacctgcaaatctggatttatacaaaagttgctaatgtgtttcataaagatttagcatgagtaacagactcttggtgcatttaaaatatgtgagttccagaaagtagatttgcatacaccttttcaacagcacatttcactggaatggatgaggggcttctgaagaccactccactacctgaatttatttggatcactgaggaagagcatttgttgggattacagaattataggccattagacatcatgggtaggtagtcttaagatccttcaactttcaaaaaccacagtctaaggactatattcaaatgacaagagccgcactgtatactgctttctgcagtgaccatgctgggtcacgcatcctatgtttctcatttttaaatgatttggaacattttagccagcattttgatcacacagattaataatgctgttctccccaaaacgggaaactttacctgaaacgctctcctgaacaaacaccagtgcactgccagcctcacatgattgcatgggagctttaattaacgctggagcccagcaaccttggcttttcctgcctgttatctgctactgtcacaccgtgaatggtatttgaatctcacctccctctcacctcagtaagagtatgtttgtttacagccccaacctcagcaatgccaaaggctggcatcgggggcagtgccaagctgtccctggatactatttacctttgaggaagaacagcatgggtttgccaagctcaattcccaggctggtgctccttgaattaatcatggcacagtgttcatctctctggaaatgcccacgccagcccagacacagctcagagtcctttccaacacgaccctccaggcagcagttaccaaccatcagtcttcagctgaagcttcaagtctttgccatccttgtaatgacagccttaggccttgccccaagcattctgga

SEQ ID NO: 43200 - DNA, 559 bp, Homo sapiens
tttttttgactcctaggagatttgggcatgtggagaataatgggacaggagatgacggtaatgaattaaaacagaatggaatggaatggaaagcctagcgcagggcttggtttggaaggagacggtccagtattatagcaggaaaaaggaagactctcatctttgcctcggtgacaaagctatgtatgacattactcaaaatctcaaggatgcacctccaacaaaacaattcttacatggaatcctagagtctttggaacgtggtttgaacaccaccagctttgagaaggaagagaaaatccagaagtcagaagtggaccatgttgatcaggatcctacaccttccaggcttgagagctctccaaagacagatcatacttttctaagcactccgtatattggacataaagaaatgctgaaggtaatcagagattaaattaagattatttttaaaactcacaggcaagctttcaactataaacttcaaatttgtgagcttttacactttcttgagtgacttcaatttgcaaagttgtttaatctcattatacacataaaa

SEQ ID NO: 43201 - DNA, 564 bp, Homo sapiens
aattctctggatctcgtctttggataccctgggaaaaagtcttgtctcttcttaggcccttctgactaaaagcagccaggacttttaaactgactaatttttaaagatttccaaatagagaaaattaaagcaaaaatttttgaaagctgaaaatgatctttccaacttttctcattcagagtagaacactggagcattgaaagtttgttcatgtttgtgattgatcacatatttaaaaaattgtaaaataaagaccttattttaatgttaaaagttcacttcaacaccatcatttctacgaggttctaggtcttttgtgaacaaattaaatatagtgctttctttataacatgaattaaatctagatcccaatgatatttggcaccttctaaatacccagatggccactgcgtttgccttgaagtgaagacgtgtgtagagttttaatcacatgttttattttttctcttttaaatatcgccttttcaatagttgcttgttaatgaatgactgattgtttactgcagtttataatcaggaatttgaacattaaaaaattctaat

SEQ ID NO: 43202 - DNA, 433 bp, Homo sapiens
ttcattcaacaaatatttgaatatatatatatatatatattcaatatatatctctcatatattaaatatgttaatataatattcaaatatatatatatctaaatatacaaatatttttgacagggtttcctgtcacccaggctagataacaaatatatatatatgtgtatatatatgtgcgtgtatatatatatacacatatacacacacacgttaacatatatatatatacatatgtacatatatatttgttgaatgaaaatagacttggaatagggagaaatcttgagtgtgactggagaaaggaaagggaaaaaaatacctttgtaaaggggaaaggaagagagaaagagaatttgggcagctggtagagggaaaagggtatttgcgggggtaaagtattttcaagaaatctttaagaatgttttgctgg

SEQ ID NO: 43203 - DNA, 268 bp, Homo sapiens
tttgtctggtttgtttccagttttataccgtgtgcagttgcagctgctgtgtatttatttgtacatattagcttttttctttgaaattattttcttgtagtgtattcccaaaagtgggattattgggccaaacagttccatagctcttgttacattattgtctgatctttctcaacaaagaaagaaagaaaggaacaccataagaagccatcacatatgggcatgcttatttcctgaaagtcctgccagtattgtgctttattcttta

SEQ ID NO: 43204 - DNA, 388 bp, Homo sapiens
tggaaggcaggagctgtgcatacttcttcccaaaggagtgcaaaattttttcttttcttttctttcttttcttactttctttttttctcttttttgagatggagcaagaccccgtctcaaaaaataaacaaataaataaaataatggacctctagctgggccctctccaggtgccctggcttcatacccggagtctctggcagacagacatgactcttccatggagaaaccaagagaataataactggccccgagtttatccagtcagtaagccgactgccagagacagtcctcgttctgaagggaagtaaagaggaatgcagaaaggaatgaattctgctcacttgtgaaccctcctaactcttcacaaaaaattgcttacaacttc

SEQ ID NO: 43205 - DNA, 415 bp, Homo sapiens
agatggggttttagcatgttggccaggctggtctcgaactcctgatctcaagtgatctgcctgcctcggcctcccaaagtgctgggattacaggcgtgagccaccgtgaccggcctgatctggatttcttgataacttgttgccaagcctggtggtgggtgctcagcatttcctaccagcccattcacagaagagcaaactgaggcctggggaaagggtcttctgtgctgagggctgccctgagggtcagagggaaggccaggcctgagcgtaggtccgcgtgaccctggagaggccccttgcctgaagcctcagtcacctgtgacatggtagaggctgggaggtggagtgtggtcacacagttggcggagcggggacgtcccctgtggtgtcaggggacgtctgtacagagggc

SEQ ID NO: 43206 - DNA, 708 bp, Homo sapiens
tttcacatgaaaatagatgtcttcccaattcccttggccttcacttggtattaacaaaatttacaatggcactgggacctaatgctttattaaagtctatctacatcagggaaaatagggctggtcacactccaagtcatgtgaaacacctcccaagacaatgtggattcatttaacacccttacttggtgcttataagtgcctccccaaaatcattcatcagtgctctcatatgtagagcttgaaaacagtagagtggctatacctttgtattttcctagacggagagtccctagggctgattatttactgtcatcctttctttctctccttaatggtgttcctaggtcaaaggggcaaacaaaggctgtttttgaatcattgcaggtataaaaccagaaattcacattttacgagacatttgattttaaagaaacaagctggtaataaccatgaggaatacttgacacagaagggaggccttcccacaagacagctcaatgccacctcgaggtctcagagctggcagaggttccagagtcactgcatcttacaatccaccaagatgctggtaatgagaccaacaccaactggaaggcatggtggtaaatgagctgactgagaaagcaaaaaggatactgatgataccatgcaaatgagttgctgacagctggtttctaagttacacgtgaaaactatttcagagat

SEQ ID NO: 43207 - DNA, 307 bp, Homo sapiens
gctaagttctggggtagttcgttacatggcagcgggtaactaacacaaggagctttagactttatgataatactggggtgggaggcctcaggttgaccagtaggcagaccctccttgctgtgtctctgcattctcgcccttgccctataccagggagaggaagtttcttcctgaacctagctggaagtggggtctttgtgtcctacctcagggcctacgatagatgggtggttaatattaaaagaaaaaaagttttgctataggtttaatgagctttaggtaatgagctacagaaccagaagaggca

SEQ ID NO: 43208 - DNA, 392 bp, Homo sapiens
aatgcagaaggcctttcagaagttctcactggcctgcaaggtagaggctgttttctgctgaggatacatttgccccctctatcccccagatcggcggctgctcaaggagcctggtacagctgcacggaggcgcagcacccacaggacaagtggtggaatgttctggttgtccttggtgcaggtggcgggcggggctggggggctctgtagccttcctggcttcggtcccctggacaggctccacctccctcttatcgtggcccctttggcaggctgcctgccacctcaaagtcacgctgccctgggcaccctgcctcttccggggactggggctggggctggggcagctgtgtttatgggtgtactccctgtgctgggcactgcgctgagct

SEQ ID NO: 43209 - DNA, 409 bp, Homo sapiens
acaggcatttgctgaaggtaaactaacagtcaggctgcagtaatattaaaaatcttggccaggcactgtggctcacacctgtagttccagcactttgggaggctgaggcaggcggattgcttgagcctagaagtttgagaccagcctggccaaaatggtgaaaccctgtctctactaaaaataaagaaattggtgggacatggtggtacaggcctgtagtgccagttacttgggaggctgaggtgggaggatcactggatcctgggagatggacgttgcagtaagctatgattgtgccactgcgctctatgtagcctgggtgacatagtgagattttgtcttaaattttttttaatctttgtattaatcatgtgttcatactaaggggcattatttgagagtcttattt

SEQ ID NO: 43210 - DNA, 577 bp, Homo sapiens
agaggctttgctaattcattgcaaccacatacttggcactaactttaaaaaaaataaaaatagagatggaggttttgctatgttgctcagagtggtctcaactcctggcttcaactgatcctctgccttgcccccacaaagtgctgggattacaggtgtgagcaccgtgcctggttgacacgacttttaaggagtatttccttgatagagataaagggaatgaaatctttagtcaaattttcataagacttagcctaaaactatttggaagatcttagagtcttatcaacttagggaggacttgggcttggggccattttctttttgaaatctccactcttctatactgataagaattttgctgagtgagaatcacaactgcctttcagaatggtgccagaattttgaatttcagacatggttaaatattaaagtaatttctataggtttgctaatgtaaaaattttgttagtaggcatattaaaaagaaacagaaaccaaccagtatgctatatactgtcaccagattacttcataaaagaaataacattttaacactgaaaggagaaaagactta

SEQ ID NO: 43211 - DNA, 477 bp, Homo sapiens
aaacatttgaattagaacagcttgttctgagtgacagtctaatatacgtaggagaaattttagaaaggaaagagatttagggattaaaatttttgcatcagggcaagctagtttttgaaggcattaaggggtggaattatcagaaggaaagaggaaagtaattagaacgaaagaaatgttagagctggaacaggttgccctcctgttggcaggtgtccacctgcagaaccagtctcacctttctttgctacaaaggggagtcagtcctacatgactataaggttgctggccacgaggcactgttttgctctttatcctttttttctaattcctgatctggcctatattaccatcttacatcactctagctctgaaatgtttggcatgcctactttattttcttctaatctctgtaccctccctgaggtcatccatgattttcagctaagaggacaattttgcagctatttctataaa

SEQ ID NO: 43212 - DNA, 390 bp, Homo sapiens
aaatacagtatgcgtaagaatgacctcagcaacttcaggacagtgactatttctgggtaagggagaatgaaaaggaacttgaacttgagttacatataacatcttttttctttcttttaaagatatttaaagcaaacaagacaaaacatgaacatatgttaaatctgggtagcagagtggggtagtagacttgtatttttgtaatccatccctctcttcctttaaaaagaagtatcatggtgttaaagccaagacattacatctccatggaccagcaatggaacagaaacacagaagttattgatggggccaaagcagcagaactactgaactctggggataggaaacagagaaatatttgggaaatggactcatatgagagtaatgggg

SEQ ID NO: 43213 - DNA, 939 bp, Homo sapiens
aggtgtgagccaccatgcctggcctggtttttctttctattctacttgtgcaagctgggaaatcgtaagaaaacgtatgtaatccatcaacaaggacactgttgggactgagtaagggataaagcaagattcacaacatgaaaagaggaatatagcctgtacacagtatcttcccatatcccagtttgtacaaaagtcaatagagaaaaagctttcaaaattggccctctttaatgcaaccttttgtctcttatacaagcttttccccctttattttcattcccactgacacctccatagcctagtctccctgcctccaaccatagtaaatactacagacctcaattttgccaaataaatcttcacaaaataccatttaatcctatcagccaataggtctcaaggttattcaaaataagaggcttgactcttctcaaattttcaaaacttttgcctattaccaggctcacacaaatcctctaaaattaaactccaccccctgaagtccattcctgcctctgcaccttggcatattctgaataactaactaacttccctccttctatctgccttaataattattctacatacctctcattcagtactagactgctttgaggtattgtttgaactgttttatttatttatttatttatgtatttatttttgagacacggtcacactctgttgcccagactagagtgcagtgacatatcagtgacatgatatcagtgcagcgacatgagctcactgcagtctcaacctcctgggcttaagcgacccttgcacttcagctgggacaataggcgcacaccaccatcatgcctggctgatttttatgaggcttttttgtagagacagtgtttcaccatgctgccgaggctggttaaatctttacgtgggtaagaactttcttctcagagggcagaaaacatgggt

SEQ ID NO: 43214 - DNA, 541 bp, Homo sapiens
aaataactcaaacttgtgctgtctgtaaaacttcttcaaataaatacattaaaatattgcatcagtgcctagaaaaatatcaaagtgaataaatctgttggcaccaactagattagtgattacgtgtaatactagaaaagatgccacatgcttgacatgtgccctacacatacaatggttgaacaatgtagccctaccagagcaataaagctgtgtgtaatggggaaatatttcatactgcatcaatttcaaaatttaaatataattaaaatgaaacaaaatttaaaatttagtttctcagtctctctagccactttcagttgctcagaaacatgcagctggtggcaccatattggggtatagagacagtctgtcaaaagacagggtgaggagccaggcgaggtggctcatgcctgtagcaacagctacttgggaggctgaggtggagaatcactggaccctaaaagctggaggctgcactgagctatgatagtgccactgcactctagcctgggtgacagagtgagaccccgtctagggg

SEQ ID NO: 43215 - DNA, 463 bp, Homo sapiens
ggtttttgattggcagaaggcttgcacggccctacatgatcttttactgtcatgcattgcaaaaatcgtaattgaaaaggcaaaaggcagtagcattattacaggaatttaaaagacatcacaggcacctgctaatcccgccaccctaacacagccactattttcactggagtaataaggtcttcacttaaaatctccccattagtgaaatgcatatgctctgaaggaaaatgaaatgtacatgcagccgagcagaaagtactcaggtcccgcgtggcccctgccccccaccaagcagcacttccctacggccctggaaaatggggattgcgtttggggaggaagctgggaggcctccagggccttccaaactgaaggatgattgaacagtggtccacgctgtcccttagccgaggctaaatgtaggattcaatctttcacagaagggttttccatgaggttg

SEQ ID NO: 43216 - DNA, 466 bp, Homo sapiens
  misc_feature (1)..(1): n is a, c, g, or t
ntttttttttcagttgcagcagtcatttattattattaatgttattattagtattatttctttttagagacagggacttgctctgtctcttaagctggagtacagtggtgcaatcatggctcactgcagtcttgaactcctgggatcaaacaattcttccagatcaccttctgaattagatgggactacaggtgccaatcaccatgcaaggttgattttgtacattttcttatatacatggggacgtctcactgcattgctcaggctgatcttgaattcctgacatcaatagtcctccaacctcagcctccaaaagtagtgggattacagtcatgagccagcatgctaggtgtatagtcactctttctacctctgcctcattttcctgcattccgtaaatccccagtcagaagacagcagggccgcctggctacggggatagcatccaagaaacaaatgttaaact

SEQ ID NO: 43217 - DNA, 1368 bp, Homo sapiens
gcacccagaagctccagaggggcccaggctgcagcctgccacacctcccaccactcagcaggctccaggcctgggggccacctaggaggacaagctgtggggaccccaaactgtgtcccagtagagggtcccggctgcaccaaagaggaagacgttcttgcatcctcagcctgtgtcagcacagacggcggcagcctccattgccacaaccccagcgggccttccgatgtgcctgcccggcagccacaccccgagcaagaagggtggccacccggcacaggagacttccccagccaggtgcccaagcaggtgctggacgtcagtcaggagctgctgcagtccggggtcgtcaccctcccagggacccgagaccgtcatggcagagcagtggtgcaggtccgcaccaggagcctgctctggaccagggaacactcgtcctgtgctgagctgacccgcctgctgctgtacttccatagcatccccaggaaagaggtccgggacctggggctggttgtcctggtggatgcacgcaggagtccagctgcccctgccgtctcccaggccctctcaggattgcagaacaacacatctcctataattcatagtatcttgctgttggtagataaagaatctgcatttaggcctgacaaggatgcaataattcagtgtgaggtcgtgagctccctgaaggccgtgcacaaatttgttgacagctgccagctgaccgcagacctcgacggctcctttccctacagccatggtgactggatctgcttccgtcagaggctggaacacttcgctgcaaactgtgaagaagccatcattttcctacagaattcattctgctccctgaacacccacagaaccccaagaacagcccaggaagtcgccgagttaattgaccagcatgagacgatgatgaagcttgtcctggaagacccactgcttgtgtctctcaggctggaggggggcaccgtcctggcgcggctgaggagagaagagcttggcacagaagacagccgggacaccctggaggccgccacaagcctgtacgaccgagtggatgaggaggtgcacaggctggtcctcacctcgaacaatcgtctccagcagctggagcacctccgggagctggcgtcactcctggaagggaatgaccaggtcagagctgcaggaggaaggcggcccggtcagcatcccctccaggccaggctggccaaggcaaccctctcaccttcacactgtgtctttagggccttgatctgatttccatttggaatgaaattatgtcaggatagggcatgccttgctgcttgtgtaaaaagaaataaattttattttttacgtgagagatactggatcagtgga

SEQ ID NO: 43218 - DNA, 894 bp, Homo sapiens
gcacccagaagctccagaggggcccaggctgcagcctgccacacctcccaccactcagcaggctccaggcctgggggccacctaggaggacaagctgtggggaccccaaactgtgtcccagtagagggtcccggctgcaccaaagaggaagacgttcttgcatcctcagcctgtgtcagcacagacggcggcagcctccattgccacaaccccagcgggccttccgatgtgcctgcccggcagccacaccccgagcaagaagggtggccacccggcacaggagacttccccagccaggtgcccaagcaggtgctggacgtcagtcaggagctgctgcagtccggggtcgtcaccctcccagggacccgagaccgtcatggcagagcagtggtgcaggtccgcaccaggagcctgctctggaccagggaacactcgtcctgtgctgagctgacccgcctgctgctgtacttccatagcatccccaggaaagaggtccgggacctggggctggttgtcctggtggatgcacgcaggagtccagctgcccctgccgtctcccaggccctctcaggattgcaggtacggcaaggttgtcatatcccttgggtgtgcagagcatcgtagggccgtgtgttgctggggctgcccacatcgtggttctggagtagccagtccacaggcttagtgtgaagattcgagatgggggcccctgtgcagagccacctccttcttggggtcttcccagtgagtccagctcttgctctctggggccaggcacagacactggggaaggtgggcttggcccatccgctggggacttggggaagcttcatgctcagggcaactgcaaacctaaaatgcaaagccagccaggcccgggtggtgggcacctgt

SEQ ID NO: 43219 - DNA, 514 bp, Homo sapiens
cattttctttctttcttcttttctttctattccctccttttccttttcttttttcttttctttccttttcttcctttttgcctaattgctctatctagaaattccaagactacgtggtatggaagtggtgaaagtgggcattcttgtcttgttcctgatcttcgaggaaaaagtttgtcttgcatcattgagtatgatttaactatggggttttcatatatggctatcatattgtggtagttttcttctatttctagtttgctgcattttttttttaatcatgaaagcgtgttgaactttttcaaaagctttttgtgcattgactaagatgatcatgtggtttttgtctgtcattcagttactgttgtgcattacacttaccgattctgggattgattttaaagcattcattcctccaaacacactcccagggttaggtctcttacctctgcatgtatttaggaaaaagacataatatgaccaacttcccaactattaaaccatgtttaggata

SEQ ID NO: 43220 - DNA, 230 bp, Homo sapiens
attgccatccctacaccagggtgccaactcccaagtgggctgacaggaagggagattggaaacagctttatagtagatttgatgctgttataagacacgttgtaagacatcaggtaaatatagcacatcagattttattaatcataagaattctttaaaagccttcagcagagccgagatcatgccactgcactccagcccgggtgacagagcaagactccatctcaaaa

SEQ ID NO: 43221 - DNA, 462 bp, Homo sapiens
gtgatcaagctagtatctgaagccagcaagtctcagaggtttacccaagacccttgatgtgttacctgggtattgctgctggcttttcagggcctaagagctcttcagttagcagatgatgaatactgccagcacttgttcctttccttcaagacagcaggctctcttctggtccagggtgtgtctgggagctagggcttggaacaggggcctcttgactctgttcagcggcctaccctgccatggctgggctagtatccaagaagtaggacaaagttctccccactctcccttctcctctcctcaagtggaaggaagtggtctcttttgaagcttcaagctgtacagtttggggctaggggaagggtgatgccagcactcccttggcttccccagctggtatctcagtatgttgtgtgctgcaccccaaatacccctacagtacactgtttctgggcctaa

SEQ ID NO: 43222 - DNA, 251 bp, Homo sapiens
tgaatatttgtattattacaagttaaatgtggattgttatataattatagaatgttaagaatggaagagctttacaaattatctagtcccaccctaaaattaatgtaaatagttagataatatttttatatgactcaaaaatgtttaaaaagatatacattgaaaaaaatctcactcccatcccatgtctttctactccattccctttccggttctctatagacagtcacttttattagtttcttatgtat

SEQ ID NO: 43223 - DNA, 357 bp, Homo sapiens
gctcacggaaggtgttccctgcacataagggcactacaatgtgaaactttttcctggaaatcaagaacaagattgtatgtgatgaccaatattatttttctcctatcggaagaaggaaagttatctgctgctcataatttcttctatgcctagaagattctgtgagaatttaaactattaaatgaatagcccagtaaaatggctgaatataagactaatatacaaaactgaagagtctttctatattagagctataatcaattaggaaaaatactaatggggaaaatcccattcacaattgtaaccaaaggataaataattaactttgtcccatacccctatttaaaaaaatttatt

SEQ ID NO: 43224 - DNA, 446 bp, Homo sapiens
acctatagatcactcacttagatcttcacagtttggtctattttaggtggtccaatgtttcatctgaatttcagtctccaccatttgcatagcatgaaagatgtactagtatgtttgcttgttatgggcttgtgcacattatctgttgtcctggtagttcaagtttatgagcgcaccctccagatggtctggaccctgagcatcttgacacacttatgaagttgatgaagagcatgtggggctggggaaggaacgtgatgcatcccttttaaccatttcttggctcctagggttcgttggccctagcagtatccagcatgtgcctgctctgtgcttaaaattttaagttataaaacatttaactgtttgctactagttccctcccaatgggttgacattatctgggatgttgtctgtaaaatattttaagctatttaaaggaaaaa

SEQ ID NO: 43225 - DNA, 529 bp, Homo sapiens
ggtcaaagggttttttttttaaaaaattgttttttgaaacagggtctcactgtcatccaggctggatggcccattgagtacccagcacaataaatgagtagtgttccatcaaagcacaacaccatgaaatttcagaacaccaggacaaagaaaaagcactataagattccagtgagggcagtgaggtacactgcctataaggtagccctgctccacaaggatcagtattaaaaaaaacaaaaaaaaaagatttcagtgaaataaaaccaggttacattcagagggctagggatcagaataactttgggcttctcaacagtacctctggaagctagaagataatagagcaaggccttcaaagtttgaaggaaacgtatttctattctagaattacgtatacctagctgaactatcaaataggaaagtagaatacattttcagacactcaagatgttaaaatgttttacctgccatgtatccttttccaggaatctacaaaggataacctccaccaaaatgaaatagttga

SEQ ID NO: 43226 - DNA, 398 bp, Homo sapiens
gatataagaaatttccttccttttacagctgcctgagttgatttaagtctcgatatgggcttccttttttctctcctccctcccatctaataacccttatcctgaatcagcacagttcttagaactggctaaagtggaagaatggccaggaacagctttcacatttataattcttacgatacacttgcgagcccctaacaaacaccgtcttccattcaagcatacttttactgtgtgctcatagtttgtatctaatatacaaatcttatgcactaatacgacatctgctacgtggtcacaaggaaagcatagaagatattctaaccactagcaagaacagatctgtaccctccacccccaaatccatcagacacaaaccttcaaacatcacccaaaag

SEQ ID NO: 43227 - DNA, 414 bp, Homo sapiens
tgtgaagggtgaagtggtttcccggggtccaggacctgttcctgaagaggagacttccagccaggaagtggagtgtgtgcagctcctcacccacgcccgcccttttacctttattgaaaatgagtggcatgttcaatgtgggtcccgtcatgaagggcttactctctttcaccaaggtgtgcacgtatcttaataaatgatttaaaacatatggaaaattatagaggataatataatgaattagcctgtacccaagacctggccacatattgatatcttccagtaacagtttcaaaattgtttaagaaagaaaactttgcaggctgggcgcagtgactcatgcctgtaatccaagcactttgggaggccgaggtgggcggatcacaaggtcaggagatcgagaccaccctggct

SEQ ID NO: 43228 - DNA, 607 bp, Homo sapiens
aaaagtaagagtgcatgtcaaaggacataggcactgacatgaaagaacccccaatgaccaaagctgcaaaattggagcaacccaattaataactatagttatttatttaacccatagaataaaatagatatatgcgaacccatactgttatagataggtagataggtagatagatagatagatagatagatagatagatagataggagtcaaggatcagctcttccttccagaagaattataattaataaatgaattatagaaggaataaaagaaattgaacaccatcatcaaaacactatgttaatggctgggcatggtggcacatgcctctaatcccagtactttgagaggctgaggtgggtgaatcactcgagcttgagagatcaagaccagcctgggcaacatagcaaaatctcatctctacctacaagaaatacacaaattatctgggtgtggtggtgcatgcctgtagtcctagctactcaggaggctgaggtgggaggactgctagagtccgggaggtcaaggttgtagtgagtggagatcacgtcactgaactccagcctagatgacagagtaagagcttatcttaaaaaaaagaaaaa

SEQ ID NO: 43229 - DNA, 339 bp, Homo sapiens
tttctctctgtataaatattttaaacatttatgagagctacaaatcatatagcttttcttgtgtatttatacccaaattcactgtggctttgcctatgaaccagcccctacaagagaaaaaattaaagggggttgcagagatttctctttgaaagataagcagaatctttagaacttacaaagtcaaaaggctatacagtttctttattcattccaaactgacctcccatcatttcaaataaataaaatgctctatttactccatgaactgactcatgtcaggctctcggcaaaggttccagtaaaactcaagactcaagggactgtgtcctcaaaagg

SEQ ID NO: 43230 - DNA, 1982 bp, Homo sapiens
gtaaagtctgagcaggacagggtggctgactggcagatccagaggttcccttggcagtccacgccaggccttcaccatggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccgccttcttcttcatcggcttttttggaagcatattcttcatcaccgtcatcagcattgataggtacctggccatcgtcctggccgccaactccatgaacaaccggaccgtgcagcatggcgtcaccatcagcctaggcgtctgggcagcagccattttggtggcagcaccccagttcatgttcacaaagcagaaagaaaatgaatgccttggtgactaccccgaggtccttcaggaaatctggcccgtgctccgcaatgtggaaacaaattttcttggcttcctactccccctgctcattatgagttattgctacttcagaatcatccagacgctgttttcctgcaagaaccacaagaaagccaaagccattaaactgatccttctggtggtcatcgtgtttttcctcttctggacaccctacaacgttatgattttcctggagacgcttaagctctatgacttctttcccagttgtgacatgaggaaggatctgaggctggccctcagtgtgactgagacggttgcatttagccattgttgcctgaatcctctcatctatgcatttgctggggagaagttcagaagatacctttaccacctgtatgggaaatgcctggctgtcctgtgtgggcgctcagtccacgttgatttctcctcatctgaatcacaaaggagcaggcatggaagtgttctgagcagcaattttacttaccacacgagtgatggagatgcattgctccttctctgaagggaatcccaaagccttgtgtctacagagaacctggagttcctgaacctgatgctgactagtgaggaaagatttttgttgttatttcttacaggcacaaaatgatggacccaatgcacacaaaacaaccctagagtgttgttgagaattgtgctcaaaatttgaagaatgaacaaattgaactctttgaatgacaaagagtagacatttctcttactgcaaatgtcatcagaactttttggtttgcagatgacaaaaattcaactcagactagtttagttaaatgagggtggtgaatattgttcatattgtggcacaagcaaaaagggtgtctgagccctcaaagtgaggggaaaccagggcctgagccaagctagaattccctctctctgactctcaaatcttttagtcattatagatcccccagactttacatgacacagctttatcaccagagagggactgacacccatgtttctctggccccaagggcaaaattcccagggaagtgctctgataggccaagtttgtatcaggtgcccatccctggaaggtgctgttatccatggggaagggatatataagatggaagcttccagtccaatctcatggagaagcagaaatacatatttccaagaagttggatgggtgggtactattctgattacacaaaacaaatgccacacatcacccttaccatgtgcctgatccagcttctcccctgattacaccagcctcgtcttcattaagccctcttccatcatgtccccaaacctggcaagggcttccccactgcctactgcatcgagttcaaaactcaaatggttgggtttttcat

SEQ ID NO: 43231 - DNA, 593 bp, Homo sapiens
ggaaatactcgtctctggtaaagtctgagcaggacagggtggctgactggcagatccagaggttcccttggcagtccacgccaggtaggtgcacaggactagttgggtacctgtgggtggggtggagcagtggacagctaataggttaataatgcctgtttgcttacgtgcagacaatggaaaccattttcctggggatgttgtagcctaaatatgtccaaggggatggaagagtgggaggcaaggggtgatcagatcatttataatacactcaacctggtggaatagtattagaagcattagtaattacgttttagagacatggagaaaagctcatgattttaaactaactgaaaaaagcatgaaaaattgcatctggatgctgttgaggaattattgctaattttttgagatgagaaattgtattaaagtctttttcaaaaaagagtccttaacttttagagacgcacacaagtgtttatgggtgaaattaaataattcagtagagacattaagtgggaaatagaggaaatattgaccatgggttgctaatagttgaagccaggtgttgggtataaggaggttctcgctgc

SEQ ID NO: 43232 - DNA, 161 bp, Homo sapiens
atacctgaaggccagagattctctattattgaaccaggaaagtttgcatgcacactggataccaacatgttaaagcagcagggcatgtttggccatgaagttgaagagtttggcttacaggtgcattgtaatggaatcccttctctacttccacatggagc

SEQ ID NO: 43233 - DNA, 4171 bp, Homo sapiens
cttagactttttctagaatattattggccaagtgatttcaggttctctgtggactggtgggggaaggggtgaggagactattggtagaaactgtattatacgaaatccaattgttctttatgaaacccaaataggattcctcagaccctggcactaaagaaaaaatatataccctgagacttttccaaaaccttaaatttgaaaatcctactagcatgtgattacgatgcccccctaaaacacagtatattattatatttttaggagagtcactacttaccataaactgaaaaattttaagaattaacatagacatgaagcctcaaagtaaatcaacgtattactattcatcttggattctcaaaccccctgccctttgatgcgaaatgtaataaatacatcatattaatactttgtagttggcagggtagaagccagcttgaaaggcagatgctggccagacagctaggctcactcgctagcgaaatgactcgcatctgcgaatttaaaagtcatgatacgtcatccaccttcaggattacttgtgaatgtttgcaacactggatattaattaaatccttaaatgctggatatctattgcacatatccgaacaatttgtggtgacactaaaggaatttttgtttcttcaggtatggctatcctgatccttcttacctgaaacgtgtcaaagaggagctgaaagctaaaggaattgagtaagacaactgctggaagatgtcttaaatcaagctttcaaaaaaatatattttaggaggctgatttaatgccagtctaaatccttatgtagaaaggactttgaaatttttcttctcaagaaatggtttgtataagaataacaatctgctagtctgtcatttctggagtgatacttttttttttgagacggagtctgctctgtcgctcgcgctggagtgcagtggcatgatctcggctcactgcaagctccgcctcccaggttcatgccattctcctacctcagcctcccgagtagctgggactacaggcgcccaccaccatgcccggctaatttttgtttttgtatttttagtagagacagggtttcactgtgttagccaggatggtctcgatctcctgacctcgtgatccgcccgcctcagccttccaaagtgttgggattataggcgtgagccaccgcgcccagccctggagtgatactttttatggaagacaaaagccccccaaatctgtgtaaaatctgctgcaaaggtgtcatccctcttgtgtcatcactggggttagaggtgggtccgaaataatcttctgtgtccttcagttggactctcggctgccaattgatctctttttcattgccatctctggggtggttctttggttttttgtgtgttttccccttcatctctacctgtgaaagtgaaattctattgtaaatgggaggaaaaagggttggttgtgaaaaattaaagacccacattctgctttcttactcatggtaagaaaagtggccatgagtagagattgggcaagcattggtaataaatggaataagactattattattattatttgagatggagtctcactctgtcacccaggctggaatgcagtggtgtgatcttggctcactgcaacctccacttcccgggttcaagcgattctcctgcctcagcctcctgagtagctgggattacaggtgtgtgcctccacacccggctaattttttgtatttttagtagagacggggttttgccatgttggccaggctggtttcaaactcctgagctcaaatgatcctcctgccttggcctcccaaagtgctggaattacaggcatgagccaccacacccacacaagactatcatttttaatgaccaagagcctagtatatagttggtgcctgtcttagtctgtttgtgttgctataaaagaacacctgagactgggtaattgataaagaaaaaggtttgtttggctcacaattttgctggctagaaggttgggcatccggtgaaagcctcaggctgcttccattcatagcaaagggcagccagtgtgtgcagaaatcaaatgacagagaggaagtgagagagagaggtgtcggggaggtgccaggctctttttaacaagcagttcttcaggaactaagagtgagtcactcccatgagaacagcaccaagccattcatgggggaatctgcccccatgacccagacccctcccgttaggcttcacctccaacactgaggatcaaatttcaacatgagatttggaggaggtcaaacaaactaaactgtagcagtgtttcataaaattgtttgcctgactcaggttgctagtaagccagcagagggatatttgcctcctaaatctttggcagaggcaggagtaaggaagccatttctggagtccttgctactaatttggaaaactgagcttctttctttcattgctttttcccttaagagacaagtccttactatattgccctgtctctcaagggaagacatcaagactggacttgaactcctgggctcaagccatcccccaaccttggcctctcgagtagatgggattataggcatgtgccacggtgcctgacttgagtttcttattctagaacacttggagcctgaactctgaccaggcccctcacttgagcctttgctttctgctccttgtaaactgccatattgggtgcacttgccctgccacagtaatgctatatatttctgagcattgtttttctctagataattttatatttttgagtataccccacttccaagtgttttttgtttgttttgctttgtttttgttgttgttgttttgagacagggtctcactgtgtcccccaggctggagtgcagtggcacaatgacgactcactgcagcctcaacctcctggggccaagtgatcctcccacctcagcctctcaagtggctgggaccacagaagtgcaccaccatgcctggctttttttttttttttgggtcgagatggggtgtccctgtgttgcccagactggtcttgaactcctggactcaagggatcctcctgtcttgggctcccaaagtgttgggattacaggcgtgagtgaccatgcctagctcacttccaggtttaacagacaaaataaacttactctagtttccatctctatcattttataataaccgtagcccacattgtagtagtttttcagctctttactaagtcccaccaattcatgttttcacccttaaaatctttctcactgatactctctctggacagaaaaaaggtgaaataagcctactataaggaatatatgacatgctaaattttatttttaaacggttcttcaagtcagattaaagtaataatagcaaattatgtgattatccatgtcccagcctctctccaaaaaaatagtaaacaagatgtcttcttcttttcccaaagatacacatacacacatgtacaaatttttttatcagataataatagctaatatttaatgagtacttaccttagtttgtcccctttacaacagctttacatctgtgtgattgatacagttcatattcccattttataactgagaaaactggtgcacagagaggataagcaacttgccaaaggtcacacagttaataagtggaaatgctggggtatgaaccaggtagtctgcccccatagctctgccccccagagctgtactgtctcccatgagggtacttctccatggagcagcctgaggcgatccctttattctgggcttctctcagaaatggattcccacacagtattcaaagcaaatttccccagaggaaatcctattggaagaacttaaaaactcagaatctttttctttgtccagagagttgaggaagcttaagctaaatgatacatgttttttaaaaaaaatcagattataaatttagtttttggtgattcattaaattctttactattatagttattttctagctgttcatcttttagctaaatttgttccaaagaagcaaaagtttggtttctactaagttctggattctggatgggagattgcactgtgtgtgacatgcaagtttcatggtgtgggagattgcagagcatttgggttactgcttttactctttggaagctgttatcatctgtatctgctttaaataaagttaaagatttgga

SEQ ID NO: 43234 - DNA, 3786 bp, Homo sapiens
tttggcaccattgtgattacttattctatgaaagcaggcatacaaacagaagaacacccaaacccaggaaagagataccctggaatacagcgaactgcatacttgcctgataataaggaaggaaggaaggttttgaaactgctttatagggcctttgaccaaaagctgatttttacagtggggtactctcgcgtattaggagtctcagatgtcatcacttggaatgatattcaccacaaaacatcccggtttggaggaccagaaatgtatggctatcctgatccttcttacctgaaacgtgtcaaagaggagctgaaagctaaaggaattgagtaagacaactgctggaagatgtcttaaatcaagctttcaaaaaaatatattttaggaggctgatttaatgccagtctaaatccttatgtagaaaggactttgaaatttttcttctcaagaaatggtttgtataagaataacaatctgctagtctgtcatttctggagtgatacttttttttttgagacggagtctgctctgtcgctcgcgctggagtgcagtggcatgatctcggctcactgcaagctccgcctcccaggttcatgccattctcctacctcagcctcccgagtagctgggactacaggcgcccaccaccatgcccggctaatttttgtttttgtatttttagtagagacagggtttcactgtgttagccaggatggtctcgatctcctgacctcgtgatccgcccgcctcagccttccaaagtgttgggattataggcgtgagccaccgcgcccagccctggagtgatactttttatggaagacaaaagccccccaaatctgtgtaaaatctgctgcaaaggtgtcatccctcttgtgtcatcactggggttagaggtgggtccgaaataatcttctgtgtccttcagttggactctcggctgccaattgatctctttttcattgccatctctggggtggttctttggttttttgtgtgttttccccttcatctctacctgtgaaagtgaaattctattgtaaatgggaggaaaaagggttggttgtgaaaaattaaagacccacattctgctttcttactcatggtaagaaaagtggccatgagtagagattgggcaagcattggtaataaatggaataagactattattattattatttgagatggagtctcactctgtcacccaggctggaatgcagtggtgtgatcttggctcactgcaacctccacttcccgggttcaagcgattctcctgcctcagcctcctgagtagctgggattacaggtgtgtgcctccacacccggctaattttttgtatttttagtagagacggggttttgccatgttggccaggctggtttcaaactcctgagctcaaatgatcctcctgccttggcctcccaaagtgctggaattacaggcatgagccaccacacccacacaagactatcatttttaatgaccaagagcctagtatatagttggtgcctgtcttagtctgtttgtgttgctataaaagaacacctgagactgggtaattgataaagaaaaaggtttgtttggctcacaattttgctggctagaaggttgggcatccggtgaaagcctcaggctgcttccattcatagcaaagggcagccagtgtgtgcagaaatcaaatgacagagaggaagtgagagagagaggtgtcggggaggtgccaggctctttttaacaagcagttcttcaggaactaagagtgagtcactcccatgagaacagcaccaagccattcatgggggaatctgcccccatgacccagacccctcccgttaggcttcacctccaacactgaggatcaaatttcaacatgagatttggaggaggtcaaacaaactaaactgtagcagtgtttcataaaattgtttgcctgactcaggttgctagtaagccagcagagggatatttgcctcctaaatctttggcagaggcaggagtaaggaagccatttctggagtccttgctactaatttggaaaactgagcttctttctttcattgctttttcccttaagagacaagtccttactatattgccctgtctctcaagggaagacatcaagactggacttgaactcctgggctcaagccatcccccaaccttggcctctcgagtagatgggattataggcatgtgccacggtgcctgacttgagtttcttattctagaacacttggagcctgaactctgaccaggcccctcacttgagcctttgctttctgctccttgtaaactgccatattgggtgcacttgccctgccacagtaatgctatatatttctgagcattgtttttctctagataattttatatttttgagtataccccacttccaagtgttttttgtttgttttgctttgtttttgttgttgttgttttgagacagggtctcactgtgtcccccaggctggagtgcagtggcacaatgacgactcactgcagcctcaacctcctggggccaagtgatcctcccacctcagcctctcaagtggctgggaccacagaagtgcaccaccatgcctggctttttttttttttttgggtcgagatggggtgtccctgtgttgcccagactggtcttgaactcctggactcaagggatcctcctgtcttgggctcccaaagtgttgggattacaggcgtgagtgaccatgcctagctcacttccaggtttaacagacaaaataaacttactctagtttccatctctatcattttataataaccgtagcccacattgtagtagtttttcagctctttactaagtcccaccaattcatgttttcacccttaaaatctttctcactgatactctctctggacagaaaaaaggtgaaataagcctactataaggaatatatgacatgctaaattttatttttaaacggttcttcaagtcagattaaagtaataatagcaaattatgtgattatccatgtcccagcctctctccaaaaaaatagtaaacaagatgtcttcttcttttcccaaagatacacatacacacatgtacaaatttttttatcagataataatagctaatatttaatgagtacttaccttagtttgtcccctttacaacagctttacatctgtgtgattgatacagttcatattcccattttataactgagaaaactggtgcacagagaggataagcaacttgccaaaggtcacacagttaataagtggaaatgctggggtatgaaccaggtagtctgcccccatagctctgccccccagagctgtactgtctcccatgagggtacttctccatggagcagcctgaggcgatccctttattctgggcttctctcagaaatggattcccacacagtattcaaagcaaatttccccagaggaaatcctattggaagaacttaaaaactcagaatctttttctttgtccagagagttgaggaagcttaagctaaatgatacatgttttttaaaaaaaatcagattataaatttagtttttggtgattcattaaattctttactattatagttattttctagctgttcatcttttagctaaatttgttccaaagaagcaaaagtttggtttctactaagttctggattctggatgggagattgcactgtgtgtgacatgcaagtttcatggtgtgggagattgcagagcatttgggttactgcttttactctttggaagctgttatcatctgtatctgctttaaataaagttaaagatttgga

SEQ ID NO: 43235 - DNA, 4119 bp, Homo sapiens
cttagactttttctagaatattattggccaagtgatttcaggttctctgtggactggtgggggaaggggtgaggagactattggtagaaactgtattatacgaaatccaattgttctttatgaaacccaaataggattcctcagaccctggcactaaagaaaaaatatataccctgagacttttccaaaaccttaaatttgaaaatcctactagcatgtgattacgatgcccccctaaaacacagtatattattatatttttaggagagtcactacttaccataaactgaaaaattttaagaattaacatagacatgaagcctcaaagtaaatcaacgtattactattcatcttggattctcaaaccccctgccctttgatgcgaaatgtaataaatacatcatattaatactttgtagttggcagggtagaagccagcttgaaaggcagatgctggccagacagctaggctcactcgctagcgaaatgactcgcatctgcgaatttaaaagtcatgatacgtcatccaccttcaggattacttgtgaatgtttgcaacactggatattaattaaatccttaaatgctggatatctattgcacatatccgaacaatttgtggtgacactaaaggaatttttgtttcttcaggtatggctatcctgatccttcttacctgaaacgtgtcaaagaggagctgaaagctaaaggaattgagtaagacaactgctggaagatgtcttaaatcaagctttcaaaaaaatatattttaggaggctgatttaatgccagtctaaatccttatgtagaaaggactttgaaatttttcttctcaagaaatggtttgtataagaataacaatctgctagtctgtcatttctggagtgatacttttttttttgagacggagtctgctctgtcgctcgcgctggagtgcagtggcatgatctcggctcactgcaagctccgcctcccaggttcatgccattctcctacctcagcctcccgagtagctgggactacaggcgcccaccaccatgcccggctaatttttgtttttgtatttttagtagagacagggtttcactgtgttagccaggatggtctcgatctcctgacctcgtgatccgcccgcctcagccttccaaagtgttgggattataggcgtgagccaccgcgcccagccctggagtgatactttttatggaagacaaaagccccccaaatctgtgtaaaatctgctgcaaaggtgtcatccctcttgtgtcatcactggggttagaggtgggtccgaaataatcttctgtgtccttcagttggactctcggctgccaattgatctctttttcattgccatctctggggtggttctttggttttttgtgtgttttccccttcatctctacctgtgaaagtgaaattctattgtaaatgggaggaaaaagggttggttgtgaaaaattaaagacccacattctgctttcttactcatggtaagaaaagtggccatgagtagagattgggcaagcattggtaataaatggaataagactattattattattatttgagatggagtctcactctgtcacccaggctggaatgcagtggtgtgatcttggctcactgcaacctccacttcccgggttcaagcgattctcctgcctcagcctcctgagtagctgggattacaggtgtgtgcctccacacccggctaattttttgtatttttagtagagacggggttttgccatgttggccaggctggtttcaaactcctgagctcaaatgatcctcctgccttggcctcccaaagtgctggaattacaggcatgagccaccacacccacacaagactatcatttttaatgaccaagagcctagtatatagttggtgcctgtcttagtctgtttgtgttgctataaaagaacacctgagactgggtaattgataaagaaaaagcctcaggctgcttccattcatagcaaagggcagccagtgtgtgcagaaatcaaatgacagagaggaagtgagagagagaggtgtcggggaggtgccaggctctttttaacaagcagttcttcaggaactaagagtgagtcactcccatgagaacagcaccaagccattcatgggggaatctgcccccatgacccagacccctcccgttaggcttcacctccaacactgaggatcaaatttcaacatgagatttggaggaggtcaaacaaactaaactgtagcagtgtttcataaaattgtttgcctgactcaggttgctagtaagccagcagagggatatttgcctcctaaatctttggcagaggcaggagtaaggaagccatttctggagtccttgctactaatttggaaaactgagcttctttctttcattgctttttcccttaagagacaagtccttactatattgccctgtctctcaagggaagacatcaagactggacttgaactcctgggctcaagccatcccccaaccttggcctctcgagtagatgggattataggcatgtgccacggtgcctgacttgagtttcttattctagaacacttggagcctgaactctgaccaggcccctcacttgagcctttgctttctgctccttgtaaactgccatattgggtgcacttgccctgccacagtaatgctatatatttctgagcattgtttttctctagataattttatatttttgagtataccccacttccaagtgttttttgtttgttttgctttgtttttgttgttgttgttttgagacagggtctcactgtgtcccccaggctggagtgcagtggcacaatgacgactcactgcagcctcaacctcctggggccaagtgatcctcccacctcagcctctcaagtggctgggaccacagaagtgcaccaccatgcctggctttttttttttttttgggtcgagatggggtgtccctgtgttgcccagactggtcttgaactcctggactcaagggatcctcctgtcttgggctcccaaagtgttgggattacaggcgtgagtgaccatgcctagctcacttccaggtttaacagacaaaataaacttactctagtttccatctctatcattttataataaccgtagcccacattgtagtagtttttcagctctttactaagtcccaccaattcatgttttcacccttaaaatctttctcactgatactctctctggacagaaaaaaggtgaaataagcctactataaggaatatatgacatgctaaattttatttttaaacggttcttcaagtcagattaaagtaataatagcaaattatgtgattatccatgtcccagcctctctccaaaaaaatagtaaacaagatgtcttcttcttttcccaaagatacacatacacacatgtacaaatttttttatcagataataatagctaatatttaatgagtacttaccttagtttgtcccctttacaacagctttacatctgtgtgattgatacagttcatattcccattttataactgagaaaactggtgcacagagaggataagcaacttgccaaaggtcacacagttaataagtggaaatgctggggtatgaaccaggtagtctgcccccatagctctgccccccagagctgtactgtctcccatgagggtacttctccatggagcagcctgaggcgatccctttattctgggcttctctcagaaatggattcccacacagtattcaaagcaaatttccccagaggaaatcctattggaagaacttaaaaactcagaatctttttctttgtccagagagttgaggaagcttaagctaaatgatacatgttttttaaaaaaaatcagattataaatttagtttttggtgattcattaaattctttactattatagttattttctagctgttcatcttttagctaaatttgttccaaagaagcaaaagtttggtttctactaagttctggattctggatgggagattgcactgtgtgtgacatgcaagtttcatggtgtgggagattgcagagcatttgggttactgcttttactctttggaagctgttatcatctgtatctgctttaaataaagttaaagatttgga

SEQ ID NO: 43236 - DNA, 2369 bp, Homo sapiens
gtagtgatctcctgctggctcaagtgtgataaggatgagcacacccacacaagactatcatttttaatgaccaagagcctagtatatagttggtgcctgtcttagtctgtttgtgttgctataaaagaacacctgagactgggtaattgataaagaaaaaggtttgtttggctcacaattttgctggctagaaggttgggcatccggtgaaagcctcaggctgcttccattcatagcaaagggcagccagtgtgtgcagaaatcaaatgacagagaggaagtgagagagagaggtgtcggggaggtgccaggctctttttaacaagcagttcttcaggaactaagagtgagtcactcccatgagaacagcaccaagccattcatgggggaatctgcccccatgacccagacccctcccgttaggcttcacctccaacactgaggatcaaatttcaacatgagatttggaggaggtcaaacaaactaaactgtagcagtgtttcataaaattgtttgcctgactcaggttgctagtaagccagcagagggatatttgcctcctaaatctttggcagaggcaggagtaaggaagccatttctggagtccttgctactaatttggaaaactgagcttctttctttcattgctttttcccttaagagacaagtccttactatattgccctgtctctcaagggaagacatcaagactggacttgaactcctgggctcaagccatcccccaaccttggcctctcgagtagatgggattataggcatgtgccacggtgcctgacttgagtttcttattctagaacacttggagcctgaactctgaccaggcccctcacttgagcctttgctttctgctccttgtaaactgccatattgggtgcacttgccctgccacagtaatgctatatatttctgagcattgtttttctctagataattttatatttttgagtataccccacttccaagtgttttttgtttgttttgctttgtttttgttgttgttgttttgagacagggtctcactgtgtcccccaggctggagtgcagtggcacaatgacgactcactgcagcctcaacctcctggggccaagtgatcctcccacctcagcctctcaagtggctgggaccacagaagtgcaccaccatgcctggctttttttttttttttgggtcgagatggggtgtccctgtgttgcccagactggtcttgaactcctggactcaagggatcctcctgtcttgggctcccaaagtgttgggattacaggcgtgagtgaccatgcctagctcacttccaggtttaacagacaaaataaacttactctagtttccatctctatcattttataataaccgtagcccacattgtagtagtttttcagctctttactaagtcccaccaattcatgttttcacccttaaaatctttctcactgatactctctctggacagaaaaaaggtgaaataagcctactataaggaatatatgacatgctaaattttatttttaaacggttcttcaagtcagattaaagtaataatagcaaattatgtgattatccatgtcccagcctctctccaaaaaaatagtaaacaagatgtcttcttcttttcccaaagatacacatacacacatgtacaaatttttttatcagataataatagctaatatttaatgagtacttaccttagtttgtcccctttacaacagctttacatctgtgtgattgatacagttcatattcccattttataactgagaaaactggtgcacagagaggataagcaacttgccaaaggtcacacagttaataagtggaaatgctggggtatgaaccaggtagtctgcccccatagctctgccccccagagctgtactgtctcccatgagggtacttctccatggagcagcctgaggcgatccctttattctgggcttctctcagaaatggattcccacacagtattcaaagcaaatttccccagaggaaatcctattggaagaacttaaaaactcagaatctttttctttgtccagagagttgaggaagcttaagctaaatgatacatgttttttaaaaaaaatcagattataaatttagtttttggtgattcattaaattctttactattatagttattttctagctgttcatcttttagctaaatttgttccaaagaagcaaaagtttggtttctactaagttctggattctggatgggagattgcactgtgtgtgacatgcaagtttcatggtgtgggagattgcagagcatttgggttactgcttttactctttggaagctgttatcatctgtatctgctttaaataaagttaaagatttgga

SEQ ID NO: 43237 - DNA, 2252 bp, Homo sapiens
agacaaatggtgtgtgtgcatggataacgtaattctggaaaaaggtttgtttggctcacaattttgctggctagaaggttgggcatccggtgaaagcctcaggctgcttccattcatagcaaagggcagccagtgtgtgcagaaatcaaatgacagagaggaagtgagagagagaggtgtcggggaggtgccaggctctttttaacaagcagttcttcaggaactaagagtgagtcactcccatgagaacagcaccaagccattcatgggggaatctgcccccatgacccagacccctcccgttaggcttcacctccaacactgaggatcaaatttcaacatgagatttggaggaggtcaaacaaactaaactgtagcagtgtttcataaaattgtttgcctgactcaggttgctagtaagccagcagagggatatttgcctcctaaatctttggcagaggcaggagtaaggaagccatttctggagtccttgctactaatttggaaaactgagcttctttctttcattgctttttcccttaagagacaagtccttactatattgccctgtctctcaagggaagacatcaagactggacttgaactcctgggctcaagccatcccccaaccttggcctctcgagtagatgggattataggcatgtgccacggtgcctgacttgagtttcttattctagaacacttggagcctgaactctgaccaggcccctcacttgagcctttgctttctgctccttgtaaactgccatattgggtgcacttgccctgccacagtaatgctatatatttctgagcattgtttttctctagataattttatatttttgagtataccccacttccaagtgttttttgtttgttttgctttgtttttgttgttgttgttttgagacagggtctcactgtgtcccccaggctggagtgcagtggcacaatgacgactcactgcagcctcaacctcctggggccaagtgatcctcccacctcagcctctcaagtggctgggaccacagaagtgcaccaccatgcctggctttttttttttttttgggtcgagatggggtgtccctgtgttgcccagactggtcttgaactcctggactcaagggatcctcctgtcttgggctcccaaagtgttgggattacaggcgtgagtgaccatgcctagctcacttccaggtttaacagacaaaataaacttactctagtttccatctctatcattttataataaccgtagcccacattgtagtagtttttcagctctttactaagtcccaccaattcatgttttcacccttaaaatctttctcactgatactctctctggacagaaaaaaggtgaaataagcctactataaggaatatatgacatgctaaattttatttttaaacggttcttcaagtcagattaaagtaataatagcaaattatgtgattatccatgtcccagcctctctccaaaaaaatagtaaacaagatgtcttcttcttttcccaaagatacacatacacacatgtacaaatttttttatcagataataatagctaatatttaatgagtacttaccttagtttgtcccctttacaacagctttacatctgtgtgattgatacagttcatattcccattttataactgagaaaactggtgcacagagaggataagcaacttgccaaaggtcacacagttaataagtggaaatgctggggtatgaaccaggtagtctgcccccatagctctgccccccagagctgtactgtctcccatgagggtacttctccatggagcagcctgaggcgatccctttattctgggcttctctcagaaatggattcccacacagtattcaaagcaaatttccccagaggaaatcctattggaagaacttaaaaactcagaatctttttctttgtccagagagttgaggaagcttaagctaaatgatacatgttttttaaaaaaaatcagattataaatttagtttttggtgattcattaaattctttactattatagttattttctagctgttcatcttttagctaaatttgttccaaagaagcaaaagtttggtttctactaagttctggattctggatgggagattgcactgtgtgtgacatgcaagtttcatggtgtgggagattgcagagcatttgggttactgcttttactctttggaagctgttatcatctgtatctgctttaaataaagttaaagatttgga

SEQ ID NO: 43238 - DNA, 1177 bp, Homo sapiens
atctctctatccttaatctctctatccttaatctctctatccttaatctcaagggatcctcctgtcttgggctcccaaagtgttgggattacaggcgtgagtgaccatgcctagctcacttccaggtttaacagacaaaataaacttactctagtttccatctctatcattttataataaccgtagcccacattgtagtagtttttcagctctttactaagtcccaccaattcatgttttcacccttaaaatctttctcactgatactctctctggacagaaaaaaggtgaaataagcctactataaggaatatatgacatgctaaattttatttttaaacggttcttcaagtcagattaaagtaataatagcaaattatgtgattatccatgtcccagcctctctccaaaaaaatagtaaacaagatgtcttcttcttttcccaaagatacacatacacacatgtacaaatttttttatcagataataatagctaatatttaatgagtacttaccttagtttgtcccctttacaacagctttacatctgtgtgattgatacagttcatattcccattttataactgagaaaactggtgcacagagaggataagcaacttgccaaaggtcacacagttaataagtggaaatgctggggtatgaaccaggtagtctgcccccatagctctgccccccagagctgtactgtctcccatgagggtacttctccatggagcagcctgaggcgatccctttattctgggcttctctcagaaatggattcccacacagtattcaaagcaaatttccccagaggaaatcctattggaagaacttaaaaactcagaatctttttctttgtccagagagttgaggaagcttaagctaaatgatacatgttttttaaaaaaaatcagattataaatttagtttttggtgattcattaaattctttactattatagttattttctagctgttcatcttttagctaaatttgttccaaagaagcaaaagtttggtttctactaagttctggattctggatgggagattgcactgtgtgtgacatgcaagtttcatggtgtgggagattgcagagcatttgggttactgcttttactctttggaagctgttatcatctgtatctgctttaaataaagttaaagatttgga

SEQ ID NO: 43239 - DNA, 4193 bp, Homo sapiens
cttagactttttctagaatattattggccaagtgatttcaggttctctgtggactggtgggggaaggggtgaggagactattggtagaaactgtattatacgaaatccaattgttctttatgaaacccaaataggattcctcagaccctggcactaaagaaaaaatatataccctgagacttttccaaaaccttaaatttgaaaatcctactagcatgtgattacgatgcccccctaaaacacagtatattattatatttttaggagagtcactacttaccataaactgaaaaattttaagaattaacatagacatgaagcctcaaagtaaatcaacgtattactattcatcttggattctcaaaccccctgccctttgatgcgaaatgtaataaatacatcatattaatactttgtagttggcagggtagaagccagcttgaaaggcagatgctggccagacagctaggctcactcgctagcgaaatgactcgcatctgcgaatttaaaagtcatgatacgtcatccaccttcaggattacttgtgaatgtttgcaacactggatattaattaaatccttaaatgctggatatctattgcacatatccgaacaatttgtggtgacactaaaggaatttttgtttcttcaggtatggctatcctgatccttcttacctgaaacgtgtcaaagaggagctgaaagctaaaggaattgagtaagacaactgctggaagatgtcttaaatcaagctttcaaaaaaatatattttaggaggctgatttaatgccagtctaaatccttatgtagaaaggactttgaaatttttcttctcaagaaatggtttgtataagaataacaatctgctagtctgtcatttctggagtgatacttttttttttgagacggagtctgctctgtcgctcgcgctggagtgcagtggcatgatctcggctcactgcaagctccgcctcccaggttcatgccattctcctacctcagcctcccgagtagctgggactacaggcgcccaccaccatgcccggctaatttttgtttttgtatttttagtagagacagggtttcactgtgttagccaggatggtctcgatctcctgacctcgtgatccgcccgcctcagccttccaaagtgttgggattataggcgtgagccaccgcgcccagccctggagtgatactttttatggaagacaaaagccccccaaatctgtgtaaaatctgctgcaaaggtgtcatccctcttgtgtcatcactggggttagaggtgggtccgaaataatcttctgtgtccttcagttggactctcggctgccaattgatctctttttcattgccatctctggggtggttctttggttttttgtgtgttttccccttcatctctacctgtgaaagtgaaattctattgtaaatgggaggaaaaagggttggttgtgaaaaattaaagacccacattctgctttcttactcatggtaagaaaagtggccatgagtagagattgggcaagcattggtaataaatggaataagactattattattattatttgagatggagtctcactctgtcacccaggctggaatgcagtggtgtgatcttggctcactgcaacctccacttcccgggttcaagcgattctcctgcctcagcctcctgagtagctgggattacaggtgtgtgcctccacacccggctaattttttgtatttttagtagagacggggttttgccatgttggccaggctggtttcaaactcctgagctcaaatgatcctcctgccttggcctcccaaagtgctggaattacaggcatgagccaccacacccacacaagactatcatttttaatgaccaagagcctagtatatagttggtgcctgtcttagtctgtttgtgttgctataaaagaacacctgagactgggtaattgataaagaaaaaggtttgtttggctcacaattttgctggctagaaggttgggcatccggtgaaagcctcaggctgcttccattcatagcaaagggcagccagtgtgtgcagaaatcaaatgacagagaggaagtgagagagagaggtgtcggggaggtgccaggctctttttaacaagcagttcttcaggaactaagagtgagtcactcccatgagaacagcaccaagccattcatgggggaatctgcccccatgacccagacccctcccgttaggcttcacctccaacactgaggatcaaatttcaacatgagatttggaggaggtcaaacaaactaaactgtagcagtgtttcataaaattgtttgcctgactcaggttgctagtaagccagcagagggatatttgcctcctaaatctttggcagaggcaggagtaaggaagccatttctggagtccttgctactaatttggaaaactgagcttctttctttcattgctttttcccttaagagacaagtccttactatattgccctgtctctcaagggaagacatcaagactggacttgaactcctgggctcaagccatcccccaaccttggcctctcgagtagatgggattataggcatgtgccacggtgcctgacttgagtttcttattctagaacacttggagcctgaactctgaccaggcccctcacttgagcctttgctttctgctccttgtaaactgccatattgggtgcacttgccctgccacagtaatgctatatatttctgagcattgtttttctctagataattttatatttttgagtataccccacttccaagtgttttttgtttgttttgctttgtttttgttgttgttgttttgagacagggtctcactgtgtcccccaggctggagtgcagtggcacaatgacgactcactgcagcctcaacctcctggggccaagtgatcctcccacctcagcctctcaagtggctgggaccacagaagtgcaccaccatgcctggctttttttttttttttgggtcgagatggggtgtccctgtgttgcccagactggtcttgaactcctggactcaagggatcctcctgtcttgggctcccaaagtgttgggattacaggcgtgagtgaccatgcctagctcacttccaggtttaacagacaaaataaacttactctagtttccatctctatcattttataataaccgtagcccacattgtagtagtttttcagctctttactaagtcccaccaattcatgttttcacccttaaaatctttctcactgatactctctctggacagaaaaaaggtgaaataagcctactataaggaatatatgacatgctaaattttatttttaaacggttcttcaagtcagattaaagtaataatagcaaattatgtgattatccatgtcccagcctctctccaaaaaaatagtaaacaagatgtcttcttcttttcccaaagatacacatacacacatgtacaaatttttttatcagataataatagctaatatttaatgagtacttaccttagtttgtcccctttacaacagctttacatctgtgtgattgatacagttcatattcccattttataactgagaaaactggtgcacagagaggataagcaacttgccaaaggtcacacagttaataagtggaaatgctggggtatgaaccaggtagtctgcccccatagctctgccccccagagctgtactgtctcccatgagggtacttctccatggagcagcctgaggcgatccctttattctgggcttctctcagaaatggattcccacacagtattcaaagcaaatttccccagaggaaatcctattggaagaacttaaaaactcagaatctttttctttgtccagagagttgaggaagcttaagctaaatgatacatgttttttaaaaaaaatcagattataaatttagtttttggtgattcattaaattctttactattatagttattttctagctgttcatcttttagctaaatttgttccaaagaagcaaaagtttggtttctactaagttctggattctggatgggagattgcactgtgtgtgacatgcaagtttcatggtgtgggagattgcagagcatttgggttactgcttttactctttggaagctgttatcatctgtatctgctttaaataaagttaaagatttggaccacttggccacaaaaaaaggg

SEQ ID NO: 43240 - DNA, 3877 bp, Homo sapiens
cttagactttttctagaatattattggccaagtgatttcaggttctctgtggactggtgggggaaggggtgaggagactattggtagaaactgtattatacgaaatccaattgttctttatgaaacccaaataggattcctcagaccctggcactaaagaaaaaatatataccctgagacttttccaaaaccttaaatttgaaaatcctactagcatgtgattacgatgcccccctaaaacacagtatattattatatttttaggagagtcactacttaccataaactgaaaaattttaagaattaacatagacatgaagcctcaaagtaaatcaacgtattactattcatcttggattctcaaaccccctgccctttgatgcgaaatgtaataaatacatcatattaatactttgtagttggcagggtagaagccagcttgaaaggcagatgctggccagacagctaggctcactcgctagcgaaatgactcgcatctgcgaatttaaaagtcatgatacgtcatccaccttcaggattacttgtgaatgtttgcaacactggatattaattaaatccttaaatgctggatatctattgcacatatccgaacaatttgtggtgacactaaaggaatttttgtttcttcaggtatggctatcctgatccttcttacctgaaacgtgtcaaagaggagctgaaagctaaaggaattgagtaagacaactgctggaagatgtcttaaatcaagctttcaaaaaaatatattttaggaggctgatttaatgccagtctaaatccttatgtagaaaggactttgaaatttttcttctcaagaaatggtttgtataagaataacaatctgctagtctgtcatttctggagtgatacttttttttttgagacggagtctgctctgtcgctcgcgctggagtgcagtggcatgatctcggctcactgcaagctccgcctcccaggttcatgccattctcctacctcagcctcccgagtagctgggactacaggcgcccaccaccatgcccggctaatttttgtttttgtatttttagtagagacagggtttcactgtgttagccaggatggtctcgatctcctgacctcgtgatccgcccgcctcagccttccaaagtgttgggattataggcgtgagccaccgcgcccagccctggagtgatactttttatggaagacaaaagccccccaaatctgtgtaaaatctgctgcaaaggtgtcatccctcttgtgtcatcactggggttagaggtgggtccgaaataatcttctgtgtccttcagttggactctcggctgccaattgatctctttttcattgccatctctggggtggttctttggttttttgtgtgttttccccttcatctctacctgtgaaagtgaaattctattgtaaatgggaggaaaaagggttggttgtgaaaaattaaagacccacattctgctttcttactcatggtaagaaaagtggccatgagtagagattgggcaagcattggtaataaatggaataagactattattattattatttgagatggagtctcactctgtcacccaggctggaatgcagtggtgtgatcttggctcactgcaacctccacttcccgggttcaagcgattctcctgcctcagcctcctgagtagctgggattacaggtgtgtgcctccacacccggctaattttttgtatttttagtagagacggggttttgccatgttggccaggctggtttcaaactcctgagctcaaatgatcctcctgccttggcctcccaaagtgctggaattacaggcatgagccaccacacccacacaagactatcatttttaatgaccaagagcctagtatatagttggtgcctgtcttagtctgtttgtgttgctataaaagaacacctgagactgggtaattgataaagaaaaaggtttgtttggctcacaattttgctggctagaaggttgggcatccggtgaaagcctcaggctgcttccattcatagcaaagggcagccagtgtgtgcagaaatcaaatgacagagaggaagtgagagagagaggtgtcggggaggtgccaggctctttttaacaagcagttcttcaggaactaagagtgagtcactcccatgagaacagcaccaagccattcatgggggaatctgcccccatgacccagacccctcccgttaggcttcacctccaacactgaggatcaaatttcaacatgagatttggaggaggtcaaacaaactaaactgtagcagtgtttcataaaattgtttgcctgactcaggttgctagtaagccagcagagggatatttgcctcctaaatctttggcagaggcaggagtaaggaagccatttctggagtccttgctactaatttggaaaactgagcttctttctttcattgctttttcccttaagagacaagtccttactatattgccctgtctctcaagggaagacatcaagactggacttgaactcctgggctcaagccatcccccaaccttggcctctcgagtagatgggattataggcatgtgccacggtgcctgacttgagtttcttattctagaacacttggagcctgaactctgaccaggcccctcacttgagcctttgctttctgctccttgtaaactgccatattgggtgcacttgccctgccacagtaatgctatatatttctgagcattgtttttctctagataattttatatttttgagtataccccacttccaagtgttttttgtttgttttgctttgtttttgttgttgttgttttgagacagggtctcactgtgtcccccaggctggagtgcagtggcacaatgacgactcactgcagcctcaacctcctggggccaagtgatcctcccacctcagcctctcaagtggctgggaccacagaagtgcaccaccatgcctggctttttttttttttttgggtcgagatggggtgtccctgtgttgcccagactggtcttgaactcctggactcaagggatcctcctgtcttgggctcccaaagtgttgggattacaggcgtgagtgaccatgcctagctcacttccaggtttaacagacaaaataaacttactctagtttccatctctatcattttataataaccgtagcccacattgtagtagtttttcagctctttactaagtcccaccaattcatgttttcacccttaaaatctttctcactgatactctctctggacagaaaaaaggtgaaataagcctactataaggaatatatgacatgctaaattttatttttaaacggttcttcaagtcagattaaagtaataatagcaaattatgtgattatccatgtcccagcctctctccaaaaaaatagtaaacaagatgtcttcttcttttcccaaagatacacatacacacatgtacaaatttttttatcagataataatagctaatatttaatgagtacttaccttagtttgtcccctttacaacagctttacatctgtgtgattgatacagttcatattcccattttataactgagaaaactggtgcacagagaggataagcaacttgccaaaggtcacacagttaataagtggaaatgctggggtatgaaccaggtagtctgcccccatagctctgccccccagagctgtactgtctcccatgagggtacttctccatggagcagcctgaggcgatccctttattattgcactgtgtgtgacatgcaagtttcatggtgtgggagattgcagagcatttgggttactgcttttactctttggaagctgttatcatctgtatctgctttaaataaagttaaagatttgga

SEQ ID NO: 43241 - DNA, 2642 bp, Homo sapiens
cttagactttttctagaatattattggccaagtgatttcaggttctctgtggactggtgggggaaggggtgaggagactattggtagaaactgtattatacgaaatccaattgttctttatgaaacccaaataggattcctcagaccctggcactaaagaaaaaatatataccctgagacttttccaaaaccttaaatttgaaaatcctactagcatgtgattacgatgcccccctaaaacacagtatattattatatttttaggagagtcactacttaccataaactgaaaaattttaagaattaacatagacatgaagcctcaaagtaaatcaacgtattactattcatcttggattctcaaaccccctgccctttgatgcgaaatgtaataaatacatcatattaatactttgtagttggcagggtagaagccagcttgaaaggcagatgctggccagacagctaggctcactcgctagcgaaatgactcgcatctgcgaatttaaaagtcatgatacgtcatccaccttcaggattacttgtgaatgtttgcaacactggatattaattaaatccttaaatgctggatatctattgcacatatccgaacaatttgtggtgacactaaaggaatttttgtttcttcaggtatggctatcctgatccttcttacctgaaacgtgtcaaagaggagctgaaagctaaaggaattgagtaagacaactgctggaagatgtcttaaatcaagctttcaaaaaaatatattttaggaggctgatttaatgccagtctaaatccttatgtagaaaggactttgaaatttttcttctcaagaaatggtttgtataagaataacaatctgctagtctgtcatttctggagtgatacttttttttttgagacggagtctgctctgtcgctcgcgctggagtgcagtggcatgatctcggctcactgcaagctccgcctcccaggttcatgccattctcctacctcagcctcccgagtagctgggactacaggcgcccaccaccatgcccggctaatttttgtttttgtatttttagtagagacagggtttcactgtgttagccaggatggtctcgatctcctgacctcgtgatccgcccgcctcagccttccaaagtgttgggattataggcgtgagccaccgcgcccagccctggagtgatactttttatggaagacaaaagccccccaaatctgtgtaaaatctgctgcaaaggtgtcatccctcttgtgtcatcactggggttagaggtgggtccgaaataatcttctgtgtccttcagttggactctcggctgccaattgatctctttttcattgccatctctggggtggttctttggttttttgtgtgttttccccttcatctctacctgtgaaagtgaaattctattgtaaatgggaggaaaaagggttggttgtgaaaaattaaagacccacattctgctttcttactcatggtaagaaaagtggccatgagtagagattgggcaagcattggtaataaatggaataagactattattattattatttgagatggagtctcactctgtcacccaggctggaatgcagtggtgtgatcttggctcactgcaacctccacttcccgggttcaagcgattctcctgcctcagcctcctgagtagctgggattacaggtgtgtgcctccacacccggctaattttttgtatttttagtagagacggggttttgccatgttggccaggctggtttcaaactcctgagctcaaatgatcctcctgccttggcctcccaaagtgctggaattacaggcatgagccaccacacccacacaagactatcatttttaatgaccaagagcctagtatatagttggtgcctgtcttagtctgtttgtgttgctataaaagaacacctgagactgggtaattgataaagaaaaaggtttgtttggctcacaattttgctggctagaaggttgggcatccggtgaaagcctcaggctgcttccattcatagcaaagggcagccagtgtgtgcagaaatcaaatgacagagaggaagtgagagagagaggtgtcggggaggtgccaggctctttttaacaagcagttcttcaggaactaagagtgagtcactcccatgagaacagcaccaagccattcatgggggaatctgcccccatgacccagacccctcccgttaggcttcacctccaacactgaggatcaaatttcaacatgagatttggaggaggtcaaacaaactaaactgtagcagtgatctcctgatgaagaagctagccttctgaacctcgcctgaagccagcctctctgccaagtcactcaggtcatgggcattgttcaagcctgagtggcagccgctcttgctcacctgttgaggaagggctggctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcagactgcccctcccctttttgtaaaaagtccattttctgtaaaaaaaa

SEQ ID NO: 43242 - DNA, 427 bp, Homo sapiens
gaaatacggcaatttctggatgtggatataagtagactctatatctgtggaattggcgccctgagagctgctgatcggggatggtaatctcaaagacagaaagattggtctccatcactttctaccgtgccagctataaagtactatggagttatttaaattttgcaccaaaggacagggggcttttgaatccgagatgaatactatataagctgatttaatttgaggcgttgtgtctatttgaaggctagaggctcggaatgtcactttgcttccttttaaggtcacctttctttttcaccccttcccccaccagtccacagagaacctgaaatcacttggccaataatattctagaaaaagtctaagttgtgaggagactattggtagaaactgtattatacgaaatccaattgttctttatgaa

SEQ ID NO: 43243 - DNA, 365 bp, Homo sapiens
aagaacttaaaaactcagaatctttttctttgtccagagagttgaggaagcttaagctaaatgatacatgttttttaaaaaaaatcagattataaatttagtttttggtgattcattaaattctttactattatagttattttctagctgttcatcttttagctaaatttgttccaaagaagcaaaagtttggtttctactaagttctggattctggatgggagattgcactgtgtgtgacatgcaagtttcatggtgtgggagattgcagagcatttgggttactgcttttactctttggaagctgttatcatctgtatctgctttaaataaagttaaagatttggaacaaattgtgttctttc

SEQ ID NO: 43244 - DNA, 1903 bp, Homo sapiens
gcaggaggaggctggggtgaatcggcaccgaggtttcataaaattgtttgcctgactcaggttgctagtaagccagcagagggatatttgcctcctaaatctttggcagaggcaggagtaaggaagccatttctggagtccttgctactaatttggaaaactgagcttctttctttcattgctttttcccttaagagacaagtccttactatattgccctgtctctcaagggaagacatcaagactggacttgaactcctgggctcaagccatcccccaaccttggcctctcgagtagatgggattataggcatgtgccacggtgcctgacttgagtttcttattctagaacacttggagcctgaactctgaccaggcccctcacttgagcctttgctttctgctccttgtaaactgccatattgggtgcacttgccctgccacagtaatgctatatatttctgagcattgtttttctctagataattttatatttttgagtataccccacttccaagtgttttttgtttgttttgctttgtttttgttgttgttgttttgagacagggtctcactgtgtcccccaggctggagtgcagtggcacaatgacgactcactgcagcctcaacctcctggggccaagtgatcctcccacctcagcctctcaagtggctgggaccacagaagtgcaccaccatgcctggctttttttttttttttgggtcgagatggggtgtccctgtgttgcccagactggtcttgaactcctggactcaagggatcctcctgtcttgggctcccaaagtgttgggattacaggcgtgagtgaccatgcctagctcacttccaggtttaacagacaaaataaacttactctagtttccatctctatcattttataataaccgtagcccacattgtagtagtttttcagctctttactaagtcccaccaattcatgttttcacccttaaaatctttctcactgatactctctctggacagaaaaaaggtgaaataagcctactataaggaatatatgacatgctaaattttatttttaaacggttcttcaagtcagattaaagtaataatagcaaattatgtgattatccatgtcccagcctctctccaaaaaaatagtaaacaagatgtcttcttcttttcccaaagatacacatacacacatgtacaaatttttttatcagataataatagctaatatttaatgagtacttaccttagtttgtcccctttacaacagctttacatctgtgtgattgatacagttcatattcccattttataactgagaaaactggtgcacagagaggataagcaacttgccaaaggtcacacagttaataagtggaaatgctggggtatgaaccaggtagtctgcccccatagctctgccccccagagctgtactgtctcccatgagggtacttctccatggagcagcctgaggcgatccctttattctgggcttctctcagaaatggattcccacacagtattcaaagcaaatttccccagaggaaatcctattggaagaacttaaaaactcagaatctttttctttgtccagagagttgaggaagcttaagctaaatgatacatgttttttaaaaaaaatcagattataaatttagtttttggtgattcattaaattctttactattatagttattttctagctgttcatcttttagctaaatttgttccaaagaagcaaaagtttggtttctactaagttctggattctggatgggagattgcactgtgtgtgacatgcaagtttcatggtgtgggagattgcagagcatttgggttactgcttttactctttggaagctgttatcatctgtatctgctttaaataaagttaaagatttgga

SEQ ID NO: 43245 - DNA, 403 bp, Homo sapiens
aaatgcccagtttccaacaaaataggaggcatgcaaagaaacacaagagtatgacccccacatttaaattttttaaaaagcagacaacagaaactgcctggggaatgaccagatattggatttaatgggaaaaggcagggagggaggaaggaaacctatcaatcccaaatcctatgcgcagcagagctttctttcaagaatgaaggtgaaataaagactttttccgacaaactgagagtttgttgccagctgacccaccttacaaaaaatactaaaggaagttcttcaggcagtgagcaagaaacttcagacagtaatttgaaatcacatgaaaaaaacagagtgcctcttaaggtaattatgtaatttcataagacagtacgaatacatatttttctctttt

SEQ ID NO: 43246 - DNA, 299 bp, Homo sapiens
tgtctctccttggtagagtttgtcacccccaagtaagaactaaggctctgagaaaataagttttgcccaacctaagtgtagtatgttcaagtcagatatttaaacctaatccaacatttcttgccccaaccatctctataagtaataattctcaactagtctagtaaaggagataggtatgtgaataaataacttacaaagttgtaatttatttaatggtttaatgattacacaaccattaaaaatgagcaatagctgtatatttattgtcattgaaatacattcaccatgtgttattt

SEQ ID NO: 43247 - DNA, 289 bp, Homo sapiens
aaaatgtgaaacacatacacacacaactttctgattatttaagttcatctaagcatattttggaggaatgaatgtacattgtatccttgaaataatcttcctaaatagattcctttaaggggagtttgttcttgtgggggaaagaaagagagatgagactgttattgtgtctatgtagaaagaggaagacataagaaactccattgtgatctgtactaagaaaaactcttctgccttgagatgctgtgaatctgtaaccctagccccaaccctgtgctcgcagaaacat

SEQ ID NO: 43248 - DNA, 586 bp, Homo sapiens
ctggggccacagagccccgggaccttgtgtcactttttagtgatcctgctgcagaagtcacgttcttcttcccactgccatcttgcctttgcattctcagttctacgtgccctttgaactttaatggtaaaacatttcacactttggatggtttgcttgtctctagtttttagaaagctcttatcactccttcctaagaaaaaagaagggcaggtaaatttttttaaccaaaaaaaaatcacacatttcataaaaccctgatgaattttggatatgtgagagggcataaacattcctaaatatggacctgtgaatttagtaaattacccccatgaatatactccttcagtgcagggatttttgtgttttttttttttttttaatttttttgcaacagccttgctcatattccaggtgtagctagcaaacccctgtttttgaagcaagagccttatttgattcagtgtagatgtttcctgtctatcctttgtgacagggccttttaatgagtgttttttctttttgtatatgttacgtgtttgttgttgtattaaataaagaggaatgtacatactaaaatcgtgtc

SEQ ID NO: 43249 - DNA, 3555 bp, Homo sapiens
aatctctaatgatagggtgtgtgtgtgtgtgtgtgtgtgtgtgtgtgtgtctgtaagtcactttttggatttttgttgctttttccagataaggccttagtagcctctaaatatcaactatgcagataaacatactccttttttttttcacatgtccctgtcttttccattctcagataacaaatgttaagacccaaagaaataaggcataagggtttttgttgaatgtgtgtttgttcttctagggaaaattaacagaagcataaaatagagatactttgtgtgttcatctatcgtaaaatgtgaactctgtattcaaaaactatctacagatgctttcactggtgcaaagctgtagttagtatcatggaatgtctttgggttgttaatgataaaatcatcccagtgttcaattctgagagttttagattatatgacacaatgttcaggtttatagagctgaatgggtgatcaaactctaattaaaaatagctttgaatattaatgttgaattcttctttcttggtttcctttagtcttcattctttattcagagctcttaatcatattgctacactagaatatgaattgtatattaggagtctggggaggaaaggttaaattgtcttttacatcctcttctcactcactctggcaacctatcctgtgtccccatagaactgagaagtaaagccctgtgcaggcctgctttagaagactttacatcccagcagaggattcaggcagggactctcaggattttaatcagactgcctttgaataatgtgatattaaattttatttttctcatagactctcaaagtaccacttgcttgaaagtagctacttgtgatctttaatttccttatattgtgatagttctacttttcagtctttcctgtgtatctccatttcatagtgcgttagtacttaaacttcggacacttttccaaactgttaaacaagtcaggaatgcttttcagaatcgcagtagtattattagggtctctgtgtctaggacttacagtcatcagtggtcatcactgggactagaggtgttcttttttttcctcttctcctttgtattaaaaaatagattttgctactgtataatgcggcatttcatgacttcctcttgttacttttcaaggttattctaaagagatggagatcttcattagaggctatttctcataatagtctgccttgcttattttcatactccccctgaaataagcctacttttgcaaacaggccatatgaatcaaattttatgtttgttcctcacaaaattttctacacattatttgttcccactttgctaataataatataatgattttattgtaaatctgtgttttaaatattttataatagagcactaatggaaacctaataaatacaaacaagataactattacccaagataacatggaaatacttctgtttttgaagttaacaacaccgtctgccctcaaagcacatttaggagtatcaaccaagaccagccagttgacatgtttttctgtgtggcaacctgcccttaaattgtcagatcttaactatcttgtgtttgctgtgcttgcagccataagctttcctccttttttgcttatccctgctgtttgtagggttagtgtgccctctgtcagaaaattgggttttctttactatacctgcaaaattaccaagggttaccccaatattgtctagaggaattaaaaagaacttattctcagttgacaaaagtattactgttatacatagttaattggaaagttggccaactttggtcacctatttttgagtcttggctatgcctttgtaattagttacatataccttctgagaccttcagataatcaatgggcctttccccattagaggtaggttcccagcctacaagtatttcctgtgatccatggcaagcctccagagaaaagattcaagctttgcactgcccttttgttgattgtcattgaaaacttactttatttcagaaagtatcaaaaataccaaattggtctttcagagagtatgtaaatctggggcttgcccttggatttcacttgttaaacaccctcaaacttaaaagaagaaaatagatctccagctggtgaaaattttgtgccccaaataatatattaatccaagtctaccaaggtaactaagtaatggatgttttctctcttttattacaagcaagaaagttcatttgcagttgtaaaaatgattaccgaactccagacctatttgctataactgattggaaataatgattctgatttttagtctgggtaaacacatacttcggtgtgaattttgataagggaaagacttgtttggtagcccaaggaaaaacaggatgtatttatacagtgaatgttcactctgcagaggaacttccctccagttacatcttcctcatacattagccacctccacacttgacatagatgccaacatgtttcaaaaccaatcttgaaggagcctaaagagttgatggtcctctaggtgaaagacaagaattactgtattgcatttgcttatagggaggtgtgtttttgctaacttgaagggatatactgtatttcaaataagtgtgtgacttaatattttgggatttttttttcctcctttaaaaactggacctgaacacaagctttgagttgatgtttgtaataatctcaggacctgaaagattgtagcatttagtgtgtcttaaaaattatgtactgtaccagccatggatttttgtaaatatacctgtctcccttttttgtattttagtaaaaaaaaaaaaaataaatttaaataaaagggggtggtgatgacatgtgaatgggtgcgggtatgtgtgcgtgtgtgtttgtataaggctcttttgagatgaactggtgcttgtttaatttccagctcaaatcggagcaggaatatggacaaactgctgctactgaaccctgcactgagccgaggtatttccatttggttaactaaacgctagctaccaggaaatgacgcagaagtcacgttcttcttcccactgccatcttgcctttgcattctcagttctacgtgccctttgaactttaatggtaaaacatttcacactttggatggtttgcttgtctctagtttttagaaagctcttatcactccttcctaagaaaaaagaagggcaggtaaatttttttaaccaaaaaaaaatcacacatttcataaaaccctgatgaattttggatatgtgagagggcataaacattcctaaatatggacctgtgaatttagtaaattacccccatgaatatactccttcagtgcagggatttttgtgttttttttttttttttaatttttttgcaacagccttgctcatattccaggtgtagctagcaaacccctgtttttgaagcaagagccttatttgattcagtgtagatgtttcctgtctatcctttgtgacagggccttttaatgagtgttttttctttttgtatatgttacgtgtttgttgttgtattaaataaagaggaatgtacatactaaaatcgtgtc

SEQ ID NO: 43250 - DNA, 3501 bp, Homo sapiens
aatctctaatgatagggtgtgtgtgtgtgtgtgtgtgtgtgtgtgtgtgtctgtaagtcactttttggatttttgttgctttttccagataaggccttagtagcctctaaatatcaactatgcagataaacatactccttttttttttcacatgtccctgtcttttccattctcagataacaaatgttaagacccaaagaaataaggcataagggtttttgttgaatgtgtgtttgttcttctagggaaaattaacagaagcataaaatagagatactttgtgtgttcatctatcgtaaaatgtgaactctgtattcaaaaactatctacagatgctttcactggtgcaaagctgtagttagtatcatggaatgtctttgggttgttaatgataaaatcatcccagtgttcaattctgagagttttagattatatgacacaatgttcaggtttatagagctgaatgggtgatcaaactctaattaaaaatagctttgaatattaatgttgaattcttctttcttggtttcctttagtcttcattctttattcagagctcttaatcatattgctacactagaatatgaattgtatattaggagtctggggaggaaaggttaaattgtcttttacatcctcttctcactcactctggcaacctatcctgtgtccccatagaactgagaagtaaagccctgtgcaggcctgctttagaagactttacatcccagcagaggattcaggcagggactctcaggattttaatcagactgcctttgaataatgtgatattaaattttatttttctcatagactctcaaagtaccacttgcttgaaagtagctacttgtgatctttaatttccttatattgtgatagttctacttttcagtctttcctgtgtatctccatttcatagtgcgttagtacttaaacttcggacacttttccaaactgttaaacaagtcaggaatgcttttcagaatcgcagtagtattattagggtctctgtgtctaggacttacagtcatcagtggtcatcactgggactagaggtgttcttttttttcctcttctcctttgtattaaaaaatagattttgctactgtataatgcggcatttcatgacttcctcttgttacttttcaaggttattctaaagagatggagatcttcattagaggctatttctcataatagtctgccttgcttattttcatactccccctgaaataagcctacttttgcaaacaggccatatgaatcaaattttatgtttgttcctcactattgtaaatctgtgttttaaatattttataatagagcactaatggaaacctaataaatacaaacaagataactattacccaagataacatggaaatacttctgtttttgaagttaacaacaccgtctgccctcaaagcacatttaggagtatcaaccaagaccagccagttgacatgtttttctgtgtggcaacctgcccttaaattgtcagatcttaactatcttgtgtttgctgtgcttgcagccataagctttcctccttttttgcttatccctgctgtttgtagggttagtgtgccctctgtcagaaaattgggttttctttactatacctgcaaaattaccaagggttaccccaatattgtctagaggaattaaaaagaacttattctcagttgacaaaagtattactgttatacatagttaattggaaagttggccaactttggtcacctatttttgagtcttggctatgcctttgtaattagttacatataccttctgagaccttcagataatcaatgggcctttccccattagaggtaggttcccagcctacaagtatttcctgtgatccatggcaagcctccagagaaaagattcaagctttgcactgcccttttgttgattgtcattgaaaacttactttatttcagaaagtatcaaaaataccaaattggtctttcagagagtatgtaaatctggggcttgcccttggatttcacttgttaaacaccctcaaacttaaaagaagaaaatagatctccagctggtgaaaattttgtgccccaaataatatattaatccaagtctaccaaggtaactaagtaatggatgttttctctcttttattacaagcaagaaagttcatttgcagttgtaaaaatgattaccgaactccagacctatttgctataactgattggaaataatgattctgatttttagtctgggtaaacacatacttcggtgtgaattttgataagggaaagacttgtttggtagcccaaggaaaaacaggatgtatttatacagtgaatgttcactctgcagaggaacttccctccagttacatcttcctcatacattagccacctccacacttgacatagatgccaacatgtttcaaaaccaatcttgaaggagcctaaagagttgatggtcctctaggtgaaagacaagaattactgtattgcatttgcttatagggaggtgtgtttttgctaacttgaagggatatactgtatttcaaataagtgtgtgacttaatattttgggatttttttttcctcctttaaaaactggacctgaacacaagctttgagttgatgtttgtaataatctcaggacctgaaagattgtagcatttagtgtgtcttaaaaattatgtactgtaccagccatggatttttgtaaatatacctgtctcccttttttgtattttagtaaaaaaaaaaaaaataaatttaaataaaagggggtggtgatgacatgtgaatgggtgcgggtatgtgtgcgtgtgtgtttgtataaggctcttttgagatgaactggtgcttgtttaatttccagctcaaatcggagcaggaatatggacaaactgctgctactgaaccctgcactgagccgaggtatttccatttggttaactaaacgctagctaccaggaaatgacgcagaagtcacgttcttcttcccactgccatcttgcctttgcattctcagttctacgtgccctttgaactttaatggtaaaacatttcacactttggatggtttgcttgtctctagtttttagaaagctcttatcactccttcctaagaaaaaagaagggcaggtaaatttttttaaccaaaaaaaaatcacacatttcataaaaccctgatgaattttggatatgtgagagggcataaacattcctaaatatggacctgtgaatttagtaaattacccccatgaatatactccttcagtgcagggatttttgtgttttttttttttttttaatttttttgcaacagccttgctcatattccaggtgtagctagcaaacccctgtttttgaagcaagagccttatttgattcagtgtagatgtttcctgtctatcctttgtgacagggccttttaatgagtgttttttctttttgtatatgttacgtgtttgttgttgtattaaataaagaggaatgtacatactaaaatcgtgtc

SEQ ID NO: 43251 - DNA, 3501 bp, Homo sapiens
aatctctaatgatagggtgtgtgtgtgtgtgtgtgtgtgtgtgtgtgtgtctgtaagtcactttttggatttttgttgctttttccagataaggccttagtagcctctaaatatcaactatgcagataaacatactccttttttttttcacatgtccctgtcttttccattctcagataacaaatgttaagacccaaagaaataaggcataagggtttttgttgaatgtgtgtttgttcttctagggaaaattaacagaagcataaaatagagatactttgtgtgttcatctatcgtaaaatgtgaactctgtattcaaaaactatctacagatgctttcactggtgcaaagctgtagttagtatcatggaatgtctttgggttgttaatgataaaatcatcccagtgttcaattctgagagttttagattatatgacacaatgttcaggtttatagagctgaatgggtgatcaaactctaattatcattctttattcagagctcttaatcatattgctacactagaatatgaattgtatattaggagtctggggaggaaaggttaaattgtcttttacatcctcttctcactcactctggcaacctatcctgtgtccccatagaactgagaagtaaagccctgtgcaggcctgctttagaagactttacatcccagcagaggattcaggcagggactctcaggattttaatcagactgcctttgaataatgtgatattaaattttatttttctcatagactctcaaagtaccacttgcttgaaagtagctacttgtgatctttaatttccttatattgtgatagttctacttttcagtctttcctgtgtatctccatttcatagtgcgttagtacttaaacttcggacacttttccaaactgttaaacaagtcaggaatgcttttcagaatcgcagtagtattattagggtctctgtgtctaggacttacagtcatcagtggtcatcactgggactagaggtgttcttttttttcctcttctcctttgtattaaaaaatagattttgctactgtataatgcggcatttcatgacttcctcttgttacttttcaaggttattctaaagagatggagatcttcattagaggctatttctcataatagtctgccttgcttattttcatactccccctgaaataagcctacttttgcaaacaggccatatgaatcaaattttatgtttgttcctcacaaaattttctacacattatttgttcccactttgctaataataatataatgattttattgtaaatctgtgttttaaatattttataatagagcactaatggaaacctaataaatacaaacaagataactattacccaagataacatggaaatacttctgtttttgaagttaacaacaccgtctgccctcaaagcacatttaggagtatcaaccaagaccagccagttgacatgtttttctgtgtggcaacctgcccttaaattgtcagatcttaactatcttgtgtttgctgtgcttgcagccataagctttcctccttttttgcttatccctgctgtttgtagggttagtgtgccctctgtcagaaaattgggttttctttactatacctgcaaaattaccaagggttaccccaatattgtctagaggaattaaaaagaacttattctcagttgacaaaagtattactgttatacatagttaattggaaagttggccaactttggtcacctatttttgagtcttggctatgcctttgtaattagttacatataccttctgagaccttcagataatcaatgggcctttccccattagaggtaggttcccagcctacaagtatttcctgtgatccatggcaagcctccagagaaaagattcaagctttgcactgcccttttgttgattgtcattgaaaacttactttatttcagaaagtatcaaaaataccaaattggtctttcagagagtatgtaaatctggggcttgcccttggatttcacttgttaaacaccctcaaacttaaaagaagaaaatagatctccagctggtgaaaattttgtgccccaaataatatattaatccaagtctaccaaggtaactaagtaatggatgttttctctcttttattacaagcaagaaagttcatttgcagttgtaaaaatgattaccgaactccagacctatttgctataactgattggaaataatgattctgatttttagtctgggtaaacacatacttcggtgtgaattttgataagggaaagacttgtttggtagcccaaggaaaaacaggatgtatttatacagtgaatgttcactctgcagaggaacttccctccagttacatcttcctcatacattagccacctccacacttgacatagatgccaacatgtttcaaaaccaatcttgaaggagcctaaagagttgatggtcctctaggtgaaagacaagaattactgtattgcatttgcttatagggaggtgtgtttttgctaacttgaagggatatactgtatttcaaataagtgtgtgacttaatattttgggatttttttttcctcctttaaaaactggacctgaacacaagctttgagttgatgtttgtaataatctcaggacctgaaagattgtagcatttagtgtgtcttaaaaattatgtactgtaccagccatggatttttgtaaatatacctgtctcccttttttgtattttagtaaaaaaaaaaaaaataaatttaaataaaagggggtggtgatgacatgtgaatgggtgcgggtatgtgtgcgtgtgtgtttgtataaggctcttttgagatgaactggtgcttgtttaatttccagctcaaatcggagcaggaatatggacaaactgctgctactgaaccctgcactgagccgaggtatttccatttggttaactaaacgctagctaccaggaaatgacgcagaagtcacgttcttcttcccactgccatcttgcctttgcattctcagttctacgtgccctttgaactttaatggtaaaacatttcacactttggatggtttgcttgtctctagtttttagaaagctcttatcactccttcctaagaaaaaagaagggcaggtaaatttttttaaccaaaaaaaaatcacacatttcataaaaccctgatgaattttggatatgtgagagggcataaacattcctaaatatggacctgtgaatttagtaaattacccccatgaatatactccttcagtgcagggatttttgtgttttttttttttttttaatttttttgcaacagccttgctcatattccaggtgtagctagcaaacccctgtttttgaagcaagagccttatttgattcagtgtagatgtttcctgtctatcctttgtgacagggccttttaatgagtgttttttctttttgtatatgttacgtgtttgttgttgtattaaataaagaggaatgtacatactaaaatcgtgtc

SEQ ID NO: 43252 - DNA, 3497 bp, Homo sapiens
aatctctaatgatagggtgtgtgtgtgtgtgtgtgtgtgtgtgtgtgtgtctgtaagtcactttttggatttttgttgctttttccagataaggccttagtagcctctaaatatcaactatgcagataaacatactccttttttttttcacatgtccctgtcttttccattctcagataacaaatgttaagacccaaagaaataaggcataagggtttttgttgaatgtgtgtttgttcttctagggaaaattaacagaagcataaaatagagatactttgtgtgttcatctatcgtaaaatgtgaactctgtattcaaaaactatctacagatgctttcactggtgcaaagctgtagttagtatcatggaatgtctttgggttgttaatgataaaatcatcccagtgttcaattctgagagttttagattatatgacacaatgttcaggtttatagagctgaatgggtgatcaaactctaattaaaaatagctttgaatattaatgttgaattcttctttcttggtttcctttagtcttcattctttattcagagctcttaatcatattgctacactagaatatgaattgtatattaggagtctggggaggaaaggttaaattgtcttttacatcctcttctcactcactctggcaacctatcctgtgtccccatagaactgagaagtaaagccctgtgcaggcctgctttagaagactttacatcccagcagaggattcaggcagggactctcaggattttaatcagactgcctttgaataatgtgatattaaattttatttttctcatagactctcaaagtaccacttgcttgaaagtagctacttgtgatctttaatttccttatattgtgatagttctacttttcagtctttcctgtgtatctccatttcatagtgcgttagtacttaaacttcggacacttttccaaactgttaaacaagtcaggaatgcttttcagaatcgcagtagtattattagggtctctgtgtctaggacttacagtcatcagtggtcatcactgggactagaggtgttcttttttttcctcttctcctttgtattaaaaaatagattttgctactgtataatgcggcatttcatgacttcctcttgttacttttcaaggttattctaaagagatggagatcttcattagaggctatttctcataatagtctgccttgcttattttcatactccccctgaaataagcctacttttgcaaacaggccatatgaatcaaattttatgtttgttcctcacaaaattttctacacattatttgttcccactttgctaataataatataatgattttattgtaaatctgtgttttaaatattttataatagagcactaatggaaacctaataaatacaaacaagataactattacccaagataacatggaaatacttctgtttttgaagttaacaacaccgtctgccctcaaagcacatttaggagtatcaaccaagaccagccagttgacatgtttttctgtgtggcaacctgcccttaaattgtcagatcttaactatcttgtgtttgctgtgcttgcagccataagctttcctccttttttgcttatccctgctgtttgtagggttagtgtgccctctgtcagaaaattgggttttctttactatacctgcaaaattaccaagggttaccccaatattgtctagaggaattaaaaagaacttattctcagttgacaaaagtattactgttatacatagttaattggaaagttggccaactttggtcacctatttttgagtcttggctatgcctttgtaattagttacatataccttctgagaccttcagataatcaatgggcctttccccattagaggtaggttcccagcctacaagtatttcctgtgatccatggcaagcctccagagaaaagattcaagctttgcactgcccttttgttgattgtcattgaaaacttactttatttcagaaagtatcaaaaataccaaattggtctttcagagagtatgtaaatctggggcttgcccttggatttcacttgttaaacaccctcaaacttaaaagaagaaaatagatctccagctggtgaaaattttgtgccccaaataatatattaatccaagtctaccaaggtaactaagtaatggatgttttctctcttttattacaagcaagaaagttcatttgcagttgtaaaaatgattaccgaactccagacctatttgctataactgattggaaataatgattctgatttttagtctgggtaaacacatacttcggtgtgaattttgataagggaaagacttgtttggtagcccaaggaaaaacaggatgtatttatacagtgaatgttcactctgcagaggaacttccctccagttacatcttcctcatacattagccacctccacacttgacatagatgccaacatgtttcaaaaccaatcttgaaggagcctaaagagttgatggtcctctaggtgaaagacaagaattactgtattgcatttgcttatagggaggtgtgtttttgctaacttgaagggatatactgtatttcaaataagtgtgtgacttaatattttgggatttttttttcctcctttaaaaactggacctgaacacaagctttgagttgatgtttgtaataatctcaggacctgaaagattgtagcatttagtgtgtcttaaaaattatgtactgtaccagccatggatttttgtaaatatacctgtctcccttttttgtattttagtaaaaaaaaaaaaaataaatttaaataaaagggggtggtgatgacatgtgaatgggtgcgggtatgtgtgcgtgtgtgtttgtataaggctcttttgagatgaactggtgcttgtttaatttccagctcaaatcggagcaggaatatggacaaactgctgctactgaaccctgcactgagccgaggtatttccatttggttaactaaacgctagctaccaggaaatgacgcagaagtcacgttcttcttcccactgccatcttgcctttgcattctcagttctacgtgccctttgaactttaatggtaaaacatttcacactttggatggtttgcttgtctctagtttttagaaagctcttatcactccttcctaagaaaaaagaagggcaggtaaatttttttaaccaaaaattcctaaatatggacctgtgaatttagtaaattacccccatgaatatactccttcagtgcagggatttttgtgttttttttttttttttaatttttttgcaacagccttgctcatattccaggtgtagctagcaaacccctgtttttgaagcaagagccttatttgattcagtgtagatgtttcctgtctatcctttgtgacagggccttttaatgagtgttttttctttttgtatatgttacgtgtttgttgttgtattaaataaagaggaatgtacatactaaaatcgtgtc

SEQ ID NO: 43253 - DNA, 1203 bp, Homo sapiens
gctcgcacccatagctacaccgtacggtgaatgttcactctgcagaggaacttccctccagttacatcttcctcatacattagccacctccacacttgacatagatgccaacatgtttcaaaaccaatcttgaaggagcctaaagagttgatggtcctctaggtgaaagacaagaattactgtattgcatttgcttatagggaggtgtgtttttgctaacttgaagggatatactgtatttcaaataagtgtgtgacttaatattttgggatttttttttcctcctttaaaaactggacctgaacacaagctttgagttgatgtttgtaataatctcaggacctgaaagattgtagcatttagtgtgtcttaaaaattatgtactgtaccagccatggatttttgtaaatatacctgtctcccttttttgtattttagtaaaaaaaaaaaaaataaatttaaataaaagggggtggtgatgacatgtgaatgggtgcgggtatgtgtgcgtgtgtgtttgtataaggctcttttgagatgaactggtgcttgtttaatttccagctcaaatcggagcaggaatatggacaaactgctgctactgaaccctgcactgagccgaggtatttccatttggttaactaaacgctagctaccaggaaatgacgcagaagtcacgttcttcttcccactgccatcttgcctttgcattctcagttctacgtgccctttgaactttaatggtaaaacatttcacactttggatggtttgcttgtctctagtttttagaaagctcttatcactccttcctaagaaaaaagaagggcaggtaaatttttttaaccaaaaaaaaatcacacatttcataaaaccctgatgaattttggatatgtgagagggcataaacattcctaaatatggacctgtgaatttagtaaattacccccatgaatatactccttcagtgcagggatttttgtgttttttttttttttttaatttttttgcaacagccttgctcatattccaggtgtagctagcaaacccctgtttttgaagcaagagccttatttgattcagtgtagatgtttcctgtctatcctttgtgacagggccttttaatgagtgttttttctttttgtatatgttacgtgtttgttgttgtattaaataaagaggaatgtacatactaaaatcgtgtc

SEQ ID NO: 43254 - DNA, 343 bp, Homo sapiens
aaacttcccattaaggactgtatactctaggtgaactgaattaccttccgttcactatgcccagaatacagttttctagaaactctctgtctctgtgatattcacgtcatgtaggtttcctatgtccacgactttgaaattctaaatctaatccataatttaaggttcagttaagttgccaccctcttcaaataggcttcctggaataccacaactaaaagtaaaatctctgccattgaactttattttcatataccaagattctactacagtgctaaaacataattatgactatgggctagtcacaggggcttatgcctataatcccagccctttgggaggc

SEQ ID NO: 43255 - DNA, 950 bp, Homo sapiens
cggcacgaggaaggctttttgaggtgagaggcccaggtggtcctggcaaccctgagtagaaggagagacggggtagggaacgggcccggccagaaaagaaccatttcttctgccatcttttatgcaccatagacatcgagactccagggggtcctggctcccctgtccctgcagccctgcaggtcagtgcatgatctgggttcgtgtcctgaccaggtgctcctcctttgatccgaggggaaagggactggtttatagaaagagcctaggagacaaaagggccagtccccctgcccagaatggagcagcagcaggacagacccccacgaggccccccagagaggaggaagatcccacggaggaacacatgaggttagggacccttgttcagcaccccaaacagcctgcctgtttaaagcaggcagcaggcttaggccttccctgcaaccccaacacccacaagtttgtttctctaggaaacacattcactgtctcagctggctgttactctctcagaccatatggcaaagttttccaagaaaatgccccgacaggggtgcccagcacactgcctgagggacaacagacatcagaacaaacccccagagagaaacagtcaaaatcagggcccggtgcagtgttgtcatgtggaacctgctttatccattgctgagtgttgaatgtgggtaatggttagggctttccagatctcagcagccaaagacagttattgttggaagactgtcatgtagataaccatgagcaatggctcgcctcagaatcagttcataaaattctatggtactggccccttcgtgggtattgtgtgaaatgagatggtggcgaggggtgcgctgtggaactgccgcagccacgcaggaggtccctgggggatgctttgggaagtccttgcccctgagcactgcctgattgccagggcctgtggaggt

SEQ ID NO: 43256 - DNA, 360 bp, Homo sapiens
gatgaacaagacaaggatattcactcttgccacttctattcaacaatatactaggggctctaaccagggcaattagcaagaaaatgaaattaaaggcctacagatgaaaaaggaagcactaaaagcatctctatttgcagatgatatgatcacttatatagaaaatcctaaggaatccactaaaaacccactgtaactaataaacaagtgcagcaaggttggaagatacaagatcaatatataaaaatcgactgcatttctatacagtagcagtaatgaaccaaaataaattaagaaaatccatttacaacaggataaaaaattaaatattttgaaataaatttaacaaagagcattgta

SEQ ID NO: 43257 - DNA, 286 bp, Homo sapiens
tgtttctgacctttgataagaaagaagaaatgttagttattgaaccacagaagccccaccaggtactaacttactgcatttttgcttttaattatctatatatgtctgtctgggacactagacttaccctccttaagagtaaaggctgttccttgtgtttgtgtatccagtatccagtactccaagggaaagatggtgtttagtcatgagtatctgcttgtgggacacatgtggtaacctagtgtgaagtgggtgtggatgagggctggatgatgtgagaagagaa

SEQ ID NO: 43258 - DNA, 1867 bp, Homo sapiens
ggtcaaaggcctgcgtcagttgcactgtagcctcggcagtgaaccgggaggtactaccaggtcgccgtcgttgctccgctcgctctgagagagcatggccctgagaggcgtctccgtgcggctgctgagccgcggacccggcctgcacgtccttcgcacgtgggtctcgtcggcggcgcagaccgagaaaggcgggagaacacagagccaactggctaagtcctcgcgtcccgagtttgactggcaggacccgctggtgctggaggagcagctgaccacagatgagatcctcatcagggacaccttccgcacctactgccaggagagactcatgcctcgcatcctgttggccaatcgcaacgaagtttttcatcgggagatcatttcggagatgggggagttgggtgtgctgggccccaccatcaaaggatatggctgtgctggggtttcgtctgtggcctatgggctcctggcccgagagctggagcgggtggacagtggctacaggtcggcgatgagtgtccagtcctccctcgtcatgcaccctatctatgcctatggcagcgaggaacagcggcagaagtacctgccccagctggccaagggggagctcctgggctgcttcgggctcacagagcccaacagcggaagtgaccccagcagcatggagaccagagcccactacaactcatccaacaagagctacaccctcaatgggaccaagacctggatcacgaactcgcctatggccgatctgtttgtagtgtgggctcggtgtgaagatggctgcattcggggcttcctgctggagaaggggatgcggggtctctcggcccccaggatccagggcaagttctcgctgcgggcctcagccacaggcatgatcatcatggacggtgtggaggtgccagaggagaatgtgctccctggtgcatccagcctggggggtcccttcggctgcctgaacaacgcccggtacggcatcgcgtggggcgtgcttggagcttcggagttctgcttgcacacagcccggcagtacgccctcgacaggatgcagtttggtgtcccactggccaggaaccagctgattcagaagaagctggcagacatgctcactgagattaccctgggccttcacgcctgcctgcagctcggccgcttgaaggaccaggacaaggctgcccccgagatggtttctctgctgaagaggaataactgtgggaaagccctggacatcgcccgccaggcccgagacatgctggggggtaatgggatttctgacgagtatcacgtgatccggcacgccatgaacctggaggccgtgaacacctacgaaggtacacatgacattcacgccctgatccttgggagagctatcacgggaatccaggcgttcacggccagcaagtgagccgctccatcaggggcccgaaactctcaagcccctttctggagagatgcctggctggaccgtaggagcgctgtgctctgagcttagaaagggaggtggcggatggagtgggaagtgagagacactgatttttaaatatcaaaatttcccttctgaagtcgttcggatgtgttccttaaaaagaagatggaattctctgtagagcgtctcaatccacttttaaccatggatgagagcagactccatttaccctgaaatagcagcttctcttgagaggagagtgacatggaagcaactccgtctgctgcagctgaccccctcacactgagttcacagtgcgccctccctccctcccatctgggggtagtgccttatgctgggtgttggagcagagtgagggagaggaaaataaagacctgcacatctgaccccaaggtgtcaggccggtttactggt

SEQ ID NO: 43259 - DNA, 984 bp, Homo sapiens
ggtcaaaggcctgcgtcagttgcactgtagcctcggcagtgaaccgggaggtactaccaggtcgccgtcgttgctccgctcgctctgagagagcatggccctgagaggcgtctccgtgcggctgctgagccgcggacccggcctgcacgtccttcgcacgtgggtctcgtcggcggcgcagaccgagaaaggcgggagaacacagagccaactggctaagtcctcgcgtcccgagtttgactggcaggacccgctggtgctggaggagcagctgaccacagatgagatcctcatcagggacaccttccgcacctactgccaggagagactcatgcctcgcatcctgttggccaatcgcaacgaagtttttcatcgggagatcatttcggagatgggggagttgggtgtgctgggccccaccatcaaaggatatggctgtgctggggtttcgtctgtggcctatgggctcctggcccgagagctggagcgggtggacagtggctacaggtcggcgatgagtgtccagtcctccctcgtcatgcaccctatctatgcctatggcagcgaggaacagcggcagaagtacctgccccagctgggtgagtggcttcccatggggcctggtggaaggaagacagtctctgaggtctggaactcaagggtggggctgtcccctgagcctattctgtccctatctcaaagatagcataagtggccacctggacccccgccagaccctgggcttcacctggagatctgatccctggccagcctgactgtccccctctgtgaccaccgtcatctccctatgctttctgtgttccccagtccagcccaaagtttaaagtccaccaggttcctgctggccatttgcagtggctcacacctataatcccagcactttgggagggtgaagtgagaagatcccttgagcccaagagttcgaaaccagcctgggcaacgtaaggagaccccatgtctatt

SEQ ID NO: 43260 - DNA, 1935 bp, Homo sapiens
ggtcaaaggcctgcgtcagttgcactgtagcctcggcagtgaaccgggaggtactaccaggtaaggaaggtgcggtggccccagccgtgggtgagaggagctccgctctgacacccccgctcctgtaggtcgccgtcgttgctccgctcgctctgagagagcatggccctgagaggcgtctccgtgcggctgctgagccgcggacccggcctgcacgtccttcgcacgtgggtctcgtcggcggcgcagaccgagaaaggcgggagaacacagagccaactggctaagtcctcgcgtcccgagtttgactggcaggacccgctggtgctggaggagcagctgaccacagatgagatcctcatcagggacaccttccgcacctactgccaggagagactcatgcctcgcatcctgttggccaatcgcaacgaagtttttcatcgggagatcatttcggagatgggggagttgggtgtgctgggccccaccatcaaaggatatggctgtgctggggtttcgtctgtggcctatgggctcctggcccgagagctggagcgggtggacagtggctacaggtcggcgatgagtgtccagtcctccctcgtcatgcaccctatctatgcctatggcagcgaggaacagcggcagaagtacctgccccagctggccaagggggagctcctgggctgcttcgggctcacagagcccaacagcggaagtgaccccagcagcatggagaccagagcccactacaactcatccaacaagagctacaccctcaatgggaccaagacctggatcacgaactcgcctatggccgatctgtttgtagtgtgggctcggtgtgaagatggctgcattcggggcttcctgctggagaaggggatgcggggtctctcggcccccaggatccagggcaagttctcgctgcgggcctcagccacaggcatgatcatcatggacggtgtggaggtgccagaggagaatgtgctccctggtgcatccagcctggggggtcccttcggctgcctgaacaacgcccggtacggcatcgcgtggggcgtgcttggagcttcggagttctgcttgcacacagcccggcagtacgccctcgacaggatgcagtttggtgtcccactggccaggaaccagctgattcagaagaagctggcagacatgctcactgagattaccctgggccttcacgcctgcctgcagctcggccgcttgaaggaccaggacaaggctgcccccgagatggtttctctgctgaagaggaataactgtgggaaagccctggacatcgcccgccaggcccgagacatgctggggggtaatgggatttctgacgagtatcacgtgatccggcacgccatgaacctggaggccgtgaacacctacgaaggtacacatgacattcacgccctgatccttgggagagctatcacgggaatccaggcgttcacggccagcaagtgagccgctccatcaggggcccgaaactctcaagcccctttctggagagatgcctggctggaccgtaggagcgctgtgctctgagcttagaaagggaggtggcggatggagtgggaagtgagagacactgatttttaaatatcaaaatttcccttctgaagtcgttcggatgtgttccttaaaaagaagatggaattctctgtagagcgtctcaatccacttttaaccatggatgagagcagactccatttaccctgaaatagcagcttctcttgagaggagagtgacatggaagcaactccgtctgctgcagctgaccccctcacactgagttcacagtgcgccctccctccctcccatctgggggtagtgccttatgctgggtgttggagcagagtgagggagaggaaaataaagacctgcacatctgaccccaaggtgtcaggccggtttactggt

SEQ ID NO: 43261 - DNA, 2175 bp, Homo sapiens
ggtcaaaggcctgcgtcagttgcactgtagcctcggcagtgaaccgggaggtactaccaggtcgccgtcgttgctccgctcgctctgagagagcatggccctgagaggcgtctccgtgcggctgctgagccgcggacccggcctgcacgtccttcgcacgtgggtctcgtcggcggcgcagaccgagaaaggcgggagaacacagagccaactggctaagtgtaaggacctctggtcgcaccgtgtgtctgctgcccctgttcagctgtctgtctgccgcaggtcgactctgtcccagaatccgagagctgcccgagcggggtggcagggtcgtggccagggtcagaggcactaaggcagtgagtgcgctgtgcctgcggggccggagaaaagtcacctgatcagtctcgcttgcagctcgcactagccggggggcgacatgggtgttggggggtagggctgatgagggtccgagaagggagggcacagtgatcttgcggactggaccgaggcgaattccccttcccagcctcgcgtcccgagtttgactggcaggacccgctggtgctggaggagcagctgaccacagatgagatcctcatcagggacaccttccgcacctactgccaggagagactcatgcctcgcatcctgttggccaatcgcaacgaagtttttcatcgggagatcatttcggagatgggggagttgggtgtgctgggccccaccatcaaaggatatggctgtgctggggtttcgtctgtggcctatgggctcctggcccgagagctggagcgggtggacagtggctacaggtcggcgatgagtgtccagtcctccctcgtcatgcaccctatctatgcctatggcagcgaggaacagcggcagaagtacctgccccagctggccaagggggagctcctgggctgcttcgggctcacagagcccaacagcggaagtgaccccagcagcatggagaccagagcccactacaactcatccaacaagagctacaccctcaatgggaccaagacctggatcacgaactcgcctatggccgatctgtttgtagtgtgggctcggtgtgaagatggctgcattcggggcttcctgctggagaaggggatgcggggtctctcggcccccaggatccagggcaagttctcgctgcgggcctcagccacaggcatgatcatcatggacggtgtggaggtgccagaggagaatgtgctccctggtgcatccagcctggggggtcccttcggctgcctgaacaacgcccggtacggcatcgcgtggggcgtgcttggagcttcggagttctgcttgcacacagcccggcagtacgccctcgacaggatgcagtttggtgtcccactggccaggaaccagctgattcagaagaagctggcagacatgctcactgagattaccctgggccttcacgcctgcctgcagctcggccgcttgaaggaccaggacaaggctgcccccgagatggtttctctgctgaagaggaataactgtgggaaagccctggacatcgcccgccaggcccgagacatgctggggggtaatgggatttctgacgagtatcacgtgatccggcacgccatgaacctggaggccgtgaacacctacgaaggtacacatgacattcacgccctgatccttgggagagctatcacgggaatccaggcgttcacggccagcaagtgagccgctccatcaggggcccgaaactctcaagcccctttctggagagatgcctggctggaccgtaggagcgctgtgctctgagcttagaaagggaggtggcggatggagtgggaagtgagagacactgatttttaaatatcaaaatttcccttctgaagtcgttcggatgtgttccttaaaaagaagatggaattctctgtagagcgtctcaatccacttttaaccatggatgagagcagactccatttaccctgaaatagcagcttctcttgagaggagagtgacatggaagcaactccgtctgctgcagctgaccccctcacactgagttcacagtgcgccctccctccctcccatctgggggtagtgccttatgctgggtgttggagcagagtgagggagaggaaaataaagacctgcacatctgaccccaaggtgtcaggccggtttactggt

SEQ ID NO: 43262 - DNA, 1831 bp, Homo sapiens
ggtcaaaggcctgcgtcagttgcactgtagcctcggcagtgaaccgggaggtactaccaggtcgccgtcgttgctccgctcgctctgagagagcatggccctgagaggcgtctccgtgcggctgctgagccgcggacccggcctgcacgtccttcgcacgtgggtctcgtcggcggcgcagaccgcctcgcgtcccgagtttgactggcaggacccgctggtgctggaggagcagctgaccacagatgagatcctcatcagggacaccttccgcacctactgccaggagagactcatgcctcgcatcctgttggccaatcgcaacgaagtttttcatcgggagatcatttcggagatgggggagttgggtgtgctgggccccaccatcaaaggatatggctgtgctggggtttcgtctgtggcctatgggctcctggcccgagagctggagcgggtggacagtggctacaggtcggcgatgagtgtccagtcctccctcgtcatgcaccctatctatgcctatggcagcgaggaacagcggcagaagtacctgccccagctggccaagggggagctcctgggctgcttcgggctcacagagcccaacagcggaagtgaccccagcagcatggagaccagagcccactacaactcatccaacaagagctacaccctcaatgggaccaagacctggatcacgaactcgcctatggccgatctgtttgtagtgtgggctcggtgtgaagatggctgcattcggggcttcctgctggagaaggggatgcggggtctctcggcccccaggatccagggcaagttctcgctgcgggcctcagccacaggcatgatcatcatggacggtgtggaggtgccagaggagaatgtgctccctggtgcatccagcctggggggtcccttcggctgcctgaacaacgcccggtacggcatcgcgtggggcgtgcttggagcttcggagttctgcttgcacacagcccggcagtacgccctcgacaggatgcagtttggtgtcccactggccaggaaccagctgattcagaagaagctggcagacatgctcactgagattaccctgggccttcacgcctgcctgcagctcggccgcttgaaggaccaggacaaggctgcccccgagatggtttctctgctgaagaggaataactgtgggaaagccctggacatcgcccgccaggcccgagacatgctggggggtaatgggatttctgacgagtatcacgtgatccggcacgccatgaacctggaggccgtgaacacctacgaaggtacacatgacattcacgccctgatccttgggagagctatcacgggaatccaggcgttcacggccagcaagtgagccgctccatcaggggcccgaaactctcaagcccctttctggagagatgcctggctggaccgtaggagcgctgtgctctgagcttagaaagggaggtggcggatggagtgggaagtgagagacactgatttttaaatatcaaaatttcccttctgaagtcgttcggatgtgttccttaaaaagaagatggaattctctgtagagcgtctcaatccacttttaaccatggatgagagcagactccatttaccctgaaatagcagcttctcttgagaggagagtgacatggaagcaactccgtctgctgcagctgaccccctcacactgagttcacagtgcgccctccctccctcccatctgggggtagtgccttatgctgggtgttggagcagagtgagggagaggaaaataaagacctgcacatctgaccccaaggtgtcaggccggtttactggt

SEQ ID NO: 43263 - DNA, 1784 bp, Homo sapiens
ggtcaaaggcctgcgtcagttgcactgtagcctcggcagtgaaccgggaggtactaccaggtcgccgtcgttgctccgctcgctctgagagagcatggccctgagaggcgtctccgtgcggctgctgagccgcggacccggcctgcacgtccttcgcacgtgggtctcgtcggcggcgcagaccgagaaaggcgggagaacacagagccaactggctaagtcctcgcgtcccgagtttgactggcaggacccgctggtgctggaggagcagctgaccacagatgagatcctcatcagggacaccttccgcacctactgccaggagagactcatgcctcgcatcctgttggccaatcgcaacgaagtttttcatcgggagatcatttcggagatgggggagttgggtgtgctgggccccaccatcaaaggatatggctgtgctggggtttcgtctgtggcctatgggctcctggcccgagagctggagcgggtggacagtggctacaggtcggcgatgagtgtccagtcctccctcgtcatgcaccctatctatgcctatggcagcgaggaacagcggcagaagtacctgccccagctggccaagggggagctcctgggctgcttcgggctcacagagcccaacagcggaagtgaccccagcagcatggagaccagagcccactacaactcatccaacaagagctacaccctcaatgggaccaagacctgtgtgggctcggtgtgaagatggctgcattcggggcttcctgctggagaaggggatgcggggtctctcggcccccaggatccagggcaagttctcgctgcgggcctcagccacaggcatgatcatcatggacggtgtggaggtgccagaggagaatgtgctccctggtgcatccagcctgggggtgcttggagcttcggagttctgcttgcacacagcccggcagtacgccctcgacaggatgcagtttggtgtcccactggccaggaaccagctgattcagaagaagctggcagacatgctcactgagattaccctgggccttcacgcctgcctgcagctcggccgcttgaaggaccaggacaaggctgcccccgagatggtttctctgctgaagaggaataactgtgggaaagccctggacatcgcccgccaggcccgagacatgctggggggtaatgggatttctgacgagtatcacgtgatccggcacgccatgaacctggaggccgtgaacacctacgaaggtacacatgacattcacgccctgatccttgggagagctatcacgggaatccaggcgttcacggccagcaagtgagccgctccatcaggggcccgaaactctcaagcccctttctggagagatgcctggctggaccgtaggagcgctgtgctctgagcttagaaagggaggtggcggatggagtgggaagtgagagacactgatttttaaatatcaaaatttcccttctgaagtcgttcggatgtgttccttaaaaagaagatggaattctctgtagagcgtctcaatccacttttaaccatggatgagagcagactccatttaccctgaaatagcagcttctcttgagaggagagtgacatggaagcaactccgtctgctgcagctgaccccctcacactgagttcacagtgcgccctccctccctcccatctgggggtagtgccttatgctgggtgttggagcagagtgagggagaggaaaataaagacctgcacatctgaccccaaggtgtcaggccggtttactggt

SEQ ID NO: 43264 - DNA, 252 bp, Homo sapiens
gtcgccgtcgttgctccgctcgctctgagagagcatggccctgagaggcgtctccgtgcggctgctgagccgcggacccggcctgcacgtccttcgcacgtgggtctcgtcggcggcgcagaccggtcagtgtggggtcgggagtgtggagggaaggagggaggaactgggggtttagggactttccggggtgactttcccgttctgtgcttgcagagaaaggcgggagaacacagagccaactggctaagt

SEQ ID NO: 43265 - DNA, 1635 bp, Homo sapiens
ggtcaaaggcctgcgtcagttgcactgtagcctcggcagtgaaccgggaggtactaccaggtcgccgtcgttgctccgctcgctctgagagagcatggccctgagaggcgtctccgtgcggctgctgagccgcggacccggcctgcacgtccttcgcacgtgggtctcgtcggcggcgcagaccgagaaaggcgggagaacacagagccaactggctaagtcctcgcgtcccgagtttgactggcaggacccgctggtgctggaggagcagctgaccacagatgagatcctcatcagggacaccttccgcacctactgccaggagagactcatgcctcgcatcctgttggccaatcgcaacgaagtttttcatcgggagatcatttcggagatgggggagttgggtgtgctgggccccaccatcaaaggatatggctgtgctggggtttcgtctgtggcctatgggctcctggcccgagagctggagcgggtggacagtggctacaggtcggcgatgagtgtccagtcctccctcgtcatgcaccctatctatgcctatggcagcgaggaacagcggcagaagtacctgccccagctggccaagggggagctcctgggctgcttcgggctcacagagcccaacagcggaagtgaccccagcagcatggagaccagagcccactacaactcatccaacaagagctacaccctcaatgggaccaagacctggatcacgaactcgcctatggccgatctgtttgtagtgtgggctcggtgtgaagatggctgcattcggggcttcctgctggagaaggggatgcggggtctctcggcccccaggatccagggcaagttctcgctgcgggcctcagccacaggcatgatcatcatggacggtgtggaggtgccagaggagaatgtgctccctggtgcatccagcctggggggtcccttcggctgcctgaacaacgcccggtacggcatcgcgtggggcgtgcttggagcttcggagttctgcttgcacacagcccggcagtacgccctcgacaggatgcagtttggtgtcccactggccaggaaccagctgattcagaagaagctggcagacatgctcactgagattaccctgggccttcacgcctgcctgcagctcggccgcttgaaggaccaggacaaggctgcccccgagatggtttctctgctgaagaggaataactgtgggaaagccctggacatcgcccgccaggcccgagacatgctggggggtaatgggatttctgacgagtatcacgtgatccggcacgccatgaacctggaggccgtgaacacctacgaagtcgttcggatgtgttccttaaaaagaagatggaattctctgtagagcgtctcaatccacttttaaccatggatgagagcagactccatttaccctgaaatagcagcttctcttgagaggagagtgacatggaagcaactccgtctgctgcagctgaccccctcacactgagttcacagtgcgccctccctccctcccatctgggggtagtgccttatgctgggtgttggagcagagtgagggagaggaaaataaagacctgcacatctgaccccaaggtgtcaggccggtttactggt

SEQ ID NO: 43266 - DNA, 2141 bp, Homo sapiens
ggtcaaaggcctgcgtcagttgcactgtagcctcggcagtgaaccgggaggtactaccaggtcgccgtcgttgctccgctcgctctgagagagcatggccctgagaggcgtctccgtgcggctgctgagccgcggacccggcctgcacgtccttcgcacgtgggtctcgtcggcggcgcagaccgagaaaggcgggagaacacagagccaactggctaagtcctcgcgtcccgagtttgactggcaggacccgctggtgctggaggagcagctgaccacagatgagatcctcatcagggacaccttccgcacctactgccaggagagactcatgcctcgcatcctgttggccaatcgcaacgaagtttttcatcgggagatcatttcggagatgggggagttgggtgtgctgggccccaccatcaaaggatatggctgtgctggggtttcgtctgtggcctatgggctcctggcccgagagctggagcgggtggacagtggctacaggtcggcgatgagtgtccagtcctccctcgtcatgcaccctatctatgcctatggcagcgaggaacagcggcagaagtacctgccccagctggccaagggggagctcctgggctgcttcgggctcacagagcccaacagcggaagtgaccccagcagcatggagaccagagcccactacaactcatccaacaagagctacaccctcaatgggaccaagacctggatcacgaactcgcctatggccgatctgtttgtagtgtgggctcggtgtgaagatggctgcattcggggcttcctgctggagaaggggatgcggggtctctcggcccccaggatccagggcaagttctcgctgcgggcctcagccacaggcatgatcatcatggacggtgtggaggtgccagaggagaatgtgctccctggtgcatccagcctggggggtcccttcggctgcctgaacaacgcccggtacggcatcgcgtggggcgtgcttggagcttcggagttctgcttgcacacagcccggcagtacgccctcgacaggatgcagtttggtgtcccactggccaggaaccagctgattcagaagaagctggcagacatgctcactgagattaccctgggccttcacgcctgcctgcagctcggccgcttgaaggaccaggacaagtaggggctgtgtggtgggggcggggggatggcagcggtggctggaggaccttgtgtccttcctggagagaaaggtccttcctgcctggtggccctggggacctgaaccttctgctgtccctcttgtccttgatgggctgggctgaggacagccccactggtccctcattgggagcttggctgcatcagggaatccccaccccgggctaggtttgcttggagcatcgggatgccaggatccccagtccttgttaccctcatgtgccactcccagggctgcccccgagatggtttctctgctgaagaggaataactgtgggaaagccctggacatcgcccgccaggcccgagacatgctggggggtaatgggatttctgacgagtatcacgtgatccggcacgccatgaacctggaggccgtgaacacctacgaaggtacacatgacattcacgccctgatccttgggagagctatcacgggaatccaggcgttcacggccagcaagtgagccgctccatcaggggcccgaaactctcaagcccctttctggagagatgcctggctggaccgtaggagcgctgtgctctgagcttagaaagggaggtggcggatggagtgggaagtgagagacactgatttttaaatatcaaaatttcccttctgaagtcgttcggatgtgttccttaaaaagaagatggaattctctgtagagcgtctcaatccacttttaaccatggatgagagcagactccatttaccctgaaatagcagcttctcttgagaggagagtgacatggaagcaactccgtctgctgcagctgaccccctcacactgagttcacagtgcgccctccctccctcccatctgggggtagtgccttatgctgggtgttggagcagagtgagggagaggaaaataaagacctgcacatctgaccccaaggtgtcaggccggtttactggt

SEQ ID NO: 43267 - DNA, 1620 bp, Homo sapiens
ggtcaaaggcctgcgtcagttgcactgtagcctcggcagtgaaccgggaggtactaccaggtcgccgtcgttgctccgctcgctctgagagagcatggccctgagaggcgtctccgtgcggctgctgagccgcggacccggcctgcacgtccttcgcacgtgggtctcgtcggcggcgcagaccgagaaaggcgggagaacacagagccaactggctaagtcctcgcgtcccgagtttgactggcaggacccgctggtgctggaggagcagctgaccacagatgagatcctcatcagggacaccttccgcacctactgccaggagagactcatgcctcgcatcctgttggccaatcgcaacgaagtttttcatcgggagatcatttcggagatgggggagttgggtgtgctgggccccaccatcaaaggatatggctgtgctggggtttcgtctgtggcctatgggctcctggcccgagagctggagcgggtggacagtggctacaggtcggcgatgagtgtccagtcctccctcgtcatgcaccctatctatgcctatggcagcgaggaacagcggcagaagtacctgccccagctggccaagggggagctcctgggctgcttcgggctcacagagcccaacagcggaagtgaccccagcagcatggagaccagagcccactacaactcatccaacaagagctacaccctcaatgggaccaagacctggatcacgaactcgcctatggccgatctgtttgtagtgtgggctcggtgtgaagatggctgcattcggggcttcctgctggagaaggggatgcggggtctctcggcccccaggatccagggcaagttctcgctgcgggcctcagccacaggcatgatcttcacgcctgcctgcagctcggccgcttgaaggaccaggacaaggctgcccccgagatggtttctctgctgaagaggaataactgtgggaaagccctggacatcgcccgccaggcccgagacatgctggggggtaatgggatttctgacgagtatcacgtgatccggcacgccatgaacctggaggccgtgaacacctacgaaggtacacatgacattcacgccctgatccttgggagagctatcacgggaatccaggcgttcacggccagcaagtgagccgctccatcaggggcccgaaactctcaagcccctttctggagagatgcctggctggaccgtaggagcgctgtgctctgagcttagaaagggaggtggcggatggagtgggaagtgagagacactgatttttaaatatcaaaatttcccttctgaagtcgttcggatgtgttccttaaaaagaagatggaattctctgtagagcgtctcaatccacttttaaccatggatgagagcagactccatttaccctgaaatagcagcttctcttgagaggagagtgacatggaagcaactccgtctgctgcagctgaccccctcacactgagttcacagtgcgccctccctccctcccatctgggggtagtgccttatgctgggtgttggagcagagtgagggagaggaaaataaagacctgcacatctgaccccaaggtgtcaggccggtttactggt

SEQ ID NO: 43268 - DNA, 1978 bp, Homo sapiens
ggtcaaaggcctgcgtcagttgcactgtagcctcggcagtgaaccgggaggtactaccaggtcgccgtcgttgctccgctcgctctgagagagcatggccctgagaggcgtctccgtgcggctgctgagccgcggacccggcctgcacgtccttcgcacgtgggtctcgtcggcggcgcagaccgagaaaggcgggagaacacagagccaactggctaagtcctcgcgtcccgagtttgactggcaggacccgctggtgctggaggagcagctgaccacagatgagatcctcatcagggacaccttccgcacctactgccaggagagactcatgcctcgcatcctgttggccaatcgcaacgaagtttttcatcgggagatcatttcggagatgggggagttgggtgtgctgggccccaccatcaaaggatatggctgtgctggggtttcgtctgtggcctatgggctcctggcccgagagctggagcgggtggacagtggctacaggtcggcgatgagtgtccagtcctccctcgtcatgcaccctatctatgcctatggcagcgaggaacagcggcagaagtacctgccccagctggccaagggggagctcctgggctgcttcgggctcacagagcccaacagcggaagtgaccccagcagcatggagaccagagcccactacaactcatccaacaagagctacaccctcaatgggaccaagacctggatcacgaactcgcctatggccgatctgtttgtagtgtgggctcggtgtgaagatggctgcattcggggcttcctgctggagaaggggatgcggggtctctcggcccccaggatccagggcaagttctcgctgcgggcctcagccacaggcatgatcatcatggacggtgtggaggtgccagaggagaatgtgctccctggtgcatccagcctggggggtcccttcggctgcctgaacaacgcccggtacggcatcgcgtggggcgtgcttggagcttcggagttctgcttgcacacagcccggcagtacgccctcgacaggatgcagtttggtgtcccactggccaggaaccagctgattcagaagaagctggcagacatgctcactgagattaccctgggccttcacgcctgcctgcagctcggccgcttgaaggaccaggacaaggctgcccccgagatggtttctctgctgaagaggaataactgtgggaaagccctggacatcgcccgccaggcccgagacatgctggggggtaatgggatttctgacgagtatcacgtgatccggcacgccatgaacctggaggccgtgaacacctacgaaggtgagctcattcattccacagctgctgctgaaacaatgactcccacagaaccatctccagaccctcaccccaccccgagttccgggtcagaaagttgaactgtatcctggacatgtggatgtccctggccaccgaaagtggctcagataaacaaggacaacacagaactcatgttcttgtctctgccagagaagccaccacctaccggaaaccaccacaagctggaaagcagacagcagtgatgtgcttgtaagcatttagcaactggctgtgtgatgggggggaagccctgattcgtagtgtttgccaatttccgtggtgcagagcctcccaccattagccaatttcaggctaccaacatgaagacgctaaatgccaagttgggaagagatgtgtagaattggctctttcaagccggtaggagctggccccagtacatcatggccgggaaacatcctccctcatccccttcctgtgtcttatggcacaaggcacttcctccatctgccctgctaaaggccaccccccccacaccccccataaaagcctcccactagacctccctacacccacacattctccctcccaaccattctctacaaagcagccatatttttttattaatattttttgagacaggg

SEQ ID NO: 43269 - DNA, 930 bp, Homo sapiens
ggtcaaaggcctgcgtcagttgcactgtagcctcggcagtgaaccgggaggtactaccaggtcgccgtcgttgctccgctcgctctgagagagcatggccctgagaggcgtctccgtgcggctgctgagccgcggacccggcctgcacgtccttcgcacgtgggtctcgtcggcggcgcagaccgagaaaggcgggagaacacagagccaactggctaagtcctcgcgtcccgagtttgactggcaggacccgctggtgctggaggagcagctgaccacagatgagatcctcatcagggacaccttccgcacctactgccaggagagactcatgcctcgcatcctgttggccaatcgcaacgaagtttttcatcgggagatcatttcggagatgggggagttgggtgtgctgggccccaccatcaaaggatatggctgtgctggggtttcgtctgtggcctatgggctcctggcccgagagctggagcgggtggacagtggctacaggtcggcgatgagtgtccagtcctccctcgtcatgcaccctatctatgcctatggcagcgaggaacagcggcagaagtacctgccccagctggccaagggggagctcctgggctgcttcgggctcacagagcccaacagcggaagtgaccccagcagcatggagaccagagcccactacaactcatcatggggctcctgtacaaggtgctgggcgtcctcttctttgccatagcctgcttcttatacaagcccctgtccgagtcttcagatggcctggaaacttgtctgcccagccagtcctcagcccctgacagtgccacagatagccagctccagagcagcgtctgaccaccgcccgcgcccacccggccacggcgggcactcagcatttcctgatgacagaacagtgccgtagccagtctg

SEQ ID NO: 43270 - DNA, 874 bp, Homo sapiens
cttcaaaaggcaaattctctatttcccccactttgattatctgcttatgctcctaaaataatgtaaatatggtcattaatcatctacaacattgtcaattaggagagtaaagccagtaatgaactctacatccctgacctcatatggtatgttgcattttaagggagctgtttttatcaatgacaatcgtattatttgtgctcataacctgggctctacatccagtgaaaggattttgatacagaatctttatttgaagagaactacacaaaaacaccatcaccatcatacctgatgtctgctattgttgaaataggcttcagcactgtagctggtggaaaccaggtcaccaaagacactgcccttgtacctggaaggcccgtccctgcccccattcacacagtgaattcatttagaagagaggaatgctgtagacagagtcattagaaaacccttcatgactgtggcgtggaaaagggctggcaaggatcacaaacagctttcctgggtttggtcttacagcatggacttcttcaccctcatctacacgtaaaatttattaacttcaaggagaggagatcagggttgcctctaccttgcattcctatgtagccatgaattaattcccaaatgccagtgtgagcctgttttccttttcatacatcgtatttgaggaaacagctggaaatattactctgtgtgccacacatcccgattcagcacagtctcttgttcccagagtggagtaaatgagtaaagaaattattcatccgccttttacctaacttggtgtgtgaccaataaattctctcaagattgattcaggttcctatattcatggaaacaaaaaaagaaaattgggcagaaaataata

SEQ ID NO: 43271 - DNA, 410 bp, Homo sapiens
tactcttctcccaagcttcttggtgttccgtggactagggaaacatgtttacctcaaattctatgaagacaagggtattggtttctcacctgttctgtttgggcagtgccaggaaacactaatgggatatgtgcttcccgacttctctctaatgtttctaggatctcctctgtttctcttttcattggaaaagaaacatgaagagagaaaaattcaccttgtcctggtcaccttttctcttactgaatagctagactttctcttgttcttccgtactagtgagggcaactccagaagccccgaagggcactcagctctaaatggctttgttaggggagcaaggcatggaagccagtggagggcagtggagcctcgactcaagtaaacaccaagggcaacgaacggcaatg

SEQ ID NO: 43272 - DNA, 459 bp, Homo sapiens
caatgcaggacaaacaaagcctgggcgggaacaaggtgagggtggaagcagggccctgtttggtcctgggacagtgtgggttctacccgatcgacaatggaaagtcactgaaggtctccattggaggtgacacagtcggatctgcatttgaggaagatggcatcacctgttgtgaagagaaggacccagaaggcggcagcggtggaggtgagtgcccctcaggctgccagggatggaacccgggggttctgaggaggccaagtccagagcgatgggcatgagtgagggtggagacaacccaaggggagggagcctcctggcccaggcacccaggcagatggggtccctcattaagaagggacaggtgtgggacacagggccagggagtgggaggaagggtggcctccgtcaagtagaggtgtctgacagacggatgtgaggacagcctgagctagagac

SEQ ID NO: 43273 - DNA, 371 bp, Homo sapiens
ggcaaccgacacatctggatgagggtgggacaagtgaacagtggtgggattaattatacaagcaaacagtggtggctttaaggtccagcttttaaaaagctggggccaaaaagttaggtgttttaaattctgggtcatgccccttattagctgtgtgacactggacaaattacttagcctctctaagccatacttttggagatcatttgaaatatagcacataggtatatgaaaaataaacaggtaatggctgggtgtggtagctcacgcctataatcccagcattttggcaggccaaggtgaaacagattacctgaggtcaggagttcaagaccagcctggccaacatggtgaaacaccgtctctactac

SEQ ID NO: 43274 - DNA, 509 bp, Homo sapiens
ccattcctgtatcttcaggggaccagttagactatattctttcttaacccttcaaatctgaaattatatatattttattaaaaatgatataatgcctatagaaacattattccaatatatgacaccaagagacttataattacaatgatgatgatgatgatgatgatgatgactatatcaatgaagctggaactaccataggagctctggtttgatagctatggataatgagatgttctatttgtgaattttgtcttaactgaaaattcttctaatgcttttcatcttcctaggggagcaagaaatatgttatttttttcaaagttaacagacgtgagagttgaaggcacagtagagcaattaataggtatttaaataagtaggaactgaagtattgattgtgtatttttgcctgtgtgtgaaaaacttttgctttttatttcctcacatttccttccagctcttgtcaatatattgaagtgcagtcagtatggttttatttctgtggg

SEQ ID NO: 43275 - DNA, 347 bp, Homo sapiens
agtttatttctaagaccccaagctcttggtgccattaagaaaatgtttattggtgctttttttttgacagttgataacgctgcggtaaaagactccaatacatctgtagccactcagcagcatggcaaggtttccaaagcagggatgcctccctcttctcctagcagcagatgcaaaggctgtttaaatggaagcagctaggctcttaaagaagtagaacaggttttctaacctaatagaaaattagtctcagcaaatgttttgaaaacctcaaatcatcactaaccaacagttagtgaatgaaagccttccagaacaaaggataatgttagttgttctcccttctt

SEQ ID NO: 43276 - DNA, 375 bp, Homo sapiens
gtgtccctttgcattctctgtacctagcatggtgcctggcaaatagtaggcactcaattaatgttagttgaaaaacgcatcctcaccctgttttctcaattagtattaggattaaatgtgaagaaagttcattttagaaaaataaaattgagttgcaaacttttaaggttcattctaatgtaaagatttaggattctattttgggagttctaaggtgtagttggaaacagtgattgaaaactggaaatgtaaatggctttcatgaatattttatgcaaaatctctaatttggcaagtctttgttactattaatagaaacattgtcattataagcagctcataaatattcattaatcaattatttggtttggtgtt

SEQ ID NO: 43277 - DNA, 356 bp, Homo sapiens
accataaaaagggctggacttgagcatggggaagagggggaagcttcaaaaaacttcaaactgaatataagggattgaatgggagtttgctagatgggaaatgcgaagaggcaacacaggagtaaaacatggaatactcccaactctggagcttagaatgtatgtgggaaagtagtagtagaggggcaggtgaaacagccagattgtgaggggatctcagtgtcacattgagacatttggacttgatatggaaagtcagtaaaggacgtaaagcagttgattgatgtggattttcttttagaaggagggcattaatggctagacaggacaagagagagcacaagaatctgggtaca

SEQ ID NO: 43278 - DNA, 401 bp, Homo sapiens
ccagctaatttttgtatttttagtagagacagggtttcaccatgttggccaggctgggtttgaactcctgaccttgtgatcctcccacctcagccttccaaggtgctggaattacaggcgtgagccactgcgcccagccatcttctgcattttttgaacagccacctaactcgttttccttatctgatctcactctaggcctgctcttatactgatactgctaacagagtatcatcctaaaacagagatcttatttaaattagttatctctgtaaagtactatcactgttccaccattaccaatgattaagatctaaagttcttcatatggcattcactcagcctctatacgctggcctcaatgttccctttgcacccaaacctctaactccctttcatga

SEQ ID NO: 43279 - DNA, 424 bp, Homo sapiens
ccagtccctgcattctcccgatgttgtcatatgcgcatacagcttcagatagacttacctgttggttccaatatcaaagcatcatgggtgagattggactacatgctcctgagatttttctcccaaaaccttttccttggctgtaattctgaggttcaggctgacagtatgtgacattaactcggctcctatttctttccttctgcataatattcttccaacaattttttttgttttgttttgtttttggtgagatggagttttactcttgttgcccaggctggagtgcaatggcgcgatcttggctcactgcatcctccacctcccagagaatgccttgaacccaggagacagaggttgcatgagccaagattgcagcattgcactccagcctggggcaacaagagcgaaactccatctcaaa

SEQ ID NO: 43280 - DNA, 820 bp, Homo sapiens
  misc_feature (51)..(51): n is a, c, g, or t
  misc_feature (63)..(63): n is a, c, g, or t
gtaattaaaaatgaattgtataaaaagatacagagaacacgaaaggaaaancctcaggttgtngctgcagtactgaagagcaacttcagctattgagttacacctcaatgcaacctcctggcaggccagccttaagcccagcagtccaaccatgcatctaagctgagttctcatcagagccaacttcaattataaacaactgagatgatgccagaggccagaatccctgagaacccaatttgctgtcatcaccgcagctgaaacaaggcgcttggcatctagaaaagctgatctgtaggaaatttccaatagagttcaattttttctaagtttaaagtgtacaatatcatcaaggtcagacactcgagataaaactaggcttgtgtttaaatataataaaaatatttgaagaatagtaagagtggtgactacttttacacaggaatgtttcaaataaattgtttttttcttgtgccttttaaattttgtgatttgtcaatgagatgctgacatgtttttaatgaagcatgccttgtaaaataataagtgaatgaaaactacacagtaatatttacatcaacaaagctagaagaagactgtatgtctcaagaggctccatcatctacccagtggccacttcaccaaattaagatccaaataccaaaaagaaaagtaattaaaatttgtgttgtatgccttataagaccaaacctataaaatgaggggaaacttcacaattacttgtaatttgctctgtggaattgtaacagatggattataaagatgattccatgataaacatctaaatgtgggttactac

SEQ ID NO: 43281 - DNA, 786 bp, Homo sapiens
actgaagagcaacttcagctactgaggtatctatcagaagtcttactctccaaaaagcctctgttacacctcaatgcaacctcctggcaggccagccttaagcccagcagtccaaccatgcatctaagctgagttctcatcagagccaacttcaattataaacaactgagatgatgccagaggccagaatccctgagaacccaatttgctgtcatcaccgcagctgaaacaaggcgcttggcatctagaaaagctgatctgtaggaaatttccaatagagttcaattttttctaagtttaaagtgtacaatatcatcaaggtcagacactcgagataaaactaggcttgtgtttaaatataataaaaatatttgaagaatagtaagagtggtgactacttttacacaggaatgtttcaaataaattgtttttttcttgtgccttttaaattttgtgatttgtcaatgagatgctgacatgtttttaatgaagcatgccttgtaaaataataagtgaatgaaaactacacagtaatatttacatcaacaaagctagaagaagactgtatgtctcaagaggctccatcatctacccagtggccacttcaccaaattaagatccaaataccaaaaagaaaagtaattaaaatttgtgttgtatgccttataagaccaaacctataaaatgaggggaaacttcacaattacttgtaatttgctctgtggaattgtaacagatggattataaagatgattccatgataaacatctaaatgtgggttactac

SEQ ID NO: 43282 - DNA, 425 bp, Homo sapiens
tccagcttcatccttgtccctacaaaggacatgaactcatcctttttatggctgcatagtattccatggtgtatatgtgccacattttcttaatccagtctatcattgttggacatttgggttggttccaagtctttgctattgtcagtagtgcctcaataaactccttctttctttgcctagttacacctcaatgcaacctcctggcaggccagccttaagcccagcagtccaaccatgcatctaagctgagttctcatcagagccaacttcaattataaacaactgagatgatgccagaggccagaatccctgagaacccaatttgctgtcatcaccgcagctgaaacaaggcgcttggcatctagaaaagctgatctgtaggaaatttccaatagagttcaattttttctaagtttaaagtg

SEQ ID NO: 43283 - DNA, 368 bp, Homo sapiens
aacaaaatcagacataaagcaaaggtcgatctaggctgatgttcacacaattgggaagggggggtctttaagaagaataattaaaaattacgaatacaaaatgaaagtgaatattgatttggaatgacaatagaaatggtgatacattatggatgtcacaaatgttataaaatccagaataacattaactgcctgatatctctctgtagtactttctcccaacattttgttttttttaagagatggggcctcaccacgtagcccaggctagtctcaaactcctgggccaagtgatcctcccaacttggactctcaaaatgctgagattgcaggcatgagccactgcacttggcctcccccaacatttt

SEQ ID NO: 43284 - DNA, 349 bp, Homo sapiens
gagatggagtctcgctcttgtcacccagcctggagtgcaatggcgcatcttggctcactgtcattgcactgtactccacagcctgggcaacaagaatgagaccccatctctagaatgaatgaatgaatgaaaccagaaccaccagaaatatggattaaaattataaataggatttcaatgctcaataatctcgatcactgtcatgtctacagtgagtcagggaacaacaaccaaaaaaatgttttttgggaaaccaacccaaaacgtttactgggacattctctaggtcataagccctatgaaacatcaacaacttgtagtacatacagtaagtcacatacatgcttta

SEQ ID NO: 43285 - DNA, 398 bp, Homo sapiens
gatggtattcacattcgtggaacactgaggctcacagacgataaataacttgctaaagtcacacaccttaagtttcagagtcttgtttcagcctagatctctgactcaaaactttggttactttctcctcaagggggaggcagacgtgtcgcagataaacatccaataacaagtaagtgctcttgaagagataaacatgagtagtgctggggtggctgacttgcctggagagtcagtagatacattttgactgttgttttatttaccaggactggagaggaaaatgggaagaacatatattctctctcttcacagccagctcctctctgctcctctcctcgcttctgtgaacaattccctcagcctgtgtatgaatcatgatcaccattcactataga

SEQ ID NO: 43286 - DNA, 87 bp, Homo sapiens
ttgtacttttaagtagactgaaatatctgtttatttaaaatttaacataaggatcttcactttttaaagaaatttgtcatgactttt

SEQ ID NO: 43287 - DNA, 1427 bp, Homo sapiens
atgcgcgcctgtctcccgggacgctagagcaggcggttcctgggctgctccggtaggtttggcgtgcgcgggtttctgcagatctagggcgagcttgcacgttacatcaccgatgcatctcttcttgcttgcttaatttgccaccacttaggcctttcttgcagaattcgccatatactccttaagggccgcggaatcggagcgaccttggtgactggcaaactctcggcagatgtgcgtgcactggtttgatgcagacgtggttgtaggcgatttaatttttcccagctttgcagcgactgttggcttcccagaacggatctccccagcctcgactggaagctgagggacaaaaattcataaaagcaattactctttcccggcgaggcttctagaagagcaagaagagcgatatgattacacctgcagccctataaagattgatctgtccgtctttcccttacagtcgtggcctgttaaacgttcctgtgttgttcagtgccagaatgagtgaccgctatttagaacaaaggattagtatcaaattttgcgtgaaattgaacaagtctgcaagtgagacccaccatcttttaaaagaagcttatggggatgaagtcatgtcaagggccagagtttttgactggcacaaaaggtttaaagaaggacgggaagatgttcgagatgatgcccgaagtgggcgtccagtcacccaccgaacagatgacaatatccagaaggtcaaggacttggtttgttcaaacaggcagttaaccgtgaggatgatggctgaagagttaaatttagacaaagaaactgttaggctcattttgaaagaaaacttgaacatgaggaagatttctgcaaaagttatttcgggtgttttgaagggtgagcctaaaccacgaaaacttgactttcggtccgatctttcaaaggaaactaggaaaaatagctcatgtttgaggaaaaagagacggaacctcactatgttgcccaggctggtctcgaactccttgtctcaagggatcctcccaccttggcctcccaaagctctgggattatcagcatgagccaccatgccaagccaaaaccaggagttcaatggtgtaaattccagtctgagtccacaggccgaagagcgaggagtgctgatgtacaagggcaggagaagatggatgtcacagctcaagaagcgagaacaaatttgcccttcctatctttttgttctattcaggtcctcaatgaattggatgatgtccatgcacattagggagggctgcctcttcattactcggtctaccaattcaaatgctaatctcttccggaaacatccccacagacacacccagaaataatgttttcccatctatctcagtaccccatgatccagtcaagtgaacatataaaattggctgtcacatctccat

SEQ ID NO: 43288 - DNA, 1097 bp, Homo sapiens
atgcgcgcctgtctcccgggacgctagagcaggcggttcctgggctgctccggtaggtttggcgtgcgcgggtttctgcagatctagggcgagcttgcacgttacatcaccgatgcatctcttcttgcttgcttaatttgccaccacttaggcctttcttgcagaattcgccatatactccttaagggccgcggaatcggagcgaccttggtgactggcaaactctcggcagatgtgcgtgcactggtttgatgcagacgtggttgtaggcgatttaatttttcccagctttgcagcgactgttggcttcccagaacggatctccccagcctcgactggaagctgagggacaaaaattcataaaagcaattactctttcccggcgaggcttctagaagagcaagaagagcgatatgattacacctgcagccctataaagattgatctgtccgtctttcccttacagtcgtggcctgttaaacgttcctgtgttgttcagtgccagaatgagtgaccgctatttagaacaaaggattagtatcaaattttgcgtgaaattgaacaagtctgcaagtgagacccaccatcttttaaaagaagcttatggggatgaagtcatgtcaagggccagagtttttgactggcacaaaaggtttaaagaaggacgggaagatgttcgagatgatgcccgaagtgggcgtccagtcacccaccgaacagatgacaatatccagaaggtcaaggacttggtttgttcaaacaggcagttaaccgtgaggatgatggctgaagagttaaatttagacaaagaaactgttaggctcattttgaaagaaaacttgaacatgaggaagatttctgcaaaagttatttcgggtgttttgaagggtgagcctaaaccacgaaaacttgactttcggtccgatctttcaaaggaaactaggaaaaatagctcatgtttgaggaaaaaggatgtttttcttctctactagcccaggacctcctaaaagccaagcccacatctgattgttccatgttccctgcatccagaataaaccttgcgtggaactgctcaataaatgtttgatagatgaatg

SEQ ID NO: 43289 - DNA, 342 bp, Homo sapiens
taagagctgtgtcatccttatgtaggcaagagatgtttgcttttgttaaaagctttattgagatataattaacataaaataaactgaacatatttaaagtgtactatttgataagttttcacaccttgtggagaacatgcatactacaattaagagagtgaacatatccatcatccctcaaagtgtcacaatgctcctcctgatgactcctccccagaaaaccaccaatcggctttcattttgcattttgtagttttatgtgaatggaatcatatagtatgtcttttttttttgtctggcttctttcactttgcataattattttgagattcatatggcaca

SEQ ID NO: 43290 - DNA, 305 bp, Homo sapiens
tttcaaagagcttttgaagctaagttcatttgaaactaagtcttaaaaaccacatgttctcgcttatgagtgggagctaaccaattggtatacatggacatacagagtggaataatagacatcagagactccaaaagatgggaggaggagagggggctgagggatgaaatactacctattgggtacaatgtacagtattagtgtgatggtgacactagaaggccagacttcagcactacgcaaaatatccatgtaacacaactgcacttgtacccctaaatctataaaaataaaacacaaaatgt

SEQ ID NO: 43291 - DNA, 226 bp, Homo sapiens
cattaatataaaaatgtatgtcggtaataagcatgcagtttatgaattttcacaaagtgaacacacatatgtatcaacatttgcttttagttgaagctaaatgttgttgctaagtgtggatggttaaggtttgttcacctatgttttgaaaagactattctcattaaaaataaaacaaaatcaaatcccaacaaagcttaaaggttaaagaaagcaaaagaaataa

SEQ ID NO: 43292 - DNA, 394 bp, Homo sapiens
cctgggcagtggcggggctggccgaggctgcggcgtttctccccaaggaagtgtcttctccgctttccctgttcttctgtttctcacacactttctatctcattctgtaactttcaagcctttccttctaactgtatgtatttagttacttgttttcaagctggttccctctctggccccctggcctggggaaagcctccacacttactgcgggtcttgtttagagtctgagtttgtgagattatttgggggagagtgggcgagtggctgacaggtgacccccaggaggaggattcctggggctggtgtcttctcccagctgctgcttccagtgggcctgggcccaggactggacctccgctggcacccctgagtgcctccctgccaggtaaga

SEQ ID NO: 43293 - DNA, 304 bp, Homo sapiens
tattcaaaataattttcttattaatcttggatagtttcttgtcacagtaattccattttgaagataataaatattaccataaagaagtgatcaaaaacatagatatgtgtgcccaaaggtatttatcacaatagtatttataatagtgaaaaaagaaacaactaaaatgtctggcaataggagaatgattaataaagcgatgtttcagctgaatatagtggcatgcgcctgtaagcccagctactcaggaggttgaggctgcaagatggcttgagcccaggagttaatgaccagcccaggcaac

SEQ ID NO: 43294 - DNA, 526 bp, Homo sapiens
tataatattcttgaaatagcctaaagatggagaaaagattagtggttgccaggggttaggagtcagcagagagaaaggaatgtggctataaagggatagcacctgggggccctgtggtgttgatacaattatgtactttgattgtggtgctgattacaaaaagctacacatgtaataaaattacatagaactacacacacacacacacacacacacacacacacgagtacacacaagcaggagaaatctgaataagctctatagattgtaccagtgttcattttctagtattgacactgtaatatatatatatttgcaagatgttaacagtatgagagattgagtgaagtgtacacagggcctgcctatatatttcttttcagcatgtacctaactatatattgttataagaaatgacttcaaatacaaaggacatcaaatgatacaaataggttggaaataaaaggatggccaagaatatgccatgtggaaaagtattcagtgtccccctgtgaaaagtaggtcc

SEQ ID NO: 43295 - DNA, 148 bp, Homo sapiens
cagaaataaagccacacacctacagccatctgatattcgacagtgtggacaaaactaaataatggagaaaaaactccctactcaacacatggtgctgggaaaactggctagttatatgtagaagaataaaactgaaccactacatttc

SEQ ID NO: 43296 - DNA, 199 bp, Homo sapiens
ataaactttttaaaggccaattatagtactgctctaggttcatatagtacatcttttccttagaacttcaaaacactcaaacaatctattctcatgactatccatgaagccaggaggagcaagtattattttatcggatgtggaatccagaagaacaaagagattctgcaatttgctcaaagccatagagttagcagca

SEQ ID NO: 43297 - DNA, 410 bp, Homo sapiens
aaagaaagaaagaaagaaagaaagaaagaaagaaagaaagaaagaaagaaagaaagaaagaaagaaagaaagaggaccaacacctgtagaggaggggaaaatgagacagggaaacagtaaaatacagacctcagagttgttccacaaaaggggccagagaggtaggatgtttatacatcaacttccattgggcattgattgagggttgatggaggggagtgttgataaaagagattggttaattctccaacacttccaaactatggacctccagggcgttacaggaaggcctcatcagaggtggggatatagattctgacaattgacgatgcagaatcacagttgattcctactgtgtattgggcattgctatgcctcccccactgaatagtccattgctgctgtgtcct

SEQ ID NO: 43298 - DNA, 505 bp, Homo sapiens
cactgaggttctagttatatttaagatgctgtgtttcacctggggtgaattagccgcttgtgttgaggaattggtccacttgacctagttgttgaatttgcccagagagttgttcgaagcattcccttatccttttgatatctgcggggtccacagtggcctcctttttcctttcagatgttggtgttttgtgtctttttttccctttgtctctcttgctagaagttgatccgtgtttttgatcttttctaagaactggcttgggcttcattgagttttctctcctgctcttccctccccatcgtcttccatgctcatactccctgggtatcttcctaggactgctgggcacagagtttgcagctgtgtcacagttgccaagacttggatgtctgttgggatgataacaacagtaatgaaagcaagttgtcatggcagcagacgcagggtttcccgggcaggcacagtgttaagtgcatccgggcctggtgacagcgcactgccc

SEQ ID NO: 43299 - DNA, 346 bp, Homo sapiens
cgcctgtccctgctaaaatcagagctttgtgagggcagagatggattctgtgcacaggtatcttctgagtctctgattcagtgcctgaaacacagtggctcccgagacaatctacctcagtgcctgttttacaggctcacctgtgacacatgactgggacatatgttattcatgatgacatgcaagagtctctgtgtaggtgtctactggtcttcatcatcaaacagagcgagaactccaagtcaggaggcagacatatcttggggcaagaagacacctagaatttttcttcaacctgtagactttcggattgggtagaaggattgttaaggaggttgcgaaactt

SEQ ID NO: 43300 - DNA, 438 bp, Homo sapiens
  misc_feature (377)..(377): n is a, c, g, or t
  misc_feature (417)..(417): n is a, c, g, or t
  misc_feature (433)..(433): n is a, c, g, or t
agcactcatcagaaatatcatggcgtgtggtgcgtgtaagagaaggccctctgatgtaagcaccaaggctgttaccatggagaccacatgattcaagtcacttcctgatgctaacgcacctgatcttcaattcttcactagtttccacagaaccttgaccatacttgacattttaaactctaatatgccagaatttattttaagaaaatgagtgatctatatacaatttagaacatgatgtaatttttccattattttcttctcagcattatgacaggattattttccatttaatttcgaatgtaattcttttaacttagatatttctgagcccacagaggcaggagagctgccagggtctgcccattcgaccaggntggcttgggccccggagcccacgggtctggttgatggccntagcagccaccaccgngggcg

SEQ ID NO: 43301 - DNA, 260 bp, Homo sapiens
cgggcgcaggaacaggaatgaggagggagaggcggcagagatttccaagctctccctacaggggatcgtagatgcccgttggatggaagtgtgtctaagtgtgtgtcagggagctggcgagtattttccagtctgtgaaagtagcatcaccccaggggtggtggctcctcctccgaggccagggcagggaacccggccttcccgctaaccctcccgctgctggcacccgaacctctcagctctgtatctgcagcatcagc

SEQ ID NO: 43302 - DNA, 1068 bp, Homo sapiens
gccttcacattttaaacttttatttttactagcactttgattggcaatatagtgttctatacaatgccttgtacatcatagatgacgtatttaattgattatttaatgaaagaaatgagttacctattgacttatatgtatgtttttacctttatggtaaaattaaaatgaacagaagcctagggtttagtacaatgagtaagatattagaaaacatttggcaatcttaaaaagataattatacaaggtctgtttattagatatcatctttaaaattgttaatgttttatgaaaatagagccctaagcatgttagcacatacagcataaaagtttatttcaggtcttgctttcacacactgggagaacactgtgatctgtgaaagtcagaataagcctgttttagaaaacaggatatgtggcagcattcacactcaaaagccttcggagctcactgagttaagggtgtgatttatagagtcatacagactggtgtttcaatcctggctctgacacaggcaaatgagattaactttgagtctaagttttctaatgtgtaagatgtataaaacaatagctctgtagaggatggcagggggccataggtaggtgccctggcagtggcagctcaggtgctgtgggtaggaagtgctccagtgggaggcaccataggcaggcagttcttgagtggggatgctgcaggttagaagtgtatggcatccatgactgggattattaccatttttgggatttctttaggccatatattacttggaacctaaacatgtgattttacatagtgtatctgcactataattgaaagttgagatttttcactggaatgacatagcaacataaattaatgtagcagcagcaacagcagcagtattgtggtagcagtaaaaaataataatttaacaacttacatcaaaataatatagacactatggctttagtgagaggttgtcatgtaaattcaagaaatgcagagaacccttgtgagatactatgtaagacaaccatccccaagacacacagtcatcagattctccaaggtagatgtgaaaga

SEQ ID NO: 43303 - DNA, 328 bp, Homo sapiens
cccacaacgttagccccatgttgggcccctctttgacaccaggccacccttctcttgccagaggagtcccaggtcagctgtgcccctgggaatgtcccaccagggctgggcatagtcagcccagatgggccaagggctgcctgtcaggagggaaaggggacggtgtagggtcccagggccaattctggacctgcactatgctggtgactgccctagggttctgcagccagagtttgaatatggatgctgctagctgtgcaacagtttgccaccctccctggcctccctttcctgtgccagatccctcctctgggggcagctgtgataa

SEQ ID NO: 43304 - DNA, 326 bp, Homo sapiens
gatctgcccaccttggcatcccaaagtgccaggattacaggcgtgagccacacacccggcatgttttctttttttggaaacaataacaggatatcagattgataaatgcaataccaatttctgataatttatcttgctatataatacttcatggacttcttgcactttgtggtgttttattagtcaggaataaggagaaaacaacttatagctgtggaaagagtacaaattaatttttaaaaactggagaataaatcaagcaattcggcttttgaagactttcacttgaaaaaacactttttactttttaattatcatttcttaat

SEQ ID NO: 43305 - DNA, 669 bp, Homo sapiens
ttctggcttttattatttccttcatagacaaaagaaagagttcacatagctttatgaagcttagcatgttttcatgaaaaacatacgtagatattggctaatggtagtatagtcttcattgacttaacgaggaaagttatatgctttgaaaggtggacaggaaacattgattagggtaaaactcataaagggaagctttacaaggaggaccaaagtacagcactttcagggaactttctttctgtccccctagggtaagcaaggctaccattaatgaaaaggacatcttctcgttattattttcttcttttactagagatgccatagcagaaggcatcttatgtattacattgtttttcttttcctttgtcaaagcatctatgttcactgacctagcccttgtcattacattgaaattatttctgggaagcaattttaatggatgttgacttccaagtggtgataggacattaggtttgggtcagacactctataatactccaggcaggcatataacaacttcgtatgaaagaattactgtttgtttttgtttttgtttttgtttttgtttgagatagggtctcacctttatcgcccaggctgagagtgcagtgagccaagatcatgccattgcactccagcctgggcgacaagagcgaaatccgtctc

SEQ ID NO: 43306 - DNA, 416 bp, Homo sapiens
tcgtcgacccgcgttgctgtagtgacaggtgaatcacctgtgttccagattagccgtgctcccgtcggcacttcacagggtaccacgcttagctgccggagacgtgttctgccacagggagctgtcagtttgatcccgtacgtttatttcctggtcttttcagcaacatttaatgaatcgcattcctcgtcttaggcgccagccgctatggagggagtgcagctgagcctacgccatgcggtgtgtctccagtggggagggtagcacccactttggaactgctcacgtgggttttgtgaaaaatccgaggtgtaagcaaagtgcagaaacgtgaaggcccggtcctgatggtgagattggcatctcatccaaggagcgtggactggagctcgggctggtccatgctcacgtcgacc

SEQ ID NO: 43307 - DNA, 329 bp, Homo sapiens
tttgccttttccttccctatggtgtccccaaaaaaccaggtcaaacaaaacaggaggtaaggagggggcctgagcactcatgctggtgttggaccaagagctttcaactaagtggaaaagaaaagtgcaaccctgttgatttagtccagtgtcctaacgtgccaggaaagaactcaccactgtagctgttagcactgatttatggaatctcatctagaccattttcagccctaccaaaaaatagctggtcctctgaatacacacagctgatgaatgcctctgtttaacttggccacaagcaaaaccacactgaatgtgaataattgctt

SEQ ID NO: 43308 - DNA, 1002 bp, Homo sapiens
ttgacagcttgatggatgaagagcagatgggtttatggtgtatgggaggaagcatggattttaggagggacagtatcagagagggatggttagaaagtgagtaagacaggttgctctttggaaaacaaggaaaatccctttattagaacaaggcatgaaattctgccactaggtggcgatgccctataactttacaacttagtgtacatcacacgagcactatggaagatttctccattctgcgccccaccaactccctcccctccttcatttttcaggatgacaacaccttagaggtttatggccatcaggagaatttactactaagctatatactgatgtaatgaaatctaatatatgttgtgcaatgaattatgagatgttatttagtttcaggattttattacttcaatcagttatgaccatatttccttttatatgattgctcactctttaaacataccagatgactgtataaggaacacctaataaagtctatagatgttaaaatattttaaatgttttaatttatatgccataatttgtttacattctggttatactggcgttcatattaaaagccataacatgttagaatctgagatctcaggtcggatagtgcctctaagttatattttgctaagaaattttattgtattagcaattgagcaagaaagaagaactgaatcattatacggtggttaatttttagcatagatgtcagaaagcctgttaatattccagaggcttatgataaactatttaaattgtcattctggattctgattatatctcctacaaagaaagagtgtattatttattgaactttttgtttgaatacatgtgcctatttttgcataaatgtaaaaatgtaattttaaaataaacccctgaaaacttctggtaacattatccagttgaataattgttctgttagtattctaaatattttaagaaaattgtatacatatctgtgacaattgtattcacaagccaaaccaa

SEQ ID NO: 43309 - DNA, 568 bp, Homo sapiens
gactgtctgctgggtgagcctgggaactgacctggttctttgactgtgggagaaaagtcaccagtcacaaccaagatgctgccaaagtgcccacccagttccgtggtcttggtaatatttgtggttagtatgacctacatatcgtcacagctgctttcagtggccgcgtagaaaagcaagcaagcagaaaggaaccttcctggctgcggagaagctgtggagtaggctggctgcaagcaaggcctttggagcagatggagctggttgcggctctagctgtgggactttgagcaagtcattggatttctctgatcctgtttcctcattcgtaaaatgggcatgaaaagagggagttaagtgaaatgtctgtctcatgctcagggctaacagcacacaacaaatgctcaattcatggtaaatggtaatattcttgttagtagagggcacaaacacttgtatatcagctcaggagtatgtcagtttcacattcattgacatttactgtttctactggttaaaaaaattaatgcatacttgtaaaaaagtttaaagttcagaagagaaaaaa

SEQ ID NO: 43310 - DNA, 403 bp, Homo sapiens
accactctgtgaaacactagagattcagaaataaataaacagtgttctatcctcaaggaattcacagcctggtaaaggagagagatatcggttgcagaaatgtggtagggattatcccagagattgtaaacagctgcccagatgacttgctccttccacctccctccactccccttcctcagcccctgcagtacctacctggtttgcaagccttgtaaactgagttgggcctcactgctaggctcatagctgtgaatgaaaatatgagtgaatacaaacatgaaatgtctgctacattaggaacttgctggaacccactcttgcctggccagctctctcccttcccttccatgcagcagcaggcacctcgggctacccctgctgccttgagcttagactttag

SEQ ID NO: 43311 - DNA, 395 bp, Homo sapiens
tgaagatggagtgtccctttgttgcccaggctggtctcaaactggcctcaagtgatcttcccacctcggcctcccaaaatgctgggattacaggcaagaaccgtcacacctggcctaactttgcttggaattgtgtacagttttatagactaatttaggaagtatgaatatcttttcattactgagtctgcacttcaaataacatgtagtatccctccagctattcatgtttgatttttttaaatattctccagtggatatgattttcttcatatacgtcctgtgtttgttaggcttattcttagacactatatattttgacacttagatgtatattgatatatgcctgaatcattaatacatatcttttactcatttgtttcttcagacacaac

SEQ ID NO: 43312 - DNA, 432 bp, Homo sapiens
cctggtgcatgcatgtgcaatatgctcccctggcctgggtctttcctgccgcttcttgccagttgggtcagaactagcttattaaccagttttttctgagctttaatcgaactggctccaaccagttggagacttgaaaagggctacgtgatagttatagatttttaaagatatattattattttagagtagtattgagtgtacagcaaaatggagtacagggtccagagatctcatatggcctcaattcctgtatactctcgggtcactccaccaacaacctcctacaccagagccactttgaaacattagaaaatatatttgagcattcagaaatgtataaactaggcagccccagactgcaagcagctcagaggtcccacagagaggcttagggagggtgggggaagaattttatatggtgaatgtgga

SEQ ID NO: 43313 - DNA, 320 bp, Homo sapiens
cgtcctcacccccacctcacatgctgcagctccagttcccactggtctcccactttgatccaaagttccctggcctggggccccacattccactcccgaaggcctggtcggctccggagacaacgcagaggggagcggctccttaactccattaaggcccggtccccaggaaatcacaggtaccaggagggccagtcccaccacacctcccccagccccggcccagcctgttcctccatgccgtccttctgggcctactcatgccgccccacagggtgacacgaggtgcaggggcaaccccagctgacttcgcaggcgcc

SEQ ID NO: 43314 - DNA, 644 bp, Homo sapiens
ttaggtcctggatctagctccatgttaaagatgagaaaactaaggcacaaagctgttacttgcctgagatcacagacctagtaagtggcagagcaaggacttagactgaaatcctgattctagtttctgtgcttgagaaaagtctgcttaatgcttccgagtgccaagtcacaccagccaggcccagctcccaggattgcacagagaaaaagaactcttaatgactacattatttgaccctttgataagggtaaacaaatatttcaataggtgtcacctgcaaaagaatcagtgaaagaggtgtatcagaaaaccttgcttagatgtcagcttttctccaacttgataaacatcccaacattaacttatcgccaccatagagtgtcagaataaatagtatacctgtgactttgaagatagggaaaccaaagcccagatggcaaatgtgaaaggacttgctttatcaaactggtggagtcccagaagttgcaaatcatccccttcatgaacggtttccaagaaaagcattctatacttaggaaatcatcctcttcaagaacagtttccaagaaaagcattctatacttaagaaattaaatctaaattaagaaaataaagaacactcacaactaaaagctatcttt

SEQ ID NO: 43315 - DNA, 442 bp, Homo sapiens
gggcaggctagaggcgccccctctcccccagcagccacttctcctcctgtcgctctccccatctccatcccagggcacccgaggacagagtctaggccttagtggcccaccctgccgcaccgacccttgacttgagacagacgtagggcttagatgcgaacatacaggcaggtgtgcagccccgtttcccatgggtgaaatagggtcacctatggctgggtgcaatggattcctgggtacacctgtaatcccagcattttgagaggctgaggcgggaggattgcttgagcccaggaattcaagaccagcctgggcaacatggtgaaacctcatctctacaaaaaacacaaaaattagccaggcgggggtttgtgtgcctgtagtcccagctactcaggaggctgagctgggaggatcacttgagcctgggaggatgaggctg

SEQ ID NO: 43316 - DNA, 531 bp, Homo sapiens
agctgggaaagacctcttgtgcctgaaagggcttctctcccttattgattcttgtatttagtgttgattttagtgagtgttaaagtggtttcaaagtgatcatagtgtctatttttatcatattctacttccttcactttacatgtgcgtttctcatgagatttaaaaactttttgaaaatatcataaatatcagtatctaaacaaaaattattaaaataacctctttagccaatcttctagtgttggattgctgggctttgattcttagtattacgagtatctgtctaatgaaaactctcctgcactttgcattctttccttgcgatccactccctgaggcagaagagcagaggaagggtgaagagcggagccacacagaggctcggcctctgctcttgacagccatcggcggcggcagcctctccacacagcactccctgagatgcacggaggtaacactgcctcactctgtgatgcactctttataagagacactccaaataaagcttgaaagtaaaactaaaaaaaa

SEQ ID NO: 43317 - DNA, 793 bp, Homo sapiens
ttttttttctttttagagatcaggtcttgccatgttgcccaggctgaacgtgaactcctgggctcaagtgattctactgcctcagcttcctgagtagctgggactgtaggtgcatgctaacatttgctttgtgtttttattgttcttattgttaattcaattctgaactttttgccagttatcgaattctcctcttaagattttcagacacaataggtgttttgtaacttttttttttttttgagaaatctctcccagagccttagcatatactccaatttggaatagctgccatctatgccttgtgtacagctgcttcacctcaaatcaagggattctcttcggctccctcctgtgttgtatctcttgtttgcaatatcccaccttgtcttctttttaagtttactccctcattttggcagagaaagtccctcagctgctttgtcaggaagagtgtgggagaggtacaaatttttgagactttgtatatacaaaaacttcattcctactcttacactagatagtttgcctagagagacagaattctaggccattttcattcaacattctggaggcattattgaattgtcttctggacgctaatgtggctattgagaagtttgaagccactctacttaattctttgtgtgtgactgtttctcctgttctctggaagtttatagaatcttgtttttgttttcagtgctctaaaatgtcacaatgatataacttgctgaaagtctgctttcatccactatgttgtacttaatggacactttccttttgtaaaaaa

SEQ ID NO: 43318 - DNA, 501 bp, Homo sapiens
aatagcaggaagtccccaggccttttcaaagttccaaaccaagctctcctgattttaatgtagagatcataccaacccaggtgggggaggagggtccccagccccaggcagcagccatcaccccctccactgaaaacaatattggaggctgctttgggactgcccttctcagccccctaagtctgttttgtaatgcctgtggtgctctccctcctggacctttcctctcgggggtcaccacactttgctaactcttgtgtgcacatattttataatagagtagcgagggaatggtgccgcctccagcttccgtaagctgcccgggctctggggggctctgggacaatcggggctgggaagtgactgtgctcttattgtacactctttatttctctgtatctttggcttgtgctctttgtaattaatgggatttgtctgccttttcaacactatactgagcaataacaataaatgcacacgtggaaatgcagacacggtaca

SEQ ID NO: 43319 - DNA, 487 bp, Homo sapiens
ccctagtttagaagttcaatagcacctagtttagaagtttcaatagctcctagttttagaagtttcaatagcacctaatacaaaacgccccaggcagcagccatcaccccctccactgaaaacaatattggaggctgctttgggactgcccttctcagccccctaagtctgttttgtaatgcctgtggtgctctccctcctggacctttcctctcgggggtcaccacactttgctaactcttgtgtgcacatattttataatagagtagcgagggaatggtgccgcctccagcttccgtaagctgcccgggctctggggggctctgggacaatcggggctgggaagtgactgtgctcttattgtacactctttatttctctgtatctttggcttgtgctctttgtaattaatgggatttgtctgccttttcaacactatactgagcaataacaataaatgcacacgtggaaatgcagacacggtaca

SEQ ID NO: 43320 - DNA, 431 bp, Homo sapiens
agagtgaaacagaacccgtacacactgtttgtgctagttcatgacaactcccatgtggaactaacgaggtgattggttcagagtgagcaaatggagtctcccttctacaggaataattgttacctaatgaaatatgttaaagatggccaggcgcggtggctcacacctgtaatcccaacactttgggaggctgaggcgggtggatcacttgaggtcaggagttagagaccagcctggccaacatggtgaaaccccatctctgctaaaaatataaaaattagctgggcctggtagtgcatgcctgtaatcccagtacttgggaggctgaggcaggagaattgtttgaacccaggcgctggaggttccagtgagccaagatcacaccactgcactcctgtctgggtgacagagtgagactttgtctcaaaaaa

SEQ ID NO: 43321 - DNA, 376 bp, Homo sapiens
tggagatggagtcttgctctgtcacccaggctggagtacagtggcaccatctcagatcactgcaacctccagctcctgggttcaagcaattctcctacctcagcctcccaagtagctaggattacaggcacccaccaccatgcccagctaatttttgcgtttttagtagagacggggtttcaccaagttggccaggctggtctcgaactcctgacttcaggcgatccgtctgccttggcctcccaaagtgctgggattacaggtgtgagcctctgtgcccggccaaatacttgaagcttattaatcaaatcactaatttaaacgttttaaattaggtaacatcaattaaaataggatatcatcatagaaaaataag

SEQ ID NO: 43322 - DNA, 1204 bp, Homo sapiens
gaagacttaacattgctaagacagcagtacctacaaattgatctacagattcagtgaaatccttatcagaatcccaggatcccatgacttctttgacaagttgattctaaaatttatatggaaattcaagacccagaatagccaaaacaatcttgaaaaagaagaacaaagttggaggactcacactttgtgatttcaaaacttactacagagctacagtctgaatcaagacagtgtggtactgggataaattagacatatcatcaatggagtagaatcacaagtccagaaataaacccttatatttattgtcaattgattttcaacagatataccaagacaattcaataggaaataatagacttttcaacaaatgatgctgagacatgcgaagagtgaagtcggatcccttcctcacatatcatatatcataattaactagaaaatgatcatagatgtaaaagctatgattatgaaactccagaaggaaatacaggaatgagtctttctgactttggattaggcaaagccttagatgtgacaacaaaagtataagtggtaaagtaaaaatagagaaaattcatgaaaattaaaaaactttcctgcttcaaaggatatcatcaagaaaatgaaaaggcaatccagagaacaggagaagatattttcaaatcataaatctagtaagcaacttgtatctagaatatataaaggacttttgccattaataaaaagataactatccagttaaagaatggacagaggatctgactggacctttccttaaaaaagacatacgttgaaaaacacaccaaagatgctcaaaaccattagctagcagggaaatgcaaattaaaactacactgcgatatcactttatatctcttaggatggctatcattaaaaaaaaaaacagacaataacaagtgttagggaggatgtagagaaatgggaaccctcacaggtcactggtgggtttataaagatggcataaccactctggaaacagtctggaagttctttaaaagactcaccatagagttattataggacccaaaagaaatgaaaacagatgtccatacaaacacttgtacattaggggtaggtgtgttggctcccagcactttgagaggcctaggtgggcagatcgtgtgagtctaggagttagaatccagcctgggcaacatggtgaaacctcgtctgtaca

SEQ ID NO: 43323 - DNA, 3243 bp, Homo sapiens
ggggcttcctggagcccccgcccctggccgggttctgcctgactcccctttcattcccttgcaggctgagcagtgcagacgggcctggggcaggcatggcggattccagcgaaggcccccgcgcggggcccggggaggtggctgagctccccggggatgagagtggcaccccaggtggggaggcttttcctctctcctccctggccaatctgtttgagggggaggatggctccctttcgccctcaccggctgatgccagtcgccctgctggcccaggcgatgggcgaccaaatctgcgcatgaagttccagggcgccttccgcaagggggtgcccaaccccatcgatctgctggagtccaccctatatgagtcctcggtggtgcctgggcccaagaaagcacccatggactcactgtttgactacggcacctatcgtcaccactccagtgacaacaagaggtggaggaagaagatcatagagaagcagccgcagagccccaaagcccctgcccctcagccgccccccatcctcaaagtcttcaaccggcctatcctctttgacatcgtgtcccggggctccactgctgacctggacgggctgctcccattcttgctgacccacaagaaacgcctaactgatgaggagtttcgagagccatctacggggaagacctgcctgcccaaggccttgctgaacctgagcaatggccgcaacgacaccatccctgtgctgctggacatcgcggagcgcaccggcaacatgcgggagttcattaactcgcccttccgtgacatctactatcgaggtcagacagccctgcacatcgccattgagcgtcgctgcaaacactacgtggaacttctcgtggcccagggagctgatgtccacgcccaggcccgtgggcgcttcttccagcccaaggatgaggggggctacttctactttggggagctgcccctgtcgctggctgcctgcaccaaccagccccacattgtcaactacctgacggagaacccccacaagaaggcggacatgcggcgccaggactcgcgaggcaacacagtgctgcatgcgctggtggccattgctgacaacacccgtgagaacaccaagtttgttaccaagatgtacgacctgctgctgctcaagtgtgcccgcctcttccccgacagcaacctggaggccgtgctcaacaacgacggcctctcgcccctcatgatggctgccaagacgggcaagattgggatctttcagcacatcatccggcgggaggtgacggatgaggacacacggcacctgtcccgcaagttcaaggactgggcctatgggccagtgtattcctcgctttatgacctctcctccctggacacgtgtggggaagaggcctccgtgctggagatcctggtgtacaacagcaagattgagaaccgccacgagatgctggctgtggagcccatcaatgaactgctgcgggacaagtggcgcaagttcggggccgtctccttctacatcaacgtggtctcctacctgtgtgccatggtcatcttcactctcaccgcctactaccagccgctggagggcacaccgccgtacccttaccgcaccacggtggactacctgcggctggctggcgaggtcattacgctcttcactggggtcctgttcttcttcaccaacatcaaagacttgttcatgaagaaatgccctggagtgaattctctcttcattgatggctccttccagctgctctacttcatctactctgtcctggtgatcgtctcagcagccctctacctggcagggatcgaggcctacctggccgtgatggtctttgccctggtcctgggctggatgaatgccctttacttcacccgtgggctgaagctgacggggacctatagcatcatgatccagaagattctcttcaaggaccttttccgattcctgctcgtctacttgctcttcatgatcggctacgcttcagccctggtctccctcctgaacccgtgtgccaacatgaaggtgtgcaatgaggaccagaccaactgcacagtgcccacttacccctcgtgccgtgacagcgagaccttcagcaccttcctcctggacctgtttaagctgaccatcggcatgggcgacctggagatgctgagcagcaccaagtaccccgtggtcttcatcatcctgctggtgacctacatcatcctcacctttgtgctgctcctcaacatgctcattgccctcatgggcgagacagtgggccaggtctccaaggagagcaagcacatctggaagctgcagtgggccaccaccatcctggacattgagcgctccttccccgtattcctgaggaaggccttccgctctggggagatggtcaccgtgggcaagagctcggacggcactcctgaccgcaggtggtgcttcagggtggatgaggtgaactggtctcactggaaccagaacttgggcatcatcaacgaggacccgggcaagaatgagacctaccagtattatggcttctcgcataccgtgggccgcctccgcagggatcgctggtcctcggtggtaccccgcgtggtggaactgaacaagaactcgaacccggacgaggtggtggtgcctctggacagcatggggaacccccgctgcgatggccaccagcagggttacccccgcaagtggaggactgatgacgccccgctctagggactgcagcccagccccagcttctctgcccactcatttctagtccagccgcatttcagcagtgccttctggggtgtccccccacaccctgctttggccccagaggcgagggaccagtggaggtgccagggaggccccaggaccctgtggtcccctggctctgcctccccaccctggggtgggggctcccggccacctgtcttgctcctatggagtcacataagccaacgccagagcccctccacctcaggccccagcccctgcctctccattatttatttgctctgctctcaggaagcgacgtgacccctgccccagctggaacctggcagaggccttaggaccccgttccaagtgcactgcccggccaagccccagcctcagcctgcgcctgagctgcatgcgccaccatttttggcagcgtggcagctttgcaaggggctggggccctcggcgtggggccatgccttctgtgtgttctgtagtgtctgggatttgccggtgctcaataaatgtttattcattgacggtg

SEQ ID NO: 43324 - DNA, 1181 bp, Homo sapiens
cgtctacgccatgactgtcaccagcttcctcctgccctctgtataagccagagcatcggtgagtggacagatcatgagcctgctgatcccgcatcgcggtagcctgttctactatcactcatctgtgctggtgacctacatcatcctcacctttgtgctgctcctcaacatgctcattgccctcatgggcgagacagtgggccaggtctccaaggagagcaagcacatctggaagctgcagtgggccaccaccatcctggacattgagcgctccttccccgtattcctgaggaaggccttccgctctggggagatggtcaccgtgggcaagagctcggacggcactcctgaccgcaggtggtgcttcagggtggatgaggtgaactggtctcactggaaccagaacttgggcatcatcaacgaggacccgggcaagaatgagacctaccagtattatggcttctcgcataccgtgggccgcctccgcagggatcgctggtcctcggtggtaccccgcgtggtggaactgaacaagaactcgaacccggacgaggtggtggtgcctctggacagcatggggaacccccgctgcgatggccaccagcagggttacccccgcaagtggaggactgatgacgccccgctctagggactgcagcccagccccagcttctctgcccactcatttctagtccagccgcatttcagcagtgccttctggggtgtccccccacaccctgctttggccccagaggcgagggaccagtggaggtgccagggaggccccaggaccctgtggtcccctggctctgcctccccaccctggggtgggggctcccggccacctgtcttgctcctatggagtcacataagccaacgccagagcccctccacctcaggccccagcccctgcctctccattatttatttgctctgctctcaggaagcgacgtgacccctgccccagctggaacctggcagaggccttaggaccccgttccaagtgcactgcccggccaagccccagcctcagcctgcgcctgagctgcatgcgccaccatttttggcagcgtggcagctttgcaaggggctggggccctcggcgtggggccatgccttctgtgtgttctgtagtgtctgggatttgccggtgctcaataaatgtttattcattgacggtg

SEQ ID NO: 43325 - DNA, 3859 bp, Homo sapiens
ggggcttcctggagcccccgcccctggccgggttctgcctgactcccctttcattcccttgcaggctgagcagtgcagacgggcctggggcaggcatggcggattccagcgaaggcccccgcgcggggcccggggaggtggctgagctccccggggatgagagtggcaccccaggtggggaggcttttcctctctcctccctggccaatctgtttgagggggaggatggctccctttcgccctcaccggctgatgccagtcgccctgctggcccaggcgatgggcgaccaaatctgcgcatgaagttccagggcgccttccgcaagggggtgcccaaccccatcgatctgctggagtccaccctatatgagtcctcggtggtgcctgggcccaagaaagcacccatggactcactgtttgactacggcacctatcgtcaccactccagtgacaacaagaggtggaggaagaagatcatagagaagcagccgcagagccccaaagcccctgcccctcagccgccccccatcctcaaagtcttcaaccggcctatcctctttgacatcgtgtcccggggctccactgctgacctggacgggctgctcccattcttgctgacccacaagaaacgcctaactgatgaggagtttcgagagccatctacggggaagacctgcctgcccaaggccttgctgaacctgagcaatggccgcaacgacaccatccctgtgctgctggacatcgcggagcgcaccggcaacatgcgggagttcattaactcgcccttccgtgacatctactatcgaggtcagacagccctgcacatcgccattgagcgtcgctgcaaacactacgtggaacttctcgtggcccagggagctgatgtccacgcccaggcccgtgggcgcttcttccagcccaaggatgaggggggctacttctactttggggagctgcccctgtcgctggctgcctgcaccaaccagccccacattgtcaactacctgacggagaacccccacaagaaggcggacatgcggcgccaggactcgcgaggcaacacagtgctgcatgcgctggtggccattgctgacaacacccgtgagaacaccaagtttgttaccaagatgtacgacctgctgctgctcaagtgtgcccgcctcttccccgacagcaacctggaggccgtgctcaacaacgacggcctctcgcccctcatgatggctgccaagacgggcaagattgggatctttcagcacatcatccggcgggaggtgacggatgaggacacacggcacctgtcccgcaagttcaaggactgggcctatgggccagtgtattcctcgctttatgacctctcctccctggacacgtgtggggaagaggcctccgtgctggagatcctggtgtacaacagcaagattgagaaccgccacgagatgctggctgtggagcccatcaatgaactgctgcgggacaagtggcgcaagttcggggccgtctccttctacatcaacgtggtctcctacctgtgtgccatggtcatcttcactctcaccgcctactaccagccgctggagggcacaccgccgtacccttaccgcaccacggtggactacctgcggctggctggcgaggtcattacgctcttcactggggtcctgttcttcttcaccaacatcaaagacttgttcatgaagaaatgccctggagtgaattctctcttcattgatggctccttccagctgctctacttcatctactctgtcctggtgatcgtctcagcagccctctacctggcagggatcgaggcctacctggccgtgatggtctttgccctggtcctgggctggatgaatgccctttacttcacccgtgggctgaagctgacggggacctatagcatcatgatccagaagattctcttcaaggaccttttccgattcctgctcgtctacttgctcttcatgatcggctacgcttcagccctggtctccctcctgaacccgtgtgccaacatgaaggtgtgcaatgaggaccagaccaactgcacagtgcccacttacccctcgtgccgtgacagcgagaccttcagcaccttcctcctggacctgtttaagctgaccatcggcatgggcgacctggagatgctgagcagcaccaagtaccccgtggtcttcatcatcctgctggtgacctacatcatcctcacctttgtgctgctcctcaacatgctcattgccctcatgggcgagacagtgggccaggtctccaaggagagcaagcacatctggaagctgcagtgggccaccaccatcctggacattgagcgctccttccccgtattcctgaggaaggccttccgctctggggagatggtcaccgtgggcaagagctcggacggcactcctgaccgcaggtggtgcttcagggtggatgaggtgaactggtctcactggaaccagaacttgggcatcatcaacgaggacccgggcaagaatgagacctaccagtattatggcttctcgcataccgtgggccgcctccgcagggatcgctggtcctcggtggtaccccgcgtggtggaactgaacaagaactcgaacccggacgaggtggtggtgcctctggacagcatggggaacccccgctgcgatggccaccagcagggttacccccgcaagtggaggactgatgacgccccgctctagggactgcagcccagccccagcttctctgcccactcatttctagtccagccgcatttcagcagtgccttctggggtgtccccccacaccctgctttggccccagaggcgagggaccagtggaggtgccagggaggccccaggaccctgtggtcccctggctctgcctccccaccctggggtgggggctcccggccacctgtcttgctcctatggagtcacataagccaacgccagagcccctccacctcaggccccagcccctgcctctccattatttatttgctctgctctcaggaagcgacgtgacccctgccccagctggaacctggcagaggccttaggaccccgttccaagtgcactgcccggccaagccccagcctcagcctgcgcctgagctgcatgcgccaccatttttggcagcgtggcagctttgcaaggggctggggccctcggcgtggggccatgccttctgtgtgttctgtagtgtctgggatttgccggtgctcaataaatgtttattcattgacggtgaaaaaaaaaaatgacaaaacacacactagatccaccaaaagagaacaatcaagataactaacgaggagccgcgtgccctgctagaagattgccgccaatggcggcgtgccccatgttaccacacgcgtcacccgtccccattgtttggctggccacggggggtggccccccaacattgggcggagggagatcgtagaggacgattccgcgtggggcactccgccgttggttcccatagcgcacgccacgtccccgtggggagccccttcgtgcgtccccgtggcgcgacctcttggtggcgaaggagggcatccccttccttccctccgccgggggttggctccccttccttgggggccctccagttccccccccactcggtcgcaacattccaccaacaccacgcctatcatacggggctcccccctgatgccacagcactctgccaccggcggttcctggctggtgcgggtcgccgcctgcgcacgcgtctgcatgtctctcgcgaccacccccgccgctaacacacgccttgctcgcgccgccccccgcgcccttgcgtcccactcgcgcacccccttctgtcttcccccggcgagccccctcgtgtcccccc

SEQ ID NO: 43326 - DNA, 437 bp, Homo sapiens
ctgaattatgggagcaatttatttttatagcccaaactctcctattctcttcaggaatatattgtcagtggtatcatatctaaactcctcaattgcactgttgcttgttacttccttacgcattagtcctttgtgctggacaaactaatgtcttcatgtccattgccattgccttccctaataaacactccttactcttttttctttctttcccttacttcatatttgccttgaaattatttgcctgtcagatagattgattcatttttagtaaaatttagtttttctaggattccctttgatcctagcaatgggagatatttgatgcaggtgtcaacctttacacttgaaagaaacaaagggactcccttgtagtcagaaaggagatatcttggctatagatcagttaacagagaatcaccttatgttaaaatgta

SEQ ID NO: 43327 - DNA, 521 bp, Homo sapiens
tttagactatcccctttagtttacaacctgacatggttggttatttaaactttgttgagctaattttcaagccatatgaaaaactcatttatatgccttggaaatgtagcagtagagggtgggtatgaccatgatatggggaatgctactgcaggactggtatcctatattctagctctgaggaagggtgatagtatccctttggaacataaaaaataccttcgagatatttttagcacacacagggcccaagttagagaaagccctgctataagaaatctctttaaccacagaataaagaactatatattacacacaagacttggcagcaactcaaattccaaatgttagtttttcttgcattcatcatatatttcatggaaaatttatatcgatctcagatcttactaggaagaaaattctaagccagcataaatgaataagtggatttcaatcttctgaaagggcttttgggtgtggctgagatagctaactttgaaaacttagcaacacaggataca

SEQ ID NO: 43328 - DNA, 298 bp, Homo sapiens
taggaagcaagctaacaagcagcaggctacggctgcctacaagtgtacataggtatctgcctgtccccctaactgggcatcagctccaggccagcagggctttcccctctctttcagtcactgccgtgtcctcgcctaagagagtgtctggcacacagtaggtgctcagtgagttactcattgattaaaaagcctggaaaaccaggctgtgtcgtgaagataataggcagccactgaggtcttactgcatgagaacaaggaaagctcagctcagtgtagattgccggacctaaatttt

SEQ ID NO: 43329 - DNA, 938 bp, Homo sapiens
taggtgtggttttcatttttctaagtgatagaatcccctctttgttgaatttttgtctttatttaaattagcaacattacttaggatttattcttcacaatactgttaattttctaggaatgatgacctgagaaccgaatggccatgctttctatcacatttctaagatgagtaatattttttccagtaggttccacagagacaccttgggggctggcttaggggaggctgttggagttctcactgacttagtggcatatttattctgtactgaagaactgcatggggtttcttttggaaagagtttcattgctttaaaaagaagctcagaaagtctttataaccactggtcaacgattagaaaaatataactggatttaggcctaccttctggaataccgctgattgtgctctttttatcctactttaaagaagctttcatgattagatttgagctatatcagttataccgattataccttataatacacattcagttagtaaacatttattgatgcctgttgtttgcccagccactgtgatggatattgaataataaaaagatgactaggacggggccctgacccttgagctgtgcttggtcttgtagaggttgtgttttttttcctcaggacctgtcactttggcagaaggaaatctgcctaatttttcttgaaagctaaattttctttgtaagtttttacaaattgtttaatacctagttgtattttttaccttaagccacattgagttttgcttgatttgtctgtcttttaaacactgtcaaatgctttcccttttgttaaaattattttaatttcactttttttgtgcccttgtcaatttaagactaagactttgaaggtaaaacaaacaaacaaacatcagtcttagtctcttgctagttgaaatcaaataaaagaaaatatatacccagt

SEQ ID NO: 43330 - DNA, 703 bp, Homo sapiens
aggtgcagtggctcattcctgtaatcccaacactttaggaagccaaggcagaagaatcgcttgagcccatgaatttgaggccagcctgggcaacatagccttgtttctacaaaaaatcttaaaaataaaattagccaatatgtgggcatgcacctgtggggccagctgctcaggaggctgaggcagaaggattgcttgagcccagcaatttgatgctgcagtaaaccatgatgacactactggactctagcctgagtgacagtgagactctgtctcaaaaaacaaacaaaacaaaaactggaaacaacaaaaaaaggactggggttatttaagctagttaggaatttatctttctatatgttaataacagcctaacagattttttgttttaaatatctctaggctagcctcaaggttaagtaattatagaagtttggtatgtattttcttcataatttgaatataattgcttccattgtgactgtcaattgaatgcatggagatcaattgtgataatatacaggattttagtcctatctctactgctgaagtaaccttacacaaaatactttgtaaaaaaatcactaaagtgccagcatttttaaagtgtatatttttctttggcaacctctcatgaaaagcactaactaaaaatatttaataatcttttttgtattacagtgcttcttttgttggaaatata

SEQ ID NO: 43331 - DNA, 467 bp, Homo sapiens
cgtgcttacactctaaacatttctggggaaacgggggttttgctgtgaggtactgggaaacatgaaaaaggtaaaatagctggtaaaaacttgttcagtgaaatcctttgctttttcctttatatagtgaaggagcaaggaattgccaaaaagctttcaagctaatggattttcaaatataggaatagtaatttttaaatcatagaagaaaggattcagtgatttcaaccccgttctcattatttccctttaacaaagcatcatatatttagattggtgatttctagaagttaccatgtttgtattataacatatttgaatctgagaatttctaataacaccatggtaactttgtagtgaaaatcattaatcattaattatatattaaaatgcatcccctcataaaatctctaaagatgtatttttttctgtttgactactgaaataaaatttgatatctcaccacc

SEQ ID NO: 43332 - DNA, 299 bp, Homo sapiens
gaaggacacctcaatggcttaagtgttcttctaaagtgtcaagtcaaaccttcataaacgtaggctggtagtcattttgcattaataaattcattaatagagtggtctggtgaaaagggtcattggaaatttatgataggccttttatcatgagtgacaactgcaaaatattaatgatttagaacaaatcatgttgcctgctgaaaagtgagtagaaagcttgtagggaaatgaaatgtcctgggtttttttgtttgtttgtttgttttttgtttttttaaatgggaaagttgttagga

SEQ ID NO: 43333 - DNA, 384 bp, Homo sapiens
aatcatgtcactctttgcttcaagacctgtggtaatttcccatcatgtccaagataaaatctaaattcaggaaagcaatataaagcattttttcttcatttgcttactatccaattctccagcctcatctctagccattcttccgctcaccctacagttttaccaaacgtgacttgagtcccacaatatgtgtgtgcatgtgtgttatgcctttgcacataatattccccctgtatggaatattattttccactaggatattttactaggataacccacacacatactttaagacttggtttaagcaccatcccctctatgcatataagacagaatatcacatcagttaccaaactgtattctaaaggtttctttcctcatttt

SEQ ID NO: 43334 - DNA, 428 bp, Homo sapiens
ttcacttttacaaaaaaagatgtatgttcttgtgcaggtctcaagagtataatgaaggaggagcaacgtggcttggtctgttttcaacagtgacaggaatgttggagagcactctctttgtctttctccctggactccagaaatcacaaacagtgctgatatcatttgccacagacctagtattcagtgcacatgggaacagaagattgataacaagtgtgtacctgtgaaaactgcctgggcgcagcccttaccaatgacaatccttcatgtttttgtagaagaaaggaattttgcatcttactttaaagcttacgtggggaaaagcttttagatgtatattctttaccagtgctgtccactaaaggtatgatgtgaaccagtgcattgctttaaattttcattacaaagattaatcaaaaaaatta

SEQ ID NO: 43335 - DNA, 484 bp, Homo sapiens
atatcttttcatttggtgactctagcctacctttctccattctttctccttactttatccactcagtgtctcctccctccattcaggagcccagctcttctttttcttttcgctccctcaaacctgttgcaagcagcccgagtctgtgcacaagtctttgtgtgtgtggtgtgtatgtgtgtgtgtatatgttttgggggagaggtaaggaaaagaaaaaagagcttttgctccatgcaagtaggaaaaaaaagataattaataatgaactgaacatcataattggcttctccatcacaagctaatgggctgcatctcttctgactctctttgtgtattcattggaggagctctaaattcacaggacaatgaagacaaacaaggaaataatagactatagacagtgacaaggaaaccagggaacctgtctcaatgtggtcatgctgaactattttcagagcttaaacggactgacaaaaaaata

SEQ ID NO: 43336 - DNA, 471 bp, Homo sapiens
  misc_feature (156)..(156): n is a, c, g, or t
ctggattctatttgagactaatttgtttgaactcagctctcaacatcaacatttatttctcactgtgtttagctgcacaaaactatttaagagaaaattcggcaaatcaccattatcatgtcatagtttccatccaattttttcaatgtgcgtcangcgcacatgagtatatttatcttctgacggttgctgtgaccaaccctctggttacccctaaagctatcaccctgcacatcggctggcccatcgtcactggctacacaggagagtcagaagctggaatatactcaaaagatcatcattagatgtgagtaagaaagcctctcacaaaacagcaggtcatatcaacttactaaatcttccttgaaaaaaaaatttttttaactgacaacaaatacttatagggtaatatttaaaagttaaaatcagctatcttttttcatttctaagttatttaataacattattcat

SEQ ID NO: 43337 - DNA, 308 bp, Homo sapiens
gcctcagcctcctgagtagctggtactacaggtgtgcaccaccacacccggctgatttttgtgtttttagtagagacagggtttcaccatgctggccaggctggtctcgaactcctgacctcaggcgatcctcctgcctcggcctcccaaagtgttgggattacagacgtgagccactgtgcccagccagaactttttatatattaaggttcttggtccttaattgatgttatatgatgtgaatatgtttttctaggtttgccaattatctttttactttgtattgttccatgttacctcatagtact

SEQ ID NO: 43338 - DNA, 890 bp, Homo sapiens
aggctggtatgcagtggcgcgatctcagctcactgcaacctgtctcctgggttcaagcagttctcctgcctcagcctcctgagtagctgggatgacaggcgtgcaccaccatacccagctaatttttgtatttttagtagagatggggtttcaccatgtttgccaggctggtctcgaactcctgacctcaggtgatctgcttgcctcggcttcgcaacattctgggattacagacgtgagccaccgcgcccaaccagtaacgatttttttaaagggcctttcttaattgacagttttaagctgtagacattaatattataacaaacaaaacatgccagttttactgattccgctttttgcttgattcaggaacttttcattgtttggggaagcttttgaatgcagtactgtggaggaaatcatccttaaaatagcatttcacacatagggccaaaattgaaattgtcaaggaaacccctcagcatctaacgtcatcttgtagaagagctgggcatacctcttcctctaggccaattcagaggccactggccacccaagtagagtggggcccactggcatgagtagtccctgtgcccatgcccatggtggtgcttgactttgctttggggcttaatcctagtatcatttggccattaatttttaattaagtttatacttgaataatcagttttactcctgaaaaattttgaagccagcactgactttgtttatattcacttaccttgtatatgaacttatgacattagagtttgtgaaactgtcttaacgtggctcatacacgtgatgtcagagggactggtcagttctttacagggtgaattaatcggcagctggctagtcagagcaactgatgggtggcttttttttct

SEQ ID NO: 43339 - DNA, 829 bp, Homo sapiens
ttcaatcaattgagcgacttataattttatttttggcttataaaaagtttattggtttaggagtatgtttctgaaatgcagatttgaacattctggcaaggaccctaagcaatggtatattctagtctctaggctacttcttagatgcatgggaaaagcaatggctcccactaagggagggtgaaatgccagaattactctagcagctgctggaagaagggattgaaagattcacagaagtgggcatgctggagtagatctaccacgtgaggccaggatactcaccaaatgattacagtgcacaggaaagccataagcagtacagatgcaggcacaccagcatcactaaaaagcacagtgatgcctcttcttcgtaggtcatcggtaacggtagaaaaggtgatcacagaacacagaactaagctaactgatagcaatagagatgatcacaatcaccctgctacccagtgggggtagggggaatagaggacagatgatgatgtgtagctgtcaaaaatcagatagatccaatgatcacaatgaacagcaaagttggagcagtccagagggccaggccaagacagccatggagaaggttaagaaaacacagcatgcctaggggcaaaatagatggacagttaacaaagaactcttcaattcaccatcaaaacaaaccaaaaatgaatgatcaagacactgaaggggctgggcacagtgacccatgccagtaatcccaacattttgggaggctgaggtgggtggatcacttgaggccaggagttaaagatgagcatgggcaacacagtaagaccctgtctctacaaaaaaa

SEQ ID NO: 43340 - DNA, 347 bp, Homo sapiens
tcattagaagatgcttttagtagacacaccagtgaacctaggcagccaatgtaatcaaagggatggaactgaaagagcaggggcagagtgggtttaagtcctggctgtgcaagttagtagctatatggcagcagcagtcacattatttaacctctctgagctgcaacttccttatttataaagtggaggtaataatgcttacatctcagggttgttgtgagaattaaatgaaaagaatgtatgtgaagtgcctagtctatagtagttgctaactaaatgtgggccacgtccagtcatcctcaatcccaacagtggtctggaatgggccatttctgacagtgaatggt

SEQ ID NO: 43341 - DNA, 522 bp, Homo sapiens
tacataaatctaatattcttattttagaaagcgtaaaaagtgcctcaaaaccataacaacttcattaccagtaagaccctcccagtttcctttcatcttaatcttgactgcatctgcctgtggggccccagctttccaaggctttgtagcttctttcagaatgaaggctccttccgtggctggggtgagcagtcttgagatatccgcaagggagactccccagaaaaaactaacagggcctttaataacctcctgttggccgggtgcggtggctcacaccgataatgccagcactttgggaggccgaagcgggtctgaggcagagagttcaagaccagcctgacaaacatggagaaaacccgtctctactaaacaccaaaattagccgggcgtgatggtgcatgcctgtaatcccagctactggtggggctgaggcaggagaatcgcttgaacccagtaagccgagatcacgccattacattccagcctgggcaccacaagcgacactgtgtctaaaaaaaa

SEQ ID NO: 43342 - DNA, 400 bp, Homo sapiens
gagacagggtttttttatgttgtccaagctggtctcaaactccagggctcaagcaatcctcccaccttgtcctcccaaagtgctgggattacaggaatgagccactgtgcctggtctgggttttgtttttttagagatagggtctcattatgttgtccaggctagactcaagtcctttggctcaagcaatcctctcacctcagcctcccatgtagctgggactaaagcgcacaccaccataggcaacctctattatcatttaaaaaaactattcttttactttgattataaaaggaatatatgatcattgtaaaaagtgtgggaaaatatagaaacatttttaaattggggggctggggcccagttaggctttacatctgtaatcacagtgctttaggag

SEQ ID NO: 43343 - DNA, 187 bp, Homo sapiens
agaacctggagcaggagcaaggtgtgtagatgtgaatagggacttgatcattgtcgtttcctctgtggaaaattaaatcccttccctttctttgaaaatgtgaatggctgagaggaaacagagaactgactttttagaaaggcaatcaaggcacagaaaatcctagaagaaaatatatggaagagga

SEQ ID NO: 43344 - DNA, 642 bp, Homo sapiens
gtagagacagggtctccttatgatgcccaggctggtcgtcaactcctgggctcaagcaatcctccctcctcagcctcccaaagtacttggattacaggcatgagccactgtgcctggccagcatgcaaatttattaacttgcacaggtgtcttacaaaatagaactcaaataaatggccagatgattgatgcttttataccatcttggggttatagaaagaatgggagcttggagcttgccagaacagattatggcaggcagagaagagaaggcctggttagcaaaggtggtcttgttatattatgtagataagacaggtagcagccctcggagaaaatagcggtaaaggtctatttcttttagacctttaaaggcatcacactctcagttaatctcccctagatctggacaagggagggcctcagagaaagcctagctgcagccatgcagattttctctacagatacagatctctcccacaaaagacagctttgcagggctacttctgtatgtaggccctctcaacagccatctcaaaatatgtcaaagtatattttggggtgaactattttggtttccttcaaggagcactgagtccagggtccagatttttcacttccttagagaggcactgtagcatc

SEQ ID NO: 43345 - DNA, 522 bp, Homo sapiens
ctcatatcatcaggcattagagtgtcacaaggagtatgcaacctggatccctcacatgtgcagttcacaatagggtttgcaatcctatgagaatctaatgccgccaccgatctgacaggaggcaaagctcaagcggtagtgcttgcctgccactcacctcgtgctgtgtgtcccagttcctaacaggccatggaccaggggttgaggaccccggcctacaccaaattataacaagcttaagacaaagagtagtagaaaaaggtaattataaatactatgcatgaccatatgaccagtggcagaaatgagcactgtaatacttatgaatgttttccttattttaatatgcaaatacttgtgtgtatattaatttttttttctcttttccttttacatttgcctaacatctaacataaaaagtattaaaagtaattaatctgtatgatagcgtttaatttgtaagatatcaaagaaggaatgtgactcaggtagaagggtaataaaagtcactcaagaggcctg

SEQ ID NO: 43346 - DNA, 583 bp, Homo sapiens
gaagtttagaagtaatagacatctgctgtttatatttcctagaatatgtttcacttcttttgacacctcccattttctttggagtaccactcctctctttccttcagtccttttggttggtagactcttggtcaaaaaaatctccaatttgctgctcaagaagaattgaccagtctccggaagggccttaacagggtcctcctggttcaagacagcatttaaaaaataaaaagagaccaggctcagtggttcacacctgtaatactggtgctttgggaggctgaagcaggaggattacttgaggccaagagtttgagaccagcctgtgctatatagtcagacattgaatctatccatacatacatacatacctatctgtattatatctctaaaaatgtcaggtactagaatccataaatacagactagaaattagctatgcctaaaatgatgggtcacatttttaaaaatctaaaacaataccagtatttttgatgcctgtgtgagagcataaatattaagaaaggcaattggtcagcaggactttctgccccagtcatatatgcattttgatttcattcaat

SEQ ID NO: 43347 - DNA, 352 bp, Homo sapiens
atatattttgaaactattgttaagggcataaatgtatttgggattgttatgtcttggtggactgaatcatttgttaatagataatatcactatccctgtcaatattcctctgaaaactactttgtcacatacttatcaaactactgctagtaatctctttttcctctcctctgggattttaattatgttagtgtattagaccccttcgttctgtctcatagacctcatattctttttcttgtcaatatttttttctcttcaggttgggtaatttatattgttctgtcttctagctcatgattccttcatctgtcatctccattttgcaaaaattttcatttgattcttttta

SEQ ID NO: 43348 - DNA, 620 bp, Homo sapiens
actttgttgcctcccagccaaagctgcttgctaacaattttacgatttgacaaaaggaaatactgccctcttgggaggacaaatcatctatgtcatgcaatgcaggagaatatgttaagctatatagagtattcacaagtaaggagtttgtaaacctaggagttgaatgcttaaatgtagaaatatggataactatagtctgagctttgaagctatgggtaaaaagatgaaattaatgtcgttacctaggatgtaactaaatctatatttttgcagaaacttcagtttttttaggtgaaaaaacttcacagtactttattgacagcatcccttgtgctgttctccatattttcaggcaggcccaagttactgctgataataaacacacttaaaattatcccagaatcaaatttgcctgaaaaccaaataaaaaacaaaaggaaggtcccttaagattatgtctttattaattactctcaagaaaaataaggaaacctactgccagccctcatttttatgtttaatgggatgatctgtacttgggtactttaccgcctctctgttggaaattttttatcatttgtgggaaaataataagaaaaataccttggatttattta

SEQ ID NO: 43349 - DNA, 354 bp, Homo sapiens
ggacacggcaagaacaacgttcccctcagtctctaatggacacggactgcccttcccaggcagaacgcacgcactcgcctgcagaaaccttgagttcaccattatttattatgtctgggggatgctgccatcccctgtgatgcccctgattaatgataatgtgcaaacctgaggtaattcgctgacatgttagatctttgtgaggcaccagaatggaagcggcatttttcaaactctgctctgcgggagccccaggggctgttccagctcaggggggaaggggagggcggcagctcccgcggctgctgctccatttttagctattttatgtgtttatttgtttacaatgcttgt

SEQ ID NO: 43350 - DNA, 575 bp, Homo sapiens
acatgtcttattccctctatcacgtgagagcatattttattatttcagtggcaaggcaaatggctaagttttgtcataaaactttcaatctgattcttccacctttgaagcccttctccagctgactggttaggtgatttgtcatataaccgctaaattcagtcaaagaacatggttttaatgagtagccgttttaaagtgattccattaaaagcagctaagtcaacaacctacatgtgattccgattataatttattatataatatcacactgctgaaagaaagaaatcagggcacaaaattgtatattcattatgatctcaatattacaaaaatatgcataggggaagataagagggaaagacagaaaatcattcttttggggtgatgaaaatgatggttatgtgttgtgttctttatacattcctgtatttttcgtgttttcaaaaatgagcatgtgttacttctataatcagaagaatattttaaaactaatctaatctggaaaataaagtcattatctccatcaatgaggttgtcaatgagataaaagatgtgatttcatttcataaatc

SEQ ID NO: 43351 - DNA, 414 bp, Homo sapiens
gatccagatgtaaaatagattttctaagtaggctaaaatgtttgagaaccactaacctatgaaactataaacttaataagaatataaagtagaaacaaaactatggtcccttaaaaaccctaatttctcctagcctgaccaacatggtgaaaccccgtctctactaaaaatacaaaaatcagccaggtgtggtggcgcacgcctgtaatcccagttactcaggaggccgaggttgcagtgagctgagatcacgccactgcactccagcactccagcctgggtgacagggcgagactccacctcaaaaagaaaaacaaaacaaaacaaaaccctaattcttcaagtacagtctgtgaaaaaacacatcacaactcctcggagtgtttgcagtggaaattcctaagtcctgcccaa

SEQ ID NO: 43352 - DNA, 291 bp, Homo sapiens
cttaaatcgggaaaggagagtaagagaaagcactcaacggagtcagaggtgtcttgcagcctagctctttccacagacaagctacatgggcctatcatctaaccttttcaagcttctccgactgcttctgtgttggagggatttgggctagaggatctttttatttttttttattttattttggtgacggagtctctcactgtcgcccgggctgaagtgcagtggcgcaatctcagctcactgcaacctctttctcctgggttcacgcgattctcctgcctcagcctccca

SEQ ID NO: 43353 - DNA, 521 bp, Homo sapiens
  misc_feature (1)..(1): n is a, c, g, or t
  misc_feature (4)..(5): n is a, c, g, or t
  misc_feature (36)..(36): n is a, c, g, or t
  misc_feature (53)..(53): n is a, c, g, or t
  misc_feature (70)..(70): n is a, c, g, or t
nggnncagaggagggttctgggtctggatctcttcntaaggagaaccagggantggccctggcctgtganttgggtctcttcctgaggaaaccaggtcactatagtgaccctagtgacaggaagaaagggagatgggtgtggctgccaggactttctccagtggaaaagggattccctctaggctgagcctcccctgggccttagggcctcacccttcccttcccccacacctgtcctggcaggtaaggctgcttcctgcttcctgggcccagatggcagccgcaccacccagctgatctccagcagccctccccctccccaagggtggcttccctgcagaagaatctgcatggcacgctgttgtcttctttctggggtccatctcctgtactggggagggagaacctcagaatctcctggaattctttaccattcagaaaccagcctcccctctgaagaatcccaaggcccagctgggctcaatttggatctgttctttgttttaaaaatgtgtatttat

SEQ ID NO: 43354 - DNA, 635 bp, Homo sapiens
tggggagctgagttcacagacaaagaaaggctggcacttcctttttctcacttgaatggggtccaaggcacagccttgtcctttctctgctgtttttggagtggcctgaaaaccgggccttccccactcctggacactggcactcagccagttactgaaggcgtttgctgggacctccttgcctcagacattgactggcctgcctgggtttgaaccctcactttgccacttctagcttaggcggaagtatcccgctctctgggccgtggtatcctcacctgcacctggggagatggcagtgctgacatcccaaggttgtaggatggccctgactgcatgagatcctgggtggccagccctgagaatccattattattattattattactgttattttgtttttgagacagagtctcactctgttgccaggctgagattgtgccactgcgctccagtctggatgacagagcaaaactccatctcaaaaagaaaaaaaaaaaagagatgatatacagatagcaaacagtatctgaaaaaattgcacaacatcatcttagtcaatgggaaaatgcaaattaaaactgcaaagagatactttgacaaacccactaaaatggccagaacttttcaatgga

SEQ ID NO: 43355 - DNA, 349 bp, Homo sapiens
tgggattacaggcatcagccaccgtgcacggcctgattattgtcttaaaaggtgaagctaatgttttaaagtagggggaagtaagacatgacttcaaccctatattgaatttgtggttcaatttacagaaaattgatgtgaaaatatgtgtgtgtgtgtgtgtgtctgggtgtgtgtgtgtgtgtattaaataaagcacttgcaagaggacctggtatacagtaagcacttaactggatattaggtcttaaatagctattatctttattgtattaatccaccttatctatgaatattatttttcttcacttgtttgtgtcttatctctttaataaagttttataatttt

SEQ ID NO: 43356 - DNA, 257 bp, Homo sapiens
atctgtcagacctgtgattaaacaaaaacaaatcctaggaacaaaacattctgaatagatgtcaatatttgtgtaacacggctgggcaaggtggctcatgcctatatcagcactttgggaggccaatgcaggcagatcatttgaggtcaggagtttgagagcagactggccaacatggtgaaaccccatgtctatgaaaaatacaaaaattagctgggtgtggtggtgcatacctgtaatcccagttactggggagg

SEQ ID NO: 43357 - DNA, 418 bp, Homo sapiens
tggacttgttggttccattccattcaaaagttctctgtggctcctttccagttcttagtttgtatattattcttgaaaagttttaagtacttacttgtgtatcaagcacaacagtaggtgctttatttgtataatctcatttaatcataatacctatctcatacagccatcagtccaatttaacagacataaatagaagctaagagattaagtacactgagcttatacaagatcacaataatttccgttaagactctaaaacccttggctcttccaactataccatgaaggttctctacagaatctgttgttctctataaattcaaacggggagaaaaggaaacaacagggaaaagggattgagctttcttttgaaagcagtgactgtcaggcctgcatccattcctacaattgtttt

SEQ ID NO: 43358 - DNA, 391 bp, Homo sapiens
catgacgtgttaaggttggagcaaaaataattgtggtttttgccgttatacaacaaaaaggcaaaaaccgcaattacttttgcaccaacgtaataggttgcctttttgtctccactgaattaagtcctactggaagtacttcccttgtggaaattacattaagattgtatgtattagccgaggcgggtggatcaccctaggtcaggagttcaagacaagcctggccaacatggggagacccagtctctactgaaaatacaaaaattagctgggcatggtggtgagcgcctgtaatcctagctactcgggaggctgagacaggagaatcacttgaaccagggaggaggaggttgcggtgagccgagatcgtgccattgcactccagcctggg

SEQ ID NO: 43359 - DNA, 406 bp, Homo sapiens
gaatgtacttaacacaaagaatagggtccccaggagagcacttaaagggcaagcagaggaagcctaggtaggttgggttggggggggggacctacaagggccaggaagtttgtaggattgccatgagtgaggagtgtcactaatgctgggaaaggagggtggacattctgtggtttttttttttgagggagtctcgctctgtcacccaggctggggtgcagtggcgtgatctcagctcactgcaagctccgcctccccgattcacgccattctctgcctcagcctcccgagtagctgggattagccaccacgcccggctaattttttgtatttttagtaggtttcactgtgttagccaggatggtctcgatctcctcacctcatgatctacacgcctcggcctccc

SEQ ID NO: 43360 - DNA, 1075 bp, Homo sapiens
gcagcttgagtgtttcaaattaactttacattgcatttgtcactagaaccaaatccaagaatgattgcgtaggtcagtgagacacagaagaggcaactcaacaaagcccatgacatacagtgcatggctcacaatcccaggagatgagggcagcacagctgcagagcaacacagagtggggggaacatccaggatgcacattcaaccagtaggtggggagcaagacagacagggacctgtgggccaaagcgtttcttggggtctagggaattgaccaaggaggtgtctcttggggagttgtttctggtggatttagagcaagcaggcactagttctgtgaagtcgcactgtgattaagaggtggtctgtaccatccatgtggggtgtaagggtcagtggtacaagtcaaattggttatatctagctgtcccacagggaggtggtcaccagaatgcagttgtgtaataaatatatgtgagttgaccacatggaggaactgggagaaagtggagaactagaaactctgttgagtttgaataaagttttcttccgttatgagaaagttaaatccttaaagaaaatgcatgctaaggtaacatataattataagaactcagtataagaggcaactctagaattaattaaattattgtatatggagatgacaggtagtggattgattattctcctgtagataaccatttgtccctgctttttctgttaagtgttcaccacttgtatcattggctggcaatacctggtttgtcatagtttcacattaccttaaacagatgcccagactgggcacagtggctcatgcctttaatcctagcactttgggaggctgaggcgggtggaacacctgagatcaggagttcaagatcagcctgaccaatatgggtgaaaccctgtctctactaaaaatacaaaattagccaagcgtggtggtacatggctgtaatcccagctactcaggaggctgaaacaggagaatcacgagaacctggggaggtggaggttgtagtgagccaagatcacaccattgctctccagcctgggcaacaagagtgaaact

SEQ ID NO: 43361 - DNA, 404 bp, Homo sapiens
ttctctcctctttggcctggtttttgcatttttccacctgaccactacttcatgccctttttggagtcttggctgctgctggggtctcccagggatgctgattccccgtccctgcctccctccccctcccccagcctcccctgtctctgcggcagcctcctgggccttgtccagggtgctcagcgcacagcagccgcctccttgctggtttgccacacagccccagggtagtcatcccaacagggcccaggtgggatgcccgaggccagggagggccattggcctatcctcagaccctggggccaagggcctccctggaggctgtgcacacatgcttttttctctctgtcgcctgggctggggtgcagtggcacaatctcggctcactgcaacctccacttcct

SEQ ID NO: 43362 - DNA, 298 bp, Homo sapiens
ggtgacttaacgaggctcctgaccttcagtagccaattcaaatcacaatatcaaatggaatctacctgagaagcatccttggggcaaaatcccttttgttacatgttgattcttaataacttcaattatgatgatacttacgataattgcaaaaggtaaaacttgtcattcttacctaatgagtctgagagcaagaaattttgttttgtactgtcacaaattccctacctttctaggaaagtagagaacaaaatgttcaaaacaaatgctttatttagtcaatgatatgatgtataac

SEQ ID NO: 43363 - DNA, 341 bp, Homo sapiens
agagatggggtttctccatgttggtcaggctggtctcaaactctgacctcaggtgatctgcctaccttggcctcccaaagtgctgggattacaggcatgagccactgcccctcgccaaatttcttgtgatttttaatctttacttttgcttaaaaaattcattggtatgtgtctatttttttcatttattacaaaaatcatttaggagaaaacatatatatttgaatgtataaaaggatttttctcacagttgagatcaatctgttatattgacattattttctataaattcaattctcttagacacatataaagagcagactgtgcttttgggttggtaa

SEQ ID NO: 43364 - DNA, 728 bp, Homo sapiens
ttccctagaggacctcacagagcctttaatttgctgacaagcacatgaatctgaagggaaggtgtatagaatgatctgataggtttcctccatgtttctacagtccttgtgtgcactctggcatgaccatcagcatgtggcagtgtggtgttggatttggagtattttccatgcctgattgtaaatccctcggggtagggaccatgtcttcatctccctaggtcgtagcgtgagaaccggcacgtgtttcccgcttgacaggtgtcccagccgtggaggcctttgcgatctgttgagatggcctcatgtttcttcttgcccccacaatgtgattcagcaaaaagacaactgggtaacagacgcatggagcagtatttcttggatcccatggggcttgctgtgttgagactgggctttcgagtctgaattcaactgagagtgaggtgttgctgatgcagagagactcatgggcccagccccttgtcctctgtaaagctgggaacagaagctaagtctggagagtcgaaccccagagttttagagatagaactgataggcaggtcgccgttctcctgggaccccagtctttgtggcctttcccagcagctgaactttggacccctctctctgtgacatcctgctcctaacctggccacatgatgctgcttgagaatccagccacagcctgagccaggacagctctcaagagaggaggacaggctgtggga

SEQ ID NO: 43365 - DNA, 474 bp, Homo sapiens
  misc_feature (448)..(448): n is a, c, g, or t
agctttctaataagacctgttggtttgaatactccagaaccacagataaataacactatgagatctcctggttctgaagctgtggggtttggctagacctgtaacattctattcagttggtagagagatccccagagattaggtgacagatttctggcctgcacttaaactatgacctggacaggtcattttgtcttgctatctgtaaaaggagaaaatcatatttagtgcagcttttatttttaaatcatggtctttatgtagaccatgctttttagaagcaaagttatgtaccttcaaagtagcatattctcttactttgttataataatacataccattatgttggtacaaatttggaagaatgtattattaccagcaaagctgtgctctagcccaggctggagtgcagtggtgtgagccgagatcgcgccactgcactccagcntgggtgacagagcaagactccatctc

SEQ ID NO: 43366 - DNA, 342 bp, Homo sapiens
tttgtatatatttacattttgaaatgggaagactgaaaaagagggaagctatatacttgtttctgctttggtctgaaaatttggtagttgaatgtacttctttttgaaagcatctttttggctgggaggagaggctcatgtctgtagtcccactaacttgatttggaaggctaaggtgggaggattgggtgagcccaggaatttgagagcaccctgggcaacatagggggaccccagtcttttaaaaaataaaaaacttggctgggcatggtggcacatacctgtagtcccagctactcagggggctaaggcaggagtgtggcttatgcccaggagctcaag

SEQ ID NO: 43367 - DNA, 660 bp, Homo sapiens
ctaatgcatataaaacaaatttagaagtatataaccatgagtgaaaccacacgttaatctacctggaaacaaatacaaatagtcccctacatgtccaaacagtgctgcctctgcttgcttcaccaacaccactacttgatgaagactccctagatcctctttttcttgatctttttccttctcttttctttttcttgttctttttgtttctgaagccttggaagccttcaattcatattcataggagtctactgtgttcatggtgcctgggacctcatagtaataaaagtctttgggaatcttattggaatcaggtacaccctggaaacactcaaattcatcagggaaacacccagacagtataatagaagggtgactgtgatagggcagaattcccaagatgggcccccaagattccccacccctgggtgcgcccattctgtatgaatcgtgactgtgagtgggatctgtgaatatgatggaatatcactccagtgagtatcttatgttatatgggaaaggggtttgtaagcataattaaggtccctaatcagttgactctgcattcatctagtgggagatcatcttgggtgggccagacctaattgaaagagcccttaaaaaagataagaagcagcagcagatgctttccagttagcc

SEQ ID NO: 43368 - DNA, 681 bp, Homo sapiens
tcacagcctttttctggattctaagataatggtaattaaagcaacatgaacacataatcatacatgaggctttcaaattacctattttcctcccaaaccttatattgcttatgaaagactgacatttatgggtgaaaaaaattatcccaatactattacattggcttgaaaatttttagattatgctaaggaaattttcaggcagacatatatctactattattaaaagatgcttcttagagctagtatgtagctaaactaattttgtaccttaagaaaaaaacttttaaaaagtaataataatgatgtacaaacaccagtaagcacaaaagagggtaagattttaaagtcaactacaattaacaccaagaactcacaactgtctggcctaaaaacctgttcttgaagtaagaacatgagtccttgactaatatgaggttatctaattttacattatcattttaaaaagaaaatgaaacaattagggcctattagcaataaccttttctaactctctgggcagccactggcacaaatgtccaagatgacagcagcacagcacaatcagaaagactgaacctgcatgagccaaggctttccttgcaacctttcctctatcaagtaaaaatggcagacccagttagactcacagagcactggccctatggtttcaatgataaa

SEQ ID NO: 43369 - DNA, 467 bp, Homo sapiens
agcaaacgttaattaatacgacgttatctagaggagataaagcattaatacttgaactctatatagtaaattaatgagagaaatttagaataaacagatgaagaagaggggtcatgtacacagtctcttcccaactcttacatctttcattaaaaaaatttttttttaattttagtttttccagaaacgggttttgctatgttgtcccttctggactcgaacttctgggcccaggtgatcctcctttcttggcctcctgagtaactaggactacaggtgtttgccatggagcctgcctgccttagatctttccctttgttaaggatctgaacttttcacctcttctatctaggttatggagccctattatcttcttgtagttcctgttattaattgtccctcactagactgagttgctttaagggtaaggactgtttctttttcccattttgtagtcacagcatcca

SEQ ID NO: 43370 - DNA, 380 bp, Homo sapiens
tgatattatgtctttgcttactcatgttcgcaagagtggtgttaatggataaacataccaccgttacacctgaaaacgggcccccaaacttagtcaaataatgtattctgttcagaaatacattttcaaggttttgaaaaataaccaatattcaaactagcctcaatttatcttaaaacagatgctatcctagttctttagacaagcagtccccagtcacttctcccacgggggagaagtgacaacagataacatttacacatgtgaagcattcccatgggcagagttacttgttctttttctttttttttttctttttttttttttggaaacagggtctcgctctgttacccaggctggagtgcagtggcacaatcaca

SEQ ID NO: 43371 - DNA, 312 bp, Homo sapiens
ttagtcctagccaaaattgacaaatgggatctaattaaagagcttctgcacagcaaaagaaactaccatcagagtgaacaggcaacctacagaatgggagaaaatttttgcaatctacctatctgacaaagggctaatatccagaatctacaggttgacatttcattacttatctttctccccctcaagacggcaagctctctgagggcagagtccatgagttaggtacctattttctctctagcacctggcacaggcctgttgcttttctagttatctaatgagtgataactgatggcagatccatcctgt

SEQ ID NO: 43372 - DNA, 1610 bp, Homo sapiens
aagcacactgcttattaaagtacactattcaggcatatcatgtaggtttactttctgtgtttctagagaccaagaagcgggacgttcaccatgggaagaaaatcgctgtaccttctgattgtggggatcctcatagcatattatatttatacgcctctcccagataacgttgaggagccatggagaatgatgtggataaacgcacatctgaaaactatacaaaatttggctacatttgtggagctcctgggacttcaccattttatggattcctttaaggttgtcgggagctttgatgaagtcccaccaacctcagatgaaaatgtcactgtgactgagacaaaattcaacaacattcttgttcgggtatatgtgccaaagagaaagtctgaagcactaagaagggggttgttttacatccatggtggaggctggtgcgtgggaagtgctgctctaagtggttatgacttgctgtcaagatggacagcagacagacttgatgctgtcgtcgtatcaaccaactacagattagcacctaagtatcatttcccaattcaatttgaagatgtatataatgccttaaggtggttcttacgtaaaaaagttcttgcaaaatatggtgtgaaccctgagagaatcggtatttctggagatagtgcaggagggaatttagctgcagcagtgactcaacagctccttgatgacccagatgtcaagatcaaactcaagatccagtctttaatttatcctgcccttcagcctcttgatgtagatttaccgtcatatcaagaaaattcaaattttctatttctatccaaatcactcatggtcagattctggagtgaatattttaccactgatagatcacttgaaaaagccatgctttccagacaacatgtacctgtggaatcaagtcatctcttcaaatttattaattggagttccctgctccctgagaggtttataaaaggacatgtttataacaatccaaattatggcagttctgagctggctaaaaaatatccagggttcctagatgtgagggcagcccctttgttggctgatgacaacaaattacgtggcttacccctgacctatgtcatcacctgtcaatatgatctcttaagagatgatggactcatgtatgtcacccgacttcgcaacactggggttcaggtgactcataaccatgttgaggatggattccatggagcattttcatttctgggacttaaaattagtcacagacttataaatcagtatattgagtggctaaaggaaaatctatagtaaaacatgtagctataacatattttaaaaataaaatctgaaaacctcagaaaatttgcattagaaattggtctttcttagaatggtctagttaagttccacatgtagcataattcttaaataggcacttttctgttttttttttcttactgtgggatttcatttcaattttctacattgtctatctgctttttctgagattttccttcttacactgttaatcttattttaaaaaatattacattcttgtatactttatttttgtgagttggctactatttacgatgcaagagaataaatgtgagcaaatattgcctgtc

SEQ ID NO: 43373 - DNA, 1926 bp, Homo sapiens
tatgtttgagctactctgtgacatttaatcattaatagaagatttggggtatacactacagatgggccctgtttgctgaaatgttggggccaaacaacttgatagagcctatgatgttcctttcaagctttctaaagtttccaccaacctcagatgaaaatgtaactgtgagaagtaaatttaacaacattgttgtctgcatatgtgtgccaaaatggaagacagaatcatgaaaaagaagcttattttataaccatggtggtggctcatgtttgagtagtaatgctccttggtctggccactgaagaatgacagagcccagggcccccggtcccatctgccatcactgctttggagcccagggtaactctgccagtaacagagaccaagaagcgggacgttcaccatgggaagaaaatcgctgtaccttctgattgtggggatcctcatagcatattatatttatacgcctctcccagataacgttgaggagccatggagaatgatgtggataaacgcacatctgaaaactatacaaaatttggctacatttgtggagctcctgggacttcaccattttatggattcctttaaggttgtcgggagctttgatgaagtcccaccaacctcagatgaaaatgtcactgtgactgagacaaaattcaacaacattcttgttcgggtatatgtgccaaagagaaagtctgaagcactaagaagggggttgttttacatccatggtggaggctggtgcgtgggaagtgctgctctaagtggttatgacttgctgtcaagatggacagcagacagacttgatgctgtcgtcgtatcaaccaactacagattagcacctaagtatcatttcccaattcaatttgaagatgtatataatgccttaaggtggttcttacgtaaaaaagttcttgcaaaatatggtgtgaaccctgagagaatcggtatttctggagatagtgcaggagggaatttagctgcagcagtgactcaacagctccttgatgacccagatgtcaagatcaaactcaagatccagtctttaatttatcctgcccttcagcctcttgatgtagatttaccgtcatatcaagaaaattcaaattttctatttctatccaaatcactcatggtcagattctggagtgaatattttaccactgatagatcacttgaaaaagccatgctttccagacaacatgtacctgtggaatcaagtcatctcttcaaatttattaattggagttccctgctccctgagaggtttataaaaggacatgtttataacaatccaaattatggcagttctgagctggctaaaaaatatccagggttcctagatgtgagggcagcccctttgttggctgatgacaacaaattacgtggcttacccctgacctatgtcatcacctgtcaatatgatctcttaagagatgatggactcatgtatgtcacccgacttcgcaacactggggttcaggtgactcataaccatgttgaggatggattccatggagcattttcatttctgggacttaaaattagtcacagacttataaatcagtatattgagtggctaaaggaaaatctatagtaaaacatgtagctataacatattttaaaaataaaatctgaaaacctcagaaaatttgcattagaaattggtctttcttagaatggtctagttaagttccacatgtagcataattcttaaataggcacttttctgttttttttttcttactgtgggatttcatttcaattttctacattgtctatctgctttttctgagattttccttcttacactgttaatcttattttaaaaaatattacattcttgtatactttatttttgtgagttggctactatttacgatgcaagagaataaatgtgagcaaatattgcctgtc

SEQ ID NO: 43374 - DNA, 1872 bp, Homo sapiens
tatgtttgagctactctgtgacatttaatcattaatagaagatttggggtatacactacagatgggccctgtttgctgaaatgttggggccaaacaacttgatagagcctatgatgttcctttcaagctttctaaagtttccaccaacctcagatgaaaatgtaactgtgagaagtaaatttaacaacattgttgtctgcatatgtgtgccaaaatggaagacagaatcatgaaaaagaagcttattttataaccatggtggtggctcatgtttgagtagtaatgctccttggtctggccactgaagaatgacagagcccagggcccccggtcccatctgccatcactgctttggagcccagggtaactctgccagtaacagagaccaagaagcgggacgttcaccatgggaagaaaatcgctgtaccttctgattgtggggatcctcatagcatattatatttatacgcctctcccagataacgttgaggagccatggagaatgatgtggataaacgcacatctgaaaactatacaaaatttggctacatttgtggagctcctgggacttcaccattttatggattcctttaaggttgtcgggagctttgatgaagtcccaccaacctcagatgaaaatgtcactgtgactgagacaaaattcaacaacattcttgttcgggtatatgtgccaaagagaaagtctgaagcactaagaagggggttgttttacatccatggtggaggctggtgcgtgggaagtgctgctctaagtggttatgacttgctgtcaagatggacagcagacagacttgatgctgtcgtcgtatcaaccaactacagattagcacctaagtatcatttcccaattcaatttgaagatgtatataatgccttaaggtggttcttacgtaatagtgcaggagggaatttagctgcagcagtgactcaacagctccttgatgacccagatgtcaagatcaaactcaagatccagtctttaatttatcctgcccttcagcctcttgatgtagatttaccgtcatatcaagaaaattcaaattttctatttctatccaaatcactcatggtcagattctggagtgaatattttaccactgatagatcacttgaaaaagccatgctttccagacaacatgtacctgtggaatcaagtcatctcttcaaatttattaattggagttccctgctccctgagaggtttataaaaggacatgtttataacaatccaaattatggcagttctgagctggctaaaaaatatccagggttcctagatgtgagggcagcccctttgttggctgatgacaacaaattacgtggcttacccctgacctatgtcatcacctgtcaatatgatctcttaagagatgatggactcatgtatgtcacccgacttcgcaacactggggttcaggtgactcataaccatgttgaggatggattccatggagcattttcatttctgggacttaaaattagtcacagacttataaatcagtatattgagtggctaaaggaaaatctatagtaaaacatgtagctataacatattttaaaaataaaatctgaaaacctcagaaaatttgcattagaaattggtctttcttagaatggtctagttaagttccacatgtagcataattcttaaataggcacttttctgttttttttttcttactgtgggatttcatttcaattttctacattgtctatctgctttttctgagattttccttcttacactgttaatcttattttaaaaaatattacattcttgtatactttatttttgtgagttggctactatttacgatgcaagagaataaatgtgagcaaatattgcctgtc

SEQ ID NO: 43375 - DNA, 1065 bp, Homo sapiens
aagcacactgcttattaaagtacactattcaggcatatcatgtaggtttactttctgtgtttctagagaccaagaagcgggacgttcaccatgggaagaaaatcgctgtaccttctgattgtggggatcctcatagcatattatatttatacgcctctcccagataacgttgaggagccatggagaatgatgtggataaacgcacatctgaaaactatacaaaatttggctacatttgtggagctcctgggacttcaccattttatggattcctttaaggttgtcgggagctttgatgaagtcccaccaacctcagatgaaaatgtcactgtgactgagacaaaattcaacaacattcttgttcgggtatatgtgccaaagagaaagtctgaagcactaagaagggggttgttttacatccatggtggaggctggtgcgtgggaagtgctgctctaagtggttatgacttgctgtcaagatggacagcagacagacttgatgctgtcgtcgtatcaaccaactacagattagcacctaagtatcatttcccaattcaatttgaagatgtatataatgccttaaggtggttcttacgtaaaaaagttcttgcaaaatatggtgtgaaccctgagagaatcggtatttctggagatagtgcaggagggaatttagctgcagcagtgactcaacaggtatgttcataatttctatgctttttaaaaatagcgtttctacgctgttttaaaaacatatttataaacatattgaatgcatgtattaaaaatatgaatgcaaataggagatattaattttttgaaacaaagagaatattgagaagaaatgactaaaacattataatatcaatccctgcttctgtcatagatttttttttctttcttaagggaatgttaattctttggataaatcattcatttaaaattatagcctgcatgtggtagctcagcactgcaatcccagcgctctgggaggccaaggcaaagggatcacttgagaccaggagtttgatagcagcttgggaaaaacagtgagaccctgtctctaca

SEQ ID NO: 43376 - DNA, 1872 bp, Homo sapiens
tatgtttgagctactctgtgacatttaatcattaatagaagatttggggtatacactacagatgggccctgtttgctgaaatgttggggccaaacaacttgatagagcctatgatgttcctttcaagctttctaaagtttccaccaacctcagatgaaaatgtaactgtgagaagtaaatttaacaacattgttgtctgcatatgtgtgccaaaatggaagacagaatcatgaaaaagaagcttattttataaccatggtggtggctcatgtttgagtagtaatgctccttggtctggccactgaagaatgacagagcccagggcccccggtcccatctgccatcactgctttggagcccagggtaactctgccagtaacagagaccaagaagcgggacgttcaccatgggaagaaaatcgctgtaccttctgattgtggggatcctcatagcatattatatttatacgcctctcccagataacgttgaggagccatggagaatgatgtggataaacgcacatctgaaaactatacaaaatttggctacatttgtggagctcctgggacttcaccattttatggattcctttaaggttgtcgggagctttgatgaagtcccaccaacctcagatgaaaatgtcactgtgactgagacactaagaagggggttgttttacatccatggtggaggctggtgcgtgggaagtgctgctctaagtggttatgacttgctgtcaagatggacagcagacagacttgatgctgtcgtcgtatcaaccaactacagattagcacctaagtatcatttcccaattcaatttgaagatgtatataatgccttaaggtggttcttacgtaaaaaagttcttgcaaaatatggtgtgaaccctgagagaatcggtatttctggagatagtgcaggagggaatttagctgcagcagtgactcaacagctccttgatgacccagatgtcaagatcaaactcaagatccagtctttaatttatcctgcccttcagcctcttgatgtagatttaccgtcatatcaagaaaattcaaattttctatttctatccaaatcactcatggtcagattctggagtgaatattttaccactgatagatcacttgaaaaagccatgctttccagacaacatgtacctgtggaatcaagtcatctcttcaaatttattaattggagttccctgctccctgagaggtttataaaaggacatgtttataacaatccaaattatggcagttctgagctggctaaaaaatatccagggttcctagatgtgagggcagcccctttgttggctgatgacaacaaattacgtggcttacccctgacctatgtcatcacctgtcaatatgatctcttaagagatgatggactcatgtatgtcacccgacttcgcaacactggggttcaggtgactcataaccatgttgaggatggattccatggagcattttcatttctgggacttaaaattagtcacagacttataaatcagtatattgagtggctaaaggaaaatctatagtaaaacatgtagctataacatattttaaaaataaaatctgaaaacctcagaaaatttgcattagaaattggtctttcttagaatggtctagttaagttccacatgtagcataattcttaaataggcacttttctgttttttttttcttactgtgggatttcatttcaattttctacattgtctatctgctttttctgagattttccttcttacactgttaatcttattttaaaaaatattacattcttgtatactttatttttgtgagttggctactatttacgatgcaagagaataaatgtgagcaaatattgcctgtc

SEQ ID NO: 43377 - DNA, 331 bp, Homo sapiens
ctattacggtaaactcttttgtagtctgcttcttaacttagcaaaatattaggaaccgttttcccacgtcactagctcttctgaaacagcgttttaagtggccatgtagaattcaccgttgaggatgagcctgcatggtcgtgtgattcggtggctctccctttttgattgtcatgaataatggcagtgattatttttccacacgtatcgcacacagccttgattatttccataggaagtgttaggtaattgtgaatggatctttttcaatgagtgtttaattagcagaatttatctctcaaccatgccttccttcagcgtgtggaagaga

SEQ ID NO: 43378 - DNA, 664 bp, Homo sapiens
gcgagaaatctcaggcagaacttgtgaggatgctggaaaaaggaaattcattgtatatgaggatctctaaaaacttcccaaacgaatcagcctttccaaggaaaagaaatgccttttcttcaggagtccttaccttttttttttgagatgggagtctctctctgccacccaggcttgagtgcagtgatgcgatcttggctcactgcagcttccgcctcccgggttcaagtgattctcctgcctcatctcccaactagctgggactacaggcatgtgccaccacacccagctagttttttttgtatttttagtagagacgggggtttcatcgtgttgggccagcctggtctcaatctcctgacctcaagtgatcctcctgcctcggcctcccaaagtgctgggattacaggcgtgagtcaccatgcctggcagtagtccttaccttttttgtcatttatagacttgctcccatctggggaaggattcaaatcatcagtcatttctgaacaccaaagactatatgaatgctgactccaaagacagcatccattaaagtgcatatcatcataataaaaatatatgactgctggatttctttgctgagagatgctttgaagtacttttgtactattagcatattaaatgttgagaaaattaaagagtt

SEQ ID NO: 43379 - DNA, 478 bp, Homo sapiens
ccggggtccctgcctgacatgtctcagacccaccctggcatatctttggagtctacttatctttctgcgtggcctcttagtgctggtgagggctgcctgggccctttctgacaggctggctccaatagggactgcttagacctgtttacacagttacacttttggctaacctggatctgggggacttgctaccatgatggacacatgttccttggtgagcaggtctgtgcaaacctaccctccaaggccaagggagctgagagcgccagtttctcagaaagaaacatttattagggacttctgaacagaaccatgtctcaggcagaaatgagatggtggtctctacacccaacctccagaaagtattctttacttgttgttttgcagacgacaatgcttgtacagaaactattcttttcttttttttcttttgagacagcctggacaagaaagcgagactccgtctccaaaaaaaaaa

SEQ ID NO: 43380 - DNA, 385 bp, Homo sapiens
actcattggcctacagaatttagtggcataaagttgatatgtagaaaagggccattgattaagtgataggcagattgatggagggatcaattgatttgctgccaagccacatcccatgtaagggaattttcagagtatgggtggtctggcttccattctttctctgccatttttaatgaattgtttctaatgtattatggatgtataatgcctgaattcatttcagcccctttgaacatattgatattttggcctgaagtcttagtaagaatgatttctgtattatgactttgagtttttatttgtaacttataacaaattactcttgtagaaaatcttttgttgaaataaattcagttatttattatttcttattatttccata

SEQ ID NO: 43381 - DNA, 464 bp, Homo sapiens
gccaatggccagcactaatcaccagccatgtgagggacaccttggacctcccagccccagctgagccagcagataactacagcagctgcacgagagtcccaagagagaccaggagaagaactactcagattgccaagccacagtgctgtaccattaaattttggggtggttcacaacataataataggtaatagaaacagaaatcttgctccgatccacactcaaacaaaccaactatttaaaaaattatgaaacaatcaggaaattttgctggatgctggctatttaatgatataattacataattgttaattttgttaggtttgataatgatggaaaccacattttttcatgttgtttttttgagtccttattttttaaaggtacaaactgaaacatttatggatgaaaggaagtaatgtctggtatttacttcaaaataatccaaagagaagtggggatat

SEQ ID NO: 43382 - DNA, 488 bp, Homo sapiens
gcaggtagatgtagctgaccaatggactataaggagaagttatgtggaccttgaaatcaaatcagcagcagcataaaacagaccaggaaaaccgtgcaggcccccgggagctcatgttctcatacacaacttcaaatgtgaccaagggggataaatagacaaagaagaacctcctttctgcagtcaaagctaggagacaagaaggacaatggatttacctttttttttttctttctttctttctctttatttttcttttttagacagtctcgctctgttgccctcgctctgttgctgaagtgcagtgacagaatcttggctcgctgtaacttttgccttctgggttcaagcaattctggtgcttgagcctcccaagtacctcccaagtagctgggattacaggcgcctgttgccacgcccggccaacatggtagacgctgtccctagtaaaaatacagaaattagctgggtgtgggtgtgggtaccga

SEQ ID NO: 43383 - DNA, 405 bp, Homo sapiens
tttttctcatgtaatttgccaactgcacccacaggtcacttttttttttaagctttacctcccttggattttgtgatggtgggagacaggacagaataactgacatggaaaaggggtaacaccaaaggcatcattgaaagaaatggaaactgactccagatacccaagactagctgccccatggggaatcaaaacacacactttgtgctctacccccaacccctagcaagggccacttatgaccctatgccaatgtcacagtaccatgtgttcgaggaaaatagctttgtatttgctctaaggtcttgagaaaacaatttccatttcttttttttttttcccttcccaaattctaattctgtaatctcattagggacaaatgcaacagttcccagaaccccaaaa

SEQ ID NO: 43384 - DNA, 449 bp, Homo sapiens
ctacagcagcctcacaacttaattgtctcacacaggactattcctactgttaagagatcacagctaaggcttgggcaccttgacctgctgtagaagctcagttaatgtacttttcatcatctgggccctggtattcccctgtaaatactgaagtagacccagtgacctagtgcccaagacacaaaatattcagcctccgtaacatttgtctaatgacatggttctagctttgctcactcccattaatttcaagtgagtactggctaggcagtctatagtgacttgattacactgtctttcttgtcctgtgctgtcctgagaatcctggatttgaagcagcctatgaataaggtttgaaaaatatttatccaactatgccgacatatgatgttctagcactgcatctgtcatctatcacccgcaccttaataaatgataattacttgtgc

SEQ ID NO: 43385 - DNA, 413 bp, Homo sapiens
tcaacgaccacttacacatatttttttcctaaacttcatgctcttcaaaattgagaaaaaaaaattaagaactattcttgtcttcaagaagacaaagaatacagtctgcctgaattgtgaattcaaaggtatattctctcattcaaattactatttctattgtgtagaatttctcctctcattcaaaagaaagaaatgtgaatcttctcatagggagggatgtgtagcatttatgttctggaaaaatcctctgtgatgagccgcattgtgcatgtgatgcccacacccttctcaggatgtgaatcgcagagtccatcatatcagtgagccaagaagcttgggtatgtttgccaatgacttaatacacaagagtgtgtgttttggaaattatatctaacataatgttcattttg

SEQ ID NO: 43386 - DNA, 482 bp, Homo sapiens
aaccaatattcccctcacttcatgggtgttacaaacctcttatcatctgtttacgtctcactcttactgtagaacctctagaaaggcaggtggcttccagctcctcgcttttcctgagggatgatctgaccacccattcttacacatgtcatctttcccacagtggcagtgcagaggagacaaaagcagaacaaaagcagacagcggccaggtctgagggtgataggctactcactgggtcctagtgttctgaactacaccctacaggaaagtgctactcagtgcccaggtgacatcgtcacaaggggaacacagtggctaagagggcaggggctcagtctcacagacctggtttccatcccacttgctctcaggaaccctgggcaacaactgtgaccacagtgtcttcctctggaaagtgcccagcagtgttgggctcacccgtagctgcacaataaattgtcatgagtgctttccactgt

SEQ ID NO: 43387 - DNA, 411 bp, Homo sapiens
tatgtaattggaatcatacagtacatactggcttcttttgatgaacattatataggcgagatccacttatattgttgctggtagttgtactttgttcattgtttttgctctaaagtattccatcatgtgaatatagcatagcgtatcatattcactataggtaaacatttgggttagttccatctggagttgttatggatagtgctgcaatggacattctttgcatgtctcttcatacacacatgtgcatgcacatgcacacggcatgtcatttctgttatacacccgtgcatcacgttctgctttaactgggtcctgccaaacagttttctatccttataccttttacctacatttatctcatgagttctcttatcaccccactttttgttgagacaggatcttatttgg

SEQ ID NO: 43388 - DNA, 201 bp, Homo sapiens
gccactacaccccagcctgggcgacagaggaacaagtccctatctcaaaaaaataaaataaaataagttttttaattagctggcatggtggcacatgcctatagtcccagctacttgggaggtaaaggcaagagcattgcttgagcccaggagcttgaggttgcagtgagccatgatcacactactgtattccagcctcag

SEQ ID NO: 43389 - DNA, 273 bp, Homo sapiens
aacagttgcctgggcgtgtggcaggaaggatgtggggagggcagggaagaagatcaaagggcatgagaaaactttttagagtgatggaaatattctatattttgtttgtggtggtagttttacagctatatgcatcactaaaattcatcgaattgtgcacttaagacaggtgtattttattgtatgtaaattttattttatgtaaaactgtacacttaagacaggtttattttattgtattttattgcatgtaataaagctggaaaaattcat

SEQ ID NO: 43390 - DNA, 375 bp, Homo sapiens
ctccagtctggtgacggagcgagactctatctcaaaaaaaaaaaaaaaaaaaaaaaggactcatcactccataataaaaagataaaccatcccattttaaaatgggcaaaggatctgaacagacatttatcaaaagaagacaaacaaatggccaataagcatatgaagagttgctcgacattcttagtcatcaggaaagtgaaaaccaataagataccacttcacaccgtagggtggttatagagacagatatgaacaagtgttggcaacaatgtagagaaattggatgcttcatgtactgctgcaggaaatgtaaagtcttgcagctgttttagcaacagcctggtggttcctcagaaggttaaacagaattat

SEQ ID NO: 43391 - DNA, 460 bp, Homo sapiens
actcctcataaactcgctctgcagagccaacctgaaagaatgaattcagcaattcagttattctagtaaaaccgcgatgtatttttttcccaacagatgctgtcagaaagacaccggtttggcaacgtgactggcttcttgccactgctgagaaagctgacatcaagataaaaccggccttcacttccccatgctggacctctttcctaacagactgtggcaaaaggaaatgcttaaacactccagcagcatctttagaggctggctctaaaagcggagtttggatatttaccagaaacatgcaaactgctgtggaaaaggaacggaaagagctgctgaccatcatttctagataagaactgtacacttctagacaacacaaaccttaacacacaacaggcatgcattacaaatttaatgaaccacaaattcaaattcagctggtgtttactgagtgcta

SEQ ID NO: 43392 - DNA, 497 bp, Homo sapiens
catgcctatgtaactagcttccataagaaccttggatactgtgtaagtctctagtcagactcatactggtagacaatattgcccatgtgctgtcaaaatttgaagctacaggaattcagcacatcctggtaactccacaggagagggctcccggaagcttgtgcttggcttccccaagacttgccacatgcccctttgccctgagccaattttactttgtattctttcactgtaacaaatcaaagcccagagtaggactgtttgctgagtccttccaagtgaatcaccaaacacagaggtggtcttggaaactctgacatagtggcattatatgaaattagttttctttaaggtgatgtgacctgtgactacgatcagaaggctgtttataaaacacctttccctcatctgttttccttaacagttgcctttgagattcctgtatttctgcatgaataaatccataagggaacagaaataattatgccaaaaaatga

SEQ ID NO: 43393 - DNA, 268 bp, Homo sapiens
agtaatgaggtttttgctgtgttgttcaggttggtcttcaactcctgggctcaagcaatcctccccactcagcctgctgagtagctgggactacaagcgtgagccaccatgcccagtggttttctgtagtgtttaattaatttggattgtttcctggcctttttttttttttttttttgagactgagtctcgctctgtcccccaggctggagtgcagtggcgcgatctcggctcactgcaagctccgcctcccgggttcacaccattc

SEQ ID NO: 43394 - DNA, 2903 bp, Homo sapiens
atagggaaaatattgccagcgttttcagtcattctgtgcatgctgctttaagcaagagatttatatttgttgagaggaaatattgctacttcctgcacttccaccctctgcagccggcaccgtccctactgttgccattaattggagctgtccttaagatggtcaccatattcttattcaggctgttgtcattttccccagagatggtttgtttaacgaatgataggctctgtgcctggggatgttagcagactctggggtttgtacagtgatgccttctccctggcccagagctgaatattcatctagaattaaagttggatttgatataacaaatttctttctatacaggttttacataagagagacagtaataatgtcaaggatagcctgtgtgggcagaaattggtagtcgtgcttttgaatgtcagctgtagagccaactctgattatctagccattgatcatacaaattgatagaaacattagtcagtaattttagcttcttgccaaattgttcacaacatctaaatgtaatgtgatgtgatgaagataagtagtacaaagagaccaaaataatttgggagaattaggaatgatgacaattttttttaacaacttacctctaatagggttacttggatgagccaactccgcttccttcccatggataggaagggactctgtgtattattcaggtttattggcacgaagatacttgttttaagttccttgagaacccatgatggacagttgacagaatgcttaaacctgtcaaaagatgagtgattttgtgtgggaaaagccttcccaggcgtctgtaccgaaaggagcagcaaacaaggggctaatccatgagcagtgttctgtaggctctgtgacatctttggtttataggattttggagccttttatgatctggaactatttgaggggtttcattataggccttggttctctccaggggccagatgagtttattgtggaatctttgaaaggacaaggcctctgtgaatgaatcagtcccagggaagcatttggtggtggcggcagtggaggattgcccggtgaacctataaatcagcagtctcttgggcagaggagcaagcccctcgaacatgatttcaaacaagcaggtcctcttctctcatctcatgtccttagtctctgttaatgaacatactggatgtggagtttaataaattacctactatcatctggccacttagattattatcacaccactgtggactgttcctggggggagaagaacagaccgatttgaaagattcaagggagaaagattaaggatcaggattgcatgaaagaagaaaatccttcaatatttaaaatgtttcttacaatacccacggagcacttttatggttccagccgagcgttcctgaaatgaactgaccattaacagcgcctctttgataggttaccctgatgctgctaaagtaaagccttaagtgtgtttttgggacaacgtgctgcttattccacctcagccacatatgtgtttgtgtttaggatattgtaaatctttgctaagtagtgttttccttggtgaatgaagtcattgttgtcttcaagtgtaccatctgcctagcaaaaaattgctacaaactttctcttatgcaatagtccttggtacttctaatatttttagcaagagacaattttctgtactagaatcttccactgccagaaaacacagtgccagtaaggttctacataccactgaccatctgcttaatagacatgtatttcctttgagtaggacattagcttttgattataaagctcaactagtataagcaaaaatataacatctagaagcacagttttagccaggatgtttaaaaattacagttttgtgagacttaagggtctttttaacctaggtaagtttatatgacctaacttaattgtagccatattctggtaccttccattttgaaaagtagaggttgcttaagcaagcaatggataataagagacttttcctgaggcacctgtttggaatctggttttctcagcggcagcttgacatgtgcacccttttgtattaaacactgcaagggtgatgcaggggagcaggaaagccatcctaaactcactactgagtacgattcagtatgttcctgtggatgtctgctgtgactaatataaatttcttgcagaatcagctacacttaattatgttgctgatagacaagcatccacgcttcagctggcactaagtgttttcattgtaggatcagcagcaggttaaagactgaacggttagtgaagacaaatgtcttaagaggctgcgatgtctaggttgggcttgtgacttcttagtggcctagccttcttgatggcaccttgaaagtgaacttctagaaatctacatttaaaaggcaaagctttaaaagcagagctagtctattctagttactgatgcaactaaaattctgtatttcttaagatggagccactgacgagatgtcacagtatagagcctgcagtctcaactcattgtgatcctaatggtctgggtgattggatggtttgagttgttagggattttgagtttttcattttattgcatatctgggttggatgttagactaaaggaaacccaggaatatttacctggtgttacatttaatatttaatgtaactggtctagcaacattaagggggatttctgaagccaactccggaggctgtgggctgcacattttgcactgtttttatatacttgtattcatatcctcttatcacctcagactcagacacaaggccttttacatggaaattttacaaattacttccatttatgtaaaataacgtcctgtgaccaagttgtttaaatggaaaataaagtgctttctttaaggaaaaaaaaaaaa

SEQ ID NO: 43395 - DNA, 2619 bp, Homo sapiens
tgagaggtcaggtaaaatgagaagaaagaataattggatttgatataacaaatttctttctatacaggttttacataagagagacagtaataatgtcaaggatagcctgtgtgggcagaaattggtagtcgtgcttttgaatgtcagctgtagagccaactctgattatctagccattgatcatacaaattgatagaaacattagtcagtaattttagcttcttgccaaattgttcacaacatctaaatgtaatgtgatgtgatgaagataagtagtacaaagagaccaaaataatttgggagaattaggaatgatgacaattttttttaacaacttacctctaatagggttacttggatgagccaactccgcttccttcccatggataggaagggactctgtgtattattcaggtttattggcacgaagatacttgttttaagttccttgagaacccatgatggacagttgacagaatgcttaaacctgtcaaaagatgagtgattttgtgtgggaaaagccttcccaggcgtctgtaccgaaaggagcagcaaacaaggggctaatccatgagcagtgttctgtaggctctgtgacatctttggtttataggattttggagccttttatgatctggaactatttgaggggtttcattataggccttggttctctccaggggccagatgagtttattgtggaatctttgaaaggacaaggcctctgtgaatgaatcagtcccagggaagcatttggtggtggcggcagtggaggattgcccggtgaacctataaatcagcagtctcttgggcagaggagcaagcccctcgaacatgatttcaaacaagcaggtcctcttctctcatctcatgtccttagtctctgttaatgaacatactggatgtggagtttaataaattacctactatcatctggccacttagattattatcacaccactgtggactgttcctggggggagaagaacagaccgatttgaaagattcaagggagaaagattaaggatcaggattgcatgaaagaagaaaatccttcaatatttaaaatgtttcttacaatacccacggagcacttttatggttccagccgagcgttcctgaaatgaactgaccattaacagcgcctctttgataggttaccctgatgctgctaaagtaaagccttaagtgtgtttttgggacaacgtgctgcttattccacctcagccacatatgtgtttgtgtttaggatattgtaaatctttgctaagtagtgttttccttggtgaatgaagtcattgttgtcttcaagtgtaccatctgcctagcaaaaaattgctacaaactttctcttatgcaatagtccttggtacttctaatatttttagcaagagacaattttctgtactagaatcttccactgccagaaaacacagtgccagtaaggttctacataccactgaccatctgcttaatagacatgtatttcctttgagtaggacattagcttttgattataaagctcaactagtataagcaaaaatataacatctagaagcacagttttagccaggatgtttaaaaattacagttttgtgagacttaagggtctttttaacctaggtaagtttatatgacctaacttaattgtagccatattctggtaccttccattttgaaaagtagaggttgcttaagcaagcaatggataataagagacttttcctgaggcacctgtttggaatctggttttctcagcggcagcttgacatgtgcacccttttgtattaaacactgcaagggtgatgcaggggagcaggaaagccatcctaaactcactactgagtacgattcagtatgttcctgtggatgtctgctgtgactaatataaatttcttgcagaatcagctacacttaattatgttgctgatagacaagcatccacgcttcagctggcactaagtgttttcattgtaggatcagcagcaggttaaagactgaacggttagtgaagacaaatgtcttaagaggctgcgatgtctaggttgggcttgtgacttcttagtggcctagccttcttgatggcaccttgaaagtgaacttctagaaatctacatttaaaaggcaaagctttaaaagcagagctagtctattctagttactgatgcaactaaaattctgtatttcttaagatggagccactgacgagatgtcacagtatagagcctgcagtctcaactcattgtgatcctaatggtctgggtgattggatggtttgagttgttagggattttgagtttttcattttattgcatatctgggttggatgttagactaaaggaaacccaggaatatttacctggtgttacatttaatatttaatgtaactggtctagcaacattaagggggatttctgaagccaactccggaggctgtgggctgcacattttgcactgtttttatatacttgtattcatatcctcttatcacctcagactcagacacaaggccttttacatggaaattttacaaattacttccatttatgtaaaataacgtcctgtgaccaagttgtttaaatggaaaataaagtgctttctttaaggaaaaaaaaaaaa

SEQ ID NO: 43396 - DNA, 1433 bp, Homo sapiens
  misc_feature (29)..(29): n is a, c, g, or t
aatacagatacaatcgagctcggtacctnaacattcgtgtctactcaaaggaaacatgtctattaagcagatggtcagtggtatgtagtgttttccttggtgaatgaagtcattgttgtcttcaagtgtaccatctgcctagcaaaaaattgctacaaactttctcttatgcaatagtccttggtacttctaatatttttagcaagagacaattttctgtactagaatcttccactgccagaaaacacagtgccagtaaggttctacataccactgaccatctgcttaatagacatgtatttcctttgagtaggacattagcttttgattataaagctcaactagtataagcaaaaatataacatctagaagcacagttttagccaggatgtttaaaaattacagttttgtgagacttaagggtctttttaacctaggtaagtttatatgacctaacttaattgtagccatattctggtaccttccattttgaaaagtagaggttgcttaagcaagcaatggataataagagacttttcctgaggcacctgtttggaatctggttttctcagcggcagcttgacatgtgcacccttttgtattaaacactgcaagggtgatgcaggggagcaggaaagccatcctaaactcactactgagtacgattcagtatgttcctgtggatgtctgctgtgactaatataaatttcttgcagaatcagctacacttaattatgttgctgatagacaagcatccacgcttcagctggcactaagtgttttcattgtaggatcagcagcaggttaaagactgaacggttagtgaagacaaatgtcttaagaggctgcgatgtctaggttgggcttgtgacttcttagtggcctagccttcttgatggcaccttgaaagtgaacttctagaaatctacatttaaaaggcaaagctttaaaagcagagctagtctattctagttactgatgcaactaaaattctgtatttcttaagatggagccactgacgagatgtcacagtatagagcctgcagtctcaactcattgtgatcctaatggtctgggtgattggatggtttgagttgttagggattttgagtttttcattttattgcatatctgggttggatgttagactaaaggaaacccaggaatatttacctggtgttacatttaatatttaatgtaactggtctagcaacattaagggggatttctgaagccaactccggaggctgtgggctgcacattttgcactgtttttatatacttgtattcatatcctcttatcacctcagactcagacacaaggccttttacatggaaattttacaaattacttccatttatgtaaaataacgtcctgtgaccaagttgtttaaatggaaaataaagtgctttctttaaggaaaaaaaaaaaa

SEQ ID NO: 43397 - DNA, 1043 bp, Homo sapiens
gctcatctgtcctgagtacacatatgccaagtcttaaggtatctaccgagtattttatgtaactagcttatgcgtaaccatattctggtaccttccattttgaaaagtagaggttgcttaagcaagcaatggataataagagacttttcctgaggcacctgtttggaatctggttttctcagcggcagcttgacatgtgcacccttttgtattaaacactgcaagggtgatgcaggggagcaggaaagccatcctaaactcactactgagtacgattcagtatgttcctgtggatgtctgctgtgactaatataaatttcttgcagaatcagctacacttaattatgttgctgatagacaagcatccacgcttcagctggcactaagtgttttcattgtaggatcagcagcaggttaaagactgaacggttagtgaagacaaatgtcttaagaggctgcgatgtctaggttgggcttgtgacttcttagtggcctagccttcttgatggcaccttgaaagtgaacttctagaaatctacatttaaaaggcaaagctttaaaagcagagctagtctattctagttactgatgcaactaaaattctgtatttcttaagatggagccactgacgagatgtcacagtatagagcctgcagtctcaactcattgtgatcctaatggtctgggtgattggatggtttgagttgttagggattttgagtttttcattttattgcatatctgggttggatgttagactaaaggaaacccaggaatatttacctggtgttacatttaatatttaatgtaactggtctagcaacattaagggggatttctgaagccaactccggaggctgtgggctgcacattttgcactgtttttatatacttgtattcatatcctcttatcacctcagactcagacacaaggccttttacatggaaattttacaaattacttccatttatgtaaaataacgtcctgtgaccaagttgtttaaatggaaaataaagtgctttctttaaggaaaaaaaaaaaa

SEQ ID NO: 43398 - DNA, 294 bp, Homo sapiens
tggaaaacagatagtctagtgacaactgatttagcaaacaggagaaaccgtactgtaaaactgcagagaggagcactagcaagaggctctctgccccttccctgtttggtctcgaaacactaacagcctggctcctactccctaaattgggggtggcagtatacctctgggtaaactgagcagtcggaagatgaagtcatgtgggggtgatcctcaaatgataaaattcattccttatcttgcccccactcctcacctaactgccagtcaactatttaatgtgaacaaaaagcc

SEQ ID NO: 43399 - DNA, 461 bp, Homo sapiens
gggttggccactagcattaggtaaaactgctgaattgagcccagcatgtggaatcagtatttttgattcagggattcaagctctttgtccttttttccttcctcctagactgattcatagaatgttccctcccccaggaagaaggtctttgtaaaggcgactttgttctcacttgtttgatgcatcaaacttccattgagtgctgtgggcaaggccctatatgtggcagtgggactatatggatgaattttaaatagttttgccttaaagaaagtctttgatgattgagactgaacttatgaaccatattgtttccttcggccctttcagttattgagctttttatggtatgaaaagattcatttctaccttaggatcagaatgaaaacaagaaaccaatctgtattttaaaacgaagagaaattattttgggaacttggtacaaaagtgttggaaagggc

SEQ ID NO: 43400 - DNA, 200 bp, Homo sapiens
gggttacttctggaatatatgttacctacaatacataaagagagtagaccttacagccacacaggccagacttaaatgagctatgtaaacctagtcgattttgtgagctatgtaaagtcagtcaattttgtgagctatgtaaagccagtcaattcgtgtgtgaatttttgggagctatgtaaagccagtcaattcacgtg

SEQ ID NO: 43401 - DNA, 445 bp, Homo sapiens
actttaagttctagggtacatgtgcacaacgggcaggtttgttacatatgtatacatgtgccgtgttggtgtgctgcacccattaactggtcatttacattaggtatttctcctaatgctatccctaccccctccccctcaccccacgtcaggcctcgctgtgtgatgttccccaccgtgtgtccaagtgttctcactgttcaattcccacctatgagtgagaacatgtggtaagtcttattttctatttttaacatcacgattgtgttccatgcttaaagatctaagtgtttcttgagaatttaatggtaaaaacactatgaagaaattggcttttaaaaactaatatatgtctgtgtgtgtataaaggagattgcattttctatgaaaatttgtctcataaagttgagtttcccctaccctcatgaaaatcctgagaatatcc

SEQ ID NO: 43402 - DNA, 409 bp, Homo sapiens
cagaaagaataaactggatgcacctcctatctccagaggtaactaaaaagatacacctgggaaggaccactctaataagggtttttgatgaaatggatcagagtcaaaaagggaagcacttgccgaaataggagatgcttctaaaaactcttgattttccctttggctttgcttttgaaaaatggaagctgtcttgtggggatttggagagtgattgaaggtgctgattagcagctgatgaactgaaagggagtgctagaaggaatggaattggagcccatagaagagcttgtggctctaaaggggaaaacagcaggaggcaaggtctgtctggttcttgctgcatccctagtgcctagcatggtgcccagcacaggccagggtaaaatcgttttcttctgactaactg

SEQ ID NO: 43403 - DNA, 247 bp, Homo sapiens
atggagaacacactgtgaatgggaaattgtgctctgtgcttttcattatctatctttacaccaactatgtgtagtattactttcttcattaagaaaaattaaaaataggccaggtgcagcagttcatgcctgtaatcccagaactttgggagtctgagtcaggaggattgcttgagcccaggatttgaggcagcagtgagctgtgatggtgccattgcactccagcttgggtgacagagtgagaaga

SEQ ID NO: 43404 - DNA, 360 bp, Homo sapiens
aaaaaacaccaacagggagttgagtaaaatgaattttcatccatccatccattggagagcaacaaaatcatttagaagaactaagtctggatccaagtaaagactcattagcctgagacaaagttaaaggtactcggtgccgacctgactgtaaatacttcagtagaagtcttgcagtagtgtttggttataaaattatcacccagggtgatccagagtgttcttactatttgaaaaattaatatcaaaataaaaatacaaaaatggaattctctttttggggaccctaaagtacacaaccagtgacccagattgagaaatatttctttaagctagcaaggacttaagtgttgcttgggg

SEQ ID NO: 43405 - DNA, 308 bp, Homo sapiens
tttgtaaatgtgtaacctttaccatataaagtaaattgcccactcaaattattccataaattttgattttttttctcatcagaagtagttcaatcttaaattttatgaaatttatattcaagaatttctttgcatagattgtcataaaatgttttccattagaatgatattttacttgtagtaagataataaagagttctctgagctattcagatgtttactttggaataaaatactgttaaatctagattaccagcagttacctttttagtttgtagaaaattggaatacaggtctaaactttacaa

SEQ ID NO: 43406 - DNA, 1216 bp, Homo sapiens
tgccaaatccccctctgcgagaaacacccaagaatgatcaataaaaaaataaataaataaataaataaagaaggaatggaaggtattatgggttgaattgtgtcccccaaattcatatattggggtcttaacccccagtatcacagaatgtgaccttgtttagaattagtggtgttgcagatgtaaatggttaagatgacatcatactggagtagggtgagctcctaatccaatatgacttggtgtccttataaaaaaagaaatttggacacagacatgcacagagggataacggcatgtgaagatgaagacagagattggggtgatgtagcagaagccaaggaatgcaaaagattgcaagcagaccaccagatgctaggatggagatgtgggatagattctccttgaaagctctgagcaggaatcaatgctgtggacatattgacttcagacttctagtctccaaaactttgaaacagtaaacttctgttgttgaagccacataattcatggtacccagttatggcagctctagcaaactaatccagaaggacttaggcacaaaatgttcatgaggaattcaggacaaatgcatgtggcttaagtaggattcagtaagtgcttataccctgtgcaaagtgtattaatttacctatctctttcctgttgatttttgttgtgtgtttaagattgactcaataagctgtgtgatgtaagcatttcaatttggtttgtgaaacttcctgtttcatgacatgcagattagcttgcaagatcgtatacttagaagctttttgtcacattagtgccatatcccaagttcataagacctttagaacctcaaatctagttgtttttgcactcctcaaagtactgtgtggatctttatgaaaactgtaatatttccttatatttaagttttgttataatagaaaacaggtttaaggctgagtgcaatggctcatagctgtaatcccagcactttgggaagccaaggtgggaggattgcttgaggccaggtgtttgataccagcctgggcaacatagcagcaagaccctgtctctacagacaaaattaaaaaaataaattagctgggtatggtggcacatgcctctagtcccagctactctggaggccaaggtggaaggattgtttgagaccaggagttcaatcaaggttgcagtgagccataatcgtgacactgcatcctttttc

SEQ ID NO: 43407 - DNA, 645 bp, Homo sapiens
ctacaggcgccctgccaacgaggaatggacattctcctacgtctgcttgcatggggcttcccctgcacccctcacaggggtgcccctgccaccagttaacaagacagtcactgacagatggactctggaagccggcagatgtgctgatgccttgatcctttccactgtcaaaaaaaatagccaatctcctagaacctccttgtgaactagaaggcaggaaagcttcatttgaaagggcaccagttcccgtacccactcactccccagatgaatcaggaaactcaggactgatgtttgggtatttaaccctaacccaaggtcctcagcctgactcctcagggaggacaactgatgccaggatgagtttcaaatgtcacctggctagtggggaagccctgacacctcccccaagggagccttcccctttagagacccccaacttccctctattttctctaatgcataatgggggccctgagagttgcaaagaaacgtttgacttttccaccaaaatacaatccttgcctcgtctttgtgtatctttggttttttgtggtctttcttggagatggcgtcttgctctgttacccaggctggagtgcagtggcatgatcatggctcactgcagcctcaatctcctggact

SEQ ID NO: 43408 - DNA, 199 bp, Homo sapiens
tgaagcttcccttttcagtcagcatgtgaataggaatagatttgtgtggatttacacatctacccacattttattatgatttccccggggcgggggttgtctttgtttttattgatggccaatgttgttaacaagagttacagactcgtatttgatatcaaatgtagcagctataataccttttaaaaactttaccaaa

SEQ ID NO: 43409 - DNA, 616 bp, Homo sapiens
catcctcggcgtcagaggtctctgtcttcctcttctctctgcgctcctgatttagcggtctctagttagcgctagggcccgggattcaaacgacttcggagggggcagctgaggagaaagggaaggatagtggaagtgggggtcagaccggaggtcaggccctcgagggcccgcggcgcaggaggctgcccaggcctgggtggggggcgtggcagggccgcgagcgggtcggaggcctctggtcctggatcctcgaagccgcttaactttcccctagtcttcctgccccgaggtgtgtcttccttggggcggaaacgccgcggcctcggcgagggctcctcggcgacacccctaccccgtcttttctggcccggagagacttcgggaaggtcagagcttccagtgccgcgagaggcggatgccctccagtccgggccgcttccaccgggcggggtggcctcctgggcttgttcctgggttgggggaacggacttgggtccactttggcctgagaaaattacaatttctttcgctgaagtaaggagcggcctctgcccgctttctcggatccctgcgtgtgtagtgagaggtcttggaaggatccttgcgcctctcc

SEQ ID NO: 43410 - DNA, 387 bp, Homo sapiens
cagctggttcaaggtatggctagacagcaaaaggcatggcaccctcccctgctgaggcttccctgtggttgggggactctgatggtgggcagtgtttactccaggccaccccagaaggccatgcagtcagggcctccctcaccatccgcacgtctgggcagttccctggctggagaaggacttcagtcctggccagaattgagccactgccaggaatccctgaacgtcagtacccggaccacttctgcccttgtgggcctctgagctgggtcgatttatcaagggtagggattttagaggcaggttcagggcagcccttctgcatcagatgtcaagtaagtagtttttttttttgagacagagtttcgctcttgttacccacccagg

SEQ ID NO: 43411 - DNA, 733 bp, Homo sapiens
aggggacctgactgctaattaattagcggtcaccttgggcaaagtggcgtaatctccatctgaggcatcttgattctcagggaagtggaatttggacttccagacaccctcagtgcctctggccttgctccctcctatccatttagtcctgcctgcatcactttgatgctgaaatttcttttagtttctcttactgcctttagaagggaacctaaacatcttaatctggctttcagtgtctttcaggatctgaaaatcatcctgataggtttaaaaagtgggatctgttttgcatttgtgtgcaggttaattgccctagcccctggagaggctgtgggggggtacgagaaagaggacccagacacctctacccaccccgcccaccccagggtgtggagcaaacccagtaaatggttagactcccaagcaatcaggcagcctgtcctctttgctctagagatgaaaaacaaaggcccagagagtggatggggcttgcccaaagtggcacagcaagtaggcagcagagctggagctagaaaccatttccagcttcgagtccagggctgttcctaaaccccactggactctctggagcgttgggtatcctgggattatcatcctgacacccatagggtaaatgtgtgtatccagtgggatgaggaatgccagcctctttacaagcaagtattgtactaaagtttggactgacttttacttggatacctactagtta

SEQ ID NO: 43412 - DNA, 396 bp, Homo sapiens
gaaatgatgagggtttgtgctgtggcagtgaagaagggaaaagagatgtaagtgtctaggtagatgtgatgcgttcattgaaataggtattagaggagaaacatgtttggagaggagcaaagttctggacaagttgggactgcaacatcagtaggacctctaaatggagttgtcttaggcagttggagatgtgacaggacatgcaaacatctattaatttgtcacaaaaatgttaagggcaatgtccacttcttcctttggtatccttatataacatccatcctagcccaatcagcctgagaccaccagggatgaatgtatagtctgatttgtgaatgcttataaccaggaagaccacacaccagagaactgtgggcatcttaccaacaaagaaaa

SEQ ID NO: 43413 - DNA, 781 bp, Homo sapiens
gctcagtactgtatgatattaggagcccctgacttcatcttctaatgagttggtcctacatgggactatggctgtgtccgaatgctggctgcccaagaccactgcactgcctgagttcagtcattcctcacagaggtgccgaggtcagccttcctcgaccagagtggttctcctgcagtgaatgaccttagactctggagatgtgaatgaaatcctagctatcttcttaaaatccttcaaagaagggattaagtcacagtaataaccaggtacctactgcattagtttcctgtgattgccataataaattaccacaaaactagtaattttggcttaagacaacacaaatttattttactaggagctgtgtaggtgaaatgtctaacatgggtctcactgaggtaaaatcaaggtttcggtagtgttgtgttcctttctggaagccctcgaggaaaaatccacattcgtgctttttccagcttctagaagccactcacattccctggctcgtggtcccttccttcatcttcaaagtcagcatcttctaatctctcgctcactgtgcttccatagccacatctctttctctgactctcttcttcctcctccttccaattaaaggaccttcatgatgacattgggtccacctggatactccaggatagcctccctactttaaagtcaggtgattagcaactttaattccatctacaaccttcattccccttgtcatgtaacttaacatattcacaactccagggatgaagatgtggccatcttg

SEQ ID NO: 43414 - DNA, 473 bp, Homo sapiens
tacttcttttcctttgcttagaactttgtggattacagactgattatacatctgtaatcctgcaggagactgtgatggactgaatgtttgggtcactctaaaattcatatgttgaggttggatgtggtgtctcacatctgtaatcccaacactttgggaggccaacgtgggcaaatcacttaagctcaggagtttgagaccaatctgagcaacacggtgaaatctcgtctctactaaaagtacaaaaagttagccaggtgtggtggtgcacacctgtggtcccagctactcaggaggctgaggtgggaggattgtttgagcccgggaggtggaggttgcagtgagcagagattgcgccactgcactacagcctggcaacactgtgtgagatgccatctcaaaaaaaaattcctatgttgaacccaaacccccgtgctgtgattaggaggtggggcctttgggaggtgaataga

SEQ ID NO: 43415 - DNA, 578 bp, Homo sapiens
tactgcactccagcctgggcaacagagtgagaccgtctcaaagaaaaagagttctttccctgccactgctgagttgagtggaggcagaggcttgggtgcattcaagattcagcttcacccgtagaccaccaccatggccacggaaggtgttgctgctggaggtgtggtggctgttaatactgctttacaagaggtgttgaagactgtcctcacccatgatggcctagcacgtggaatttgcaaagctgctgaagggtcaggcccatcttttgtgtgtttgcatccaactgtgatgagcctatgtcaagttcatagaggttctttgtgctgaacaccaaatcaacctacttaaggttgatgacaagaagctagggggaatggttaggtctctgtaaaattgacagagaggggaaaccccgtaaagtggttcgttgcagttgtgtagtagttgaagtacttcaaatgcaagaaatgaacgaataaaactctggctaacccccctgccccccaacacacacacagacacacacacacacacactcacagtcacactcactctgggcatgttggctcaatcc

SEQ ID NO: 43416 - DNA, 413 bp, Homo sapiens
tagataaagtctcagataacaaccccaagaagaatagttgaacagtctgtccagtaggcatggtaatgacctttagtttcttctttggtgattaatctttgcaggttactgagatttcagacaggggatttaaggcaattgtgtttcttttggaagaacttttctcagtcagataaggaaacttcagagagcttccctctctgttcttggggcaagtggaggggagaaacaaaggaatgtcagagagacattgatgttaaggaagtttctaatgacttacaatttcctttagttcaaagtgctcagaaagccaaagcaccacattttgggatatcgttttctgagccccaacaccagtctcactattaacactgtgagatctacattaccaaagagagttttgttctcagtgg

SEQ ID NO: 43417 - DNA, 626 bp, Homo sapiens
ctgtccagccaggtctggtgctgaagtcgcctcaccgttctgattacttcctctagttgtgaaggcagaggaggggctgttttggaaagtgactattctggcttttggttgggttctttcttctttttctacaatcgagttagcgtgtactattggttttcttattattaaacattgcataagttaccttttttgtaaaaaaaaaaaaagtattaggtgatgtgccagtactgaaagtgcagtatctaacccaactagaacgtttgttttatttttagaacaagtgcaccctttgttatatatttagtatattggtacccaaatacagaaaaaaactatagttctgtactatgtcctccaaactgtatattattgttcttaatttccagctgttgatataatggttaccactggatgagaaattcagtggtgcagacctggcttctgctgtttccagaagtgttcttttgtaccttattctgtagtagactgttataaaaagatgacacacacgctttattttttcttttgcaaataatagaaaaaacacaaccacagaaacaaacaaataatggatgtgcaagaatgccatctattaaaaacatggttaatatttaaaaaaaaaa

SEQ ID NO: 43418 - DNA, 522 bp, Homo sapiens
tatcacccaaaatgtgccccctagaggcaatcatagttaatgttttggtgcgttctaatcttttcccccatgcatatgtaactttttatatagttcagatcataccacacatgcaatttatcttactcttttcccataatttgctactgtaattttctcatgctattgaaatgtttttgtaaatgtcaagtttttaatagctgtgcattatcttattaaatggatatactatcctctattgttaaaatttaggttgtttcaaattgtccccataagtaacacttagtgagttttttttttttttttttgagacagggtcttgctctgttgcctaggctggagtgcagtggtgcaatcatggttcactgcaacctcctcctcccaggctcaagctattatcccacttcagcctcccaagtagctggggccacaggtgtgtgccaccacacccagctaatttttgtattttttgtagagatgggattttgccatgttgcccaggttggctctcgaattcctggg

SEQ ID NO: 43419 - DNA, 658 bp, Homo sapiens
acccctttctctgactaggaaagggaactccctgaccccttgctcttcccgagtgaggcaatgcctcgccctgcttcagctcgcgcacggtgcgcgcacccactgacctgcgcccactgtctggcactccctagtgagatgaacccggtacctcagatggaaatgcagaaatcacccgtcttctgcgtcgctcacgctgggagctgtagaccggagcttattcggccatcttggctcctccgttccctctatgagtccaaccaggatggcgacttgactggattttacagtttcattgacacgcatgagctctatcaaacttctgggagtttttctgaaatgtttacatggaaggcacctggagcccattgaatttccctcttcaaatgcttaagttttcttctgtcttggtggctactgcctccttctcactttctgccttaggtcaagataaatgagtttttccccaagaaagccatatggatctctgaggttttgaactctaaccaatgctatctcgttgattgcctttggatttcagggtcttattttacgtcaacctcagcctctctcttctgcagttccatatccacatgagctacaagagtcccatgtaggtcccttcctctgctaatagctgcctcattgtactgcttct

SEQ ID NO: 43420 - DNA, 296 bp, Homo sapiens
aaacaggctagaacaattttaaagggagtcaaatgtatagcccaaatatgtggaagacttgtagactggtctggaactcctaacctcaagtgattcgcctgccttggcctaccaaagtgctgggattacaggcgtgagccaccgtgtgaagccccacctaggtttttaatcaggttcatttatgtaaataaaaaatggaaacacgtttagttgtgattggtgagtgtagttgatttctcattggctggcaaaaatgagttctggttggtcaatacagctgaaccctgattgattga

SEQ ID NO: 43421 - DNA, 401 bp, Homo sapiens
cactctgcataggccttggtaccctgaactttgttttggaaagaagcaggtgactaagcacaggatgttcccccacccccatgcccagtgacagggctcatgccaacacagctggttgtggcatgggttttgtgacacaaccatttgtctgtgtctctgatagcattgagaaaagtgaaagggcagttttgaaggtaaggaaaatagtggcatttgcttggatccactggctcatgccactgtctgggttggttagaagcactggaaaagtcaaaccataactttgagaattaggtgatcagggaatcagaaggaaagatgcaaactttggctcttttaggcgaatcatgtgcctgcagatgaggtcatttattatcttttacacagtctataaaattata

SEQ ID NO: 43422 - DNA, 153 bp, Homo sapiens
caaaatgctatctaattctggcctcaaactacctgtaagtagttttatgtctttctctctgagaaataatctttgcttcaccccgcattactgatggacacgtacgtaagtatgtaggtagatgagtgaaaggtctggaagaatacacgccct

SEQ ID NO: 43423 - DNA, 190 bp, Homo sapiens
taggcgtgagccaccgtgcccggccacattaatctttataaatgtgaatttctaaaaaatttaagtgttggcccacttggtttctcaagttgcctgcctgaccctcttcgaagttgtacttttcttcttttctttcctttccgtactattctaaagctttttaataaactttcactcctgatctgaaaaa

SEQ ID NO: 43424 - DNA, 312 bp, Homo sapiens
gaatttgagcagcaagataaaaaatgatagcattggattttcacccacagaataacgtaatagccagaagtccatagttatataaataaataattttaagaatacataggagagaagggacaactctttcttaagtagaattccaaagaatacatataaaaggaaagtggaaaacagaaccaccattggggaaataactgttatagacaagattcacagattggtgctaaaattagtgggcaacgatttgaggagaaacggaatttgcgtagtctcagcatatctcacttaaaatgcttatttgctaccaag

SEQ ID NO: 43425 - DNA, 167 bp, Homo sapiens
cttgggaggctaaggcagaaggatcacttgagcctgggaggtcaaggctgcagtgagctatgatcctataagtgcactgcagcctgggtgacagtgcaaaaccctgccccgcctttcccctccaaaaaaaaaccccaaaaaaacccccacaaaaaaccaacaacaac

SEQ ID NO: 43426 - DNA, 454 bp, Homo sapiens
  misc_feature (412)..(412): n is a, c, g, or t
catcatttgagatgtcttgcttctttaaaaaaagaagagaccagcaattcttgggtacaagatgatctcaaatggcacagcaaaattaaaacatcatatcctctgttaatttgctaataagagacattaagagcatgagagcccttcaggtggacagagggcaacacactccaggctgatggaagacagacgatgaagatgtgattaaaaccctaaccaaactatttctgcatgagcaagcggggcactgtcgatactctcagaatcacagcagccactccttataaaccgctccgaacttgctgatatgctctgtactgtatacatagctcacgtgacacaaaacacaaaccaactgctgagagaggtaattcagtgaataaaatgggatcgcgcgccagcgccccttccntttttctatacataaatattgaggagctactaatctaggaac

SEQ ID NO: 43427 - DNA, 628 bp, Homo sapiens
agttcgaaaccagcctggccaacatggcaaaactctgtctctactgaaaatacaaacattagctgggcgtggtggcagacgcctgtaatcccagctactcaggaggctgaggcaggagaatcacttgaacctgagaggtggtggttgcagtgagctgagatcgcactactgcacttcagcctaggtgacagagcaagactccgtctcaaaaaaaaaattttttttgaagctgtggtatttctttggtgtttattccaaataaaagctgtattactagaaactgttctttgggtccatttctaactgataactcattatttcaggttgaactattcaatgaataaatacttactctggctcataggtttaacccacccctctccttacagagcatgagagcccttcaggtggacagagggcaacacactccaggctgatggaagacagacgatgaagatgtgattaaaaccctaaccaaactatttctgcatgagcaagcggggcactgtcgatactctcagaatcacagcagccactccttataaaccgctccgaacttgctgatatgctctgtactgtatacatagctcacgtgacacaaaacacaaaccaactgctgagagaggta

SEQ ID NO: 43428 - DNA, 985 bp, Homo sapiens
gctgtggccatgtttattggagtgttggatctattctttatcatcctatcttatatctttatccttcaggcagttctacaactctcctctcaggaggcccgctacaaagcatttgggacatgtgtctctcacataggtgccatcttagccttctacacaccttcagtcatctcttcagtcatgcaccgtgtggcccgctgtgctgcgccacacgtccacattctcctcgccaatttctatctgctcttcccacccatggtcaatcccatcatctacggcgttaagaccaagcagatccgtgacagtcttgggagtattcccgagaaaggatgtgtgaatagagagtgaggaataagtggaaaaagagtggggcacagtgaatgctgtagtgggccagggctgtgctgagagtagatgggtgctagactccacgtttagttcttttcttgtattatggaaagaataaatgatgtcctgaagctcagtgccaacagtctgtttagaatttgtgggtctttgccctctggtagcctctggattgaacctggtgactgtgctgtctcctcacagagccctgactcctgtcagtaaacttgacagagtcttgaccctccggcctcatggtgactttgctgaaggacacaaagatgcttccaagttcatttgcctaagagaagactgtgaaaatctgaatttccatctctgacttgttggaaatttggtgaattatccactcagattcccgagttaggacctctactccatccagtgcaggagttctgctacattctaacagttgaaccctagactctacctaaacactgtcagtgctggtgcacatgcatcctttaggcctatttattccaagtgagacagctctgcttgttagaaggttatttcttcaactaagccagtctgtattctttgacttctttttacctcctcatcctcatggctattccatctcattaaatactttgaagaa

SEQ ID NO: 43429 - DNA, 374 bp, Homo sapiens
tttattctcctagagaatatcacactaatttaggttttggggccaatttctgtgtgtccatttgatacaatctaactatttgaaaagtgaaaaattcagttctttaatgtgccgtttttcttactgccaccaagatactgatttagctgttggaatgctgagcccaaactcctagccattatgatacatgacctctgggggcagagttgtgctattatcacttttacttagtctccttccccttggcccctctactccagcaaacctagccctgtgctctccctgtaggtggttaataaatgctgtgggtgcaagagattattttctccaaagtacttggttaccagctacctatgtcaaggagttaaaagaga

SEQ ID NO: 43430 - DNA, 391 bp, Homo sapiens
gatccacccaactcggcctcccaaagtgctgggattacaaatgaatctcttctttttgaagtcaactgtatcacgtcgcataacctaatcacaaaagtaatatccacaaaattaatagtcctacagatgatgtagggtgtgtacagcaggaagcaggaaatcttgggggttgtcatagaattctgctaaatatgcctagagacacacatccttaactggactttaggtttatcatttgtgttctctggcctcagtgttttcaatttgtggatcatgtaccaatagcatcagcattacctaggaattagtaagtaatgcaaattagcagctcccactcagaaatcaaaacttgaagtaggggtaggaagacatcagaagtctgtgtcttaat

SEQ ID NO: 43431 - DNA, 202 bp, Homo sapiens
ttcgtgtgccacaccccgagcagcggctgctggtcagcaaacaagggctgagacagacaaaggcagggatagcgcctgatctgggacagacagacaaaggcagggaccgcgcctgatctgggacagacagacaaaggcagggactgcgcctgatctggggcactctgtgtctggcaccacacacatcgcgaacgttctgtct

SEQ ID NO: 43432 - DNA, 461 bp, Homo sapiens
aagaggctgggacagggggaggatgaacttggagaagccatgactggaagcctgtgtcccatggcattgtcatctgtgtgtgtgccccatcttgactttgagctccacacaggacaggactctgactcatctttgttatagatctcagtgagtgcaaggcacgaagaagaaggggtgtcaatgagtgcttcataaatgaatgattggatgaatgaatgaatcatctgtttctccacttccattctgtggtctccggccaacattccctcccatttacctctcattaaactctttttgcagcagcactttctcttagttcttcctgtcatttgctagacttcagctttgtgatctttgggtcagacaccatgatgagagatgcagatcgcaactgagcgtcatttaaatattcagaagagctgaggctccgcaggctgaattctgaatatgcagataattca

SEQ ID NO: 43433 - DNA, 146 bp, Homo sapiens
atgtatcccttctgtgattatatatatatatatatatatatatatatatatatatatatgtaaatatatattcacacatctctatatattttaatgtattgcacatgtatatttaaaatatatacgaaagaactctaaatcctgca

SEQ ID NO: 43434 - DNA, 912 bp, Homo sapiens
tctaggactggtcagatgacttttttttttttctacataagaaagcaagttgctggccaggcacggtggctcatgcctgtaatcccagcactttgggaggccgaagcgggaggattacctgaggtcaggagttggagaccagcctggccaacatggtgaaaccctgtctctactaaaaatacaaaaattagctgggcgtggtggtacacacctgtaatcccagatactcgggaggttgagggaggagaattgcttgagcccgggagatagaggttgcagtgagctgagatcatgccactgcactccagcctggctgacagagtgagactgtctcaaaaaaacaaacaaacaaacaaagaataatggtagcttttcttatttatagttttctttcttccccccagatttccaagagtaaccatatattagttttatcattagaaaaaaaaacctaaacattaaaaaaattcttggaacaccatctgtattcctccattatgtcatttttcataaaacagtcagctcagcttgattataccaaatagatctcttggtacctaagactcagggaaaactaatggattgaaacgactaagatcagagagcagaatctaactagccatgcttacctctcaaaatgataccttgttaactaagcatggaattagataactagttgttataaaaggcagactatagaaatatatttaggccagcctgggcaacatagtgagaccccatttctacaaaaaaattttttttaattagctgggtgtggtggttcacacctgtagtctcagctagtaagtagcatgaggtgggaggatcgcttgagccctgaaggtcaaggctgcagtgagccatgatcgtgccactgcactccagcttgggtgatacaccaagaccctgtct

SEQ ID NO: 43435 - DNA, 234 bp, Homo sapiens
aaaaaaaaaaaaaaaaaaaaaacctggaaagaaaagaaataaagtgactactgcaatagataaaataaattgcccagctgcctccaggtttgctattttttcattatcagtgttttcttgacagtgttaaaacatttggccccctaaattcacagtttattggaacacttgatgaaagctgaatctctgtagtcatgctgttagtgactcactcttcctttgaaatgtctaatg

SEQ ID NO: 43436 - DNA, 776 bp, Homo sapiens
tacatctcattctggaggaagagatggcaccacatgaggagcaggcagggagtcaatcccaggtgcacttaggagagaagaaaggcacatccacctggtaagccgctctgaaatgagtagcgtgcagggtgatgttgagctctattctgcagttcgatcaacatgcttctacctctcggccctcacatagcagcctgcctggctgccatctgccaagcttttgctttcctttctgttttgcataaggcttttgcttttaatatgctgctactgagtacagaaaaacaagagcgtaccagacttcagggatctgcctgtttcttttctgccttttaatagagcttagctcttttgccacttgttattgtcaagtacaacatgagttcagagaaagaacactgcacctgaccggggatggatgccacgccttgaagaaattggcaggaaacagaagaggtttataggatcttctcttctgccactcccatcttggaaacaagtggaagtacatttgcaaaattatattgaaaaaaatgagaaaatgcatttttctttatagtcaacccttctgacatggacctagtttcaaatgaagttatgaggaaatggcccttatgactaaatgttgattcatgtgctgtgagctgtgaacccaggatgagaaatgggaggaaatcaaactaaggaatggaaagggggaagtgctctgggtgccttgcctaagagactgaaccctcaaatcttggaaataaaccatattttgtaaaccaaaaaat

SEQ ID NO: 43437 - DNA, 268 bp, Homo sapiens
ttttggaggagtgtcagggacctccctgctctggctgctgacagtgaagcctagtggggaattctctggtctccctaaaaacattactgggccagatgtggtggctcatgcctataatcccagcactttgggaggctgaggtaggcagatcacctgaggtgaggagttcgagacaaccctggacaacatggcgaaaccctgtctctactaaaaatacaaaaattagccgggcatggtggcacgtgcccgtattcccagctactcggaa

SEQ ID NO: 43438 - DNA, 382 bp, Homo sapiens
ggggtttggtgaaactcaccagaggctgaaccctctccagcataacacagggattgggaggagcagggcggcattaggccagatgtatagcccagtgctgctctctctggacttgtttgctagctgagctcatccatttacataattttcagtgccatttctcagctaatgagtcctgaacttttgtcttgaggctagaattctccttcaaacagcagttttaacactcaacttctttcttgttttttccacttgtcaactcatgaacacctcaaccttgttacatccaaagccaaactcatggcttggagtggtaggtgatggctgtaatcccagtgctatgggaggcagaggtgggaggattacttgaggccaggagttg

SEQ ID NO: 43439 - DNA, 503 bp, Homo sapiens
acctaatatggccccatgtccactcagatacccccactcccacactgcctgtcatcccccttgatggagaataacctgcctttagtgttacgtgaaggaagattcagataaatactttgaatgctgaaagacaggaatgcgggacctagtttggtatggggtaccctgtaccgatgctttagcaaggaccagcagacttgttgccttgaggcagcttcagggcagacctcagaggcaactggatttacttgagaaccttcttgctttctgtttcttgcagctgcagctgttggacttgtgccccaggagcacgttcctctatggccacagtcctgggagtcctctgctcctctctcctccctactcccaaactccagacagcttggttagggcccttagccaagcctaactgacctttgagtacttcagcctcttagcatttcccagcttcttcccagaatgacatttgccaaccaaatagcacaagggaaggaagagtacaa

SEQ ID NO: 43440 - DNA, 663 bp, Homo sapiens
ttagcactgcagggctctgcgcgggaacgctaacctggtccggagcgagtctgggtctcagccccgcgaacagcctttcacgagtcttcaagctttcaggctatcttctagtcaagatgagtgataagccagacttgtcggaagtggagaagtttgacaggtcaaaactgaagaaaactaatactgaagaaaaaaatactcttccctcaaaggaaactatccagcaagagaaagagtgtgttcaaacatcataaaatggggatcgcctcccaacagcagatttcgacattacctgagagtcttgattttaggcttgttttttgtaaacccatgtgtttgtagagattttaggcgtcttcggatatcttctcacctatgttccctggctaagaagtcagaggtagccaatgtttccttaaattcatttttaaacttaccattggtgcatatgttccagatggcagatgctgtcaataatctcaccattgatgacctttgtgtatgtagttcttgcatcctatactggataagcctgttttaacctgctatgatgggtgcttccattgcttcataatcttcatgaagttgcatgcttttgcagcttttcacagtttatttgcatttctaatgtagtaataaagtaaccaatataatcattatctg

SEQ ID NO: 43441 - DNA, 739 bp, Homo sapiens
  misc_feature (678)..(678): n is a, c, g, or t
ttagcactgcagggctctgcgcgggaacgctaacctggtccggagcgagtctgggtctcagccccgcgaacagcctttcacgagtcttcaagctttcaggctatcttctagtcaagatgagtgataagccagacttgtcggaagtggagaagtttgacaggtcaaaactgaagaaaactaatactgaagaaaaaaatactcttccctcaaaggaaactatccagcaagagaaagagtgtgttcaaacatcataaaatggggatcgcctcccaacagcagatttcgacattacctgagagtcttgattttaggcttgttttttgtaaacccatgtgtttgtagagattttaggcgtcttcggatatcttctcacctatgttccctggctaagaagtcagaggtagccaatgtttccttaaattcatttttaaacttaccattggtgcatatgttccagatggcagatgctgtcaataatctcaccattgatgacctttgtgtatgtagttcttgcatcctatactggataagcctgttttaacctgctatgatgggtgcttccattgcttcataatcttcatgaagttgcatgcttttgcagcttttcacagtttatttgcatttctaatgtagtaataaagtaaccaatataatcattatctgaaaaacaaaaaaaancgggctctatccggggccggcaacgcggttcgaatggccctggccataccggttccggacc

SEQ ID NO: 43442 - DNA, 877 bp, Homo sapiens
  misc_feature (13)..(13): n is a, c, g, or t
  misc_feature (76)..(76): n is a, c, g, or t
  misc_feature (78)..(78): n is a, c, g, or t
  misc_feature (80)..(80): n is a, c, g, or t
  misc_feature (719)..(719): n is a, c, g, or t
  misc_feature (726)..(726): n is a, c, g, or t
agagagagagagngagagagagagagagagagagagagagagagagagagagagagagagagagagagagagaganananagagagagagagagcgagtctgggtctcagccccgcgaacagcctttcacgagtcttcaagctttcaggctatcttctagtcaagatgagtgataagccagacttgtcggaagtggagaagtttgacaggtcaaaactgaagaaaactaatactgaagaaaaaaatactcttccctcaaaggaaactatccagcaagagaaagagtgtgttcaaacatcataaaatggggatcgcctcccaacagcagatttcgacattacctgagagtcttgattttaggcttgttttttgtaaacccatgtgtttgtagagattttaggcgtcttcggatatcttctcacctatgttccctggctaagaagtcagaggtagccaatgtttccttaaattcatttttaaacttaccattggtgcatatgttccagatggcagatgctgtcaataatctcaccattgatgacctttgtgtatgtagttcttgcatcctatactggataagcctgttttaacctgctatgatgggtgcttccattgcttcataatcttcatgaagttgcatgcttttgcagcttttcacagtttatttgcatttctaatgtagtaataaagtaaccaatataatcattatctgcacaaancaaaaanaaaactcccgaggacatctattgccgcgggcgcaacacagcaccgccttgaactgggcactggtccatagcggttcctgacccaagtttcttgtcacaagggaaactctgcggcaccccaaaaggagcgaataattcgacaaccggtaacg

SEQ ID NO: 43443 - DNA, 712 bp, Homo sapiens
  misc_feature (13)..(13): n is a, c, g, or t
  misc_feature (76)..(76): n is a, c, g, or t
  misc_feature (78)..(78): n is a, c, g, or t
  misc_feature (80)..(80): n is a, c, g, or t
agagagagagagngagagagagagagagagagagagagagagagagagagagagagagagagagagagagagaganananagagagagagagagcgagtctgggtctcagccccgcgaacagcctttcacgagtcttcaagctttcaggctatcttctagtcaagatgagtgataagccagacttgtcggaagtggagaagtttgacaggtcaaaactgaagaaaactaatactgaagaaaaaaatactcttccctcaaaggaaactatccagcaagagaaagagtgtgttcaaacatcataaaatggggatcgcctcccaacagcagatttcgacattacctgagagtcttgattttaggcttgttttttgtaaacccatgtgtttgtagagattttaggcgtcttcggatatcttctcacctatgttccctggctaagaagtcagaggtagccaatgtttccttaaattcatttttaaacttaccattggtgcatatgttccagatggcagatgctgtcaataatctcaccattgatgacctttgtgtatgtagttcttgcatcctatactggataagcctgttttaacctgctatgatgggtgcttccattgcttcataatcttcatgaagttgcatgcttttgcagcttttcacagtttatttgcatttctaatgtagtaataaagtaaccaatataatcattatctg

SEQ ID NO: 43444 - DNA, 389 bp, Homo sapiens
tcatcaaaaggatgtaggccaggtatctgccttctcttagaaaactcatgcagcagtgcttagctggatgacataataaactgcttcgtgggatggcagagccctgtgtccacttatgtggaaggatttaagaatttttttttttttttgagacagggtctcactctgtcacccaggctggagtacagtgatgtgatcatgtttcactgcagcttcgacctcctgggttcaggtgatcctcccacctcagcctcccaagtagctgggactacaggcacgtaccaccacacccagctaatttttgtattttttttttgtaaacatggggtttggccatgttgcccaggctggtctcaaactcctaagctcaagtaatcctcctaccttgg

SEQ ID NO: 43445 - DNA, 984 bp, Homo sapiens
agctcctcaaagccttacctgttttgcctaagaggagtgtccttcattcgtacctatagaaacactacttggcaacagtgaatgttctctgacacatgtaataggttgttaagtttctctatttagagtccattggtagtcaagaccacctgggtgctgtttgcaagacataactatcatggaagtatttaatactatactattggtatagcaggtacatgatatgctattagtgctgtagaaatgttatgttagagacgggaacctgaagcccctccttgtggcacatagacaacctttgttttttcctataatcctttccaccttttccttggggtaatgcccctccaagtgtgctctcccctgggactcagctgcctaggccttccttcttagccactattagctgagagcagaggcagcagctctggctggcagtggcccctggagctttgacatctggaggggatgaggaccccgttcggatgactcctgcccttccctacccaggctgtttgactcttgatctcgcctagtactttttctcaatatctaattcctgagcctgcgattgagttgtcctgcttggacacagcccttgtgttccacatgtgtggtctgatccagtgacaaagaagttgccatttaaacatctcatcttgaagaaccattctgcctttcatgcttcatgtattgaacactgaaactgataggagtcttagctttccctgtgtgtttccaagggtttaatacatacataatgatcaagagaacctgatttaacattttgctcaccctagtattaaaaaaaaaaattctggagaaggtaataaagactaagtttaaagaatgtcttggcagttgttaaaggaaattttaattaaatcccaaaatagtgggtacatgagaataattccatttgagggtaactgttgggtgtcctcattaaagcctatacaatgcatcgtatgaattttctcctgt

SEQ ID NO: 43446 - DNA, 506 bp, Homo sapiens
gagaagttcatatattcttgccacttagataatgatcgtgggggatactgttgtagaggagtctagcaaaacaatccctcctagactttgtggtcagtcagcaagcgaagaatgtgggggcctgtgcagctgggcacctgaccgcgtttgctgcaaaggagcagcccccgtctggaggggtaggcactgtggggtgggggcctggctttcttggctgtgagagagaaaatggcagaagcattatggaaagacaaccgtcactctgttacaagcagagaccaaggacttggaacgtcctccaaactctgggcttgagaaatgaaggccgaagtcgctgctgagaaagccactaagaaaggagtttgggagatgccaccaggcagccgtcgggggaggcaaaagcgcctcacgcattctgttccttgttgcttctcggtttgtagataaacatgaaatcaaagcttgataaagcataatctgaatgtgctgctcattctctttttctc

SEQ ID NO: 43447 - DNA, 2134 bp, Homo sapiens
agccccggacagcgcaggctgcggcttttcgtcctccactgagtcctgccggtggcccgagcccggtggcctcccggcgaccctcggcgcgaggcgacatggcaggcggccacagcctcctgctggagaacgcgcagcaagtggtgctggtgtgcgcccgcggcgagcgcttcctggcgcgggatgcgctgcgcagcctggcggtgctggaaggcgccagcctggtggtgggcaaagatggatttataaaagctattggtcctgctgatgttattcaaagacagttttctggagaaacttttgaagaaataattgactgctctgggaaatgtattctaccaggtttggtggatgcacacacacatccagtatgggctggtgaaagagttcacgaatttgcaatgaagttggcaggagccacctacatggaaattcaccaggccggaggagggatccactttaccgtggagcgcacgcgccaagccacagaggaggagctgttccgctccttgcagcaacggctccagtgcatgatgagggctggcaccacgctggtggagtgcaagagtggatatggcctcgacctggagaccgagctcaagatgctgcgcgtgattgagcgcgcccggcgggagctggacatcggcatctcggctacctactgcggggctcattcagtgcctaagtaatcaggaaaaactgctactgaagctgctgatgacatcatcaataaccacctcccaaagctgaaggaacttggcagaaatggggaaatacacgtggacaatatagacgtattttgtgagaaaggtgtctttgatctcgattccaccagaaggattcttcaacgtggaaaagatatagggttacagattaacttccatggggatgaactccacccgatgaaggctgctgagcttggggctgaactgggagcgcaggcaatcagccacctggaagaagtgagtgatgaaggcatcgttgccatggcaacggccaggtgctctgccatccttctgcccaccacagcctacatgctgagactgaaacaacctcgagccaggaagatgttagatgaaggagtaatagttgctctgggaagtgatttcaaccccaatgcatattgcttttcaatgccaatggtcatgcatctggcctgtgtaaacatgagaatgtccatgcctgaggccttggccgctgccaccatcaatgcagcttatgcactgggaaagtctcacacacacggatcgttggaagttggcaaacagggagatctcattatcatcaattcatcccgatgggagcatttgatttaccagttcggaggccatcatgaattaattgaatatgttatagctaaaggaaaactcatctataaaacatgatagatttgaaaagagaagactttttgactatatgaaataagtcaatatagttatattaaaagttaaaacaccttaatatttacaagaattatatcacttaaacctaaatgtacttcaatgtctttttaagtcactcaaaaaacccaagggatagatttattttcatttaacacatgcatttgacatataaacaggtaaacctattgtgattaaaatcacaaaacatccaattagttcacaaatattggttacaaatattctgtagattaatatggtggggtatcacaaaaatgcctttgtggggaaaagtaggcttggcttaaaatttccattttgtgtctgtatttcacatctcagtttttaaactatatttagtgaacattgagggatcgaaagaaatctaagtgatacgccccaatgaagctaaaatatagccttctgttaagcaaatagtatttcctttccccaagtagttcattttctagatgcttgtcaaatgaattaatgtcctctgatgaagagtgtccttccgtttctaaggtcttctcaatctcagcaatagagcttcccagcagcgttcaagacacatcatttatacacaggcacaggggccttcctgaaatgggtgcatttttaccaactacaatcatgtaatttttttggaaattttttaaaattttcgattctttacattacaattgggtgaaacacattttacagctctcaataaatgtttgctgtcgctctta

SEQ ID NO: 43448 - DNA, 2070 bp, Homo sapiens
agccccggacagcgcaggctgcggcttttcgtcctccactgagtcctgccggtggcccgagcccggtggcctcccggcgaccctcggcgcgaggcgacatggcaggcggccacagcctcctgctggagaacgcgcagcaagtggtgctggtgtgcgcccgcggcgagcgcttcctggcgcgggatgcgctgcgcagcctggcggtgctggaaggcgccagcctggtggtgggcaaagatggatttataaaagctattggtcctgctgatgttattcaaagacagttttctggagaaacttttgaagaaataattgactgctctgggaaatgtattctaccaggtttggtggatgcacacacacatccagtatgggctggtgaaagagttcacgaatttgcaatgaagttggcaggagccacctacatggaaattcaccaggccggaggagggatccactttaccgtggagcgcacgcgccaagccacagaggaggagctgttccgctccttgcagcaacggctccagtgcatgatgagggctggcaccacgctggtggagtgcaagagtggatatggcctcgacctggagaccgagctcaagatgctgcgcgtgattgagcgcgcccggcgggagctggacatcggcatctcggctacctactgcggggctcattcagtgcctaagtaatcaggaaaaactgctactgaagctgctgatgacatcatcaataaccacctcccaaagctgaaggaacttggcagaaatggggaaatacacgtggacaatatagacgtattttgtgagaaaggtgtctttgatctcgattccaccagaaggattcttcaacgtggcttggggctgaactgggagcgcaggcaatcagccacctggaagaagtgagtgatgaaggcatcgttgccatggcaacggccaggtgctctgccatccttctgcccaccacagcctacatgctgagactgaaacaacctcgagccaggaagatgttagatgaaggagtaatagttgctctgggaagtgatttcaaccccaatgcatattgcttttcaatgccaatggtcatgcatctggcctgtgtaaacatgagaatgtccatgcctgaggccttggccgctgccaccatcaatgcagcttatgcactgggaaagtctcacacacacggatcgttggaagttggcaaacagggagatctcattatcatcaattcatcccgatgggagcatttgatttaccagttcggaggccatcatgaattaattgaatatgttatagctaaaggaaaactcatctataaaacatgatagatttgaaaagagaagactttttgactatatgaaataagtcaatatagttatattaaaagttaaaacaccttaatatttacaagaattatatcacttaaacctaaatgtacttcaatgtctttttaagtcactcaaaaaacccaagggatagatttattttcatttaacacatgcatttgacatataaacaggtaaacctattgtgattaaaatcacaaaacatccaattagttcacaaatattggttacaaatattctgtagattaatatggtggggtatcacaaaaatgcctttgtggggaaaagtaggcttggcttaaaatttccattttgtgtctgtatttcacatctcagtttttaaactatatttagtgaacattgagggatcgaaagaaatctaagtgatacgccccaatgaagctaaaatatagccttctgttaagcaaatagtatttcctttccccaagtagttcattttctagatgcttgtcaaatgaattaatgtcctctgatgaagagtgtccttccgtttctaaggtcttctcaatctcagcaatagagcttcccagcagcgttcaagacacatcatttatacacaggcacaggggccttcctgaaatgggtgcatttttaccaactacaatcatgtaatttttttggaaattttttaaaattttcgattctttacattacaattgggtgaaacacattttacagctctcaataaatgtttgctgtcgctctta

SEQ ID NO: 43449 - DNA, 1636 bp, Homo sapiens
agccccggacagcgcaggctgcggcttttcgtcctccactgagtcctgccggtggcccgagcccggtggcctcccggcgaccctcggcgcgaggcgacatggcaggcggccacagcctcctgctggagaacgcgcagcaagtggtgctggtgtgcgcccgcggcgagcgcttcctggcgcgggatgcgctgcgcagcctggcggtgctggaaggcgccagcctggtggtgggcaaagatggatttataaaagctattggtcctgctgatgttattcaaagacagttttctggagaaacttttgaagaaataattgactgctctgggaaatgtattctaccaggtttggtggatgcacacacacatccagtatgggctggtgaaagagttcacgaatttgcaatgaagttggcaggagccacctacatggaaattcaccaggccggaggagggatccactttaccgtggagcgcacgcgccaagccacagaggaggagctgttccgctccttgcagcaacggctccagtgcatgatgagggctggcaccacgctggtggagtgcaagagtggatatggcctcgacctggagaccgagctcaagatgctgcgcgtgattgagcgcgcccggcgggagctggacatcggcatctcggctacctactgcggggctcattcagtgcctaagtaatccttggccgctgccaccatcaatgcagcttatgcactgggaaagtctcacacacacggatcgttggaagttggcaaacagggagatctcattatcatcaattcatcccgatgggagcatttgatttaccagttcggaggccatcatgaattaattgaatatgttatagctaaaggaaaactcatctataaaacatgatagatttgaaaagagaagactttttgactatatgaaataagtcaatatagttatattaaaagttaaaacaccttaatatttacaagaattatatcacttaaacctaaatgtacttcaatgtctttttaagtcactcaaaaaacccaagggatagatttattttcatttaacacatgcatttgacatataaacaggtaaacctattgtgattaaaatcacaaaacatccaattagttcacaaatattggttacaaatattctgtagattaatatggtggggtatcacaaaaatgcctttgtggggaaaagtaggcttggcttaaaatttccattttgtgtctgtatttcacatctcagtttttaaactatatttagtgaacattgagggatcgaaagaaatctaagtgatacgccccaatgaagctaaaatatagccttctgttaagcaaatagtatttcctttccccaagtagttcattttctagatgcttgtcaaatgaattaatgtcctctgatgaagagtgtccttccgtttctaaggtcttctcaatctcagcaatagagcttcccagcagcgttcaagacacatcatttatacacaggcacaggggccttcctgaaatgggtgcatttttaccaactacaatcatgtaatttttttggaaattttttaaaattttcgattctttacattacaattgggtgaaacacattttacagctctcaataaatgtttgctgtcgctctta

SEQ ID NO: 43450 - DNA, 2189 bp, Homo sapiens
agccccggacagcgcaggctgcggcttttcgtcctccactgagtcctgccggtggcccgagcccggtggcctcccggcgaccctcggcgcgaggcgacatggcaggcggccacagcctcctgctggagaacgcgcagcaagtggtgctggtgtgcgcccgcggcgagcgcttcctggcgcgggatgcgctgcgcagcctggcggtgctggaaggcgccagcctggtggtgggcaaagatggatttataaaagctattggtcctgctgatgttattcaaagacagttttctggagaaacttttgaagaaataattgactgctctgggaaatgtattctaccaggtttggtggatgcacacacacatccagtatgggctggtgaaagagttcacgaatttgcaatgaagttggcaggagccacctacatggaaattcaccaggccggaggagggatccactttaccgtggagcgcacgcgccaagccacagaggaggagctgttccgctccttgcagcaacggctccagtgcatgatgagggctggcaccacgctggtggagtgcaagagtggatatggcctcgacctggagaccgagctcaagatgctgcgcgtgattgagcgcgcccggcgggagctggacatcggcatctcggctacctactgcggggctcattcagtgcctaagtaatcaggaaaaactgctactgaagctgctgatgacatcatcaataaccacctcccaaagctgaaggaacttggcagaaatggggaaatacacgtggacaatatagacgtattttgtgagaaaggtgtctttgatctcgattccaccagaaggattcttcaacgtggaaaagatatagggttacagattaacttccatggggatgaactccacccgatgaaggctgctgagcttggggctgaactgggagcgcaggcaatcagccacctggaagaagtgagtgatgaaggcatcgttgccatggcaacggccaggtgctctgccatccttctgcccaccacagcctacatgctgagactgaaacaacctcgagccaggaagatgttagatgaaggagtaatagttgctctgggaagtgatttcaaccccaatgcatattgcttttcaatgccaatggtcatgcatctggcctgtgtaaacatgagaatgtccatgcctgaggccttggccgctgccaccatcaatgcagcttatgcactgggaaagtctcacacacacggatcgttggaagttggcaaacagggagatctcattatcatcaattcatcccgatgggagcatttgatttaccagttcggaggccatcatgaattaattgaatatgttatagctaaaggaaaactcatctataaaacatgatagatttgaaaagagaagactttttgactatatgaaataagtcaatatagttatattaaaagttaaaacaccttaatatttacaagaattatatcacttaaacctaaatgtacttcaatgtctttttaagtcactcaaaaaacccaagggatagatttattttcatttaacacatgcatttgacatataaacaggtaaacctattgtgattaaaatcacaaaacatccaattagttcacaaatattggttacaaatattctgtagattaatatggtggggtatcacaaaaatgcctttgtggggaaaagtaggcttggcttaaaatttccattttgtgtctgtatttcacatctcagtttttaaactatatttagtgaacattgagggatcgaaagaaatctaagtgatacgccccaatgaagctaaaatatagccttctgttaagcaaatagtatttcctttccccaagtagttcattttctagatgcttgtcaaatgaattaatgtcctctgatgaagagtgtccttccgtttctaaggtcttctcaatctcagcaatagagcttcccagcagcgttcaagacacatcatttatacacaggcacaggggccttcctgaaatgggtgcatttttaccaactacaatcatgtaatttttttggaaattttttaaaattttcgattctttacattacaattgggtgaaacacattttacagctctcaataaatgtttgctgtcgctcttattgttgttgtttcctttcagcctggaagtagatcagcagcgttgtctattagagt

SEQ ID NO: 43451 - DNA, 1263 bp, Homo sapiens
agccccggacagcgcaggctgcggcttttcgtcctccactgagtcctgccggtggcccgagcccggtggcctcccggcgaccctcggcgcgaggcgacatggcaggcggccacagcctcctgctggagaacgcgcagcaagtggtgctggtgtgcgcccgcggcgagcgcttcctggcgcgggatgcgctgcgcagcctggcggtgctggaaggcgccagcctggtggtgggcaaagatggatttataaaagctattggtcctgctgatgttattcaaagacagttttctggagaaacttttgaagaaataattgactgctctgggaaatgtattctaccaggtttggtggatgcacacacacatccagtatgggctggtgaaagagttcacgaatttgcaatgaagttggcaggagccacctacatggaaattcaccaggccggaggagggatccactttaccgtggagcgcacgcgccaagccacagaggaggagctgttccgctccttgcagcaacggctccagtgcatgatgagggctggcaccacgctggtggagtgcaagagtggatatggcctcgacctggagaccgagctcaagatgctgcgcgtgattgagcgcgcccggcgggagctggacatcggcatctcggctacctactgcggggctcattcagtgcctaagtaatcaggaaaaactgctactgaagctgctgatgacatcatcaataaccacctcccaaagctgaaggaacttggcagaaatggggaaatacacgtggacaatatagacgtattttgtgagaaaggtgtctttgatctcgattccaccagaaggattcttcaacgtggaaaagatatagggttacagattaacttccatggggatgaactccacccgatgaaggctgctgagcttggggctgaactgggagcgcaggcaatcagccacctggaagaagtgagtgatgaaggcatccccaccacagcctacatgctgagactgaaacaacctcgagccaggaagatgttagatgaaggagtaatagttgctctgggaagtgatttcaaccccaatgcatattgcttttcaatgacacatcatttatacacaggcacaggggccttcctgaaatgggtgcatttttaccaactacaatcatgtaatttttttggaaattttttaaaattttcgattctttacattacaattgggtgaaacacattttacagctctcaataaatgtttgctgtcgctctta

SEQ ID NO: 43452 - DNA, 472 bp, Homo sapiens
caacctcgagccaggaagatgttagatgaaggagtaatagttgctctgggaagtgatttcaaccccaatgcatattgcttttcaatggtaattatttttttcatgtacctttctgagcagagtatctaccaagcatataaataatttaaaaatatttcactagcttttaaaacagtataaaaaatctaaaaatatttttctgtgaaacaagaaaaaaaggggtagacagcagtgtaattggatttttctgtcccacataaatgcctgcaggcatagagagaggagagaagcttctacatgcattattttctgattcagctttgagtattgtagttttacagtaacccatttcctttctccagagaatagcataaactccaagaggtcttagtaagtatggaagtgaacttcattgtgtgcagtaagtggtcttgaaaagttgtcaataaatattaaatacgcaatccctata

SEQ ID NO: 43453 - DNA, 1170 bp, Homo sapiens
catctatcagatgggaatagtaatactcattttacctatttttaccaggtggttgtaggaacaggattcattcattccttcattaatataatgaacactttgagaccccactatataacagggccatacatatgacaaggtgatagatggaaagacgttttgcagaatttttgaagacttgcaatgtttttgaagactacaggatagtttgtgatttttatattaaggtcgtatcaactctttatgtcaatatatcaaagtaattgacacttttagagctctgccaatcagtgggccatattcatagaatgtcagtaatctgtctgaatacaagttatagttggtctttagctgttctgtctctgaggagctagaaataaaatattaggttctaatttttttttgttcaaacactgatcatgtaacaaactgcaaatccatgttttcagcaggttcgccaacctttgagttgaatgcagacctttctttagaacaacctaactttgagtacaggcaaagtattaaatggaatagcttttcctcccctacaaagtggatttgaatacagtccttagaaaaattcttcccctgccaaaaaaggtccttcaatctcctttattatttttcttttgaagaatcaaacttgtccatctctcccctcccaagtgactttcctcactcatgtaatcattttcttcataaatgcccttttactatcccacagaaaaagtaaagatttaaaaaatcatttttaaggtacatccaagatttcatagcaatattttatttgtgttcacagtgcaagataaatctgactttctcaatatttttggtcttcatatggcatctgaaacagttgttcacattcacacatttatgtttcaccatatgcatactgtgtacagctctgttgttctaaaatattttattggttttcctttatatctcaacttttgatgggtgtccttgaagaactttcatgaaaaaaatgtaaatgtgaatgattcattcattttgaacatatgtaactattttaggagattttcaggagattttaccctacatggagtacactgttcttagcagggaatgtgctttatattactattctactcacagctggatgctgcagatgtattaacattgtaaacatgtactttttctattcta

SEQ ID NO: 43454 - DNA, 233 bp, Homo sapiens
caactcagattaatccagaaacttgctttaatagtctttttagggccgggcgcagtggattacaggcatgagccaccgtgcctggccacctcccatattttaaaaactctccgaatgtgaggataaaagactattagattgatcaggtacacagagtttgcaaggtggtatggcaaaaggatcacagattcttacaaggtcattataagtactgctttggctaggaaaatgat

SEQ ID NO: 43455 - DNA, 466 bp, Homo sapiens
agtaataaaaataactatacttatgataatttggtaacagatacacattatctacaaaatgtaaattatggctgggtacagtggctcacacctgtaatcccaacactttggaagcctgaggttggaggatcacttaagcccaggagttccagaccaggccgggcaatatatcaagacccccatctatttttttaaaatgtaaattatgacattaataacataatgtgagtgagaagtttaagatttatcatatgcaagtgaagttcttttcagcttaaaatagacttataactatgagatgttttacataagcctcatggtaaccacatacacacatacacacacacatgaatagacctgtagtgggtacacaaaagagaaagagaaagaaagcttaccactatgaaaaaaattatcaaattacaaagaagacagcgagagaggaagaatagaacaaaagtactac

SEQ ID NO: 43456 - DNA, 1637 bp, Homo sapiens
aaccaccagcatccgtcttcttcctttccagccagacaactctccctggccctaatgggtttcaggcagagatggtttcctgagggcagcaccagtcagaatgggtggagcaggccccagagcttctaatggtcccagctgagtcccccaaggctcagcacgtgatcctgccggtcgtacacacagccccagctcgagcactgtgcggccactctctctccaagtactctctgcccgggagcccacttcatcctgcttcatcagtctctgaagctgagagaacacccttgtttgtttctgcagacattcctttgcttcagcactcaccgctccccagaccacaaaggtgtatggacttagcaaaaccagtcataatgatttttctatatcaaaaccagccctaacaatttttatacaacttttaaataaaaacagtggaaaatacaataaataagtcctctaaataaagctgtggtatgaagtttaaatgccccaagtcagaagtcaattggatgtctctgtctgagctgagagcacatgacatacaacgaaaccacatggacagacacaaccccgaatgccaattccagtgtcctgtgcagtgatgaccacactgttagaagcattttaactcttgtttttacaaactttcttttttacatatatgttagcggtcaaagaactctgtttttcttggtccaaaccagaggaaatttattgtccaaaccagacccaccccaatgcatttgcctctgatgtgagaaagaaacactagggcttcaaccagatgaggggcgtttaggaaaacccacagctgaagtcacattcaatgcggaacactgggcacctccccctaaggtcaggaacaagacgagggtgtccgctcttattcctttcagcctcggcactgatggtcctagggcaactctatgttgacgcctctgaggaactgccgggctgcagtgaatccaggtgacctcacagaaacttgtatgtgagcattcgcagcggcatcattcacagtggccaggaggtggaaacaaccccgatgtccatcaactgatgaaccaaccgatgaacacagggtgacctgtccatacagtggggtctcagccacagagggagcaaggccgtgaaacctgcagcgggagcaaggcggtgaaacccgcagagggagcaaggccgtgaaacccgcagcgggagcaaggcagtgaaaccctcagagggagcaaggccgtgaaacccgcagcgggagcgaggcgcggaaacaggccatgacacggacgagccacaccatggatgaccccacggacacgccaccaaagcaccatcatgctgagtgacagaagccaggcacccagaccatgcaccgtatgattcctttcacgtgaaatttcccagaacagggaaatgcagagcgacagaaagcaggttagaggttcccaggggctgggggttgggggaatggggagagactacttaacaggcagagacttgtttttggggtggtgaaaatgttctaaactgactatggctgcacaactctgtgaacacactaaaaacactggcttggacaacctaaatggtcggatgctgacttaggtctcaataaagctaaaaaataaggtgaaaaaaaa

SEQ ID NO: 43457 - DNA, 390 bp, Homo sapiens
caaaaacgccactgcaacaccacacgccattctaagccaactgacaagcctacaggcaactccaaaactatagaccacaaaagctctacagataatcatgaggctcctcccacttctgaagaaaactccagcaaccaagggaaagacccaatgatccggaaccagcgctctgttgatcctgctgactccactaccacacataaagaatccgctggaaaaaaacatataacgccagcacccaagagcaaaataaactgtcgtaagtccacaacaggcaaatcaacggtaacaagaaaatcagataaaactggaagacctttggaaaagtccatgagtactttggataagacaagtaccagctcacataagactacaacttccttccacaac

SEQ ID NO: 43458 - DNA, 372 bp, Homo sapiens
aagcaatatacagaaagaaaaatattctatgacctttcttatatgcagaatcctacaatataaagttgaataaatagaaacagagagtagaactgtagttattatgagaggaagaaatggagatgtggatcaaaggctacaaatttgcagttaggaagaatgaatatgtctaggggcctaatgtacagtatgaagactgtagttaataatattctactgtatactgaaaaatctgctaagagagtatattttaggtgtttttacctcacagatgcacacacacacacacacacacacacacacaaaccttctgcctttgatgttacagatttaatacagtttatttttaaagatagatccttttataggtga

SEQ ID NO: 43459 - DNA, 422 bp, Homo sapiens
cccaaactagtacaataaacctcctgtcaccaatttctccctcctccagcccacccagcacactgctacctgatttcctgaaaacctaattcaagaggaaacacactgatttcacccttgctcaagaattcatggcagggctatgcacggtggctcacgcctgtaatctcagcactttgggaggccgagatatgcagattgcttaagctcaggagttcaagaccagcctggacaacatggaaagaccctgtctccacaaaaagatgcaaaaaattagccaggtgtggtggtacacacctgcagtcccagctacttgggaggctaagctgggagactcacttgagcccaggaagttgaggcggcagtgagctgtgatcatgccactgcactctagcctgggtgatggagtaagactctgtctc

SEQ ID NO: 43460 - DNA, 373 bp, Homo sapiens
ggggaacttgcagagagaaaaaggccatgtggggacaccagagacagtggccatctgcaagacgaggagggaggctcaccagaccctggccctgcctgcaccatgaacttggactttcagtctccagactatgagaaaatatgattctgttgttgaagccacccaggcctttcccctgacataaatgcccacctggaaggaacctttacctatttctctggcgtgtgttatctatgaatatgttctaagacttattcataacacttcagttatttttaagcacctatgatgaaaaagacacagtactggacacagaggtgaattttctagcctgatggactaggaagaagtgacacttaagatgagccttgct

SEQ ID NO: 43461 - DNA, 756 bp, Homo sapiens
tgagagcccctgactgttttcttgcgctggcccagggcttctggaactacagtctggggtcaggtgaccctggcccagagtcagctgctccacaggggtatctggagcctggagcccaggccttgcctttgtcggggagcagccaggaaacgccctagggacggcagccgctcttggcctcggaggcacctggggagctgtcaggtggatttggggccctttcctccaaagctctgattcacttatgccaggaggagcccaggcatgcttgttccaaaggaacagctggggaccgggagcctgtttaggagcctggggcatccacacactcacctgggcctggctccgaaggtcgctgaaccctcatcacctggtttagggggctggaaccacctcgcctcatctgatgcttcacccaatgagctgggcagagagggcaggtgccccattggacccagcaggaccccagcatggaaagcggcagccccaactccagggcccggggccaggctgcagccccaggtgggctctcaggggcctgctactgcagcttagcccctgacgagatttgccgctgcccaccaacccactgcatccagactggactcttcaccctggttcctcttagtaacccaggactttatttgtttgccacctctgtatgctgcccacagtgttatttgcttactgtttttatttaaatagattttctgacaattcacttttttacttagccctgtctgtgaatttgccgtc

SEQ ID NO: 43462 - DNA, 434 bp, Homo sapiens
cgtggtggcgtgcacttgtaatccccgctatttgggaggctgaagtaggagaatcgcttgaacccaggaggcggaggttgcagtgcgctgagattgcaccattgcattccagtctgggcaacaagagcaaaactccgcctcaaaaaaaaaaacaatagaaatatgcattctctgtgttttggagtttgttaaagagatttccatattttgtaacagtgccccccttctcctgcccctgttatgataaattggctagtctctgtgaaggctggtgaggtttccacgaactagaatggtatgacttccttgggcttcaggtatggccactgcattggagtttgtttggtcagaccacttcctgagcccaggaactcaaggctctggcttgtttagggaggtggcagtggcagtatctccggaaatgactcttgaag

SEQ ID NO: 43463 - DNA, 599 bp, Homo sapiens
agctactcgggaggttgagacatgagaattgcttgaacctgggaggcgaaggttgcagtaagccaagatagtgccactgcactccagcctgggtgacagcaaggcgccatctcaaaaaaatgaaaacaatagaatacaattgtgggagactttaatacatcttgaaaattaaactggtttatcagttaaataggaataatgaattttaactgtaaaataaataagacttgattcattttcatagaaatgtatgtatttggccatcttttataataatggaaaaattaataaaaagagctatcattaaagcaaggcaaacaacaataacaaaaagagaaatggtgtccagatcctggtttctaaataccactctccactaaaaggaatttggagaaatggctgattctggggttgtgataggtaagacacagaatgagtatggtatcagaaacctagaaaatgttcaaaaaattaagagtgcccacttcaaaagcacctgtactaaaattggaacaatagagagatgattagcatggatgacacacgaattagtaaagcatttcatattcttgtaaactgtgtatgttttatcacagtaa

SEQ ID NO: 43464 - DNA, 573 bp, Homo sapiens
cttggctcacttggcaccttggctgagtacagcaggcaaaagcccataccaggcagcatgttgtggatggtttagttctccccgcctccctgtttcttggaaaagctacagggtccctgtagggcaaaattcccaggcgccttgctgcagacagagtaagacaaaaacaccaggaagcaggattccgtgcccatctctgcagtttgggttcacaaaagggggtgccgtcatccctgggtggaggagggagtgttggttttttgtttttgtttttttaacatgtatgaaactgacatcttctcaaatcttgttccacccccctctggaagcccccatcacccacccctgctatggacaccacacctatgccaggcccccccccccaccccagtctcattctggggtctgcccatgctgtgggaaagaatagggaggcctcccaaatatatgcaaattgtccccattccgtgggggcacctgacaatgacccgggtggagatggggcatggaggagtaggaagacccagccctatttgactggggagaggaggatctggagtccttcatgcccag

SEQ ID NO: 43465 - DNA, 231 bp, Homo sapiens
cttggctcacttggcaccttggctgagtacagcaggcaaaagcccataccaggcagcatgttgtggatggtttagttctccccgcctccctgtttcttggaaaagctacagggtccctgtagggcaaaattcccaggcgccttgctgcagacaaggtaggccgagagacaaggtagagccgagagacaagtagagccgagagacaagtagaccgatgctgctagaccgagg

SEQ ID NO: 43466 - DNA, 744 bp, Homo sapiens
acaaatgtttatttgcataatttgtccccctgatattttgctgctaaaatggaaatttagaagatctaccatggtggcagcctttcaacaggagtgagagagatgaggaaaggaaattatgggtaaatttccctcaatcaaaagcagggaatccaaagatcccccgccctaccccatcccaaatttaaatggttggcagctgcattggtaggagcttctgaagacatgtgaagcatagctgaagaggtctatggaataattaagtgctcttccttttgctgtaggcaaacagggctcattcccctttagggaacatagggatcactcactgctgctcttgagcatttagcaggattcttattgctatttacattctgacagctgaccagaaaggcagttatgtaaaatgaattttaaaataaaaaaagctttcttcccaaaacttgaatgtaagacagatacaatgggctttaaataaatacaggtaaatataatcaaacaaatacacaatacaatggcttgttggttagtgttttttaagctcttcatggttttaggcccagttataccacttttttttttttttaaatgataacatcaaaagtctaaatttagttcaaaaacaggctggccatgatggctcacacctgtaatcccagcactttgggaggctgaggcgggcggatcacataaggtcaggtgttcaagaacagcctggccaacatggcaaaaccccatctctac

SEQ ID NO: 43467 - DNA, 360 bp, Homo sapiens
taggtctcactatgttgcctggtctcaaacttctgggctcaagtgatcctcttgccttgcctcagccttccaaagtgctgggattacaggcatgagccacggtgcctgtttcacccctgccttttaagtaacagccacagttgctacaaacataggaaggcacagggcaggtgggtctcagtttcaccatctgtcacacaggaagcccagtttctccaccctcaatcctggggcctacaatccagcctccacatctcagcccaggtgaactttctcaaacctctagtgtccttgccctctcatcaaccttctatggctccgtactgccctttcctgtgttcccactgccaagttgcttcc

SEQ ID NO: 43468 - DNA, 379 bp, Homo sapiens
ctagaaaagaatctgagtttgatccacagggctgtgagaagccatcagagcttttgtcttattcatttaccatatgtctgtcaagtacccttcagtgagtctggtatgtgtcctgtggaaatattttttacctccaatttttattaaattatggacaaaaaaagtaagagagccagatgggaaagaagtagtgctttggccatgagtcaaggcatgctctgtgggcatgagtacagccttgctagtgtggaacttgtgttcaatgtagtttaaggccttaccataggagaaagcagggcctctagagacacagtgccccacccttccactcagttggccccaggaagggtggctactctgggaaggtgaaggtctgact

SEQ ID NO: 43469 - DNA, 482 bp, Homo sapiens
gggctggttgtgaactcctgacctcaggtgatccacctgccttggcctcccaaaatgctgggattacaggtgggcaccaccatgcccagccggattttggagtattttcataacacttactggtgagcatccctaatctgaaaatcctaaatctaaaatgctccaaaatttgaaactttttgagcaccagtatgatgccccaagtggaaaatcccacacctgatctcatgtgatgagtccaaactgttgtatgcacaaaattatttaaaatattgcataaaatgaccttcaggctatgaatagaaggtgtctatgaaacataagtgaatttcgtgtttagacttgggtcccatcctccacatatctcattttatatatatgcaagtattctcaaatccaaaaatatacaaagtctgaaacacttctggtcccaagcattatgaatgagggatactcaacccgtagtccttcttttaggggaa

SEQ ID NO: 43470 - DNA, 550 bp, Homo sapiens
tcctcagatgatcacacccactttgcttcactttcatgtccagagctgcttagactgatttctgcaaagtgcacaggcattttcatgctgaggataaaggaccatgatcgcttgtctggacccagaaaatatttcccatttgctacacagatgccgtctcatccttccagagttcaagacttcagcagaaaaaaaaatcacctcattaaaggaaaattgtgccttatccccactactcgaagatgcaaccatctgcctggtcacagccacttttttcctttttttctcactccatcgtatgtgtgtgtggtggggcaggggataaggggaataatctctctccagtataagaagggatcaagaagcaacaggactgcgggatgggatagaaaataattttcatcttagcaatattgagtattccagtacatgagtattgtatgtttctcaattcacttagatccttaatttcccttagtcatgttttgtgattttcagtatacaaatcttgtactctgtattaaaccattcttgcattgctgtaaagaaa

SEQ ID NO: 43471 - DNA, 634 bp, Homo sapiens
tcctcagatgatcacacccactttgcttcactttcatgtccagagctgcttagactgatttctgcaaagtgcacaggcattttcatgctgaggataaaggaccatgatcgcttgtctggacccagaaaatatttcccatttgctacacagatgccgtctcatccttccagagttcaagacttcagcagaaaaaaaaatcacctcattaaaggaaaattgtgccttatccccactactcgaagatgcaaccatctgcctggtcacagccacttttttcctttttttctcactccatcgtatgtgtgtgtggtggggcaggggataaggggaataatctctctccagtataagaagtgtgtggccctttacagggggtcccagagagccttctttctgctatgcgaggatacaagaggaattcaacaatctgcaatctggaagataaccctcccagaacccaatcatgctggcaccctgattttgaactttcagcctccagaactgtgagacatcaatgtattttgtttttgcagttttttatgaagttgaacatacacatatcctaagagccagttatttcgatcttctttatcaaagggaaataaaaacatatttcttcaaaaagacttgtata

SEQ ID NO: 43472 - DNA, 256 bp, Homo sapiens
ggagcagctgggaggagagaagggttgtggttttctgggaaactgctccgtcccctttcttccctggccctgtccaccagtgttagcctggagcaaggcctcacttgtctggggcacttgaagctgctacaggttgggagaagtggtaacagcttggagtcctcactcagggcagtgagcacagccagctcttcctgggcccttcccagcaaaaggagccactcccaaaacccctaggtaaccgtgagaggactcc

SEQ ID NO: 43473 - DNA, 2205 bp, Homo sapiens
gaattccggctcccgcggctgcaggcgcgcggctagagtgcctggcgggctccggcttccgcgtccgccccggccccggtccagacttagtcttcagctccgcgcccgctccgccgcggcccaccgcgcccgccggcagccgagcccccagcgacgcccgcacagctccgggtgcccagacagggggccatgccgtgccggagggaggaggaagaggaagccggcgaggaggcggagggggaggaagaggaggaggacagcttcctcctactgcagcagtcagtggcgctgggcagctcgggcgaggtggaccggctggtggcccagatcggcgagacgctgcagctggacgcggcgcagcacagcccggcctcgccgtgcgggcccccgggggcgccgctgcgggccccggggcccctggctgcggcggtgccggcggacaaggccaggtccccggcggtgccgctgctgctgccgcccgcgttggcggagactgtgggcccggcgccccctggggtcctgcgctgcgccctgggggaccgcggccgcgtgcggggccgcgctgcgccctactgcgtggccgagctcgccacaggccccagcgcgctgtccccactgccccctcaggccgaccttgatgggcctccgggagctggcaagcagggcatcccgcagccgctgtcgggtccgtgccggcgaggatggctccggggcgccgccgcctcccgccgcctgcagcagcgacgcgggtcccaaccagaaacccgcacaggcgacgacgacccgcaccggcttctgcagcagctagtgctctctggaaacctcatcaaggaggccgtgcgaaggcttcattcgcgacggctgcagttacgtgcaaagcttccccaacgcccgctcctgggacctctgtcggccccggtgcatgaacccccttcgcctcgcagccctcgcgcggcctgcagtgaccctggcgcctccgggagggcgcagctcagaactggcgacggcgttcttgtgcctggcagctaacacgcccggggtggccacagcgccagcctcagactggagggcaaggggttcccttgagggctgcagttctactcaggctggtggagaactctggcttttggaagcgagagtaaaaagctaatgacgaggaaccgaaaaatcgcgagtgtttcgcgggtaactggggttgagggccaaaatatttggaatgaaggacttggccctatttaaggcagattttacagagcgcacctcaaacgtacaagtcagtaggactccttatttggcgtgacccgacctggccgcggagcctgcatttcctcgcagcctctcagtgccctccagccccgcgaccatgtggccacaatccacgcttctccggatcgcggtgcgccggaaccacggaggatgatgccagttacttgctttaccttttcagggctggctcctgatccactttgggggaggagaacatgagtagataatttcagggtgcagcccaatctgccagacttaaaaaaaccatcttgtgtctttggaggtgctgcttaatatcaaacatgcggtgccatgaagggaccctttgggggttgaataggagttaacccctgcgctctctttgcaactgtctctcttctcagagtggtgggggaaggctgtacgacacgggtggggaaaggaggtgggggcggggagtattgaatggtggtggaagggtagagaggcgcggagtgaaccccacgccctgtctaaagtgtattttcagagccggcccgcctctcctcggttcaaggtcactgtttcctgggcacgcactgggttgcgggacagagtagccaggttctgccggtgctcggagaagagcgcagtgttttgcaagtgctggagtctcctgaggacacgcgcgtcgccgccaccgcgggtgtgggaaagcgcggacgtgctgggcggctgtgcttcgtcaatggcttgttcatcatccagatgtggctactgacatatctacacttcgcaccggagtgtctggaattgtggctatcctgattataggattttaacttaactgaaatgcctgctttgaataaatgtgttgggttttttgtttggttttattttatacttgccatcagtgaaaaagatgtacagaacacatttctctgatctccataaacatgaaaacacttgaaatctcaaaca

SEQ ID NO: 43474 - DNA, 2655 bp, Homo sapiens
gaattccggctcccgcggctgcaggcgcgcggctagagtgcctggcgggctccggcttccgcgtccgccccggccccggtccagacttagtcttcagctccgcgcccgctccgccgcggcccaccgcgcccgccggcagccgagcccccagcgacgcccgcacagctccgggtgcccagacagggggccatgccgtgccggagggaggaggaagaggaagccggcgaggaggcggagggggaggaagaggaggaggacagcttcctcctactgcagcagtcagtggcgctgggcagctcgggcgaggtggaccggctggtggcccagatcggcgagacgctgcagctggacgcggcgcagcacagcccggcctcgccgtgcgggcccccgggggcgccgctgcgggccccggggcccctggctgcggcggtgccggcggacaaggccaggtccccggcggtgccgctgctgctgccgcccgcgttggcggagactgtgggcccggcgccccctggggtcctgcgctgcgccctgggggaccgcggccgcgtgcggggccgcgctgcgccctactgcgtggccgagctcgccacaggccccagcgcgctgtccccactgccccctcaggccgaccttgatgggcctccgggagctggcaagcagggcatcccgcagccgctgtcgggtccgtgccggcgaggatggctccggggcgccgccgcctcccgccgcctgcagcagcgacgcgggtcccaaccagaaacccgcacaggcgacgacgacccgcaccggcttctgcagcagctagtgctctctggaaacctcatcaaggaggccgtgcgaaggcttcattcgcgacggctgcagttacgtgcaaagcttccccaacgcccgctcctgggacctctgtcggccccggtgcatgaacccccttcgcctcgcagccctcgcgcggcctgcagtgaccctggcgcctccgggagggcgcagctcagaactggcgacggcgttcttgtgcctggcagctaacacgcccggggtggccacagcgccagcctcagactggagggcaaggggttcccttgagggctgcagttctactcaggctggtggagaactctggcttttggaagcgagagtaaaaagctaatgacgaggaaccgaaaaatcgcgagtgtttcgcgggtaactggggttgagggccaaaatatttggaatgaaggacttggccctatttaaggcagattttacagagcgcacctcaaacgtacaagtcagtaggactccttatttggcgtgacccgacctggccgcggagcctgcatttcctcgcagcctctcagtgccctccagccccgcgaccatgtggccacaatccacgcttctccggatcgcggtgcgccggaaccacggaggatgatgccagttacttgctttaccttttcagggctggctcctgatccactttgggggaggagaacatgagtagataatttcagggtgcagcccaatctgccagacttaaaaaaaccatcttgtgtctttggaggtgctgcttaatatcaaacatgcggtgccatgaagggaccctttgggggttgaataggagttaacccctgcgctctctttgcaactgtctctcttctcagagtggtgggggaaggctgtacgacacgggtggggaaaggaggtgggggcggggagtattgaatggtggtggaagggtagagaggcgcggagtgaaccccacgccctgtctaaagtgtattttcagagccggcccgcctctcctcggttcaaggtcactgtttcctgggcacgcactgggttgcgggacagagtagccaggttctgccggtgctcggagaagagcgcagtgttttgcaagtgctggagtctcctgaggacacgcgcgtcgccgccaccgcgggtgtgggaaagcgcggacgtgctgggcggctgtgcttcggtaggcgaccaccgcccctggccgcgctccgggctttcacggaaactcccgagaccgggccctgggttcctcctctcctactcggctctgcagtcctactcaagcgggtggctctgggatcctgggggcctgggttgggggctagggagacgccatgtgatggacactccagggacacacagcctagcacagcagcttataatgggctctccggggccatttgcaataacagctgcaattccctggatagacgagttgatttcctccctctgcccctcccccagccatgccagctggcctttgtaagtgcaggaaaccgagtagaaaatgtgaccctccaaatggagaagctgccagctttgccattgtgaaccatggtgaagtgcttggaacatactgttcactcactctaaaggcgctgagactgtgctgttgttctcgtttttatagtcaatggcttgttcatcatccagatgtggctactgacatatctacacttcgcaccggagtgtctggaattgtggctatcctgattataggattttaacttaactgaaatgcctgctttgaataaatgtgttgggttttttgtttggttttattttatacttgccatcagtgaaaaagatgtacagaacacatttctctgatctccataaacatgaaaacacttgaaatctcaaaca

SEQ ID NO: 43475 - DNA, 1696 bp, Homo sapiens
gaattccggctcccgcggctgcaggcgcgcggctagagtgcctggcgggctccggcttccgcgtccgccccggccccggtccagacttagtcttcagctccgcgcccgctccgccgcggcccaccgcgcccgccggcagccgagcccccagcgacgcccgcacagctccgggtgcccagacagggggccatgccgtgccggagggaggaggaagaggaagccggcgaggaggcggagggggaggaagaggaggaggacagcttcctcctactgcagcagtcagtggcgctgggcagctcgggcgaggtggaccggctggtggcccagatcggcgagacgctgcagctggacgcggcgcagcacagcccggcctcgccgtgcgggcccccgggggcgccgctgcgggccccggggcccctggctgcggcggtgccggcggacaaggccaggtccccggcggtgccgctgctgctgccgcccgcgttggcggagactgtgggcccggcgccccctggggtcctgcgctgcgccctgggggaccgcggccgcgtgcggggccgcgctgcgccctactgcgtggccgagctcgccacaggccccagcgcgctgtccccactgccccctcaggccgaccttgatgggcctccgggagctggcaagcagggcatcccgcagccgctgtcgggtccgtgccggcgaggatggctccggggcgccgccgcctcccgccgcctgcagcagcgacgcgggtcccaaccagaaacccgcacaggcgacgacgacccgcaccggcttctgcagcagctagtgctctctggaaacctcatcaaggaggccgtgcgaaggcttcattcgcgacggctgcagttacgtgcaaagcttccccaacgcccgctcctgggacctctgtcggccccggtgcatgaacccccttcgcctcgcagccctcgcgcggcctgcagtgaccctggcgcctccgggagggcgcagctcagaactggcgacggcgttcttgtgcctggcagctaacacgcccggggtggccacagcgccagcctcagactggagggcaaggggttcccttgagggctgcagttctactcaggctggtggagaactctggcttttggaagcgagagtaaaaagctaatgacgaggaaccgaaaaatcgcgagtgtttcgcgggtaactggggttgagggccaaaatatttggaatgaaggacttggccctatttaaggcagattttacagagcgcacctcaaacgtacaagtcagtaggactccttatttggcgtgacccgacctggccgcggagcctgcatttcctcgcagcctctcagtgccctccagccccgcgaccatgtggccacaatccacgcttctccggatcgcggtgcgccggaaccacggaggatgatgccagttacttgctttaccttttcagggctggctcctgatccactttgggggaggagaacatgagtagataatttcagggtgcagcccaatctgccagacttaaaaaaaccatcttgtgtctttggaggtgctgcttaatatcaaacatgcggtgccatgaagggaccctttgggggttgaataggagttaacccctgcgctctctttgcaactgtctctcttctcagagtggtgggggaaggctgtacgacggtccgagttctgtccgagcata

SEQ ID NO: 43476 - DNA, 713 bp, Homo sapiens
ggatgactgaaacacatggtgtaggtatgaaagtgacaccttcattctctgttttgctgtgcacactcatgtcttgaattgaactgaatggatttgagacgtttctgatggtgtaatgtaagagttttggcaaagtcacttaatttccacatgcagtcatgcctagagatgtgctcattgggcttatgagaattagtctttataagacatttcatttaatatcctgacatgagcttacgaggtatcttaacatgctgacaaatttttattttgcttgccttgctaatggtgagcactacaagaggaaaaccagtatgtggtcatcgtcatagtatatagacaggatgcattacagtaaattctcctccctaaggaattttgctaataagtagcagttatattcttgtgcatcatattctctaaaatgcttttgttgaattttttggttttattgttcattgtttatgggttttcaataaagactgatttacattgcatatattctgtagtcattacattacattacatagatattttttgtccatgaccatagtcttacatgtaaggcacaagatagtcacaaaataatttaatgacaggtgataaatacagtcattgatgaaaggaaattgtcttcaaatgttgtgctgtcattgctcacatgagctattgtaataattgtggccattgtaatgagacttggtactgtttta

SEQ ID NO: 43477 - DNA, 1037 bp, Homo sapiens
ggcacgaggagggttctgccctagtgaaggttacaacttaggaggacataggtaattacaatatagtgcataaagtggtaatgtgacaattgaaactagattaatgtttcatttggattttcttacatagatttgtacatgtaagtttcttcaccatatatttattgtatgatgtaaagcaaattgaagtattgaacagcaggtctgaaataacacaaaagagctcatttacctgatcttttgtattgagtaatgagctatcacaattggcatgctgaaatgatgtgtctgtctttatgtgtagtgagccccatgttttggtagatggttttcaaagctgtccaccgtcagggcttctcatccctgtctgtgcatgctgctccacccatcagcagtctaggctgttttcctaatcctagattggactgacctggtgacttacactgactgatgggtagcctggaaggaactgcctgggacttctgggctcaggccttgtctggcagcattcactttctctgtctttggagctagccatcatagtaccctgctgaagagagaggccactgtatgaggcctgaagccatcttggatgtttcagctccactcaagctgaatgcacctgcgtgactgagctcgagacagaccagaagaaaacccacctagctgagttctagccaacccacagaatcatgaggaattttgctaataagtagcagttatattcttgtgcatcatattctctaaaatgcttttgttgaattttttggttttattgttcattgtttatgggttttcaataaagactgatttacattgcatatattctgtagtcattacattacattacatagatattttttgtccatgaccatagtcttacatgtaaggcacaagatagtcacaaaataatttaatgacaggtgataaatacagtcattgatgaaaggaaattgtcttcaaatgttgtgctgtcattgctcacatgagctattgtaataattgtggccattgtaatgagacttggtactgtttta

SEQ ID NO: 43478 - DNA, 981 bp, Homo sapiens
ggcacgaggagggttctgccctagtgaaggttacaacttaggaggacataggtaattacaatatagtgcataaagtggtaatgtgacaattgaaactagattaatgtttcatttggattttcttacatagatttgtacatgtaagtttcttcaccatatatttattgtatgatgtaaagcaaattgaagtattgaacagcaggtctgaaataacactgctgaaatgatgtgtctgtctttatgtgtagtgagccccatgttttggtagatggttttcaaagctgtccaccgtcagggcttctcatccctgtctgtgcatgctgctccacccatcagcagtctaggctgttttcctaatcctagattggactgacctggtgacttacactgactgatgggtagcctggaaggaactgcctgggacttctgggctcaggccttgtctggcagcattcactttctctgtctttggagctagccatcatagtaccctgctgaagagagaggccactgtatgaggcctgaagccatcttggatgtttcagctccactcaagctgaatgcacctgcgtgactgagctcgagacagaccagaagaaaacccacctagctgagttctagccaacccacagaatcatgaggaattttgctaataagtagcagttatattcttgtgcatcatattctctaaaatgcttttgttgaattttttggttttattgttcattgtttatgggttttcaataaagactgatttacattgcatatattctgtagtcattacattacattacatagatattttttgtccatgaccatagtcttacatgtaaggcacaagatagtcacaaaataatttaatgacaggtgataaatacagtcattgatgaaaggaaattgtcttcaaatgttgtgctgtcattgctcacatgagctattgtaataattgtggccattgtaatgagacttggtactgtttta

SEQ ID NO: 43479 - DNA, 425 bp, Homo sapiens
gacttataaacaacagagatttatttcccagagtcctggaggctggaagtgggagatcagagtgccagcatggtcgggctctggagacagtaagtgaggggtgcctcacttactcagcccacagctctcaaccccttgtgggtaggggtgcatgcaggtgagcatgttcaggagccggggcaagcgcttctgggcaccagcaggagcaaaactcagtgcgggcccatggcagcatctgggaggggattatctgtgacccccgaagccccagcgggtgtatgttactgtgggctctttcagctttgccttccgtggatgccttaagtgttcaacagctcactggccctctgtctttttgtgtgaggcagtagctctctgtcagggaggacagagggtcagtgtgacagccttagtgctcccgtggt

SEQ ID NO: 43480 - DNA, 390 bp, Homo sapiens
gcagacataatattactgttagcaatttgtagttatacaaacacagctgagaaacaaaacttttcccgtaaagtggaataaaaacaattacctacctcaaagaagtagtttacaaaatatatgagattactgtagcacctagctcctggtaaatgtttaataagtttcagttgctgataagattagcattatcaccaggatgtcatttctgagaacaggcatttgtgtctcttcattcactgtggtatcttttggcctacaacagtgcctggcacataacatagactcaggaaatagctgttggatagagcagtgctcccaccgagtgtgtggcctcagctaagttcctcaacctgcttctaccatgctttcttcatttgaaaatgagga

SEQ ID NO: 43481 - DNA, 392 bp, Homo sapiens
tataatagattcttgattggcctccttcccgttttccactgtttgatatatatattatgccccaccttccctcaacagtcagttctctttatttatgcatttatttatttttgagacagagtcttgctctgtcacccaggttagagtgcagtggcaccaacgtggctcactgcagcctcaacctcccaggatcaagtgattctccacctcagccttctaagtagctggaactacaggggctcgccaccacacccagctcatttttaagttttttgtagcaatggagtctcactatgttgctcaggctggtctcgaactcctggactcaagcaatccttcagtttcagcttcccaaattgctgggattaaaggtgtgaaccaccacgccccac

SEQ ID NO: 43482 - DNA, 909 bp, Homo sapiens
agaatatctactatagcaatttaaactaatcactggggaaagattcacatgtttattctacaaaaacccgttgaacaacctcatgtcaggcattaggaaaattctggtatgctaccagtgaaacaagatataatcccttttatcaaggaacatactagctctggtgaaaagaggataaacaacaaaaacacaaggaaggcagacaacagtttttatgtaattagtatcagctgtacagacctttataacaaatgcctcaggtttctagagcacttgggagtaaatggaactaagaaggtagacaaatcaatcaaaaaaggaaggaagacaaactatgacattaccaaattactgcattgataatccttccaaatagtcaaaaaaaattaatttatggcaaaaaaccaatttgaatattcatgaatttaatgtaaaagaacattttaaatctatcaaatcttaccaagtatacatttagaaaaaaactgaaagaagcaaaaacaagttgaatctatggacaagagatttggggaaatagccacaagcagggaaaatttgaaggagaaagaaaaataggcaagcaaaagggaaagaatagaagtaaagaaaaaaggagaagggtaccacttccaaatttcacatttgtatcccagaaactctgagttaaaccctgtattacaggaaaatatttcagatggttagattcaaaatgtttatcccttgcaagcaagccagccatttcaatatccaacataaaggcccagcatccagtatgttagtgttattttgaaaaaacacagcaacctctatgtagtcaggtctttggacttcatctgcctttatctagtctcaccccttctgcttttatttttctgagattgcttgaagagacttttcttttattttcct

SEQ ID NO: 43483 - DNA, 422 bp, Homo sapiens
gctgagactacaggtgtgcactacaatgctcagataatttttcattttttttttatagacacggggtctcgctctgttgcccaggctagtctaaagctcctgagctcaagtgatccacccacctcggcctcccaaagtgctagcattataggtgtgacccactgcactcagcttgttttgtatattacaacattttgagcacttcctttgggccacaggctgagctgcaagggggaggggagggtgccacctcccctttgcctgggtctcagagcccagcagcctggaggaggaggatggctcctgagggcggggtccaggctccccagcactgagacctgatcctgtcttccccgggatccccagagtgttctgagtctggggccttgctgggccgtgagccccctggtcgctatgtggcg

SEQ ID NO: 43484 - DNA, 455 bp, Homo sapiens
ggaaaggcgggcaaagctgtggggagcggtggagtggaaggaacaaaggaggtcagtactgggaacgctgaaggtgggaggccatttcataacattacttgttgatgaaattgccatggataccttctttgcccatcagcaggcctagcgtcttggcagtcatggtgacaatgacgttgaaggtgggggctccaccgatgctcttcatacaaagatccgtggtcaattccccatcctgcagcagtgagtccaggaccacagtatatttctggccccccagtgtcagcccattcatgacaaagcttgaccagtctttgccaaccaggacaccaacctcagctggcgtgatgttgaggaaggttttccctgggacggtggcacagatggaaggtgggtccttgttgcccacaatggccgtgtcctaacaggtcccgtccgccacgaggctgtagatg

SEQ ID NO: 43485 - DNA, 404 bp, Homo sapiens
ggattacaggcatgagccaccatccctggcccctttttttttttaattgaaaagaaaaataggactcaattggtattttataagtgaagagcttattacagtggtaaatatttaggggttatatatttaaatccacaagtaatcatatattgaatagaatgaccaatattgtctttttatgatgaaataatgatctttacatacagaacagtaagccttatatcaggcatttgatataatttgtttctaaatagacctatacttaatattcactaacaggtggttcatgattaacgtgtttgcttttacctcctatgcgaatgaataaatgtgttaaggtatgttagagtatatttgagttttacctgggattttaacgtagaatagatttgatactctatgta

SEQ ID NO: 43486 - DNA, 616 bp, Homo sapiens
aagtaaatatagttcaaaattgaaaacttcaattctaaggcttttaccaaaactgacctcattaatttttagttatacatcaaaaatttttatacccataaagaccaacacatcttaaccccaatgaagttctaaatgatgtgagccccttttacgttaacgcatttttgaaagatgaggctttatcaatactaagtatattcagaggaatgtgtacatgctgtttcataatgcaaattttaaaaataactttaaacaatggaaatactgtaacaacaaatgtacagttttccaaagtgactgcataaaaagaaaaaagtactcagatgaaaagatacaattatttactttaaaaatcaggtggatcactttacaattgctggtgctttaggattttttccctaaaaacttaaaaatttagactacattgttatgtagcaaaaacaatcaacgaagaggtaggattaattattatttaaatcaatggcaatctgtttaaaactttttggctctgaagacaacaagtacctttatttataaataattcaccagcctcattgaccaatcctaggtaagtcttcttcaatcaacacagagctaaaataagttggatctg

SEQ ID NO: 43487 - DNA, 342 bp, Homo sapiens
ccaaagtcgctgtgacattgttgggtatcttttcagcaataccccactcccggtaccaatttactatattagtctgtttttatgccactgatacagacatacccaagactgggaagaaaaggagctttaatttgactgacagttccacaggctgaggaagtctcgtaattatggcggagggcgaaaggcacttcttccatggtggcagcaagagaaaatgaggaggaagcaaaagcagaaaccctgataaacccattagatctcatgagacttattcactatcaccagaatagcacaggaaagaccggccaccatgattcaggtacttcccctgggtccctc

SEQ ID NO: 43488 - DNA, 1174 bp, Homo sapiens
ccgagatcatgccactgcactccagcctgggcaacagagcgagactgtgtcaaaaaaaaaaaaaagagaagaaaaacaatttttaaaaccacagctgtttttaaaatatgaattttaaaatagtacaatgtaactactatttacaaagctttgacatggtattaggtagtgtaggtaatctagaggtgatctaggttatatgcaaatactatgccattttatataaaggacttgagcacacacacattttgacaatgtgggtcctggacccaaacccctgaggatgcggagggactgactattttacttcttacagcctgggtaaggttcaacatgtggtatatcatttgaaaggtgtagaaacagccattaagagtttaagtgaccttcctaaggcctgtggtctttccactagacctcaaaactcataccattacattctcgttaatgtaatttgcaaaaaaaaaaaaaaaaaaagattaaatctactcagaaaatgaactgttttgaaaatttggtgcaaaatcacctgggttccttaaatatattatacctctaaaagcctatgggaaagccaacttaaacacactctggatgtggtgtcaaacagcagtatatgggttctcacacaccactataacttgtcctcttcaccttaatcactcgggcttaaaagctttggggacaaagacaggaaacctactctggggaactcttacgtgggaaaccttacgatttatcccattgtggacttaacattaattctcatatacggaacagaatttaaacggtccttttaaacgggacagacgtggcggcaactggcacacgaagtgaccttggccttctaccacctatcctttttagagaaggaacttacaggtacacgcactacattacttcgccaccaacaattttattcgcaacttgctctttttcgtcccacacacagtaaacaccttctacatgcggggaaaaacccccagagtttcacctttgggaaaccacggaatcgtaagaaacatctctccgtggtccaggtcaagacaattcccctgggtagaggaaaatactgtcggggaatacagtggacaaagggtctttcctcggacgcaactgatggcttctcgtgtgggcagacgacgagacctcctatcgcgttctaaacatcata

SEQ ID NO: 43489 - DNA, 472 bp, Homo sapiens
tcagccctgtagcccacatgacactgggcctcacccaaagccatgaatgaattttataagccagtttcttttcattgaaaataattgggggcagcatgccttgggctgacttgaagagcaagatacatcttcatgtactccttaagcagacaagctctcattgaagcaaagcctacccctaattgctcatacttggaaaagaaagaacatttttcaagggataggttctaggtagaaactttgttaagtgctgtctcactaaatcttcatatcttccatgtttctccctggtcacaccagcttgggagaaaactggactacaattaaaaacaaaactcttttttctagctgtattcagatgccttaagtggaaaatctagccccttaaaatgcctcttaaaacgatcttggagttctcctgggaggcagagattgcagtgagctgagatcgtgccattgcactccagcctgg

SEQ ID NO: 43490 - DNA, 841 bp, Homo sapiens
cgtgcaattagatcttcttgactaagaaaaaatgcagacaagcaattactccgttactttaattactctcctaattataacgataaccttgtcacattatcataattccccaaacagaaaaacgcatgctccaaattgcaccaatatttgataattttaccttgttaacggctcactgtcagtatgtagagcactacattttttccccattacctttctattgcacagtctatatttctttgcctcagaaaatgataatacattctgtacaacatgtttgtgttgcacaaccccgtgatttgaatatggctttttaacgtctcgcagtttcagaagctatctcctgagcagtgtgtaattctctcctggctgtttgatggtaatgggagctgtacatgtatctggagagaggagaaccagcctggggactcaagatatattaaagactatgctcatggacatcaattctttcctgtcctttagggcagtattcaggccacacggttcaataacgggaaagaatgtcgtcacatgattgcatcatgttcttcaaaatgaaatctattgaacagtataaacaacaaagaacatcatttgtcagaatgacctgggggaaatagtccagtgaaactaagcaaagggaactttataccgtgagggaaaatcaatggattgtaacagaaccctgcaagaagagacatagctttcaagttccagagacctagaggtgactgagaagcaggatgtaccagaaactgggcttcttgttctacttatctagcgcccttttcacagtgttgtatatgtaaataaataataaagcagtgtgatttttaaaaaa

SEQ ID NO: 43491 - DNA, 785 bp, Homo sapiens
cgtgcaattagatcttcttgactaagaaaaaatgcagacaagcaattactccgttactttaattactctcctaattataacgataaccttgtcacattatcataattccccaaacagaaaaacgcatgctccaaattgcaccaatatttgataattttaccttgttaacggctcactgtcagtatgtagagcactacattttttccccattacctttctattgcacagtctatatttctttgcctcagaaaatgataatacattctgtacaacatgtttgtgttgcacaaccccgtgatttgaatatggctttttaacgtctcgcagtttcagaagctatctcctgagcagtgtgtaattctctcctggctgtttgatggtaatgggagctgtacatgtatctggagagaggagaaccagcctggggggcagtattcaggccacacggttcaataacgggaaagaatgtcgtcacatgattgcatcatgttcttcaaaatgaaatctattgaacagtataaacaacaaagaacatcatttgtcagaatgacctgggggaaatagtccagtgaaactaagcaaagggaactttataccgtgagggaaaatcaatggattgtaacagaaccctgcaagaagagacatagctttcaagttccagagacctagaggtgactgagaagcaggatgtaccagaaactgggcttcttgttctacttatctagcgcccttttcacagtgttgtatatgtaaataaataataaagcagtgtgatttttaaaaaa

SEQ ID NO: 43492 - DNA, 442 bp, Homo sapiens
gctagtggcttcctaaacgtttagtgttctaatcaaataaacttgtatttaaatacattaacacagaccaatacacgcacatagaagcacatgtgtacacatagataggtgcacatgcatgtgtacacatacatcactgtcatagctcttcatgcagaatactttgctattcagccccatcaacacatactttttgaaaatatgctcagcagaggggtacaagcatacagaggactcagaccccagtctcaacttcttcacagtctgatggggacagacttgggagcagagatgctatgatgggggaggctgtgtacattgcagcctgaaaacagagtagaagaggggccctttctccttcgggcccctgggaagactccaggaggtgatggatgaactttgagctggtcattggtgaaagaacatggattagctgagcaga

SEQ ID NO: 43493 - DNA, 373 bp, Homo sapiens
gattttgaaggttagaggaaaggcatcttcaaagttcgtaagaaatttggtacataagctggtattgttgctgactatgaaaaatacagttcttaatatttagttcatcagtattttatttataaattgtgctatacacgccccataaagatttatcataatttttattgctctaaacttttagagattaaaaagtttaatttttagagagtaaagatttagcatcatttttattactctaaactgcctgtaatctcagctacttgggaagctgaggcaagggaattacttgaaccagggaggtggaggttgcagtcagccgagatcgtgccactgcattccagcctgggtgacagagggagactttgtctca

SEQ ID NO: 43494 - DNA, 1317 bp, Homo sapiens
attgttaggttttggtataaggtcataaaatcctgtgcatatgggatttctgaccatttgccctgcctcttgcaaaataggtctaatggcaggatggtgtcataattaaggctaccaagactgcccattgttccaggctgggcagttcataatgggggcagacaatagtgcaaaaaaaattttacattttatctttagagtgtcagggtcaaattgatttccatggttgaggatgtagccaagtgtggaatcaggtggaataggtggagagttgcccatagtggtttggaaaagagaagaggactttgaaaagtggagggctcattaggtgacccaaattttacctggggcatcccccctttagggccccaacttagtctgtcagacatctctgaccttagatgggtgctggcaccactttggaatggttccctccatcactgaggacctgacttaaagtttttctatctcacttaaaacaaccctttaacgctctcaacttaggcaataataaattccttttcatgaattccctccaccaccatgcaccacacagaccacatgcccggaccctctgacttgtgtaaccttttgtgcatagctaggtgggttttctgtcctttgccagttgggtgggagaagggaagaatttagcataaataaaagcagcataagtcacctgaaacctgtgagtttgccctggacgagctgctgctgctaactgcatcacacatagggatcagggattataactgaaaaggacagaaatgagtcttttccctttctgggcagggcagccatccctgttcactccttggccttcagaggataccagagagtggccccagtcagttcccctcaattaccaacgagctactaggaaacggccgctgaaagactgaaaaaggagaaaaggaaaataactcagaaaaaaaaaaaaaggaataggactcagaaaaacaaaaacgaggaaaaggactcaggttcctcaccttaaccaagcggtggcagttaggcacttccacacggaaaccttccagtttcaccagagaatggccctggccagaaacttgcaagtgtctttgtgcttaggtgctgtccactgagggtcctcagttggaaaggaaaagatggagagaggaagatttccctgtatgtaaaaggggaaaggagaaaaagaaatcccaaactttgggcctaccttctctcctggctagctcaccagaatatgttaccagtagagggtcttgactgcaagttgtttaggttcttggcattttgaacaaagacttggaagaaacacccagcaaagcaatg

SEQ ID NO: 43495 - DNA, 1347 bp, Homo sapiens
  misc_feature (950)..(950): n is a, c, g, or t
  misc_feature (961)..(961): n is a, c, g, or t
attgttaggttttggtataaggtcataaaatcctgtgcatatgggatttctgaccatttgccctgcctcttgcaaaataggtctaatggcaggatggtgtcataattaaggctaccaagactgcccattgttccaggctgggcagttcataatgggggcagacaatagtgcaaaaaaaattttacattttatctttagagtgtcagggtcaaattgatttccatggttgaggatgtagccaagtgtggaatcaggtggaataggtggagagttgcccatagtggtttggaaaagagaagaggactttgaaaagtggagggctcattaggtgacccaaattttacctggggcatcccccctttagggccccaacttagtctgtcagacatctctgaccttagatgggtgctggcaccactttggaatggttccctccatcactgaggacctgacttaaagtttttctatctcacttaaaacaaccctttaacgctctcaacttaggcaataataaattccttttcatgaattccctccaccaccatgcaccacacagaccacatgcccggaccctctgacttgtgtaaccttttgtgcatagctaggtgggttttctgtcctttgccagttgggtgggagaagggaagaatttagcataaataaaagcagcataagtcacctgaaacctgtgagtttgccctggacgagctgctgctgctaactgcatcacacatagggatcagggattataactgaaaaggacagaaatgagtcttttccctttctgggcagggcagccatccctgttcactccttggccttcagaggataccagagagtggccccagtcagttcccctcaattaccaacgagctactaggaaacggccgctgaaagactgaaaaaggagaaaaggaaaataactcagaaaaaaaaaaaaaggaattttntaagggggggnaccccttttcccccaaggactcagaaaaacaaaaacgaggaaaaggactcaggttcctcaccttaaccaagcggtggcagttaggcacttccacacggaaaccttccagtttcaccagagaatggccctggccagaaacttgcaagtgtctttgtgcttaggtgctgtccactgagggtcctcagttggaaaggaaaagatggagagaggaagatttccctgtatgtaaaaggggaaaggagaaaaagaaatcccaaactttgggcctaccttctctcctggctagctcaccagaatatgttaccagtagagggtcttgactgcaagttgtttaggttcttggcattttgaacaaagacttggaagaaacacccagcaaagcaatg

SEQ ID NO: 43496 - DNA, 642 bp, Homo sapiens
atgcatttaaagacttcaattaaaagataacaatgcatttttctcagcatattatttcttttaagaagcctctagaatactcaataggttccctgaaacagaaaaaaaacaaaaacaaaaacaaacaaacaaaaaaacgcaaccctggatattataatgcattgtgaatatccttttcaacccactaccaaaagctactatgaatgtaaatttctgtttagcctaaatgcataccaagttctatattgatggaatccaaatgaatgagattttattatagatgaaatataaatactggattatctgacaccacacacacaaaatcaactcaaaatagattgaaatgtaagagccaagactgtaaaactcctagaagaaaacaccgaggaaaggcttcttgacattggtctcagcaatgatgtcatggatatgacaccaaaagcacaggcaacaaaaagaaaaataaacaagtgggactgcatcagactaatacacttctgcacagcaaagaaatcaatcaacagagtaaaaaggcaacttatagaatgggagaaaatatttgcaaaccatatgcctgataagaggttaatctccaaaatatataagcaactcctacaactgaatagttaaaaaaaaaaacct

SEQ ID NO: 43497 - DNA, 369 bp, Homo sapiens
atcactttattaaatcactcgttcattaaatattttagtgcctacctaatgtgctaggtgttgttctaggtattagagatgtgtcagcgagcagtgaacaaaataaataaaaattcccgctctcattctagcctgagagcagatcagggcacctgttcaactgtagggatggccagctgccagtgcaggaggaggcgggcagaggtcagctgctacctccgtaacatgcagctcctctgatatctctgtcccctcatctctaagggaatacttccagggcctgccagaaaacatacagagtacagctcaacttggagattgctggtataatctttacttttttttccagaactacctaataattcattg

SEQ ID NO: 43498 - DNA, 254 bp, Homo sapiens
gagccaggcctgtgctgtgagctgcctgggccccacggagcagctaggccccaagggaggccccagagcacagcagccaggggtcagggggaggcaggcagcagcctaggcctggtggggggtgggaggctctgaagagccctgagggggttcaatagaaacatgggtctacactgtgccctgggaagggagccccagactgagcacaggtctggacgctacagaccctcctttcccagcccttctctggcccc

SEQ ID NO: 43499 - DNA, 448 bp, Homo sapiens
attcaactttctacctgtcaaaagaatgtgttcatcctggccaggcgcggtggctcatgactgtaatcccagcactttgggagactgaggtgggcagatcacttgaggtcaggagttcaagaccagcctggccaacatggtgaaacctccatctctactgaaaaaatacaaaaagcagctaggcgtggtggtgcacaactgtaatcccacctacttgggaagctgaggcaggagaatcacttgaactcaggaggcagaggttgcagtgagaggagatactgggcaaacttggtgatgaattggccacagggtaagtgtcagagggcaaagggtgaatgccttatgactttcttgggcagttagaatcttgggccagctttctctgagagcactttcactgtaatgcttgcagtgtacttctcctttgccattggactgagtgttcctc

SEQ ID NO: 43500 - DNA, 418 bp, Homo sapiens
attgctcagaagtcctaaatgttaaacattgatgattactatatatgaacatcataacagtagccacaaccaagaagagaacaactccaagatgctaagaagcacagtgaaggttatttgcttatgaaaagcataattttagcttgcaatgctatttgttcacatactttagttgtctggctgccatttaaacatatagattagctaaggagatttatgacagcagcctatccagtattaactttcagcattttatctggtacccaaataatatttaattataataacctggctgagattacatgcataactttgatatctcagcacacccagttctgctcctgggactatggtacacaagcagtatcacccttaggtctaagaaagaggggaccctgccacaaaccctatgtttcag

SEQ ID NO: 43501 - DNA, 612 bp, Homo sapiens
ttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacgaccagcgctgcaaaacccgaaaccgttacatctgccagtttgcccaggagcacatctcccggtggggcccagggtcctgaggcctgaccacatggctccctcgcctgccctgggagcaccggctctgcttacctgtctgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcgaaggagaggacaccgccagtggtccaaaaaggctgctctcttccacctggcccagaccctgtggggcagcggagcttccctgtggcatgaaccccacggggtattaaattatgaatcagctgaa

SEQ ID NO: 43502 - DNA, 652 bp, Homo sapiens
ttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacgaccagcgctgcaaaacccgaaaccgttacatctgccagtttgcccaggagcacatctcccggtggggcccagggtcctgaggcctgaccacatggctccctcgcctgccctgggagcaccggctctgcttacctgtctgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcgaaggagaggacaccgccagtggtccaaaaaggctgctctcttccacctggcccagaccctgtggggcagcggagcttccctgtggcatgaaccccacggggtattaaattatgaatcagctgaaaaaaaaaaaagtcgacgcggccgcgaatttagtagtagta

SEQ ID NO: 43503 - DNA, 491 bp, Homo sapiens
agaccgagtgcaacagggctgccatcttgggactgcctgggctgccatcgagccctgctctcttctgcttccttccagcccaggagcacatctcccggtggggcccagggtcctgaggcctgaccacatggctccctcgcctgccctgggagcaccggctctgcttacctgtctgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcgaaggagaggacaccgccagtggtccaaaaaggctgctctcttccacctggcccagaccctgtggggcagcggagcttccctgtggcatgaaccccacggggtattaaattatgaatcagctgaa

SEQ ID NO: 43504 - DNA, 460 bp, Homo sapiens
tcacctgctgtcgctagtttatatgactttacatttaccactcctgccaagagaaaggaagctttgtgattgtgccccgtcatagttaattgtacaaatcaattaaaaatggtatgtaagcatctggctcacacagcagctctgaattctgaatgaaaagataacccatgctaatgtatatgttgcatgaacaagtagatgggtgttggaaagaaaacactgatagtcactctgggtgaagggggaggcctggccaatgatttgtatctgagaaacattttgagattatttatatgtcttctgactgccctttgctttgtagctacagcaacttgcagaacctggcattattgcagagatgaaggtatagttgtataaagaatattggattaaagttgatgaggcctgtgttctgatatcaaatcttccactaatgagctctaaaatgaatatcaagtca

SEQ ID NO: 43505 - DNA, 195 bp, Homo sapiens
gataaatttaataaaactctaaaatgttaacccaaagatctctaaaaatatttgaagtgatttacaagatatgatagataataataacacagtagagactaaagaaaagaaaattgagtagcatagaaaacctggataagcacatcactgaggttgggtattaaattggtttgagagcttttgaataactaggtg

SEQ ID NO: 43506 - DNA, 445 bp, Homo sapiens
agcctggctgacatggtgaaactctgtctctaccaaaagactttaaaaattaggtgggggtggtggtgtgtgcctgtgttgtccccgctactccggaggctgaggcgggtggctcacttgagcccaggaagttgaggctgcagtgagccatgatcgcaccacggcactccagcctgggtgacagggagagatcctatctgaaaagaaaaaaaaaagaaaagaaaagaagacaggtcttcctgggagcacctagacaaaggcctttgtaaagatatattacaaaggaatatttctagttgcctcttttcttcaaaatcacagtcaagtaagctgggcatggtggctcacatctgtaatcccagcagtttgggaggccgaggtgggcagatcacctgaggttaggagtttgagaccagcctgcccaacatggtgaaaccccatctct

SEQ ID NO: 43507 - DNA, 378 bp, Homo sapiens
aaaatcccaagcagaaaattcagtcattcaagagaaaagtcattaaagaaaaaggaaaaaatagagaacagaaaagcagacatttagtttttccttaggcgtgacaaagcttaacaaacagtcagttctgcagaaatgctcccagttttcctggtgtcccaagccctcgctctgtttggagactaccacagcctctgtacttctcagctttgtgggtctgggaggcacttttgcttcggaattggggtgaaggctttctaggtcctgattaacagaatctgaactgctcccacctgtcttccctgcagtcctccacccagcagccagggggaattgctttaaaactccaagcctccaagcagatcatgtcgtctcttg

SEQ ID NO: 43508 - DNA, 1102 bp, Homo sapiens
aaatggtaaaagctaaaaagctatgttttctaattattgagattgccacgggtgtcaataagatgtaattaaagatacaggccaataatcacatagcaagaaaataggtccaaaatcaaataaaactggaaataattatgttttttcattagtgaagaaattgtatagtacattaagatatgtattgctaaacaaagccggaaataaaatataaaccttaaaaattgttatccatttcttctcctcccacctcactttaaaagaaggaggattttttaaagatgaacttccgaagagactccaaattactgactttatagtaatttctttaaaaatgagtataaatacaaagcaaattttggtgatggtggtgaaagtgtgaggttagagagaagagagtccaagcaattttaaagaaatataaggaaataaaacactcagatcctaaaattacaatctattcctcctttgatagatgcttaaaactgttctctttacctcttgaggtataatattgatatttaagaaactatgtactcttaagaagtagttgagtgctatggtaatctgcatcatgaggacctaccacagcaagtcctgaaagctggaaggaggcaaaggcttccccagcctccaactatagagagaggggtcaggtgggcagccagcattaagtaccacttctctggaggtgctgcaccccctacccccctgttcaggggcatttttagcacttacagcctccctcctgagacaggagagaaaggagaaggtggttctaacagtcctcaccattctgtggaaacaatctccagagaagcacatagctccttctagaccacgaggaatattcctgtgaagaagccagaaacggtttttaggcaatacagccttgggggctgcatcttcacttagtgtctttgtctacacccctccacaaacacaaggaaagaaagcaagtcaggccgctcttcagagccttgtccttaactcaccttcagtgaactcactttctaaagatggagtcgagccctacatgatttctaacaaaggacgcatttagggttgccagctacccaggtttagcctgggccgtctggga

SEQ ID NO: 43509 - DNA, 272 bp, Homo sapiens
gatttttgtatttttagtagagacggggtttcaccttgttggtcaggagttcaagaccatttagtaactccattttacagacgaggaaatgaaacccagcaatgataaaagaccaggtgaaaggtcacccagctagtaagtggcagaggcaagaggtgaactgaagcctgtctcactacggagcccgtattctcatgcgctgtgtgtagtgcattccagactgcattcatcttggtatccctacaacacctaaaaaatcagcattatattat

SEQ ID NO: 43510 - DNA, 969 bp, Homo sapiens
gtgcaacaagaaatcatctgaaggagtaaaacttactggcaaaagtaaatacacagacaaattgagaatattttaacactgtagttctggtgtgtgaacccctcatatctttagtgtgagcactaaaatacaaatctgtcaagaatgatgactgaatagctttttaggagatatataaaaagatataaagtgagacaacgaaaagaaaaggagtgatgagttatagtgtagagatttttagtttattctttgcttatttcttttcattgtgatcaaagtcaagttgtcatcagtttaaaataacttgctgtaactgtaagatactttttatgtctcatggcaaccataatgcaaaaatttatagtagagatactaaaaacaaaaagcaaaggattaaatcatactaccagagaaaatcacttatccacaaaaaagggagtaagaaaattagagaagacttagaaaacaaataacaaaatggaagtagtaagtccctaactataaatataagatttaatgtaaatggatgaaattcttcaactaaaagacatagagtagttgaatggattgaaaaaaaaaaagacccaactatatgctgcctacaagaaaactcactacacctataaagatgtacagactgagagtgaagggatagaaaaagatatgccatgcaaatgaaaaccaaaatggaacaggtctagctatatttatatcaggtaaaataattatttttaaataatgcagtttttcaagttaaaaactaaaaaagagaaagtaattatataatgaaaaaagtcaatttagaaagatgtaacaattgtaaatatatatgaccccaacattagggcacgcacaaacacataaagcaaatattagtagatcaaaaggatagacttcaatacagtaataccagagaacttcaacacctcatcttcagcaatgggcagatcattcagagaatacattaac

SEQ ID NO: 43511 - DNA, 548 bp, Homo sapiens
gtgcaacaagaaatcatctgaaggagtaaaacttactggcaaaagtaaatacacagacaaattgagaatattttaacactgtagttctggtgtgtgaacccctcatatctttagtgtgagcactaaaatacaaatctgtcaagaatgatgactgaatagctttttaggagatatataaaaagatataaagtgagacaacgaaaagaaaaggagtgatgagttatagtgtagagatttttagtttattctttgcttatttcttttcattgtgatcaaagtcaagttgtcatcagtttaaaataacttgctgtaactgtaagatactttttatgtctcatggcaaccataatgcaaaaatttatagtagagaaatttaacaaagagattgaaataattaccaaaaaaaaaaaaaaaaatcaaacagaaatcctagtgctgaaaaagacaatggatgaactgaaaaatacatcagaatataacaacagcataattgactaagcagaagaatttgttagcttaaatacaggctattgaaaatacagaggaga

SEQ ID NO: 43512 - DNA, 586 bp, Homo sapiens
ttaggggatatgaggtatgatacctgcaaccaaaataagctggctgttaagtgctctctccttaactattgtccaagcaatgtacatcactcttgcctagatgagtgaccatacttttttctttgctgcttggtttttctatcactaaaaagcaaatttaggtggaagatggatgggtaagtcctttgtccttgtcaaaagaatttagaaagggtaaaggtggtgggatttgaattcttttaaacggtttattcattggaaaggcaagtgagtggcagttgactgtagaatcttgggaatttttgaaggaatttaagagctgtacttattttaaataatgaggaaacaatcagagagacttaaccagggtggcaactatggaagagtgggggtagaatccaagtctacagttctacggcactgctttgtttattttttcaatcaagcacacatgagggattgcttaataaattcaagagttttctatatagtttgggattactacagacacaggtactctagccatgtgactatttcagattagtgttcccattgctctccatcctatttttcatatctaaatgtg

SEQ ID NO: 43513 - DNA, 268 bp, Homo sapiens
atgcatggaaacaaggggaaatgttgaacccagctgggacaggcagtgtcagagggctgttaggagagctggatccagcatggatgcatagcagagaggccagatgaagaaatttctggtcgaggggtccaggatgtatggagtaaatacctgggcctaaccagtggggaaaggattggcctaggacccaggggatgaaattagaggctacctgacttattaaatgctgggaagcaatgattaataaataaaagtttacttgaactgt

SEQ ID NO: 43514 - DNA, 365 bp, Homo sapiens
ggtgtaaatctaggcagtctttaacaaaattggtgcttcatgtgtttaagaggcataacttaagaattgtttgtttcttataaatcaggagaatggaggtttaatagaggtgaactgtctttctcactgcagaacctttaatatgccactatgcattgtaaatctcccaagagtgagattctagtatgatgcttttcttttccttttctgttctttccctttccctctacctcctttttcttttctttgttggtggcatgagtcctatattataaggaaatgcttttagagtacagtcttctgatatatagtgatttttgaaaaagatttatttattgtcttgttcactgtgagctttttccccc

SEQ ID NO: 43515 - DNA, 425 bp, Homo sapiens
tggtgaatgaaaataactagtatttcaatatgtctctactgtaatacaatatgaaaatatctgtgatttctattggtgacaaagtcacaagcactactaatactatcgtgggttttcttaccaatatgcatgatgaaagaaaatactgaatttcagttagaggtaatgcataccaaggatgtgatttttcccacgtaaattcatgaaccttctacactctatccagaggctccttgggctccatggactctatgtgaacatcctctcatgtctctgttctagctcctactttaatgctttttccttcattatatgcattgtgttccttcattctgttctcctgcagacacttattacagagctatgatgtgccaggcaatacccatcctgtatgtcatgtagtccttgaaaacttcctttgaggt

SEQ ID NO: 43516 - DNA, 418 bp, Homo sapiens
ttccttaaattttaaggtggaaggagatacagtcaccttctcctttgaaatgagaagtggccgtgaacacaacactcctgataaagccatgtggggtctttgcttgcacagttcgcgctcaggtacttgaatctaaccactgccgtggacaaaatgtactatctgctatgtgccttgattacatacagcatatttgccttggaaacagggcagaatatgagtcactctttcatctttctcttctagttggcactagtcaactactagcagttagtagtacttttacagaataaaactagccatgacctaaaatcaactcagcagcacagaaataaatctattgattggagctccctcttcaaagtttggggaggtgacctgaccccagcatctttccacagagcaaagaccccaaaag

SEQ ID NO: 43517 - DNA, 399 bp, Homo sapiens
ctgtgtcccctagcagtgatactcgatgctgctctgtagaaccctgtggttggggacagtgcagtgtggggcagcacaggtagcagcctctgccagtgtacactgaccagtgtggtttacccctgtctgcattgtaggagtcttcggaggatgtctcaggaggcttgccctttctggtagacctggctttaggtctgtctgtgttagcttgttccatgttaagaatcctgtacaatggaccagaaattaccaaagaagaagaagcctgtcaggagctattgcggtccaaacttttacaaaggtgccagtggcaggtggaggccaatggcgtgatctcccctgcccttactccgagcccctctccactgcctctgaccatagaggaagacagagaattca

SEQ ID NO: 43518 - DNA, 384 bp, Homo sapiens
ttccttaaattttaaggtggaaggagatacagtcaccttctcctttgaaatgagaagtggccgtgaacacaacactcctgataaagccatgtggggtctttgcttgcacagttcgcgctcaggagtcttcggaggatgtctcaggaggcttgccctttctggtagacctggctttaggtctgtctgtgttagcttgttccatgttaagaatcctgtacaatggaccagaaattaccaaagaagaagaagcctgtcaggagctattgcggtccaaacttttacaaaggtgccagtggcaggtggaggccaatggcgtgatctcccctgcccttactccgagcccctctccactgcctctgaccatagaggaagacagagaattca

SEQ ID NO: 43519 - DNA, 482 bp, Homo sapiens
ccttagataaatacttttctttttccactcttattcatgagccagatctttgtcttagagagcccataatggttatgcagagtgggcaatagtattttcaaaaagcttagtaaatgtaggcagtttctttagggttaatcatctttcaaagggccttaggaatgtccttcaaacagaatataaatgtcaaagagaatatctctttctgtttgaaattatttgggcaggttgaaagaatttgataaagggaaattctatatttaatctttcattgtaaattatatgtgcaatgaaagagtttaaacatttttggagtttgctgtcttaaaggcctttctggaatgtaaggaaacccagcagtggtgtctgctaaatatgcgaatgtagttcttaacttctttgagactgctttttatctgaaaatgggagtgattcctcctaccacctcacatgtttattgtgagggttaaatgagatactga

SEQ ID NO: 43520 - DNA, 511 bp, Homo sapiens
tttatattaataaattattataaattaaatttaaaaagtaaacaacatgctcctgaacaaaaatgcatcaaagaataaattaaaagggaatttttttaaaatcttgagacaaatgaaaattgacatgcaacataccaaaacttacgaaattcagcaaaaacggttctaagagaaaagcttttagtaattaatgcctacattaaaaggaagaaagatcttaaataaacaacataactttacctcaaggagctagaagaagatttaaaaaacccattgtagaaggagataaataataaagattagaaaagaaacaaatgaaaaagagactagaaaacagtaaaagaaaaaaatcaatgtaagacttgggtttttgaaaacataaaacagaatcaacaacttttagttaaactaacaaataaacaaagagaagcctcgaaatcagaaatggaagagaagacattgcaaacaatatgataaaactgcaaaggatcataagtgaccactaagaaca

SEQ ID NO: 43521 - DNA, 631 bp, Homo sapiens
ggtcagcttgactaataattacttgtcctgtctgtccctggattgtaagcctcaaggagatgaagactacactttgttcatttttatacttcccttctccccagggccaactacagtagcttgcatcaatatgttaagctaacatttcttgcgtctttaccatatcaagccacctggctggtgttgcaggtagcagacactcaacaaacacccactggattaaagtcagtcagggtggcatggacaagtgttccctggacctaatgatgttcagatgagatgcccatctatcatctgtgtttgcagagctgagacagcagagttagactcatggtggcatccatggtgaggcaatgaatgaatctcagcctagccttttacaaaaaaacttttacatgaggcataatttctcatttaaaattaaatgacattaattaataattaaatgacataaatagaaaacaaaaaaaagcactggaattaataagcaaacagacaaatccacacacatacaacacagtttttcctctttttaaacaattaattaagttgacattcctctctcctcttttctttctctttctttctttgagacagaggcttaactctgtcgcccaggctggagtgcagt

SEQ ID NO: 43522 - DNA, 421 bp, Homo sapiens
tttttgataaaaatttaaaaattgagctccaaaagggattcaccaattaatatttccatcatcattatgcagaagttgctatttactcacatccttaattatagaggaaagtatcaatgaatgtttaccaatttaatgactcaaatattttcatatctatatttctccattattagtgacattgtgcacttttacttatgtgtattgacgatttgtacttttactctgtgaatttctttttctcttctttttttcaacttttattttagaattggagagtacatgtgcaggtttgttatgaagttatattgcgtgatgctgaggtttggagcatgagtgaatctgttacccaggtactgagcatagtacccaataggtagttttctttctaccttgcccccaggagtccccagtatctatt

SEQ ID NO: 43523 - DNA, 536 bp, Homo sapiens
ccattttatcctcaaaatatccctattatataattactattcttatactcttcaaaatacatattttatatatttattaactcaacaaatatttattaaggatctttggtgttctggggactagggagtctttcttaaacaagactaggtcctgttttcttgtagttaatattctgttcaaaggtgtgtgaggaaaagacagcgaaactgaaacattaaaaggtataaacttgcctaaattcacacaggctatagatggcagagccagcgctgaataccaatctgcctgacccggaaaacgacactcctaaaagtcaaattgcagatttcattcttcctacacaagctctgcatagaaatttattttttaggcaggcaagccaacttcttgtgcatggagaagttcaatatgccttaagtaaaatatcagcttattctcagaggtggaatggtgcttttaagaaaaggctgtggtgacaccttatagtcattattagattaaaaatatattatctttagagtaaatagtagttgga

SEQ ID NO: 43524 - DNA, 646 bp, Homo sapiens
agagaaggcttacaaagcaagatggctgccactgagatcagcacactggggtttttaacagaaacctattacttgatttactgggagtggtagaaccctaaagaagcggtgaacatccaacactgaaatttgagctggctcttcctcagaaaggtttcagcggcttaatctcatgcaatcttgcaacattcctgaattcaaacccatgaagtagagagtcagcccgagaccctcttcagaatccaccgagtctgctgggcaggaagagctagcttgttgagttgtcctgctgcaaatgaaatagtaactttctcagaagcataggatattgaaagattcctttaagaggccaagtcctcaaaggcatgtatgcaacgtgaagtcatgggggcaggccttcctggttccaatgcatgttttcacagggttgtgtctctatgcttgaaggggagctcttgggcctatctgagggatcatttaccacttgctgtaggaaagtccagtggaaatcacttctagtggtgagtcttggccaaatatactcctatgtagaaggcctgtgtaggaggttatgcttggaacagttgagtagatgttctggcaacctgtgatggccttactaagtcatgacagtcagcaaaaaaaa

SEQ ID NO: 43525 - DNA, 915 bp, Homo sapiens
gtaaaaggtacattttactatttcttagcttttatctttgaagatgtctgggaactcctgagctcaagtgatcctctcacttgggcctcccaaagtgctaggattacaggtgtgacccaccgcacctggccctggtatacttttaagaatctcaacaattacatttgaaggtacaagcacaaaactgcagaacatacaacatatacacatgcatacagcaccttgccttaatggtagttcagtacctgatgagtaggaaacactatcaccatatttgctcagctctaaggtgtgtacattaccatattttaacatttctgatattcaggtgcgtcttacttttgaagaatttttaagctactgttaaagtggaatttatacttaacaagatttcagaatcaagtcagtattgtaaataagtcagtctgaggggctttgcgaaacctgaagttttgaagttacctttggatgtcttaactgaaaaaaatgtaacggctgaagtttttttcttcttaaaatttcagtttttgtagttgaaaactgtagaaatagaaaacaaaagccacattgttaggaaatgacaggtcttctaattttagtctttttttttttctttttaaaatttcctgttatcttagctcagagctgggtttcagtctccagttttctagctaatttaaccaatggcagctttttgtttgtagttttattacggcattgctaatcctcattatatttgtcgtggccttgagcaaaaaactcaattgatgacattcacctgtttatagtcataaccatttggtaaataactttaatttttggcaaagtagcacctgaatttctctcattttaccagacaggtctacatttactttggggtaaagctatttatttttcatattgctagtttaaaaa

SEQ ID NO: 43526 - DNA, 1071 bp, Homo sapiens
agatattggctgcaagccattccaggaaagggatgtgaccttgaatgagatgacttttcttagctgaggcaattctcaaagggagctgtcagccagtagccttgcagttggacagatggcagcacagcagagcatctgggacaggatgtgacctggaaatagcattgatatggtttggctgtgtccccaccccaatctcatcttgaattcccatgtgttgtgggagaaatccagtgggaggtaattgaatcatgggggaaggtctttcccatgctattcttgtgatagtgaataagtctcatgagacctgacagttttaaaagggggaatttccctgcacactttctctctttgcctgctgccatccatgtaagacgtgacttgcttctccttgccttctgccaagattgtgaggcttccccagccacgtggaactgcaagtccattaaacgtctttcttttgtaaattacccagtcccatgtatgtctttatcagcagcatgagaacagactaatacaagggtaaaccacttccattcacccctcattatctagaatgtctagaacagccaccatagttgccacggaggctgggaaatacagtctctagctaggaggccctatgcctagctagcactaaaaggaagaagggagaagggatactggggagcaatcacaagagggaaggaaaatcattctttgatttgttcagcttattgactgttgtagatcaaaaaccacttcattgaggaaagcaacccaccaaacacagaagcagaaagagagctaaaaatgggataagaacaactgagaaactgcttatccagtaatatattttaaatagtgaggactacaccaaacttaggtaggcttcagaatgagccagggacaactccccagaactctgcaggaaggggctcctgaggacacacgtccaacctgcacctgaaaccccaagtcacaaggacaactgatatttagatgcttttcttcctaagacctgctacatatcagaaaaagtcacttaaggtaaaagataaaatatgctgagaaacgattctgtttcttaaa

SEQ ID NO: 43527 - DNA, 303 bp, Homo sapiens
attttattctctggatgaaccataacttgagcatttacattgttttaaatttttccagttcgtaattaaagttacagtaaatatatttaagcataaagctggatttttccccttctccaataaatttcacattcttcccttaaaattggtttattgagtcaaaacaactaaatatctttaagacttttgatacagttgaattttctccacatttatttgaatactaggaaataaaatatttgttcattttattagctggttttattttgtgatttatccattatttgattttacattggattt

SEQ ID NO: 43528 - DNA, 387 bp, Homo sapiens
tttccagcaccttcatgccacttcacagtcaatactacccacccccatgggtaagcactattccaacttctatcagcattcattagatttgctgtaatttgttcatttaacaatttgtcacattttccgtattacattattactcattcttttttttttttaataatttgagagtaggctgactggactacataatttggaacttttgaccccattaccttcagtcttctctttgattttattttgctctgtttaacaaattgttttgggctgagcacggtggctcatgcctgcagtcccagcactttgggaggctaaggtgagaggattgcgtaacgccagaatttgagacaagcctagcaaaatagtgagaccgtcgtctctaca

SEQ ID NO: 43529 - DNA, 1073 bp, Homo sapiens
gtctattcttaatatgacagccagaatgatcttttaaacatgaaagtgagatcatattactccttgtgttcccattacaatggcctttgagagtgatcagggccccctttgtctctctgaccttattgcttattctcttgatcactctgctgccgctacgctggcctcttccctgtccctcaaatgtgccagacatgcttccatcttagggtctctgcactggctatttcctcaaatgtcatctcggtgaggctaaccctgatcaccctacctcaatacacccaattatttttactccgctttttctttccgtaggagttaacacctcctaacatttacttctatcagtttcttatgattaactgtgttgtgtattccctcccattagaatgtgaatatctgaaagacacttacagtttgaaaagtgcctggaacgtagtaaatgttcaataaattgcacttcattgatatttattggcaacataacattattaccactcctcagaagcctgccacatcttccctatcatttatacctctccccaagcctgatgtttttgtttcttgtcttaatatagagacaaggtcttactttcacccaggctggagctcagtggcatgatcatagctcactgcaacctgtatcttttgtgctcaagctatcctgctgcctcagcctctcaagtagctgagactacaggattgggctaacacacctagctaaatttttatttttatttttttgtagagatggagtcttgctgtgttgcccaggctggtcttgaaactcatgacctcctgccttgacctcccaaatgatcctcctgctttgacctcccaaagcactgggattataggcatgaatcatcaagcctggccaagtctgatggtttttaaagttgtttttagtatgattgaatatgattctcatacaaataaaggtctgctgtatagtagtaatctgttgcgtagaactttgttcttcaggtgaggtgtgagtcacatccttttatcttgtttgttttttttccccgccccccgcccccccagtatagtcatgagcagtccacaaa

SEQ ID NO: 43530 - DNA, 374 bp, Homo sapiens
tgtatttttagtagagtagcggtttcaccatgttagtcaggatggtttctatctcttgacctcgtgacccacccgctttggcctcccaaagtgctgggattacaggcgtgagccatcgcgcccggccaactttttaactttttgtagagacagggtctctccatgttgcccgggctggtcttgaactcctgggctcaagtaatcctcctgcctcagcctcccaaagtgctgggattacaggcatgagccaccacacctggccaatacataactattaaaagaaaaaaatgttggcttgctttttaaaaagagctaaagaggtcttgtgtaaccattagtggtatgcagagtacattttggaaaacactgcctga

SEQ ID NO: 43531 - DNA, 362 bp, Homo sapiens
aaaacagtcttcaggtcagtgttagcgtcccttgcttttgagttgggaatttcttcagcgagaagcgtttattttcttgaaagttgccacatatgggcttctgtgttctgaagaaaaaaagacagtagcagtcactctatagttgcatgtgtttatgctctggcccagatctgacctcaggttatccacccgcctcggcctctcaaagtgttgggattacaggcgtgagccaccacgcccggcccatgttttcttaatatgattcttgtgaaagtcctggttgaacttttggaggtcattatcttgattgtgaggatggtgccatgggtgggtacatatgttaaaccttatccaattgtaca

SEQ ID NO: 43532 - DNA, 1641 bp, Homo sapiens
gaagttattatatatgttgttttcttgagcaacagttacactaggtagaaaagtattcacacaataatagtgggctgggcagacaacctttgggcagtctcaaccttaatccttgggtacagcacctgaacttaattgatgagaagtggaacttaagtggtttccctggtgctgttcattatggaaattttatgctggatttatcgatgtcattcttaatcttttgatactataaaggagtcttaccaactggagaaaatttgcctacatgctatatatttgaattgtgtccaaagctttgcagaaaagcaaatctgaagttattatatatgttgttttcttgagcaacagttacactaggtagaaaagtattcacacaataatagtaatgcaaaaaaagtgagctacttggaaagtatcatctctgttcaggtaagtttacttcagtgaactcttgtgtggttagcgataagttttaaagtccaggatagcctcatgagcataggccttcctatgaagtagtgcaaagggggccgattttagtggattaccctatcagtgttcttcagtatgtccaattgttatcataccaaaaaccttaattacataacattgtgtggatgaaatgctgcatcttcagttaatacatgttttgagcacattcttaaaatacataataattaaatgatccctattcaaaagaaccctggcttgggtggaggatccactctggctaacggataagagtgatgaacttctttgttacctgacccttctcttctggaaaagtgaggtgtacattaaacatcttttggtcaccgtgcctcactaagacctttcacattccagcttgtccgactagtgtaatgtacctctcacttctgttttacgttgagcattacgaattaaaatctttacagtctagggggaaaaaaaggcttcaataccagttggcttatgaggctctgcatataattttctctaaaatatgtaactattttgtagtctgtggggactttcaaagccaatttttaaaattagtagtagtaaaggtttttccctttcctgaatgaaaaatcagaaattctaatctttgctataaagtacttaaacacaatacattgcctcagcataaataaaaacatttttattaagatgatttatgaacatggatttctaactggaccaacactaatgttgcaacctgataaaatttgagatgtaaattcatttcacagactcataaacacactctctttaagactcttctttaaatggatccttacattaccctgcctgttttattatgccttcatttttgtggttttcattcactcctgcttgcttctattgaggttctcctacatttcccagaaactcagtgaatatcttgccttttcttcaaacaaagggggtttttataaagtttgtatttttgaaactagctctatgtctatctaaaaatcaagtctcggcagtggctcatgcctataatcccagcactttgggaggccgaggagggcagatcatctgaggtcaggagtttgagaccagcctggccagcatggtgaaaccccatctctactaaaaatacaaaaaattagccaggcgtggtggcgcgcacctgcagtcccagctact

SEQ ID NO: 43533 - DNA, 3078 bp, Homo sapiens
ctcaaccttagattttccttctcagtgtccttctagaaagtgccgcctctactaaatgatttcatgttatttcctcaggtctagagctatttgatttccaaaattctatactcactcttctgttctcattcccggtcatggctcattttccctcagcagctaatgatgctaatcatgtatctaccccccattgtcacaaaaaagagagatggaagagttccttagataaatacagggttagcaaagaaaagtttcattatctcttaagaattactccaagatctggccaggcgtggtggctcatgcctgtaatcctagcactttgggagtccaaggtagacaggtctcgatctcctgacctcgtgatccgcccgcctcggcctcccaaagtgctgggattacaggcgtgagccaccgcgcccggcccactactggtttttaacaggatgattcaaagtacagcccgtgcacatttacttcgtcacctggtgcaccacactgtcttcatgttggccctcgtttcttgtatacttagcttactgcccagatgcaactgagaaaatacaggaaaagcaggtccaaattcagccttcgacttctgcaaaagtccataaacagaaagtctgtgagcctccaccctgccagaaagaactcttcatgaagaagtcacgtatttgctcttcctttcaaaggatggcattttaatgttgctttgctgccagatgttcatctgcttgctgtgaagtgattctttttttaaaatgttttttaatggatgtaagttttctaaaaggcagggctgaaatggagaaccaagaatttgcttggtagaaaaattatttttttttaatttcagacttatcaaaaatttggttgagggaatttttattagctgccctgactttataatgctacgctcttaacagtgccaaaaatcctacatagttactgacaaatgtgtgatctttttacagtcacaacacctgctgcccggaaagcacaccgtccacgtagaatggagaaggcagaaagttaccgtgtgttcccactgtatctgcactgttcttacttcctcttgtcccttttcatatcttggtctattcagccttaacatttcaaaggcttatagtaaaataggaactgaagatctgtatcaaaatgtaacactttcatcctttggaataattgaagtttaacataacctctacatgtatataagttagctggtgaaaatgtggcatgaaacttcacaattgtgcttcaggcctaagtgactgctacctatgatttaagtgacagtaaatgtcttgctacatttttctatttcatcctctacaatcatatgtcatggaatggagctatgaaatgtgctaacttggtattcaggattctcattgtgataaggtgatacattagttttaccttgtttgaaattttacaaaaatgcttacaatccaggcattctttctctacctattatgaactacggtgtgttaaacaacagcagtgggctgggcagacaacctttgggcagtctcaaccttaatccttgggtacagcacctgaacttaattgatgagaagtggaacttaagtggtttccctggtgctgttcattatggaaattttatgctggatttatcgatgtcattcttaatcttttgatactataaaggagtcttaccaactggagaaaatttgcctacatgctatatatttgaattgtgtccaaagctttgcagaaaagcaaatctgaagttattatatatgttgttttcttgagcaacagttacactaggtagaaaagtattcacacaataatagtaatgcaaaaaaagtgagctacttggaaagtatcatctctgttcaggtaagtttacttcagtgaactcttgtgtggttagcgataagttttaaagtccaggatagcctcatgagcataggccttcctatgaagtagtgcaaagggggccgattttagtggattaccctatcagtgttcttcagtatgtccaattgttatcataccaaaaaccttaattacataacattgtgtggatgaaatgctgcatcttcagttaatacatgttttgagcacattcttaaaatacataataattaaatgatccctattcaaaagaaccctggcttgggtggaggatccactctggctaacggataagagtgatgaacttctttgttacctgacccttctcttctggaaaagtgaggtgtacattaaacatcttttggtcaccgtgcctcactaagacctttcacattccagcttgtccgactagtgtaatgtacctctcacttctgttttacgttgagcattacgaattaaaatctttacagtctagggggaaaaaaaggcttcaataccagttggcttatgaggctctgcatataattttctctaaaatatgtaactattttgtagtctgtggggactttcaaagccaatttttaaaattagtagtagtaaaggtttttccctttcctgaatgaaaaatcagaaattctaatctttgctataaagtacttaaacacaatacattgcctcagcataaataaaaacatttttattaagatgatttatgaacatggatttctaactggaccaacactaatgttgcaacctgataaaatttgagatgtaaattcatttcacagactcataaacacactctctttaagactcttctttaaatggatccttacattaccctgcctgttttattatgccttcatttttgtggttttcattcactcctgcttgcttctattgaggttctcctacatttcccagaaactcagtgaatatcttgccttttcttcaaacaaagggggtttttataaagtttgtatttttgaaactagctctatgtctatctaaaaatcaagtctcggcagtggctcatgcctataatcccagcactttgggaggccgaggagggcagatcatctgaggtcaggagtttgagaccagcctggccagcatggtgaaaccccatctctactaaaaatacaaaaaattagccaggcgtggtggcgcgcacctgcagtcccagctact

SEQ ID NO: 43534 - DNA, 338 bp, Homo sapiens
gagtctcgctctgtcgcccaggctggagtgcagtggcgggatctcggctcactgcaagctccgcctcccgggttcacgccattctcctgcctcagcctcccaagtagctgggaccacaggcgcccgccaccacgcccggctaattttttgtatttttagtagagacggggtttcaccgtgttagccgggatggtctcgatctcctgacctcgtgatccgcccgcctcggcctcccaaagtgctgggattacaggcgtgagccaccgcgcccggcccactactggtttttaacaggatgattcaaagtacagcccgtgcacatttacttcgtcacctgg

SEQ ID NO: 43535 - DNA, 1245 bp, Homo sapiens
gttcaatggaggtgcatgtcctagagaaaatgaaagagatctcgttgtcggttatacttaaatcaataaaatgtttcttccctcatcagagacacaattctggaatggaaagtagcttatcatctctgaagccttgggtcccccggtggcaaccatgcctctgattacccaggggttccaagaaaacaggtcgtgttcttatgcagaagccacaagtgaaataactgatgagttcagaattctgacatctccagacacctgctgtactgcacttgtttatttatatctgaacagataagtgctcccaatattaatctatgcatcaaaaatataataaatcagatctgtatccttctttcaacaaggataagtaggcgagtcaaatgcagatgagaaaaatgattaaaatatatagaatgtaaaataaaaagtgttaagtactgtgagaagaacagctagagtgagatgggtattcaagagggatattcaaggaagacctcttggaggaggtcttaccgtatctgggtcttcaaagattttctgaaaggcagggagagatgggcctgagaagggagaagggcactccggactgaagatgctgcgtggattgccatagaggctgtaggtgagagcctggatgcggggagcagctgagtggttatcgtaaaccacctgcacaggaggtgaggagggctttacccagggaggtgacagaaaggattgaagatgttgcagaactaactttttggttatgagagactaggacgagagaaagtcaaagtcctgccaagtttctgagcttgagtgctgagggggcaggtggtgcttttcacaagagcaaagaacaaaggaagaaggaaggaaggagcatgatgaattctcttgaaattgtaatcttactgaatctgaggtgccacaggacatccagatgggttcatctagcaggtctttgaatgtgttagtgcaggtttgaactcagagaagggtaagaggtaaaggtttaggagtcatttacatagaattaatagttggaaaaacaaaaatgagcttgctaaaagagaataaagaatgcaaagttgcaatcttggagatcatcatagattttgggaagagggagtgaaaagccagaaaagattatcaaagaagaaacagcctgagggaagaaaacaggagtctgtgttatcttggcactacaagaaagaagggcatcttagagagacaggaagggaggatgaaagaggggta

SEQ ID NO: 43536 - DNA, 2096 bp, Homo sapiens
  misc_feature (1275)..(1275): n is a, c, g, or t
  misc_feature (1360)..(1360): n is a, c, g, or t
  misc_feature (1375)..(1375): n is a, c, g, or t
  misc_feature (1431)..(1431): n is a, c, g, or t
  misc_feature (1491)..(1491): n is a, c, g, or t
  misc_feature (1578)..(1578): n is a, c, g, or t
  misc_feature (1582)..(1582): n is a, c, g, or t
  misc_feature (1597)..(1597): n is a, c, g, or t
  misc_feature (1620)..(1621): n is a, c, g, or t
cttggagactatttattacatgtatttttaagactttagataaatatccccaaattgccttccaaaaactttacagttctataaatgatatatgagactactgtttcttcacatattcaccaacacaatacttttttatttttgctattttgatggggagaaaagtttctcattttaattttaatccacattgtaaattgtgtagtgaaacatttttacacataattattaataatttggaagtttcttttgagaattacctgcttataatggcacattcatcttttatacctgagagttcttgagtttttaaaaactttgcatttagtccccttccaaaaataatctaataatatttaccataaatgggccgggtgcagtggctcacgcctgtaatcccagccctttgagaggccgaggcaggtgaatcacctgaggtcaggagttcgacaccagcctggccaatgtggggaaaccctgcctctactaaaaatataaaaattagccgggcgtggtggtgggtgcctgtagtcccagctacttgggaggctgaggcagaattgcttgaacccaggaggcggaggttgcagtgagctgagatcatgccattgcactccagcctggatgacaagagcaaaaaactctgtctcaaaaaaaaaaaatttaccataaatgacatacaaaataaaagtaataatctagaaatagtcaaaaactcaaaacgatggaaaaggaaggccgcattaaatagagctctcataaataagcatcaaatctgagctgtccaacaaaaagggaagccctgtaagttatataattttaatcataaaggaagaagcacattagtcacaaaagagaccacatttattcctggcattaaattctaaaacagatttctcatttgggctcttacataggggaatacagagtgacagtataacagtatccttaatgacagttttacaacaaatacagaagcaatttttatgacttttatatcttgaaactttttatccacttatagtacataaagtactctatatagtactttaaaaactgtggtttatcaatgtttaaatgtttttggacttttttgtgagaaacagttattagcaataagtttttttttcaaaggcatttcttctccaagctaggccaagtgataaaattatagagcaaaagctaattagaatggcaacaataggccgggtgtggtggctcacacctgtaatcccagcactttgggaggccaaggcaggtggatcacgaggtcanaagatcgagaccatcctggctaacacagtgaaacactgtctctactaaaaatacaaaaaaattagccgggcgtggtggcgggcgnctgtagtcccagctnctcaggaggctgaggcaggagaatggtgtgaacccaggaggcagagcttgcagtgngccaaggttgtgccactgcactccagcctgggcaacagagtgagactccatctcaaaacnaaaaagaatggcaacaatagaaaattgtacttaggctgggtatggtggttcacacctgtaatcctagcactttgggaggctgaggcnggangattgcttgacctcngaagtttgagactagcctgggcnncatagcaagacctcatctctattaaaaataaaaaaattagttgggtgtggtagtgcatacctgtagtccgagctacccggtggtggggggcggtggggttgctgaggcaggaggattgcttgagcctggagatccaggctgcagtgagctatgatcatgccactgtactccagcctggcaacagagcgagaccctctctcaaaaaaaaaaaaaaaagaaaagaaaagaaaaaagaaaattatagtcaatacttgtaaaagattatttgcctttcgttgcaggctgagcctgaggcatgggtataccaaactgctaaatctatgtcactgtataagaatatacctaaatttaaagcagtcttcaacatatgaaaagaaactaaactatttccgtaataaaataaatgcacattaaaactatgctgaagtaccttgttttttaattgctgaaataaaaaaagcttgataatttaaag

SEQ ID NO: 43537 - DNA, 401 bp, Homo sapiens
ctgccctgaggactgggccagagcccttgaggggcccgcagggaaaggccaaaaggaccaagtgctcattaaagaccaaggcaggctggactgagctagacacccaggctccaggttccttcctctgaaacatctgcaggtttttgggaggcgaagggctctcagctgccatggctgatgtctggggactttttcttcagctccagatggtctacacagggttcgtatacacaggccccctagccgcacgcatgcgtgcatgcacgcgcgcacacacatacacacacacaccccagagtaaattcactgatatacaccactatgaacacacacaatgacttacctatacacacatattaatagacacccatactgctcttaacacacaccttcagacatcc

SEQ ID NO: 43538 - DNA, 1001 bp, Homo sapiens
gcccagcccatggtacacattcaataaagcctagctatcctgattttcagtcttaaaatcatgcctactttttagggtaacaaatttaagattctggacattaaagatgatctagtctgcctgggatccatttccttccttctgagaatctgaaatgccttcctcaggcattggatgtattaccatctaaacttccctgagatggttgttcaaaaccatgaaagtaattacagaggcagatgaaaatgagagtcacacaacactgctcttcaaaggcccttgctgacacaagcagatggcacagtggccgggatgggccagtgctgactaagagggagtgtgtcgtccgctctgtactccgcgcaagtccctgatgtgtaagggcacaggcttacaggcgtacgaattttattccccattttgatcccatttgattctgaatgcattaaaaaaaatctgtgtagcacaaaaaataatctatgttgttgaaataacaaaagtctatatgcggtagttagaataacaactagcttgggatctgggatacgtaggtttgacttcgtgcctttgcagctatgtgaccttgagtaaatatttcccttctctgggcttccattttcccacctataaagggcctaggagcctagatcatcacaagtaatttttttttggctctaatattctatgatttaaaatcttgccttggttcttattagctatgaatgaagtgtaaatttccttttctatattatctttagagcttccaatttttgctctgagtacaaaggaagtggaggaagcaagattaagccaaagataatggagagagaaggttagaagagaaaagggaaaattacagatgggcatttgggttgaggtcccctctcagacttggagtgtgtgtaggaggaaggcaggtggacgccggaccttctaggacaggcatcgaaggctggtccatcagacatgcgctttaatcagtgagtctggatcgccgaggt

SEQ ID NO: 43539 - DNA, 959 bp, Homo sapiens
  misc_feature (593)..(593): n is a, c, g, or t
cacactccttatgagaatcttgcctgatgatctgaggtggaacagtttcatcctgaaaccaatcccctgccatccctcagttggtggaaaaattgtcttccatgaaactggtccctggtgccaaaaagattgggggcagctgcattataccatgacagagggatctttctaaaacataagccaatgcaagtcactctccttaaacccttcagtgacttttcactgcccttagagcccgggttcctccaaatctgtacctgtacctctgaactctttcccaccagtgttctcacagctcttgggcagcaatgacacctgctctgtagaagccttccctggctgacccatctaaaattgcctcaacccccaactttctgtctgtcataagagtcaacttcattttactcatatcacttatctccatctgatatttatttatttatgtagtctctctgtcttcccatcccctcagcttatattctgagctcaatgtgaggtcttttcttcattactaggtccatagaggaaactcagatcactatttgatgggtgaatgaatgcttcaataaatgaatgcatgcatgcatgatganaattctgtgaggctggcttctttattcccatttcacaaatggagaaactgaggcccagagaggctaagtggctttcccaggattgctgcatagaatagacacaaatctggaattcagggttcttgccacctacccctgaattcccctctgcctttcccttgtgatctccttcctctcgggtcaccccacctgcctccagggactgagcacaaagctcctcttgagctttgcctgtctgaggagtcttgggctctgtgtggttattttgttttctgtgtgttgttttgggttctaaacagttgagccgccatgggcaggtgggtatgccagggctatgctgtcccaacacttgtatgtcctccttgg

SEQ ID NO: 43540 - DNA, 463 bp, Homo sapiens
tgtgctcctaggaaaacttgttagatacagcaaacttagatcatgacttctttcattgttccttctgggtcttcaagcctcaaatacatgaagaaaataactaattttcaagccactacacttggatttctcttacatacaagcgaacacccaacctgactggtatacccagatttaaactggcctcccactgtcctgagattaagcaggaggatttatcatacatttattattttgtttttgattccagaattccctgctcacaaatgatggtgagagttatctttctgcattacagttagggaaactaagaagataattgaattaaatcctctgagttcattataaggaatgacttattttatcataaagtgtaaatattacttttattagattattaccttgttaactatcatcccatagaattataaatttatttcttttaaaccatgacaactactac

SEQ ID NO: 43541 - DNA, 457 bp, Homo sapiens
ggtcgacagtcacctgacaaactgtttctctcccactcagtgggggaaagctccattctctcaacatttattgtgcatctgctatgttcccagtgtaggagaaatcgtctgggaatcaaatggccccacccgtcacgggctcagcaagccagttgtccccaggaggcagcctgcccaaggccctgtcatgcctggaacccccacccgctcagtgagtcggctgcctgttaactgggctggcaattgcagggtgcctggggcagcctggcccctagactgagggggtgaccaagggttcaagtccagaaagctaagccactaggctgcaatggcaagggctgggagaccagacacaccattggagcggctgaagaggaaggtggatgtccctgagcattgctcttgctgtctgcagaatgagcatattatactctactcccagcacttctagtttggc

SEQ ID NO: 43542 - DNA, 414 bp, Homo sapiens
acaagatagtcccttttcagtgcccagcatgacatttccaaaatgaagctatgtgtgttatgttcatgtgttttgtgcataaaaagggctcagagtcaaaatagtttggcagattctgggtttttatgctgcagaacttctcagagcctttaaaatgttcacgtgctaggtgattctctgaggatgcgagtgttaggattagattctgaaaggcagaaaacccaaaatactaggattaactatgatggagctcaaccttcagggtgggcaggcagatctgtataggctccatggcagtgggagccaggccccttccctggcatggctctgctgggcatggcctcagcctcatgattcaagatggcagcagctgtgttccaggcagctgttatggggtgaggggccctggggcca

SEQ ID NO: 43543 - DNA, 359 bp, Homo sapiens
atgtcgaccccagacttgtctcgaattctggactcaagagatctgcctacctcggcctcctaaaatgctgagattacaggcatgagccattgaacctgacctcttgataactttttaatatttacatttctaaggagatctctaatcaagcactatgagccacgtgaacttttaaatcacgtatttattcaattctgagccctgttaaaagtatatgatttgctgggcgtggtggctcacgcctgtaaccccagcactttgggaggcagaggcgggtgcatcacctgaggtcaggagtttgagatgagcctggccaacatcgtgaaaccccatctctactaaaaatacaaacgttagcc

SEQ ID NO: 43544 - DNA, 399 bp, Homo sapiens
cccagattcctcagtgagaatagaaggggctagagacatcagggaattggatttggtgactttaatacccactcagctccaaagcattcttgaatgatgcacgatttatgaatatatatattgaaatttactgatgggtgaacagctctcaacatgagatttttgttgtatgccttaaaaaagattatacataaatatgcgtgtgtgtgtgtatgtatgtttcgatgtatatgaacccatgatctgaaaaatggccactgtggcttgtggaaacctattaatctctgctgttccacccaacatcctcagagaaaaaaataaacaactttttgaaagtgctgccatggggtcagaccaaatactgtggccacttccaaggggtttgccttgatttgcctg

SEQ ID NO: 43545 - DNA, 1732 bp, Homo sapiens
tttcaggcttcatagccagagtcctatagagttcttatagaaacagaataattgaaattcagcatatactatgcttagaaagtattttgtttgggtttgattgggtttttttttcttttacttgtgtgtgtatgtactgggggagtatagcttttattctgtgctcaattcgaaagagagtattataagttttcccagcccatccacccgctaaaaaagaacatatccaaattttaatatgtatacacccaacctgtacctatgtacgtgaatatacatgcactgggaaatctacttaagagtcttcactgagaagttcactcgatagaaaggtcttgatagagaagagaagaggaaagcaatggtctgaaggcaaatcctgctttaacttggtggtccatttcccattcattcctgaaccaatgagagcagaaagaaacaagtcaacccaaacaagcaaactaggggctggacgcggcgaatggatgctggtcagtttggcaaattcactgaaactcatcaagaacccagctgaacttgcattccaacttccacaattatctgaaagggctagggaccaggtagccatgtgtcccaatcacacgggggagagtctgccaccggcggtgagagaggtggggaagctttggaggagacagtatattcacctttttatctttgggtaaaagaaaccaacaggactttggtgcagtagatttctcagtgccttctttaggaattctatcttaagcacacttcaaggggaaagaaaaaaggaggagagaacatttgttcccgtgaagtccctttctccaaaggactggggatcaagaaggaagaagagtaagaaggaaaaacaacaaaatcctgaggaggccatttcttttaacccacccagcttgcccctgaaaactgctggtgatacaaactttttcaaactgacttccagcttctccatgtgtcttggtaactgtagcctcgtctctgccctttctcctaataagatccatgtttctaaggagaaaaacaaaacagtattctcttctgtaaaactgtaatgtattgttgatatttgtaactattgtatatttctgtcttgctccagtcccagctggagtgtctagttccatggacaaggggatatttaaaattcaccacggacaagagccactaaagccaggtctctatcgctaatctctctcctattcttatttctctaccaactaatctcaagtaacaataccccaggctttttttcagcctcaattcaagtaactttgaatcaaaagagagcaaggcaaaaagcctccggacatgcttctttgggaaaggactttttctgtagctgcagagtgggcaggagggagaaggggctcccctgagaccccggcaggacaatggaaagcttccagccccgagctgatgtttcctcacctatcactgcttataggacagcatccaaatgctttcatgtcactcagcccaggcaacccaaaccagtcctggctacacccagaaataagagttacctctgcattttctgttgccatttttctggctctagaagtatctgatgcgcgactatgtcatagaatgtccacgcatctcagagtagtctatttttctgttcagataaaatatatatatatatgtatttttagcaaatttataatagggcaattgagtctaatttcttcttttgtaatacagaacaatatcttaggagtttcat

SEQ ID NO: 43546 - DNA, 234 bp, Homo sapiens
gtctactgctagatgaacaaggctaagtctacagagaaggtaaattatagaaattaggccccgtctctactaaaaatacaaaaaattagccgggcgcggtggtggggtcctgtagtcccagctactcgggaggctgacgcaggagaatggcgtgaacccgggaggcggagcttgcagtgagccgagatagcgccactgcagtctggcctgggcgaaagagcgagactccgtctt

SEQ ID NO: 43547 - DNA, 349 bp, Homo sapiens
ccccataaaactcatcacaattgggattaggtatctagggagttatttatttaaaatctgccccctacactagactgtactgcatcaaggcaaagacatatccatcttgttctaggctgtatcactagtgcttagtacggttcctgcaccataggcaggtgcttccacaaatgttttctgggatatttcagggagctcattctgtaccagggaaagctaagacttctttactggaaacaactgtgggggcatagggatgaggacagggcacaggaggcttaaatgtgtgggtgcagcccccagttgagggggagatgttcacttcttgggctgccggggggatgctccg

SEQ ID NO: 43548 - DNA, 1638 bp, Homo sapiens
ccactgtagacattactcgctttatattatttgctttcaaatactaaaacctcagctgctaattcagcgctctaggtgtacagtgtctccttcccttggctcctagcaatgtagggaacttgaggttcttcagtatcttcagagattccttccaggccacatatttttatgctaatacttctatagttgcattcaatctacaaggagaaagtgtacattggtgcatgttttataaacccagacacagatagctaaaaccataattagtttttctatacccagagctttgaattaaaaacagatgctttttttttccccaagagcagacagttctacattcctaacattaggaattggtgatacgagaagcaggatccagaattcagaatgatttagtgagactcggtgaaaaaaatgcattttcccctggctgtttgaaaatttacttatttgcagataagtctagatttagtcttggagatcaaagtcttttatattttaaaaacttattctttatattgatcaaacatggcatatgttagagaaccacttcttctgtcatgtttatgtattttggaattaagttgtttgcattcactttcaaaatctgcccatttctgtttatgtgcacttaccacagatgtgtcgggactttgcctcaggggagaggtactttagcacctgtgtcactgaggagatggagtggttgacaagtactgttgcgctgtgtaacttggggtttggccctgtggacaatatattagcagaatgataccacacaaaagtattacaggattaaggcatgtaacttctatggtagtccttatgtatcagcgtatacccaagttcagaaaccacaggtgcatttttagacctttacttagagaactaaaggcagttccaaccatcagcccatatggcgggattaatgcatgaaaaccctcagagggtgttgggacatcctacttccctgtcctcacccagtggaactctggtgtgtgccttgaggataaggaagtagagtggaaactcatcctatcattgagtattctcaatattttggccttccctctggaattatgagaaatttaacaaagtctcaggaacctttagaatccattgtccaacactgctagaaaaactgtaggaggtacatggagaattcctatagttcttaggtaagtgcaagacatggcacagggatccctatccacataaaggggaatctggatgctgcacacctcaattctgagaaatccctgactgaacttggaattatgacagtaaagttttcgtcctttagttttctagagcagctcacagaaattttaaaaagtaaaacaaggccaggcgcagtggctcatgcctgtaatcccagctctttgggaggctgaggcgggcagatcacgaggtgaggagatcgagaccatcctggctaacagggtgaaaccccgtctctactgaaaatacaaaaaattagctgggcatggtggcgggcgcctgtagtcccagatgctcaggaggctgaggcaggagaatcgcttgaacctgggaggcagaagattacagtaagccaagatcgccccactgcactccagcctgggcgacagagtgagactccgtctcaaaaaaaaaaaa

SEQ ID NO: 43549 - DNA, 570 bp, Homo sapiens
  misc_feature (524)..(524): n is a, c, g, or t
aaaagtaaaacaaaaataaagtctatgcccattaagacgtcttctaattcagttgtgattgtctgctcctacttaaaaaaatatttaagcttgatgtttaattattccctttcagcaaatttggatcagaaaattaaagtatgtgacaagatcaggtcaccttgaatttccacacaatctcaagacactgaatagcaaaaaagtaacattacacagtaatgattaggatatttccttagactttgctggatctttggtcttaaggtaacatgtaaaagtagtgaagcctttcctttcatggccctgtgcaatgtaacggttttctgcctcctcttcagctggaagcgttagtggtagtatgggcacagaatatatgtacactggcgatgctgaccatgcctcccaggtaccctggctctgggttccttgacctagggaacaagattggatgaggcagatctttgagcccatgtgactatagaatttgctgatgatataattttacaataacaatggatagggtnccgcgggggaaactcgtaagagacgagccagcaggcatcaggtgca

SEQ ID NO: 43550 - DNA, 1583 bp, Homo sapiens
aaaagtaaaacaaaaataaagtctatgcccattaagacgtcttctaattcagttgtgattgtctgctcctacttaaaaaaatatttaagcttgatgtttaattattccctttcagcaaatttggatcagaaaattaaagtatgtgacaagatcaggtcaccttgaatttccacacaatctcaagacactgaatagcaaaaaagtaacattacacagtaatgattaggatatttccttagactttgctggatctttggtcttaaggtaacatgtaaaagtagtgaagcctttcctttcatggccctgtgcaatgtaacggttttctgcctcctcttcagctggaagcgttagtggtagtatgggcacagaatatatgtacactggcgatgctgaccatgcctcccaggtaccctggctctgggttccttgacctagggaacaagattggatgaggcagatctttgagcccatgtgactatagaatttgctgatgatataattttacaataacaatggataggaattttacctctctttttattagtttaatattatttaatattatgtacataagtgttcactcgcctaattaaaaacattgagtaaaccaagtttttatatagactacccttgccatatgatgctctttttctctaataatatgcagtttaaatcctgaggaatcaatgcccagcatttcaccacatctgaactctgtgtgggcattcttcactcgcctacaaggggtaaacaaggctaccagaacttgaatttgacttatagggagctacccaggaaggggaaagcccttgggactttttccaaaacaatcttctatttgaactgttcatcagccaaagtagtccactgaggtgacaaagctttcagaaatacaaagatgggaagataaaggtaacactggcccacttggggctttgacattggattgggtggactgaataaacacagcctaggtggcctgggcttgagcctcacttacttctccttgatacatagttcctggtctaccttctgaccctttttctaaaatagccagtgtctatttcactaggccatttacttacaagttcccagcttttagggaaaaaagagggaggggggagcatctagttttgaattagatatacatcttagaagtaatgagctattggcagctgttaaatcagattcagccacaaaccagaattctttcttgttgaacaagaccaatgagttagatgactttaataattccacttttctctccctctcttctcctcttcctgaaatcagagagatgagaaactactctttgaaatacctccagaggcgttttattgtgttcctttcccctccaagcagctccctttatacaattttgctcaggcaaccaaggacagagtatcggcagaaacatggagtgcttttgtataggccacctgtacataaaagtgtaattatttatttaattttcccatttgtatcatattaaagctttgtacagtgttttaagttctgttttaaaattattttgtattttatttttataacctagtaataaaatattcattccgcatgcaaaa

SEQ ID NO: 43551 - DNA, 2043 bp, Homo sapiens
aaaagtaaaacaaaaataaagtctatgcccattaagacgtcttctaattcagttgtgattgtctgctcctacttaaaaaaatatttaagcttgatgtttaattattccctttcagcaaatttggatcagaaaattaaagtatgtgacaagatcaggtcaccttgaatttccacacaatctcaagacactgaatagcaaaaaagtaacattacacagtaatgattaggatatttccttagactttgctggatctttggtcttaaggtaacatgtaaaagtagtgaagcctttcctttcatggccctgtgcaatgtaacggttttctgcctcctcttcagctggaagcgttagtggtagtatgggcacagaatatatgtacactggcgatgctgaccatgcctcccaggtaccctggctctgggttccttgacctagggaacaagattggatgaggcagatctttgagcccatgtgactatagaatttgctgatgatataattttacaataacaatggataggaattttacctctctttttattagtttaatattatttaatattatgtacataagtgttcactcgcctaattaaaaacattgagtaaaccaagtttttatatagactacccttgccatatgatgctctttttctctaataatatgcagtttaaatcctgaggaatcaatgcccagcatttcaccacatctgaactctgtgtgggcattcttcactcgcctacaaggggtaaacaaggctaccagaacttgaatttgacttatagggagctacccaggaaggggaaagcccttgggactttttccaaaacaatcttctatttgaactgttcatcagccaaagtagtccactgaggtgacaaagctttcagaaatacaaagatgggaagataaaggtaacactggcccacttggggctttgacattggattgggtggactgaataaacacagcctaggtggcctgggcttgagcctcacttacttctccttgatacatagttcctggtctaccttctgaccctttttctaaaatagccagtgtctatttcactaggccatttacttacaagttcccagcttttagggaaaaaagagggaggggggagcatctagttttgaattagatatacatcttagaagtaatgagctattggcagctgttaaatcagattcagccacaaaccagaattctttcttgttgaacaagaccaatgagttagatgactttaataattccacttttctctccctctcttctcctcttcctgaaatcagagagatgagaaactactctttgaaatacctccagaggcgttttattgtgttcctttcccctccaagcagctccctttatacaattttgctcaggcaaccaaggacagagtatcggcagaaacatggagtgcttttgtataggccacctgtacataaaagtgtaattatttatttaattttcccatttgtatcatattaaagctttgtacagtgttttaagttctgttttaaaattattttgtattttatttttataacctagtaataaaatattcattccgcatgcaaaaaaaaacacacacacaacccaaacaaccaaaaacaaacagaaccaaaagatagaaaccaaacacagcaacagacagacacaagagaagacgaaaacaaccacacaaacagcacacacaaccgcagcggagaaccaacaaagccaaacgcaagacagcacaacaagggacaaaacacacacgtagcacaaagcagccgcagaaccgaacacacatctaaagacaggcgacaacaacatagcaggccgtagcaccgacaaccactaaaccataactatccagcggagatcagatcacagaagccgacacagaaagaaaagcatgtatgcaacgcatgacaccgcagggcggataaaaacactcgtaggcgggaccgccgcagaacgatcgaaggctaacaaacaagctagtagatcacaagtacgtgaccacgccctcttatctataaaggaggaagagggag

SEQ ID NO: 43552 - DNA, 1202 bp, Homo sapiens
aaaagtaaaacaaaaataaagtctatgcccattaagacgtcttctaattcagttgtgattgtctgctcctacttaaaaaaatatttaagcttgatgtttaattattccctttcagcaaatttggatcagaaaattaaagtatgtgacaagatcaggtcaccttgaatttccacacaatctcaagacactgaatagcaaaaaagtaacattacacagtaatgattaggatatttccttagactttgctggatctttggtcttaaggtaacatgtaaaagtagtgaagcctttcctttcatggccctgtgcaatgtaacggttttctgcctcctcttcagctggaagcgttagtggtagtatgggcacagaatatatgtacactggcgatgctgaccatgcctcccaggtaccctggctctgggttccttgacctagggaacaagattggatgaggcagatctttgagcccatgtgactatagaatttgctgatgatataattttacaataacaatggataggaattttacctctctttttattagtttaatattatttaatattatgtacataagtgttcactcgcctaattaaaaacattgagtaaaccaagtttttatatagactacccttgccatatgatgctctttttctctaataatatgcagtttaaatcctgaggaatcaatgcccagcatttcaccacatctgaactctgtgtgggcattcttcactcgcctacaaggggtaaacaaggctaccagaacttgaatttgacttatagggagctacccaggaaggggaaagcccttgggactttttccaaaacaatcttctatttgaactgttcatcagccaaagtagtccactgaggtgacaaagctttcagaaatacaaagatgggaagataaagagagatgagaaactactctttgaaatacctccagaggcgttttattgtgttcctttcccctccaagcagctccctttatacaattttgctcaggcaaccaaggacagagtatcggcagaaacatggagtgcttttgtataggccacctgtacataaaagtgtaattatttatttaattttcccatttgtatcatattaaagctttgtacagtgttttaagttctgttttaaaattattttgtattttatttttataacctagtaataaaatattcattccgcatgcaaaa

SEQ ID NO: 43553 - DNA, 570 bp, Homo sapiens
ccactgtagacattactcgctttatattatttgctttcaaatactaaaacctcagctgctaattcagcgctctaggtgtacagtgtctccttcccttggctcctagcaatgtagggaacttgaggttcttcagtatcttcagagattccttccaggccacatatttttatgctaatacttctatagttgcattcaatcacagatgtgtcgggactttgcctcaggggagaggtactttagcacctgtgtcactgaggagatggagtggttgacaagtactgttgcgctgtgtaacttggggtttggccctccagaggcgttttattgtgttcctttcccctccaagcagctccctttatacaattttgctcaggcaaccaaggacagagtatcggcagaaacatggagtgcttttgtataggccacctgtacataaaagtgtaattatttatttaattttcccatttgtatcatattaaagctttgtacagtgttttaagttctgttttaaaattattttgtattttatttttataacctagtaataaaatattcattccgcatgcaaaa

SEQ ID NO: 43554 - DNA, 362 bp, Homo sapiens
gagcacagatgtgtgccactatgcctggcaaatttttaaattttatgtagagatgaggtctccctatgttgcccagactggcctcaaactcctgggctcaagggatcctcctacgtcagcctcccaaggtgctgagattacaggcttgtctcttgaccacttccaagccatgccctgttttttccacttttgttctccaggggtcctgggccaggggagctgtgtccaagtcctggtctctcaagccccagctctggttccactttgtccctgaagactgcttcaccactctaggtcacacgctcccctgacttcccacaggggttttagaagtatctccaagtccaagaaactgtgcagct

SEQ ID NO: 43555 - DNA, 968 bp, Homo sapiens
aaaataaaaaactcttactgctgtgttattatatttggaatatcttggatttttaaatttatagtctatatcgagggactacaagaaccatgtagaatattgttagacgaactaaaactccatctatgacctttgttctaatggtatgttttcagagaagagttttttaggatgtccagctacttggctgtttcacaaggtccccacagttaagaaatctcaagtatgtaattgtgatgggtctacgtgtgatctgtggcaaaaccatctagaccacctgaaccacatgccgtgtaggtttgtgctaaccagtagctcttgaggcaagcgataggacagaagaagctctgcctcaggcgagttaagaaaggagaatgcactcctactaaagttctttgtatgcttgtgcgtatttttgcaggtttagaatctttaaaccctgctttcttgatacaaacagagaaaaatccacttttctcgtggtcctgacacttttctccaactagtctttgtaaaatactgattctggcatttcatctgttctgcattttcatgggaatctgaacttaacagataaagtgggtgccattcctctttatatgattccattaaagaaggagttctcagattttatgctacccatccccctaaggaaagtaaagagggagtgcagggcagacagcatcgccgagcagccacccaccattggggctgccgattctcatctccagctcatgcagcgttacatgagtgagtttagtaatagcttctaaacatagtctacgtgattttatagcattgatacatgctgagacttggaggagaaaataaacatttaattagtagatatatcatgggttgatgaacttaggactttggatagaaactcaaacttcatttttctccctaggttattaaacaggaggttacttggttaaattgggttcataaagttaacttcagacttc

SEQ ID NO: 43556 - DNA, 604 bp, Homo sapiens
agaagtttcggaaggaagagtcttggcctgaagagcagttctaataaaatttgccctagctgatgggagtcctttagccaaagctgcctattggaatagttctgtcttccggaaatggatctgacttagtatcactgctgtgctcagtcactggctggaagaatgtggcctcaaagaaaagctgcgaatattgggctgaatttagaacctagcagctagctagggccaaggtcatttacattccccatgctgggagaactgaaaggcacattttcgtagctgtctcaatcagagattttccactgctttgggtcgctggctcccagtccaagggatggatccttggattgggtgagccaaggtcatgtgcctgtgttctgactgcaagggggacctgcttcccaccaagattcctaagccccctctcccaaataaaggggttcatatgctggacagcaacccccacaaaggacaaatgtccactatactgtgtgacctccttaagagcaaagatctttgtcttgctgattgcaattataaatatttacaaataaatgtttattgaagtaactgaatgccccacaatgctatatctgactaagta

SEQ ID NO: 43557 - DNA, 236 bp, Homo sapiens
ttttcacaaataatcctttgtcaattgtcacttgcacatacatccttgggcacccgtgcattgatttctagggatttctagaagtaaggagttaaatcttcgagaaatattgtcagattgactttccaaaaggatgcttccatttacacttgatcttctgtgtgtggccaatccccatgctctagccaacactggatagcgctgtcacttacagctcctctgatgggggaggtggg

SEQ ID NO: 43558 - DNA, 546 bp, Homo sapiens
  misc_feature (10)..(11): n is a, c, g, or t
  misc_feature (14)..(14): n is a, c, g, or t
acaaggcggnntcnccggcagcatgtcaggttcactgaatatgtaaaagatgggctgaaacacacgtgtgtgaaattctacattgagggctctgagccagggaagcaaggaacggtgtatgcgcaagtgaaagagaacccaggaagtggtgaatatgattttcgatatatatttgtagaaattgaatcttatcctagaagaactattatcattgaagataatcgatcccaagatgattaaaatagggtttctgatggatgttgaatggcgtggactcgctactccgttcttcacagctgccttccagaatgtgttcaaaagaaagacaagaaggagtgtatggcttataaagtgaatctaatacagtatttgttgcatttaaacaaactagacattttcttacggaaaaattatgaaatacagcatattttatgttctcccattgactcaatcatgacaatatttctgctttaacaccatctttcatgattagaaatgtttgttattggaaatgttacaccatgtaaataaaggaaatagatttta

SEQ ID NO: 43559 - DNA, 535 bp, Homo sapiens
aacggtgtatgcgcaagtgaaagaggtgtgggaatcatgggatgtggggtcagaggttctgagcgcggtgttatttaagttctggaaaggaaaataatacctggaaacactacatttttttcagaacccaggaagtggtgaatatgattttcgatatatatttgtagaaattgaatcttatcctagaagaactattatcattgaagataatcgatcccaagatgattaaaatagggtttctgatggatgttgaatggcgtggactcgctactccgttcttcacagctgccttccagaatgtgttcaaaagaaagacaagaaggagtgtatggcttataaagtgaatctaatacagtatttgttgcatttaaacaaactagacattttcttacggaaaaattatgaaatacagcatattttatgttctcccattgactcaatcatgacaatatttctgctttaacaccatctttcatgattagaaatgtttgttattggaaatgttacaccatgtaaataaaggaaatagatttta

SEQ ID NO: 43560 - DNA, 729 bp, Homo sapiens
  misc_feature (10)..(11): n is a, c, g, or t
  misc_feature (14)..(14): n is a, c, g, or t
acaaggcggnntcnccggcagcatgtcaggttcactgaatatgtaaaagatgggctgaaacacacgtgtgtgaaattctacattgagggctctgagccagggaagcaaggaacggtgtatgcgcaagtgaaagagaacccaggaagtggtgaatatgattttcgatatatatttgtagaaattgaatcttatcctagaagaactattatcattgaagataatcgatcccaagatgattaaaatagggtttctgatggatgttgaatggcgtggactcgctactccgttcttcacagctgccttccagaatgtgttcaaaagaaagacaagaaggagtgtatggcttataaagtgaatctaatacagtatttgttgcatttaaacaaactagacattttcttacggaaaaattatgaaatacagcatattttatgttctcccattgactcaatcatgacaatatttctgctttaacaccatctttcatgattagaaatgtttgttattggaaatgttacaccatgtaaataaaggaaatagattttagtattgtattcattttatattatagaactgcataatgtctgcagaataaaattaaaactaacaaatatgtcattagcagctgccctccgcatactttggaatctgacttgagataagcatgtgaaaatggttgagggccatagggaaccagatggtaaatacattcttcaaaattgtgtgagt

SEQ ID NO: 43561 - DNA, 1414 bp, Homo sapiens
  misc_feature (10)..(11): n is a, c, g, or t
  misc_feature (14)..(14): n is a, c, g, or t
acaaggcggnntcnccggcagcatgtcaggttcactgaatatgtaaaagatgggctgaaacacacgtgtgtgaaattctacattgagggctctgagccagggaagcaaggaacggtgtatgcgcaagtgaaagagaacccaggaagtggtgaatatgattttcgatatatatttgtagaaattgaatcttatcctagaagaactattatcattgaagataatcgatcccaagatgattaaaatagggtttctgatggatgttgaatggcgtggactcgctactccgttcttcacagctgccttccagaatgtgttcaaaagaaagacaagaaggagtgtatggcttataaagtgaatctaatacagtatttgttgcatttaaacaaactagacattttcttacggaaaaattatgaaatacagcatattttatgttctcccattgactcaatcatgacaatatttctgctttaacaccatctttcatgattagaaatgtttgttattggaaatgttacaccatgtaaataaaggaaatagattttagtattgtattcattttatattatagaactgcataatgtctgcagaataaaattaaaactaacaaataaaaaaaaaaaaaaaaaaaaaaaaaaaaaaaaaaaaaaaaaaaaaaaaaaaaaaacaaaacaattgagtgcggcggcgcgcgcgcgcagcgcccacgagaaaagatctcatcacaacaacacctaatgtgggaggagcggcgcgcgcgcgaccacaacagatagcagaagaaaacaagacgcgcgagagaaaaggggccacaggaagagaacaccggagagaaaacaaaaggggaggggggagctcctctaccacaaaataaaaagcacgcgggagggaagagacagaaagagacgggtttgagagacaacaccccagagaggaggagtactctggagggagcacagaggggcgaaaaataaaaaaaggggaagacagagaaagcgcggacgtaaataataaaaacccccaggccggcggggggggggggggagggggaaagagcaacaaggcgaaggtaggacgacgaagaacgacaacagcagcaagagagagacgaggagaacaaaagcaagagagaagcgagacgaaaacagagaaagaacaagagggtcacgaacgagagcacacgaagagaaaagcacaacagacacggaaaaacagaaacgagacgaaggaaaagcaaggaagagcagagaaagggacgaggagaaaggaagacaaagaggaggaggaggagacagaaaggagggagaggcacagcggaggacaccagaagcgaacagaagaacacgcaagacaagacaaggaaacccaaacagcacaagaggccagaaggaacgccgacgaggaaggcgcgaga

SEQ ID NO: 43562 - DNA, 470 bp, Homo sapiens
  misc_feature (10)..(11): n is a, c, g, or t
  misc_feature (14)..(14): n is a, c, g, or t
acaaggcggnntcnccggcagcatgtcaggttcactgaatatgtaaaagatgggctgaaacacacgtgtgtgaaattctacattgagggctctgagccagggaagcaaggaacggtgtatgcgcaagtgaaagagaacccaggaagtggtgaatatgattttcgatatatatttgtagaaattgaatcttatcctagaagaactattatcattgaagataatcgatcccaagatgattaaaatagggtttctgatggatgttgaatggcgtggactcgctactccgttcttcacagctgccttccagaatgtgttcaaaagaaagacaagaaggagtgtatggcagacaagacgatatgttaaaacacgatcagtgccaagtatagcatactagaaagttcgactacagagaaacctactgcaatacggcaaagcgtagtgtagaccacgatgcaatatgcacgccaggt

SEQ ID NO: 43563 - DNA, 391 bp, Homo sapiens
gatttcaaatacgccgtccttttgcccccataagtacactcaaactcgtgagaccatgtgcctctatttttaattatgaaaatatggacgctgtatctccaccagtggttagaactgtgaaacatcctaaccacaacgtccagaagggcgactgatcgcagagcttcaagtgatcttaactacgttatgtgttcctaacacactacagctgtgttccgcgtcagcgacgcagggcagaaccatcattgtattaacctttcccgctcatgggacgcggtgcttagtccccgggaaccgacaggggctccgccaacaactctgcgtcccgctctcgcggcccggacggcagcagcgcaggttaactggaaatggctggcaaggaaaacacctt

SEQ ID NO: 43564 - DNA, 1155 bp, Homo sapiens
atcgtctttttactttatttagaaacctgtttggaggttatggatgataaacccaatcctgaagccctaagtgacagttcagagcgtcttttctcctttggcgtcatcgcagatgttcaatttgcagacttagaagatggctttaatttccaaggaaccaggcggcgatactacagacatagtcttcttcacttacagggtgccattgaagactggaataatgaaagcagcatgccctgttgtgtccttcagcttggagatatcatcgatggatataatgcacagtataatgcatccaaaaagtccctagaacttgttatggacatgttcaagaggcttaaagttccagttcatcatacatggggaaaccatgaattctataacttcagtagagagtatttaacacactctaaacttaacactaagtttctagaagatcagattgtacatcatcctgagaccatgccttcagaagattattatgcttatcattttgtaccattccctaaattccggttcattttacttgatgcatatgacttgagtgtcttgggcgtggatcagtcttctccaaaatacgagcagtgtatgaagatattgagggagcacaatccaaatacggaactgaatagtcctcaaggactttctgagccccagtttgtccagtttaatggaggattcagccaagaacagctaaactggttgaatgaagtgctaacattctctgacacaaaccaagaaaaggtggtgattgtgagccatcttcccatttacccggacgcctctgacaatgtgtgcctggcctggaactacagagatgccctggcagtcatttggtctcatgagtgtgtggtgtgtttctttgctggtcacacccatgatggtggctactctgaggatccttttggtgtataccacgtcaacctagaaggagttattgaaacagctccagacagccaagcctttggcacagttcatgtctatcctgacaaaatgatgttgaaagggagaggcagagttccagatagaattatgaattacaagaaaggaagagccttccattgttagtctaatttattttaacttgatagaaaatgagctttgtgtttgtccctcctaaacaaaaaaataaaaatcctctgtctcattgtttag

SEQ ID NO: 43565 - DNA, 1526 bp, Homo sapiens
ggcgctgttacatagcccgtagtcagaggcctttcagcccaggggccggcgcacgaaacctgtttggaggttatggatgataaacccaatcctgaagccctaagtgacagttcagagcgtcttttctcctttggcgtcatcgcagatgttcaatttgcagacttagaagatggctttaatttccaaggaaccaggcggcgatactacagacatagtcttcttcacttacagggtgccattgaagactggaataatgaaagcagcatgccctgttgtgtccttcagcttggagatatcatcgatggatataatgcacagtataatgcatccaaaaagtccctagaacttgttatggacatgttcaagaggcttaaagttccagttcatcatacatggggaaaccatgaattctataacttcagtagagagtatttaacacactctaaacttaacactaagtttctagaagatcagattgtacatcatcctgagaccatgccttcagaagattattatgcttatcattttgtaccattccctaaattccggttcattttacttgatgcatatgacttgagtgtcttgggcgtggatcagtcttctccaaaatacgagcagtgtatgaagatattgagggagcacaatccaaatacggaactgaatagtcctcaaggtgaattattcctttgagctgagaatctaatagattgtctttaaattcttcagctaccttttattcagcaggaagatggacaattaaggactttctgagccccagtttgtccagtttaatggaggattcagccaagaacagctaaactggttgaatgaagtgctaacattctctgacacaaaccaagaaaaggtggtgattgtgagccatcttcccatttacccggacgcctctgacaatgtgtgcctggcctggaactacagagatgccctggcagtcatttggtctcatgagtgtgtggtgtgtttctttgctggtcacacccatgatggtggctactctgaggatccttttggtgtataccacgtcaacctagaaggagttattgaaacagctccagacagccaagcctttggcacagttcatgtctatcctgacaaaatgatgttgaaagggagaggcagagttccagatagaattatgaattacaagaaaggaagagccttccattgttagtctaatttattttaacttgatagaaaatgagctttgtgtttgtccctcctaaacaaaaaaataaaaatcctctgtctcattgtttaggtaaaaaaaaaataataacaaaaagtgatgagaaaaaacaaatgagaaagtataagagaggagcgagtaggaataggagaaatgatggggagctagcatggaaatctggataggggcgagtggtgttgtagtcgctggtgttgggtagatattacaggtgtaggtcgttggtgtggaggggggtcctggtgggggtggctgaatacgtgtgcggtgtgggcggttgagggggtgggtgcggtgttgggtg

SEQ ID NO: 43566 - DNA, 1223 bp, Homo sapiens
ggcgctgttacatagcccgtagtcagaggcctttcagcccaggggccggcgcacgaaacctgtttggaggttatggatgataaacccaatcctgaagccctaagtgacagttcagagcgtcttttctcctttggcgtcatcgcagatgttcaatttgcagacttagaagatggctttaatttccaaggaaccaggcggcgatactacagacatagtcttcttcacttacagggtgccattgaagactggaataatgaaagcagcatgccctgttgtgtccttcagcttggagatatcatcgatggatataatgcacagtataatgcatccaaaaagtccctagaacttgttatggacatgttcaagaggcttaaagttccagttcatcatacatggggaaaccatgaattctataacttcagtagagagtatttaacacactctaaacttaacactaagtttctagaagatcagattgtacatcatcctgagaccatgccttcagaagattattatgcttatcattttgtaccattccctaaattccggttcattttacttgatgcatatgacttgagtgtcttgggcgtggatcagtcttctccaaaatacgagcagtgtatgaagatattgagggagcacaatccaaatacggaactgaatagtcctcaaggtgaattattcctttgagctgagaatctaatagattgtctttaaattcttcagctaccttttattcagcaggaagatggacaattaaggactttctgagccccagtttgtccagtttaatggaggattcagccaagaacagctaaactggttgaatgaagtgctaacattctctgacacaaaccaatgtgtgcctggcctggaactacagagatgccctggcagtcatttggtctcatgagtgtgtggtgtgtttctttgctggtcacacccatgatggtggctactctgaggatccttttggtgtataccacgtcaacctagaaggagttattgaaacagctccagacagccaagcctttggcacagttcatgtctatcctgacaaaatgatgttgaaagggagaggcagagttccagatagaattatgaattacaagaaaggaagagccttccattgttagtctaatttattttaacttgatagaaaatgagctttgtgtttgtccctcctaaacaaaaaaataaaaatcctctgtctcattgtttag

SEQ ID NO: 43567 - DNA, 415 bp, Homo sapiens
cttcttttctttaactaacaggccatcttcccatttacccggacgcctctgacaatgtgtgcctggcctggaactacagagatgccctggcagtcatttggtctcatgagtgtgtggtgtgtttctttgctggtcacacccatgatggtggctactctgaggatccttttggtgtataccacgtcaacctagaaggagttattgaaacagctccagacagccaagcctttggcacagttcatgtctatcctgacaaaatgatgttgaaagggagaggcagagttccagatagaattatgaattacaagaaaggaagagccttccattgttagtctaatttattttaacttgatagaaaatgagctttgtgtttgtccctcctaaacaaaaaaataaaaatcctctgtctcattgt

SEQ ID NO: 43568 - DNA, 1276 bp, Homo sapiens
ggcgctgttacatagcccgtagtcagaggcctttcagcccaggggccggcgcacgaaacctgtttggaggttatggatgataaacccaatcctgaagccctaagtgacagttcagagcgtcttttctcctttggcgtcatcgcagatgttcaatttgcagacttagaagatggctttaatttccaaggaaccaggcggcgatactacagacatagtcttcttcacttacagggtgccattgaagactggaataatgaaagcagcatgccctgttgtgtccttcagcttggagatatcatcgatggatataatgcacagtataatgcatccaaaaagtccctagaacttgttatggacatgttcaagaggcttaaagttccagttcatcatacatggggaaaccatgaattctataacttcagtagagagtatttaacacactctaaacttaacactaagtttctagaagatcagattgtacatcatcctgagaccatgccttcagaagattattatgcttatcattttgtaccattccctaaattccggttcattttacttgatgcatatgacttgagtgtcttgggcgtggatcagtcttctccaaaatacgagcagtgtatgaagatattgagggagcacaatccaaatacggaactgaatagtcctcaaggtgaattattcctttgagctgagaatctaatagattgtctttaaattcttcagctaccttttattcagcaggaagatggacaattaaggactttctgagccccagtttgtccagtttaatggaggattcagccaagaacagctaaactggttgaatgaagtgctaacattctctgacacaaaccaagaaaaggtggtgattgtgagccatcttcccatttacccggacgcctctgacaatgtgtgcctggcctggaactacagagatgccctggcagtcatttggtctcatgagtgtgtggtgtgtttctttgctggtcacacccatgatggtggctactctgaggatccttttggtgtataccacgtcaacctagaaggagttattgaaacagctccagacagccaagcctttggcacagttcatgtctatcctgacaaaatgatgttgaaagggagaggcagagttccagatagaattatgaattacaagaaaggaagagccttccattgttagtctaatttattttaacttgatagaaaatgagctttgtgtttgtccctcctaaacaaaaaaataaaaatcctctgtctcattgtttag

SEQ ID NO: 43569 - DNA, 1416 bp, Homo sapiens
ggcgctgttacatagcccgtagtcagaggcctttcagcccaggggccggcgcacgaaacctgtttggaggttatggatgataaacccaatcctgaagccctaagtgacagttcagagcgtcttttctcctttggcgtcatcgcagatgttcaatttgcagacttagaagatggctttaatttccaaggaaccaggcggcgatactacagacatagtcttcttcacttacagggtgccattgaagactggaataatgaaagcagcatgccctgttgtgtccttcagcttggagatatcatcgatggatataatgcacagtataatgcatccaaaaagtccctagaacttgttatggacatgttcaagaggcttaaagttccagttcatcatacatggggaaaccatgaattctataacttcagtagagagtatttaacacactctaaacttaacactaagtttctagaagatcagattgtacatcatcctgagaccatgccttcagaagattattatgcttatcattttgtaccattccctaaattccggttcattttacttgatgcatatgacttgagtgtcttgggcgtggatcagtcttctccaaaatacgagcagtgtatgaagatattgagggagcacaatccaaatacggaactgaatagtcctcaaggtgaattattcctttgagctgagaatctaatagattgtctttaaattcttcagctaccttttattcagcaggaagatggacaattaaggactttctgagccccagtttgtccagtttaatggaggattcagccaagaacagctaaactggttgaatgaagtgctaacattctctgacacaaaccaagaaaaggtggtgattgtgagccatcttcccatttacccggacgcctctgacaatgtgtgcctggcctggaactacagagatgccctggcagtcatttggtctcatgagtgtgtggtgtgtttctttgctggtcacacccatgatggtggctactctgaggatccttttggtgtataccacgtcaacctagaaggagttattgaaacagctccagacagccaagcctttggcacagttcatgtctatcctgacaaaatgatgttgaaagggagaggcagagttccagatagaattatgaattacaagaaaggaagagccttccattgttagtctaatttattttaacttgatagaaaatgagctttgtgtttgtccctcctaaacaaaaaaataaaaatcctctgtctcattgtttagtattcagcttgcataacaaaatgtatttatagtttcagtgtgtgatggttgataaaatactcagaaatgttattttggatcatgtatccattgtaagttagaaacaaaccagggaggaaactgaggcaggggtgtatagt

SEQ ID NO: 43570 - DNA, 1035 bp, Homo sapiens
atcgtctttttactttatttagaaacctgtttggaggttatggatgataaacccaatcctgaagccctaagtgacagttcagagcgtcttttctcctttggcgtcatcgcagatgttcaatttgcagacttagaagatggctttaatttccaaggaaccaggcggcgatactacagacatagtcttcttcacttacagggtgccattgaagactggaataatgaaagcagcatgccctgttgtgtccttcagcttggagatatcatcgatggatataatgcacagtataatgcatccaaaaagtccctagaacttgttatggacatgttcaagaggcttaaagttccagttcatcatacatggggaaaccatgaattctataacttcagtagagagtatttaacacactctaaacttaacactaagtttctagaagatcagattgtacatcatcctgagaccatgccttcagaagattattatgcttatcattttgtaccattccctaaattccggttcattttacttgatgcatatgacttgagtgtcttgggcgtggatcagtcttctccaaaatacgagcagtgtatgaagatattgagggagcacaatccaaatacggaactgaatagtcctcaaggactttctgagccccagtttgtccagtttaatggaggattcagccaagaacagctaaactggttgaatgaagtgctaacattctctgacacaaaccaagaaaaggtggtgattgtgagccatcttcccatttacccggacgcctctgacaatgtgtgcctggcctggaactacagagatgccctggcagtcatttggtctcatgagtgtgtggtgtgtttctttgctggtcacacccatgatggtggctactctgaggatccttttggtgtatccttctcaacctttactgcactattgaaatccctttttctagtcttttctttctaccattttttggctatctttaccttctgatgtctatcgtgttaggacttttcttatttttttctcccc

SEQ ID NO: 43571 - DNA, 417 bp, Homo sapiens
taaaagcaaacccctcactgctgctgtataaagttgccctaatgtaaatgtctattgtttaagtcccctaggtcacctttgtgctgtgctgtggagttcagaaacggggtacccatgacctggaatcttttgcctcttgtttttgcagtcttcaaggctgggggccctgtctcattgggaagcccctctttataaagcattatattacttggaatggcttggtcaactgtgttcagttcataaatatgttttacatttttatctgcctgttataaagatgaacaaaaaaacttaatgagaaagatcacagatacgtaataatttaaagtctgtagttgaatttcctaacttaaagaatagaccaaaatttctgtgtataaaaaaaaatgaaaggctccttacatcctggtctgggta

SEQ ID NO: 43572 - DNA, 342 bp, Homo sapiens
caccatgaatcccacctttcttgcctgcattttctctttccctcactgctgcttgttcctttctctgctggccaagagactctcttaggtctccctttgggtaaagaaaaaaaaactactttaactttgctgcctccaggaaccaggcccctcctccccttcactccacactccttgaaaatgtagtccatgttgccactgccaaagccgtgtccctcccggctgccctggggaaacatttcctctaagggtcctcagcgtcctcctcgcagcccacctgtaaccaaggcctggtcttgttcctcacaatccagacactgcatgctaccccgtctagagggg

SEQ ID NO: 43573 - DNA, 353 bp, Homo sapiens
tgactaaacacttggttctgacttgctttctcacccatattccaacaacttattctagtctactgtaatcccagttataaaactgtcactgacatcatctgttgcaaaaaaattatttacaactggatccatcatcaactcagtctacactaccagctttgaattccaaagcaattccacaccacaatccacatctgtattctcaaatccactttgatacagtttcccaagtccactttgatacagttacctctttagaaagatattagaatgacaaattttctggaaacaggttttcttcggggctggggctggaaggacattaaattaaaaagatggacctggcttaagac

SEQ ID NO: 43574 - DNA, 598 bp, Homo sapiens
agggttgcagaggcgccgagggctgggggggctgccggggctgccgggccctcgtgcaggctcctccccgcagcctcgcggccgggcctggagaccgcgtgcccggacgccgccgccagcctcgtgggccgcaaaggggcgggggcggcccctggcggcgggaggactcggccgcccgagggaccccgggccaggctccggggtcgccccggctgggtctctgcggccccacagctctgggcggggatgggggcgccggcgcctacgcgcgaggccaaccgggggaaaccgaggcagtgaatggcccaggccccgcccggttatcccggagccaggccgggagcgcccagtgtcccgcgaccgcagccgccgcagcctgaactcgtcccctcccagtaggatgcggagcgcggcccttccatcctgtccctgccaccgttgcttccccacgccgggccgccgtcgggatgggcagacggcgcggccggtacccgaggcctgcgagcgcgaggcccgcggggcgctgcggagccgggagcgcggagccggggcgggggacagacaaaggcggggacggcggcgaggggaagacaaagcg

SEQ ID NO: 43575 - DNA, 1982 bp, Homo sapiens
gcggtggcggcggcggtggctcggggtccactggtagcggcagcagctcgcgcccgcgccctcctcgtacccgtgcgcccccggagaccgatcccgccccgcggcccaggccgggcctggtgagagccgcggggggaggggccgcgtccggctccggaaccgggagaggcgccgaggggtgtggggtgagggccgcccgtggggtcccggcgagtctgcgagccgctctcgcccggggcgcacaggctcgagtcctcgtttcagggccggcccccggctgggcggagccgagacccgctggcggggctcgcggcgtcggggtctggggtccggtcctcgcggggccaggtcgggggccgaggggcggggcgggcggggacctcgggcgctgtccaggggctgcgcagcctaggcctggacgcccgggcgcggcgcagggcagcgagggccggggtcaggtcggggcagcggcttctcatcgcggccccgccggccccgacctcccctcaccccaagcggtcccagcccgcgggacgcacacggcggctgcgcgggagcccccggcccctccgctcccgctaactttgttcttccgagggacggtgccactcgggaccccggcccctggggagcaggggtgggggaggtgggtgaggggcggaagtggcaagaccaagagcaacaggaaatgacttagggaaagtcccaaccgcaatccccccagaccctgcctgtcaacaccccccaccctgcaggctggggccgggctggcggggccctcccgactgacttccccttgcagaacccagcgggtgccgcttctccacccgaggcttccacctccaacgagccatgttccaggctgcaggagccgcccaggccaccccctctcatgacgccaaaggcggcggcagcagcacggtgcagcgctccaagtccttcagcctgcgggcccaggtgaaggagacctgcgccgcctgccagaagaccgtgtaccccatggagcggctggtggccgacaagctcattttccacaactcttgcttctgctgcaagcactgtcacaccaagctcagcctgggcagctacgccgcgctgcacggggagttctactgcaaaccccacttccagcagctgtttaagagcaaaggcaactacgacgaggggtttggccgcaagcagcacaaggagctctgggcccacaaggaggtggaccccggcaccaagacggcctgaggcctctgtaaccttccaccccctctgcggaaggcctggagccggcagggggaaggtgggaaggaggtcgagctgggcttgcgtgggggccaggtgggaaggggatgaggcttgctcaggcgtaggggaccagggcagggctctgctccaggactccttccttcttccttctcccgcagccggtgagggtttggaaaccaggattggggtctgcccaccaccctgcttcctgcttcgttcagcctccctccccacctcaccccaggaccccctgggaggcccccaagcccagctcccctatctaggtgccttttctccagcaaggagtcagcatgcccccctcagggtcccaagctccctcactgccaccggagactgtgtggcccccacgtctccccatctacctctacccttaacctgtttctgagccacggagacagggaggaaggagcgcgacagtgccacctgttgggcatcataaatgcccctgcagcccatgggggaggagatggggaagtggagccaccctgcctctgcagggcaaggcagggcctgccccagtggggcttgggaccatctcgaaccaccagcgtggagaagcagaagcaaaagcactcgccaggctgcagcctcaggcactggcaggggctggtgcggccccactcccctcccccgctcccatttgtgcccatcctgttgtgaccaaccccgttttaaacatgtttcaatagatccagattctctat

SEQ ID NO: 43576 - DNA, 1346 bp, Homo sapiens
gcggtggcggcggcggtggctcggggtccactggtagcggcagcagctcgcgcccgcgccctcctcgtacccgtgcgcccccggagaccgatcccgccccgcggcccaggccgggcctggctggggccgggctggcggggccctcccgactgacttccccttgcagaacccagcgggtgccgcttctccacccgaggcttccacctccaacgagccatgttccaggctgcaggagccgcccaggccaccccctctcatgacgccaaaggcggcggcagcagcacggtgcagcgctccaagtccttcagcctgcgggcccaggtgaaggagacctgcgccgcctgccagaagaccgtgtaccccatggagcggctggtggccgacaagctcattttccacaactcttgcttctgctgcaagcactgtcacaccaagctcagcctgggcagctacgccgcgctgcacggggagttctactgcaaaccccacttccagcagctgtttaagagcaaaggcaactacgacgaggggtttggccgcaagcagcacaaggagctctgggcccacaaggaggtggaccccggcaccaagacggcctgaggcctctgtaaccttccaccccctctgcggaaggcctggagccggcagggggaaggtgggaaggaggtcgagctgggcttgcgtgggggccaggtgggaaggggatgaggcttgctcaggcgtaggggaccagggcagggctctgctccaggactccttccttcttccttctcccgcagccggtgagggtttggaaaccaggattggggtctgcccaccaccctgcttcctgcttcgttcagcctccctccccacctcaccccaggaccccctgggaggcccccaagcccagctcccctatctaggtgccttttctccagcaaggagtcagcatgcccccctcagggtcccaagctccctcactgccaccggagactgtgtggcccccacgtctccccatctacctctacccttaacctgtttctgagccacggagacagggaggaaggagcgcgacagtgccacctgttgggcatcataaatgcccctgcagcccatgggggaggagatggggaagtggagccaccctgcctctgcagggcaaggcagggcctgccccagtggggcttgggaccatctcgaaccaccagcgtggagaagcagaagcaaaagcactcgccaggctgcagcctcaggcactggcaggggctggtgcggccccactcccctcccccgctcccatttgtgcccatcctgttgtgaccaaccccgttttaaacatgtttcaatagatccagattctctat

SEQ ID NO: 43577 - DNA, 1641 bp, Homo sapiens
gcggtggcggcggcggtggctcggggtccactggtagcggcagcagctcgcgcccgcgccctcctcgtacccgtgcgcccccggagaccgatcccgccccgcggcccaggccgggcctgaacccagcgggtgccgcttctccacccgaggcttccacctccaacgagccatgttccaggctgcaggagccgcccaggccaccccctctcatgacgccaaaggcggcggcagcagcacggtgcagcgctccaagtccttcagcctgcgggcccaggtgaaggagacctgcgccgcctgccagaagaccgtgtaccccatggagcggctggtggccgacaagctcattttccacaactcttgcttctgctgcaagcactgtcacaccaagctcagcctgggcagctacgccgcgctgcacggggagttctactgcaaaccccacttccagcagctgtttaagagcaaaggcaactacgacgaggggtttggccgcaagcagcacaaggagctctgggcccacaaggaggtggaccccggcaccaagacggcctgaggcctctgtaaccttccaccccctctgcggaaggcctggagccggcagggggaaggtgggaaggaggtcgagctgggcttgcgtgggggccaggtgggaaggggatgaggcttgctcaggcgtaggggaccagggcagggctctgctccaggactccttccttcttccttctcccgcagccggtgagggtttggaaaccaggattggggtctgcccaccaccctgcttcctgcttcgttcagcctccctccccacctcaccccaggaccccctgggaggcccccaagcccagctcccctatctaggtgccttttctccagcaaggagtcagcatgcccccctcagggtcccaagctccctcactgccaccggagactgtgtggcccccacgtctccccatctacctctacccttaacctgtttctgagccacggagacagggaggaaggagcgcgacagtgccacctgttgggcatcataaatgcccctgcagcccatgggggaggagatggggaagtggagccaccctgcctctgcagggcaaggcagggcctgccccagtggggcttgggaccatctcgaaccaccagcgtggagaagcagaagcaaaagcactcgccaggctgcagcctcaggcactggcaggggctggtgcggccccactcccctcccccgctcccatttgtgcccatcctgttgtgaccaaccccgttttaaacatgtttcaatagatccagattctctataaaaaaaaaaaaaaaaaaaaaaaacaaacaaaaaaaaaaaaaaaaaaaaaaaaaaaagagagggggggggcgcccaaaaaaaatccccgcgggggggccccgagaaggcgcgcccccgctttgggggaaacagagaaggggcccgccccaataagggagccgccctgttattaaaacagcctacacaagccgggggccccgcgtttaacacacgtgggccgcgcgggaacaaaccgctgtcacctggcgcacaacctggggggaagcgaccccacactgcggcgcggggcaccaaagtggccaaacacccccgacaggattaacgctcgcggggacaaataa

SEQ ID NO: 43578 - DNA, 1326 bp, Homo sapiens
  misc_feature (939)..(939): n is a, c, g, or t
gcggtggcggcggcggtggctcggggtccactggtagcggcagcagctcgcgcccgcgccctcctcgtacccgtgcgcccccggagaccgatcccgccccgcggcccaggccgggcctgaacccagcgggtgccgcttctccacccgaggcttccacctccaacgagccatgttccaggctgcaggagccgcccaggccaccccctctcatgacgccaaaggcggcggcagcagcacggtgcagcgctccaagtccttcagcctgcgggcccaggtgaaggagacctgcgccgcctgccagaagaccgtgtaccccatggagcggctggtggccgacaagctcattttccacaactcttgcttctgctgcaagcactgtcacaccaagctcagcctgggcagctacgccgcgctgcacggggagttctactgcaaaccccacttccagcagctgtttaagagcaaaggcaactacgacgaggggtttggccgcaagcagcacaaggagctctgggcccacaaggaggtggaccccggcaccaagacggcctgaggcctctgtaaccttccaccccctctgcggaaggcctggagccggcagggggaaggtgggaaggaggtcgagctgggcttgcgtgggggccaggtgggaaggggatgaggcttgctcaggcgtaggggaccagggcagggctctgctccaggactccttccttcttccttctcccgcagccggtgagggtttggaaaccaggattggggtctgcccaccaccctgcttcctgcttcgttcagcctccctccccacctcaccccaggaccccctgggaggcccccaagcccagctcccctatctaggtgccttttctccagcaaggagtcagcatgcccccctcagggtcccaagctccctcactgccaccggaaaaaggaagaaancctttgggtttggggactgtgtggcccccacgtctccccatctacctctacccttaacctgtttctgagccacggagacagggaggaaggagcgcgacagtgccacctgttgggcatcataaatgcccctgcagcccatgggggaggagatggggaagtggagccaccctgcctctgcagggcaaggcagggcctgccccagtggggcttgggaccatctcgaaccaccagcgtggagaagcagaagcaaaagcactcgccaggctgcagcctcaggcactggcaggggctggtgcggccccactcccctcccccgctcccatttgtgcccatcctgttgtgaccaaccccgttttaaacatgtttcaatagatccagattctctat

SEQ ID NO: 43579 - DNA, 1220 bp, Homo sapiens
gcggtggcggcggcggtggctcggggtccactggtagcggcagcagctcgcgcccgcgccctcctcgtacccgtgcgcccccggagaccgatcccgccccgcggcccaggccgggcctgaacccagcgggtgccgcttctccacccgaggcttccacctccaacgagccatgttccaggctgcaggagccgcccaggccaccccctctcatgacgccaaaggcggcggcagcagcacggtgcagcgctccaagtccttcagcctgcgggcccaggtgaaggagacctgcgccgcctgccagaagaccgtgtaccccatggagcggctggtggccgacaagctcattttccacaactcttgcttctgctgcaagcactgtcacaccaagctcagcctgggcagctacgccgcgctgcacggggagttctactgcaaaccccacttccagcagctgtttaagagcaaaggcaactacgacgaggggtttggccgcaagcagcacaaggagctctgggcccacaaggaggtggaccccggcaccaagacggcctgaggcctctgtaaccttccaccccctctgcggaaggcctggagccggcagggggaaggtgggaaggaggtcgagctgggcttgcgtgggggccaggtgggaaggggatgaggcttgctcaggcgtaggggaccagggcagggctctgctccaggactccttccttcttccttctcccgcagccggtgagggtttggaaaccaggattggggtctgcccaccaccctgcttcctgcttcgttcagcctccctccccacctcaccccaggaccccctgggaggcccccaagcccagctcccctatctaggtgccttttctccagcaaggagtcagcatgcccccctcagggtcccaagctccctcactgccaccggagactgtgtggcccccacgtctccccatctacctctacccttaacctgtttctgagccacggagacagggaggaaggagcgcgacagtgccacctgttgggcatcataaatgcccctgcagcccatctcgaaccaccagcgtggagaagcagaagcaaaagcactcgccaggctgcagcctcaggcactggcaggggctggtgcggccccactcccctcccccgctcccatttgtgcccatcctgttgtgaccaaccccgttttaaacatgtttcaatagatccagattctctat

SEQ ID NO: 43580 - DNA, 1134 bp, Homo sapiens
gcggtggcggcggcggtggctcggggtccactggtagcggcagcagctcgcgcccgcgccctcctcgtacccgtgcgcccccggagaccgatcccgccccgcggcccaggccgggcctgaacccagcgggtgccgcttctccacccgaggcttccacctccaacgagccatgttccaggctgcaggagccgcccaggccaccccctctcatgacgccaaaggcggcggcagcagcacggtgcagcgctccaagtccttcagcctgcgggcccaggtgaaggagacctgcgccgcctgccagaagaccgtgtaccccatggagcggctggtggccgacaagctcattttccacaactcttgcttctgctgcaagcactgtcacaccaagctcagcctgggcagctacgccgcgctgcacggggagttctactgcaaaccccacttccagcagctgtttaagagcaaaggcaactacgacgaggggtttggccgcaagcagcacaaggagctctgggcccacaaggaggtggaccccggcaccaagacggcctgaggcctctgtaaccttccaccccctctgcggaaggcctggagccggcagggggaaggtgggaaggaggtcgagctgggcttgcgtgggggccaggtgggaaggggatgaggcttgctcaggcgtaggggaccagggcagggctctgctccaggactccttccttcttccttctcccgcagccggtgagggtttggaaaccaggattggggtctgcccaccaccctgcttcctgcttcgttcagcctccctccccacctcaccccaggaccccctgggaggcccccaagcccagctcccctatctaggtgccttttctccagcaaggagtcagcatgcccccctcagggtcccaagctccctcactgccaccggagactgtgtggcccccacgtctccccatctacctctacccttaacctgtttctgagccacggagacagggaggaaggagcgcgacagtgccacctcaggcactggcaggggctggtgcggccccactcccctcccccgctcccatttgtgcccatcctgttgtgaccaaccccgttttaaacatgtttcaatagatccagattctctat

SEQ ID NO: 43581 - DNA, 350 bp, Homo sapiens
ggggctggtgcggccccactcccctcccccgctcccatttgtgcccatcctgttgtgaccaaccccgttttaaacatgtttcaatagatccagattctctatttctctattgtgtggcctgctgggggatctgtcacaggaagggtgcagactcaccatggggcgggcatggggggacagggccagccccgactacctcggccctgatgggggcagggagctagaagtgggtgtcagttccctgacacaccattgagaaatgggagggctcctcttcacagcgagggcttcatgctgtcacacccacagtggttttggaactgaaactccacctcacccctcagttctgg

SEQ ID NO: 43582 - DNA, 1299 bp, Homo sapiens
gcggtggcggcggcggtggctcggggtccactggtagcggcagcagctcgcgcccgcgccctcctcgtacccgtgcgcccccggagaccgatcccgccccgcggcccaggccgggcctgaacccagcgggtgccgcttctccacccgaggcttccacctccaacgagccatgttccaggctgcaggagccgcccaggccaccccctctcatgacgccaaaggcggcggcagcagcacggtgcagcgctccaagtccttcagcctgcgggcccaggtgaaggagacctgcgccgcctgccagaagaccgtgtaccccatggagcggctggtggccgacaagctcattttccacaactcttgcttctgctgcaagcactgtcacaccaagctcagcctgggcagctacgccgcgctgcacggggagttctactgcaaaccccacttccagcagctgtttaagagcaaaggcaactacgacgaggggtttggccgcaagcagcacaaggagctctgggcccacaaggaggtggaccccggcaccaagacggcctgaggcctctgtaaccttccaccccctctgcggaaggcctggagccggcagggggaaggtgggaaggaggtcgagctgggcttgcgtgggggccaggtgggaaggggatgaggcttgctcaggcgtaggggaccagggcagggctctgctccaggactccttccttcttccttctcccgcagccggtgagggtttggaaaccaggattggggtctgcccaccaccctgcttcctgcttcgttcagcctccctccccacctcaccccaggaccccctgggaggcccccaagcccagctcccctatctaggtgccttttctccagcaaggagtcagcatgcccccctcagggtcccaagctccctcactgccaccggagactgtgtggcccccacgtctccccatctacctctacccttaacctgtttctgagccacggagacagggaggaaggagcgcgacagtgccacctgttgggcatcataaatgcccctgcagcccatgggggaggagatggggaagtggagccaccctgcctctgcagggcaaggcagggcctgccccagtggggcttgggaccatctcgaaccaccagcgtggagaagcagaagcaaaagcactcgccaggctgcagcctcaggcactggcaggggctggtgcggccccactcccctcccccgctcccatttgtgcccatcctgttgtgaccaaccccgttttaaacatgtttcaatagatccagattctctat

SEQ ID NO: 43583 - DNA, 1528 bp, Homo sapiens
gcggtggcggcggcggtggctcggggtccactggtagcggcagcagctcgcgcccgcgccctcctcgtacccgtgcgcccccggagaccgatcccgccccgcggcccaggccgggcctggtgagagccgcggggggaggggccgcgtccggctccggaaccgggagaggcgccgaggggtgtggggtgagggccgcccgtggggtcccggcgagtctgcgagccgctctcgcccggggcgcacaggctcgagtcctcgtttcagggccggcccccggctgggcggagccgagacccgctggcggggctcgcggcgtcggggtctggggtccggtcctcgcggggccagaacccagcgggtgccgcttctccacccgaggcttccacctccaacgagccatgttccaggctgcaggagccgcccaggccaccccctctcatgacgccaaaggcggcggcagcagcacggtgcagcgctccaagtccttcagcctgcgggcccaggtgaaggagacctgcgccgcctgccagaagaccgtgtaccccatggagcggctggtggccgacaagctcattttccacaactcttgcttctgctgcaagcactgtcacaccaagctcagcctgggcagctacgccgcgctgcacggggagttctactgcaaaccccacttccagcagctgtttaagagcaaaggcaactacgacgaggggtttggccgcaagcagcacaaggagctctgggcccacaaggaggtggaccccggcaccaagacggcctgaggcctctgtaaccttccaccccctctgcggaaggcctggagccggcagggggaaggtgggaaggaggtcgagctgggcttgcgtgggggccaggtgggaaggggatgaggcttgctcaggcgtaggggaccagggcagggctctgctccaggactccttccttcttccttctcccgcagccggtgagggtttggaaaccaggattggggtctgcccaccaccctgcttcctgcttcgttcagcctccctccccacctcaccccaggaccccctgggaggcccccaagcccagctcccctatctaggtgccttttctccagcaaggagtcagcatgcccccctcagggtcccaagctccctcactgccaccggagactgtgtggcccccacgtctccccatctacctctacccttaacctgtttctgagccacggagacagggaggaaggagcgcgacagtgccacctgttgggcatcataaatgcccctgcagcccatgggggaggagatggggaagtggagccaccctgcctctgcagggcaaggcagggcctgccccagtggggcttgggaccatctcgaaccaccagcgtggagaagcagaagcaaaagcactcgccaggctgcagcctcaggcactggcaggggctggtgcggccccactcccctcccccgctcccatttgtgcccatcctgttgtgaccaaccccgttttaaacatgtttcaatagatccagattctctat

SEQ ID NO: 43584 - DNA, 1714 bp, Homo sapiens
agggttgcagaggcgccgagggctgggggggctgccggggctgccgggccctcgtgcaggctcctccccgcagcctcgcggccgggcctggagaccgcgtgcccggacgccgccgccagcctcgtgggccgcaaaggggcgggggcggcccctggcggcgggaggactcggccgcccgagggaccccgggccaggctccggggtcgccccggctgggtctctgcggccccacagctctgggcggggatgggggcgccggcgcctacgcgcgaggccaaccgggggaaaccgaggcagtgaatggcccaggccccgcccggttatcccggagccaggccgggagcgcccagtgtcccgcgaccgcagccgccgcagcctgaactcgtcccctcccagtaggatgcggagcgcggcccttccatcctgtccctgccaccgttgcttccccacgccgggccgccgtcgggatgggcagacggcgcggccggctggggccgggctggcggggccctcccgactgacttccccttgcagaacccagcgggtgccgcttctccacccgaggcttccacctccaacgagccatgttccaggctgcaggagccgcccaggccaccccctctcatgacgccaaaggcggcggcagcagcacggtgcagcgctccaagtccttcagcctgcgggcccaggtgaaggagacctgcgccgcctgccagaagaccgtgtaccccatggagcggctggtggccgacaagctcattttccacaactcttgcttctgctgcaagcactgtcacaccaagctcagcctgggcagctacgccgcgctgcacggggagttctactgcaaaccccacttccagcagctgtttaagagcaaaggcaactacgacgaggggtttggccgcaagcagcacaaggagctctgggcccacaaggaggtggaccccggcaccaagacggcctgaggcctctgtaaccttccaccccctctgcggaaggcctggagccggcagggggaaggtgggaaggaggtcgagctgggcttgcgtgggggccaggtgggaaggggatgaggcttgctcaggcgtaggggaccagggcagggctctgctccaggactccttccttcttccttctcccgcagccggtgagggtttggaaaccaggattggggtctgcccaccaccctgcttcctgcttcgttcagcctccctccccacctcaccccaggaccccctgggaggcccccaagcccagctcccctatctaggtgccttttctccagcaaggagtcagcatgcccccctcagggtcccaagctccctcactgccaccggagactgtgtggcccccacgtctccccatctacctctacccttaacctgtttctgagccacggagacagggaggaaggagcgcgacagtgccacctgttgggcatcataaatgcccctgcagcccatgggggaggagatggggaagtggagccaccctgcctctgcagggcaaggcagggcctgccccagtggggcttgggaccatctcgaaccaccagcgtggagaagcagaagcaaaagcactcgccaggctgcagcctcaggcactggcaggggctggtgcggccccactcccctcccccgctcccatttgtgcccatcctgttgtgaccaaccccgttttaaacatgtttcaatagatccagattctctat

SEQ ID NO: 43585 - DNA, 1388 bp, Homo sapiens
gcggtggcggcggcggtggctcggggtccactggtagcggcagcagctcgcgcccgcgccctcctcgtacccgtgcgcccccggagaccgatcccgccccgcggcccaggccgggcctgaacccagcgggtgccgcttctccacccgaggcttccacctccaacgagccatgttccaggctgcaggagccgcccaggccaccccctctcatgacgccaaaggcggcggcagcagcacggtgcagcgctccaaggtaggggcctggggccgggtgtgcgggaggaggggtgtgagggagcgggatgagcactggggcagcacctggctgagcttcccgcacagtccttcagcctgcgggcccaggtgaaggagacctgcgccgcctgccagaagaccgtgtaccccatggagcggctggtggccgacaagctcattttccacaactcttgcttctgctgcaagcactgtcacaccaagctcagcctgggcagctacgccgcgctgcacggggagttctactgcaaaccccacttccagcagctgtttaagagcaaaggcaactacgacgaggggtttggccgcaagcagcacaaggagctctgggcccacaaggaggtggaccccggcaccaagacggcctgaggcctctgtaaccttccaccccctctgcggaaggcctggagccggcagggggaaggtgggaaggaggtcgagctgggcttgcgtgggggccaggtgggaaggggatgaggcttgctcaggcgtaggggaccagggcagggctctgctccaggactccttccttcttccttctcccgcagccggtgagggtttggaaaccaggattggggtctgcccaccaccctgcttcctgcttcgttcagcctccctccccacctcaccccaggaccccctgggaggcccccaagcccagctcccctatctaggtgccttttctccagcaaggagtcagcatgcccccctcagggtcccaagctccctcactgccaccggagactgtgtggcccccacgtctccccatctacctctacccttaacctgtttctgagccacggagacagggaggaaggagcgcgacagtgccacctgttgggcatcataaatgcccctgcagcccatgggggaggagatggggaagtggagccaccctgcctctgcagggcaaggcagggcctgccccagtggggcttgggaccatctcgaaccaccagcgtggagaagcagaagcaaaagcactcgccaggctgcagcctcaggcactggcaggggctggtgcggccccactcccctcccccgctcccatttgtgcccatcctgttgtgaccaaccccgttttaaacatgtttcaatagatccagattctctat

SEQ ID NO: 43586 - DNA, 1179 bp, Homo sapiens
gcggtggcggcggcggtggctcggggtccactggtagcggcagcagctcgcgcccgcgccctcctcgtacccgtgcgcccccggagaccgatcccgccccgcggcccaggccgggcctgaacccagcgggtgccgcttctccacccgaggcttccacctccaacgagccatgttccaggctgcaggagccgcccaggccaccccctctcatgacgccaaaggcggcggcagcagcacggtgcagcgctccaagcactgtcacaccaagctcagcctgggcagctacgccgcgctgcacggggagttctactgcaaaccccacttccagcagctgtttaagagcaaaggcaactacgacgaggggtttggccgcaagcagcacaaggagctctgggcccacaaggaggtggaccccggcaccaagacggcctgaggcctctgtaaccttccaccccctctgcggaaggcctggagccggcagggggaaggtgggaaggaggtcgagctgggcttgcgtgggggccaggtgggaaggggatgaggcttgctcaggcgtaggggaccagggcagggctctgctccaggactccttccttcttccttctcccgcagccggtgagggtttggaaaccaggattggggtctgcccaccaccctgcttcctgcttcgttcagcctccctccccacctcaccccaggaccccctgggaggcccccaagcccagctcccctatctaggtgccttttctccagcaaggagtcagcatgcccccctcagggtcccaagctccctcactgccaccggagactgtgtggcccccacgtctccccatctacctctacccttaacctgtttctgagccacggagacagggaggaaggagcgcgacagtgccacctgttgggcatcataaatgcccctgcagcccatgggggaggagatggggaagtggagccaccctgcctctgcagggcaaggcagggcctgccccagtggggcttgggaccatctcgaaccaccagcgtggagaagcagaagcaaaagcactcgccaggctgcagcctcaggcactggcaggggctggtgcggccccactcccctcccccgctcccatttgtgcccatcctgttgtgaccaaccccgttttaaacatgtttcaatagatccagattctctat

SEQ ID NO: 43587 - DNA, 643 bp, Homo sapiens
agaggctgggacacaatacaagcaagatgtaggaataccatgctagatctcagggaagaaaatgaggctggagatgtaggagggagagcaattggtacatattaaatgtgttatcctttgcctctttgaaaaatcatctagagacacagtgagaagaggagaaaccacgacaataatattagtgaagagcaatgacaaaggacatgggaggagaattaacaagggagaaaatagagattacaaccccaaatcaacacagttatgctggttaagctgcaggcctggttctgagcctgccagcactcagggaaggttacctgagtttcatggctgccattgtgagaatgaagaaaatatatcagtttctcaaaagaacaccaagttttccaaggactaaactctcagcagaatggcttacttggaaaattacatagggaacatgagtaaaactgggttatgaatgataatgtcattcagataaagaatttacatggttgtcttttgttaagacactttttcattccattaatgtttgctcattgataataaagattatcaatacatttagctttggcatttttatgatagaattcatgtatagtaatatgtaaatgctccattaaaacaaaaacaaacaaaaaac

SEQ ID NO: 43588 - DNA, 342 bp, Homo sapiens
ccacatagaaaaaaaaaagtgtgtgtgtcaggggaagattcctgcatcacaacatacacaaaaatcaacttcaagaagattaaagtcagccgactgtgctggttcacacctgtaatccaaacactttgggaggccgaggtgggtgaattgcttgagcccaggagttcaagaccagccagggcaacatgatgaaaccccatctctactaaaaatacaaaaattagctagacgtggtgacaggcacctgtggtcccaggtacttaggaggctgaggcatgagaatcgcttgaacctgggagacggaggttgcagtgggccaagatagagccactgcctccagcc

SEQ ID NO: 43589 - DNA, 143 bp, Homo sapiens
gagagttaattgaaaaactggtagagattaatagggtaactggataaaaaataagtatgtaaactttttaaatgttaataacatttagataacaaagggagagatacgttttattcatagtagtaaaaaaaaaaaactaaaga

SEQ ID NO: 43590 - DNA, 220 bp, Homo sapiens
tgtcaaatcacgttgcatacacagggtttaataatgatctgacacactttttccttgataaaattgaaaggaaatagggcctatatgttatttactgacacctcatttatattttgaggaaactagaagtccttaaacgtctaaaacaagtgtattgaatgttcatttaagcagtctatcagttgtaaatgtttacatttaaagttaattgtttattgaa

SEQ ID NO: 43591 - DNA, 408 bp, Homo sapiens
tggattgttctctttgactcatctcaattccacaggcccaggtcagcaaaagctgagccttttctagcaggtagacctactaggtcttaacttgggaaaattgaattattcatcaagattcattgaaggggtctgggtgtggtggctcactcctgtaaccccagcattctggcagaccaaggtggaaggatcaattgaactcagcagtttgagaccagcctgggcaacataacaagaccgtatctttacaattttttttttttttaattagccagatgtggtggcgggtgcttgtaatcccagctactcaggctaaggtaggaggcttatttgagctcggcagttcaaggctgcagttctcatgccagtggactctagcctgggtgacagagaaagaccctgtctcaa

SEQ ID NO: 43592 - DNA, 440 bp, Homo sapiens
ttgtcaaaggatttaaagtagcattagatggtagagagaaacaaaagatgacccaagtttcattttctcagctttctactggagagaggacgtcatataaaccagagtgcgaaaaaggtcagaatggaaccctggggctggctagctcaaatttgtatgagggatgaagggcagtcctctctgctcacactaaggctaaatggccagggcctgcggagaaatcacatcctttgctgtaggagtagaagggattccatgtgcctaagaaatgtcagagaaaaaggggatgtgagctccatggatcctctccaggccacctggatccctccttatctttgtaggactctgcttactgccagctggaattgtcaaccaaagggctctaagttgggatctcggtcccttaagatgaggggagatggctgggcgtggtggctcct

SEQ ID NO: 43593 - DNA, 601 bp, Homo sapiens
ctcagggctgtgtctgggacttaagttggatcgtacacagaattaggtcattctcctttccctctctctcttctccaggattctcctgccccctttcctcatcatacccacttgccagttcatatgatcagaaagacaggtttctttgagtgttagccttttcactatacagcagttccttacaagggggacagcctttagcacagagttaagaaaagagagaaaaaagggggattctgtccacacttttcaggcaatactgatcccttttcccagttcctctggtagacactttctcttgagttttatgttccccagttgccatggttggtgtctgctctgaggctagggccagccttggggcagggctgggaggtgagagagaaagcaacataaagccctgggctttgtcctataccttctggcatgcaggggtcattttccttggtcttctggataaaaataggtttactgtctgtgcccactggatggttcaaagctgaaagacaaaaaagaaccaaaaaaccgaaaacaaactgaaactcgtcaataaatgggttgttattaagatttcaacttcagtccccaatctacctgctat

SEQ ID NO: 43594 - DNA, 540 bp, Homo sapiens
  misc_feature (496)..(496): n is a, c, g, or t
ctgtgtgtacatcagttgggcttctttgatagcccagttctggcttcttttacacaatacaccgagaaacaccaattaatagtatattatacattacagataatagtatattatacttaacagatattctcatttgatgccaacacactgaagaaatgttatctctggtttcccaaataacaaaacctggggctcaggaacttttaagtgacatgcttggaatcatatggctagaagctgacacaagctggggctagaaacctgatctcaatcagattattaactcttcgagagcagggagtgcatcttcatcactgatttagccaagcacttgactgacacacatcttggcacatagttgaagcccagagaggtattcagcagacgttgagcccctcctccatatcgtgcagctgtccttgactctgagctattgtgagattgctttggcagaagattctggactcttgcagtgaaactgagcctctcctcttangacccaggggcatcagctactttaatgggtgagaaaattctctc

SEQ ID NO: 43595 - DNA, 337 bp, Homo sapiens
aaaaaaaaaagctatagccacactttttatcagtgtaatagtttctatggtgggttaaattcctctgaaatagagtatttatgcttgctggaatttctgagcaagtttgataaatagtaagaattgctttgtctttgggccaagctcaccatggtttgtggagtttgtatctctttgtgccccatgatgctgaaagagagcaagaccatgcttttgttttccagtctgtaggataccactccctcctccaatcactcgtccctgtgaagtttcaaggaataagagtatattggtagaactaacctgggtcatgcccctcatcagtgttctctttgtt

SEQ ID NO: 43596 - DNA, 207 bp, Homo sapiens
  misc_feature (163)..(163): n is a, c, g, or t
aaaaaaaaaagctatagccacactttttatcagtgtaatagtttctatggtgggttaaattcctcctccatatcgtgcagctgtccttgactctgagctattgtgagattgctttggcagaagattctggactcttgcagtgaaactgagcctctcctcttangacccaggggcatcagctactttaatgggtgagaaaattctctc

SEQ ID NO: 43597 - DNA, 328 bp, Homo sapiens
cagtggagtagcatgaatgactccatgtgacagtctcctttaatgattgatattatttttgagtcaggcataggattgcttttggttattcacaccacttctctattatcttcacacagataataaaacattgattcagatagctgctttaaactataaaattctaggcccatggcttggccatgtcttgtagtcctagcacctaggacagggcctgacttccagtgggttttcggtcatgtttgttggctgggaacagaaccaccctaagatgatatgttattggttaagagcctacaagtggactgcttaatttttaagctgggtt

SEQ ID NO: 43598 - DNA, 392 bp, Homo sapiens
ctcatcatttagctcccacttataaatgagagcatgtggtatttggctttctgttcctgcaaagaccatgatctcgttctttttatggttaaggccccttttaattcaagtctcctttaaggctctcatcaggtgagttacagttgtagttttgtacagaacggggaagggaagaaatgactatctgacagttgaaacatagacatctaatcactaggtcagatcctggccaaacttgttaaagtcttgggagaacagcttaataatcatgtggtgcatcagttctaaaaatagactgggaactttgcaaggtcggtgtctcactaaagatacataataaccaaatgcaacgtatgaattgtaattgggtcctgttttgaaaaacccagcaa

SEQ ID NO: 43599 - DNA, 212 bp, Homo sapiens
ccatgtgtcctggccacatcccagtctgttcttcccatgacctgaggggtctggatttccactgttggtgctgtcattgagttaaggtgcggtgcctctcgtttaaactgctgataacagtggtggcaccaaggtgtgggctggggggtgcttaagccccttttaatctctatcataataactcccttatccaaataaacaccatcgacata

SEQ ID NO: 43600 - DNA, 641 bp, Homo sapiens
ctgagaacaaaaaccaaatatttcttgttataacacacctatgggacaaaattcatttagttttctacatttttgtctttgaatgctgcattagttaaattagatgtgtttggtcccaaaatataatgtgggatatagaagataacaattatttcttaaaatgggcaaagtgagttttgtagacctgaaacttcgtaaagaaaatatttataactttcccaaagcctcaaaccttatatgacaaatgcattgtcacattttatttgaagtcttttcagtggtctgggttgtaaatcagagttaggaagggtgtgatagctcctatggttagggagtttagagccacaggaatttaagagatttgccatgctgaatgggccctgaacccacgacctgacccgtaggtaatttagtttcctaaaccattggatccatctttatcgataaaggagcatctgtttcggtctttcagatcatactattagctccaaaattttttaacttccaaaattaaatacatattagtcagagaaatggtccttacttaagtcaaattgaaaaaatgaataaacgaggcacagtggctcacgcctgtaatcccaacactttgggaaggtaaggaaggagaatttcttgagccc

SEQ ID NO: 43601 - DNA, 527 bp, Homo sapiens
ttccacaggtggattttaagtgccttgaaacagggtgtatgctttatgtgttttataccattttcatcagttagcattagctgtgtaacaacacttccaaatttagtggcttaaaacaacaagcatttactatttctcacgattctgtgagttggctgggcagttcttctagtttggactggctcgactggggctgaataatctgggatagaggtaggcgaaccatagcccacaggcctgccacctgtttttataaatagggttttattggaacacagccactcccatatcgtctatggctgcttctgcactacaacagcagagctgagtatttggaatggagatgatcatatgcccacaggcctaaagtatttcctgctggtcctttaagaaaaaggttgttaccccccattctaggatggttggtctggggaggcctcccctgggatgactcatctctgttccacatgttctctcatcctccaggaggctagcctggaattctttatatgatgccctcaggggta

SEQ ID NO: 43602 - DNA, 383 bp, Homo sapiens
tgaggttgatctacaagagctaaatcaagtgggctctgatgtcctctggcttgaggcttggttggagaccagagggagaaaagagagtgaggctggagtatttatttccttggctccttcagcaaaaagtcactgttcttttaaaggcgaataactgtgtctgactttttgtctcctgttgggttatagcaactctcccctcacatgttttattccttttgttttctctgcctctgttcttttgtatatagcttcctaaaaatctcctggaattttcctattttgcatgcatgctctgttgtaagttgagatcctgatggataaattttattagctacattctttttttgtctcctgaccaaaacagtgagaggtggatatga

SEQ ID NO: 43603 - DNA, 305 bp, Homo sapiens
aaaatttgagctttcacttaatgtaaatgaaatttaaatttagattgaatattaccctagaattatcaaatatgactttcaaatgaatcacatttcttaggcaactccataaggactgactttgctgacagttaaagttgatgccatctattactttttaaacacacctttggaaatcttggtctgtaagtgttttaaaataacctgtcaaacttggttattttattttattaaatatgcatcttctgaatagtcattttgaatttaatgacttaataggtatatgtattagattctcaagtaat

SEQ ID NO: 43604 - DNA, 972 bp, Homo sapiens
  misc_feature (1)..(1): n is a, c, g, or t
ntctcggcgcgcgccccgcccgcggagcctgagccgagcccgggttccactctagggagcgtctcaaaagtgcgctgctcccgccccctctagttggcctcgctcacagcttcctgcatcccggatccctgccccctccccctgcgcgccccagcaatctaagcagatggccgcactgtcgggaacatctggaggtcgccggagtacgtgcctgtgtatgtgtatgtgtgtgtatgactgtgtgtgtggaaagagagagggaattagttgctagtaagaaagagatttggtgggtgggtgagggcttcctctttgcttgttcaccgcccctccccatttttttttaaagagtgaaagaggttcagggactaccgggagcaagaaaccaagaatctgaagcagagaaagactggctgaaagacgaacccacagagaagagagagcccggctcgggcagaaaagctggcaggagaggagagagaaagtcaacagattgagtttttcttttaggaggaaaccattggcttctggttagagttctaagaagggaaactggcgtgtgagtaggcagcagtttcagtctattccccctgctgtagctcttgggctctcacccctctttatgttaaaaaaaaaaaaaaagggcaggaaagcatccaagacactttaaaatgagggtttgcaggagaaatgacctggtggacgcatttcctaggaggggagagtcaggtgtgtgggtggctcccagtctacacaccccgacaatgcctaccttgggagaggggcagttcacaggtgggagagttgatagaggctttggtcttgggccctggacctcccaggagcttctcctagactttggagggcctcggggtgcagaaattgggcaatgtacctcctgcagtggcccagacttgttaacacacccagtctgcttgctgcttctttccttattactttttcttattcatt

SEQ ID NO: 43605 - DNA, 629 bp, Homo sapiens
  misc_feature (1)..(1): n is a, c, g, or t
ntctcggcgcgcgccccgcccgcggagcctgagccgagcccgggttccactctagggagcgtctcaaaagtgcgctgctcccgccccctctagttggcctcgctcacagcttcctgcatcccggatccctgccccctccccctgcgcgccccagcaatctaagcagatggccgcactgtcgggaacatctggaggtcgccggagtacgtgcctgtgtatgtgtatgtgtgtgtatgactgtgtgtgtggaaagagagagggaattagttgctagtaagaaagagatttggtgggtgggtgagggcttcctctttgcttgttcaccgcccctccccatttttttttaaagagtgaaagaggttcagggactaccgggagcaagaaaccaagaatctgaagcagagaaagactggctgaaagacgaacccacagagaagagagagcccggctcgggcagaaaagctggcaggagaggagagagaaagtcaacagattgagtttttcttttaggaggaaaccattggcttctggttagagttctaagaagggaaactggcgtgtgagtaggcagcagtttcagtctattccccctgctgtagctcttggctggggacctctagatcacccag

SEQ ID NO: 43606 - DNA, 298 bp, Homo sapiens
gttcctcctgttcattatgcaattccctaaatgtagtatatccttcatgatcttattctcttgtctgtgctgcaggctaatgtttcatatgcatgtattttatttttatttaaagttatttttacatggcagtggaatgtgccttcatctgtcaacattaaccccattggacttgcagggcactcccttaaaaggaactgtcgcttaggggattaggcaactaaaccggacctcttgaattacttcactgtgctttctgaggaaatgctgattggttactgctaaagattccactaac

SEQ ID NO: 43607 - DNA, 600 bp, Homo sapiens
ggggtttcaccatgttggccaggatggtctcgatctcttgaccttgtaatctcagtactttgggaggctaaggcgggaggatcactttaacctaagagttcaaggctgctgtgagctgtaagtgtgccactgtactctagcctgtgtgacagagcaagaccctttctctaaagtacatacacacacacatacatacatacaggacttggcctttcagctcctatatttgactgaagttcttccactatgcacttattgtcagttcttgagatgatgctctggacttaataactttgatcagaccttctaaacccaaatttgaagtgaggaccagaccagaaaatctaggatacatgatggctagagacacaggtgtagcttttaatagatgcaggctaacagctgccattttcccattctctagatacattattctattttcatcttccccagaaccctgcaaggcagtgctttcacttcctgaaagaaactggcaggatagggaccttaccatagaacagagttctgggagaagggaactgaaccaggtcccttgcagctgtccctagacttccctgaccccatccttgcttgctttcc

SEQ ID NO: 43608 - DNA, 234 bp, Homo sapiens
ctggcaggcagagggctacagaaacagggtgatggattctaatgaatccatctggagaacacctggagaagttcattctgatgaacacctggagaagtttcatgtgagaggcaggcacggggttgtgagaggcaggcatggggtcaggagaggagtcatctaccaggccctggagtgtgggctgtggagatggaggaggttcttagactggagttgcccttcagttctgtaggg

SEQ ID NO: 43609 - DNA, 431 bp, Homo sapiens
aagatctctctctgtaatgctgatgaagatcactataatgctgaaaagcattcattatgactgggcaccagccaaagcacagcttattttatgccattaccgctattggaatagtacaaaatgtgcctacagtgggctgttggacctgctcattaaagcactgtcaatctgctcctctctcaccactacaaagagtagatcagtagcaagccactactgcttgaaatatttttttcacatagtgtgaatctctttccatgaaatctttagtccttgaaatttaaggaatataggggccaggagtggtggctcacgcctgtaataccagcactttgggaggccaaggagggtggatcacgaggtcaggagatcaagaccatcctggctacacggtgaaaccctgtccctactaaaaatataaaaaattagct

SEQ ID NO: 43610 - DNA, 397 bp, Homo sapiens
agttccagctacttgggaggctgaagtgggaggatcacctgagcccaggaacttgagactgcagtgagctatgattgcgtcactacacttcagactgtgagacagagtaagaccctgtctggaaaaatatatatacatatatatacattttttttattttttatttttatctttttttgagatggagtctcactttggcgccctggctgcagtgcagtggcgcgatctcagttcactgcaacctccacctgccaagttcaagcgattctcctgcttcagccttctgagtagctaccattacaggcgcgcgccaccacgcccggctaatttttgtattttcagtggagacggggttccaccatgttgtccaggctggccaggctggtctcgaattcct

SEQ ID NO: 43611 - DNA, 1039 bp, Homo sapiens
  misc_feature (2)..(2): n is a, c, g, or t
  misc_feature (4)..(4): n is a, c, g, or t
  misc_feature (6)..(6): n is a, c, g, or t
  misc_feature (10)..(10): n is a, c, g, or t
  misc_feature (1036)..(1039): n is a, c, g, or t
tncngnacanagctataacatggcagcctcgcatcccttcctgcttaccacctttctagatattaaggcttacttagttcttactgaattaaatggagagtgacttgacaactcttggccagccattcttaatgatatttgtgttcctaagatatagcagtatctgcaaatcctaaatctgtctcatgaagattttatgatcttttagatcagtgattaatggaagacaatgtcctttatttttttaaataaaaaataatgacctgaactttctctgtagccaataaaggtgagtgtgaatggctatcaccatggtagtgttgggagttaacattctctagttaaaacatactataacttccacacaccagctaaatggaaacgctcttgacaggatctgctatgaagaaaatggaaaggagtaacatgaggatatgtggaataagtccggagatggagtagagtaaaagcaccattgcccaagggcagagttggataccactgcagtaaagagtgactgattaggcagtgtgttaagttttatgtcaaataattggtggttgttagatgtgaggatgatctggctgtgacatctgtcaccccattgattaccagggttgatttggctgatctggctggctaggctggtgtcccgttccatcctcactgctccatgcacgtccctcccaaagctgcattctcagtcgaagaggacgaccatccccgataaaggaggaccagtctcggtcaagggtatatgagtagctgcactcccctcctagaacctccaagctttcaaataattggtgattcttaagatacatggagctaactaggggttagaatgatttcccaaacttctcctagaaggagactgtagtgccagaccatactgtcaacttttagatgtgtggtgtgacccagagagacctgaatttttattttatgagactagaattggatcaaaagtaaaaatatgaactagtcttcaaattaaatcatatctagggcttataaagaaagtagtgaatgcttnnnn

SEQ ID NO: 43612 - DNA, 312 bp, Homo sapiens
tccagggtgtctgatttttttacttagaccctgacaactcattctaatcatgatcagatgaccaccttatttacaattcattagccaggtataatattaattgagccttgctgtaaaatgggaaatgctacttcttacacacactccctccctcccgcaaaagtctcttttacaagagaatgggttctggttgtaaactagtactttcttgccttggttctttttaaaagtccatgggaagatagttttgtgccattatttttacagcccattggtatgatcatcaaattgtttgatgttttgatatggaag

SEQ ID NO: 43613 - DNA, 274 bp, Homo sapiens
ttttagtagagacagggtttcaccatgttgcccaggctggtctccaactcctgactgcatgtgatctgcctgtctcggcctccaaaagttctgggattataggcgtgagccactgcgcccagcctctgaatcatttttctaagagcatggccaagtgggggccgggagcccacctgctccacccatggggacccagctcctgggcgcacccctgagggttgcaggcctccacccccaacgcagccagtgccttactcatgttggtggtgacgat

SEQ ID NO: 43614 - DNA, 630 bp, Homo sapiens
tgagacagagtcctactctgtcccaggctggaatgcaacagtgcaatctcagcttactacaacctccacctccccggttcaagcgattctcctgcctcagcctcctgagtagctgggattacaggtgcgtgccaccactcctgactcattttttgtatttttagtagagacagggtttcaccatgttagtcaggctggtctcaaactcctgacctcaaatgatctgcctgcctcggcctctcaaagtgctggaattacaggcgtgagccacgacacccagtgaaaaacatcttttaaaagacatttattcaacatcatgatcagactatgacatttggcaatcaacaggatgagtgcaaaggaaaaaaaaaacacattaaaactctttgttaagactgctttacactttccacagaacagaaactaaactaacctgttatacaattagtcacaaatacggtccttgatttttttacccatacacctgagtattgtctaaaacatatcttctttgtagcagctaggccctgctaccaactgtgcttggctgagttcacaaatctgttgtaacctgtagtttccctgtcacttctctggctctcctctcctgctaagctttgtttcctggca

SEQ ID NO: 43615 - DNA, 351 bp, Homo sapiens
tgagatggagtcttgttctgttgcccaggctggagttcagtgacgcaatctcagctcgctgcaactctgcctcctgggttcaagtgattcttcagcctcagcctccgaagtagctgggattacaggtgcatgcaccatgcctagctaatttttctgtttttagtagagacagggttttgccatgctagccaggctggtcttgagctcctgacctcaagtgatcctcctgcctcagcctcccaaagtgctaagattacaagcatgagccaccatgccctgcccctattttctaataaggtcacattctgggattcctggtgaatgtgaatttttggaggacagtattcagtc

SEQ ID NO: 43616 - DNA, 325 bp, Homo sapiens
ctgtgtcccttacccttaagggaagaagccttgccatctaccctcgtgtcccaacatccagctcgagccaatcattgagacactgaagcaaatgacactctgaggctaaaaagggtggccagaggaacccaaacagatgaccttccaaacggtttaggcagcatccaggatcctcccctgaccagtagaagggactgtattgatatttatggagaacctgctgcagtagctcatttcaaacccacagcacccctggctaccaggtattgttaacaccacattccaggtgacacaacagagcccccaaatgtttaagtgacttttg

SEQ ID NO: 43617 - DNA, 185 bp, Homo sapiens
atgttatttattttgtctgaacaagacttttttaattccattctgtgcaaaatattaattaaaattggaacagtatgttctccatccctgtttttcaaactgttggttgcagcatgattagggagtcatatacagacttttgtggatttcatgttaaaaaaaaaaatcaattgttataagagaac

SEQ ID NO: 43618 - DNA, 443 bp, Homo sapiens
atgtcccaggcagtaaccattattgataaatttgctttgtttatccttctaggctcagtgcacgtataaatatggcctcatgtagggaggttttttaaaaaacaaaaatgggatatactatattgtattgcaacttggcattttcaaaatatcacagtatttttccatacgtatttttaagcgtaacttctcttatttttattttcagtaatactttttttttcttccttagggatgtgggggtgggtctcgctatgttgaccaagcttgtcttgaactcctggcctcaagctgtcttcccatcttggcctctgaaggtgctgggattacaggtgtaagccaccacacccagccatttttccatattcatgtgaacagacctgccacactaagtgttttaaaaataatgttaggtttctaaaaaatatacaggtgtgtaaaag

SEQ ID NO: 43619 - DNA, 857 bp, Homo sapiens
cagctgtgacatcactgggctacaggcatttttctgctccattatgtgtaatgttaggggaccatggttgtatatgtggtctgtcgttgacccaaaacgtctttttggggcacatgactgtatataaatgcataaaagatgtgactgcagatgactcctgtgttatgccatccaagattaagcaccctagaataaagagaaattccagaagtaccttgattggccacataggacccaagaatgtgatgtgcctactcttctgctccgctagctaggcagatagggtacttgattggcagcaccaccaaaatcacatggttggaatggaggagaagcagttgccctccaggaaaggtggcagtggtgctggggtgttttaacctttgttttttccgttgcagttcagcaagacgcttccagttacttcctgctcttaaaaaaaaaaaaaaaaaaagaataaatctctcatgactctatatccttcttgacacctaaccaagagaaattgagatgacagttaattgcaaattaataaagaaggccatcatctactcagcctttacctaagtggaatcctgtcttttgcgcatttaacttacaagaatttacctgcatcagtcagttatgtgaagaagaaaagggaatatatttcagcgtacacaaggcccttgtgctttttaggaggagttctttggagctgaagtgggtctgagaagagacattctcatgatagtggagacagtattatagaagctggaagtgatcatttttctctgttatttatttcacttattacctcacacacatattgatataaaactgatcaataaagttagaatttctacattatctagata

SEQ ID NO: 43620 - DNA, 402 bp, Homo sapiens
gggcattttgggcaggacaattatttcttttgtaggactgtcccaagcattgcaggacatggagtacaacccttaacctcctccacagaaatgccagtagcactccccctagtcatgacagccagaaatagccctgtttccagatacccccaggagagctgtttgacatttagttgaggaccccaaggctaaatcccaaaaaagactacctgctgaagagaggtaggagcagccaggttttgtactgctcagcagagtaaaaggaggaaataagggctttttttgttgctttgaggaagtttattttgattttttatttttgccaggagtggtagggtatacagaaacagagactgatggtaatacattatttcattttattctcttgataattttatggat

SEQ ID NO: 43621 - DNA, 623 bp, Homo sapiens
aatgattccagtagttggcttgtgggagaaaataaaagtttacttttcagcaatgaagtgcatagaaatttaatcatagtattttaaagcagattgttatgctttaagaacctctgacaatggaatgtgaagtataacattgtcagtcactgagcagaaatctggtctctgaatatgaattctcaatgactgtaatagtcaatgaatttaaacttttggaataaagatgtaaaatcatatgtaattggttaaaatgctttcacattagattcataatttgaattactttccttggctttgcaaatggagaaaaatttttgtattaatacaattaaaagaccttctaaaccccctgtggcccaaattgtgaaaactagaaacccaaaacttttctaagaatataataaaaatttctgtgtgtgcatcctattacattttaaagagtgtggtatattaagaggataccttttcaatatttacttatttttagtcctgttatgtaaaaactgatttgggagaacttcaatgagagacacaggtaaaataagaatatttaagacaaggataaaaataacgtgaagataaggagcaaggagagcaatattaattaaaaattaagcctg

SEQ ID NO: 43622 - DNA, 384 bp, Homo sapiens
gttagcttcccagatgctctccctatgtccaatctctcatctctccaaattatccttctcctgttgccaaactagattcctaaaaacaggtaaggtcatgttactcctctgattaaaaatattgataactcatcacctgcaaaggaaacttgaaaacattaacatgcatttcattccttttcaggcttatcccctctatagctccctgcttgtgcaagctaccttatctcagaatagttccagttccttaacagttctagatacattgaggccgggcacagtggctcaagcctgtaatcccagcactttgggaggctaagggaggatccttgagcccaggaattgaagaccagcttgggcgacacaggagaccctgtctctacg

SEQ ID NO: 43623 - DNA, 364 bp, Homo sapiens
taaaatataaggaaagcaagacaagtaatgtgcatgaaaactgaaaaaatgtgaacacccgagcctggatgcagcactaataatcaacattgttcttggtttagttaaagaaaatttggccactggcaaaataccatttgggagtaatgagacacacccctaatcctaaaatattttcttgtcacttcctcaaagttgtttttgactttttttccttcagggttgacttcatatgtgttcattttattctaataagcaaaagttgtaatttttaagtgaaaaaataatttatgtcattctacttacaaatacaatttttctattctatatactcatatataaagatactgaagttttactgtat

SEQ ID NO: 43624 - DNA, 754 bp, Homo sapiens
aagtagaatgattttctagctgtaaaagtagacagcaattcacctagttttgtaaacagctattataggtctatatataatgctttcttctattttcagtggtgatctctgaatgaacttaatttctaaagaagctaaaataaagggaaagccttgaaagtttcctaggtaggatagcaatcatttataaagctcttattactcccttgccccaccctaccgctagaggcaggtagtaagggaaggggcggcctgatcctcactcacaagcacaagagggattaaacaaggcaggaaccacaaattccaaggtctcgtggcctgggaagggcaaaaccaatgaggggagcaggcccagcctggcccttggcaagctggtctcctgtcctaagaagcagctgttactaagctctagctattatcacacaagaatttacaagtggcattgctggatcttctagtttttcaagagatagggaatgtggatttatttctaaagcctcccaacttttaaacgttgacatttaaatctaaaattttaaaataatttgtgtgccaaagaaagcatatccacaagccaggattgaaatctgtttatctttttcccattcattattaacgaggtgacctggggcaagagccttaaattttccacaactttcttacggatcagttttctcatctgtaaaatatggataataatatttaacttaaaaaaattctttagaacatgtggaaaaaataatcaaaaaga

SEQ ID NO: 43625 - DNA, 342 bp, Homo sapiens
aggtattttaggggagtttattttgaaactatgtttctaattaagctttcaatatatgcatttacgtatttataacaatatgggctcatgtttttctctttgattcaatgagtagtaatccattttgccattaattatttaaattctcaaactgacaacaatttaatctttcaggatgaccttattatcctttcaacattgtcttaatttttaacaatatatattccaggatcatcttgtaatttttctgcaccagctccagaatcaggcctcattcttttcaatggagcatgttattgagaaccaagatctgggggttcagtgtcctcattgcgattaggg

SEQ ID NO: 43626 - DNA, 405 bp, Homo sapiens
ccaaatttcttaattactggcaaataaaatatatgcacttatagaaaatttaaatttcacaaggtatgagaaaacaaaaatcccctgaaataccacacctgagaccaccaccatgattacttctctgtggatacatacaaagaaccgcacacaagcggcttcagacgtatgattttgttaaagcatttgttgtacagctatatagattaattaccaactcagccccaggatgacagcttccttcctgtccccaccacacctcaggctgtagcaggtggcagggaccttttggaaggaagagactctgccactcagaacgaccagcccggtgtcccagagccagtgctcacagctcagcggacgggacacgggcgggccctcatgctgtggtggggctggccagca

SEQ ID NO: 43627 - DNA, 428 bp, Homo sapiens
tctttctttcacttactacctttcccctaagcctcataagtcaaatcctcaattagcagatttcaaccaagtgaacaagaacttgagtttttgtctcatgatccctcttttcaactttgccgttatacaaaggtctgaaaccaaaagtaagacacttatcttgtattttttttcaatttcccagctgtttaaaatattattctctttgctgtctccaatagatatacggtctagcttgctttctatgttttgccttagatcagttatgtctctggcctaccaaatttcccatttctcctaaaatatatctcctcatctattatcactcagaaaacaacttctttcccaaaactgctgatgaattctaccagaaatctgcttaatgtctgcttattcagtgggattctttctgtctctttcctagatgc

SEQ ID NO: 43628 - DNA, 181 bp, Homo sapiens
ttatgtggcttaaggttttgaatgtgttcatttgtaacctgtcgccaatttctatttcattcttttcctaattattctgtgaaattctttagtgagaacccgcatcttacatctagagtttatgattcttttggaaaaattaagtctactaagtaagaaatatatctaatgcagaaagaca

SEQ ID NO: 43629 - DNA, 302 bp, Homo sapiens
ggactttttagttaccagatgataacctcttctacgatattcccattaaaagcaataaaatcgtggccagaacctacctcaattctgcatttttgatgtgtgaatgggatcgtaagaagaagttataaaaaagagaaaatatctttcacaagtatttctgcttgtaccatgtccgttacattgattcaaaatgtttaaactttaaagaaggtaatacatgcatatggtaaaacaaattgtaaagggcagtaaagagatatcaaatgagaaataaatgtctcccttcttatctcccatctcaa

SEQ ID NO: 43630 - DNA, 178 bp, Homo sapiens
aagattcatgaagttgacaaggatatacaagtagaaagaactttcaaagattatggagtaattgtgctagtgggaaggtaggttgagctataatatcagaaacgttggtcctggtgtggtcgtggttaggtagccttcaaattggttgcaagcagagccttggttctccaagaatgaa

SEQ ID NO: 43631 - DNA, 2204 bp, Homo sapiens
cagaccattgagatgtggaagctgttgctgtgggttgggctggttcttgtgctgaaacaccacgatggtgctgcccataaactcgtgtgttatttcaccaactgggcacacagtcggccaggccctgcctcgatcttgccccatgacctggacccctttctctgcacccacctgatatttgcctttgcctcaatgaacaacaatcagattgttgctaaggatctccaggatgagaaaattctctacccagagttcaacaaactaaaggagaggaacagagagctgaaaacactactgtccatcggcgggtggaactttggcacctcaagattcaccactatgttgtccacatttgccaaccgtgaaaagtttattgcttcagttatatcccttctgaggacacatgactttgatggtcttgaccttttcttcttatatcctggactaagaggcagccccatgcatgaccggtggacttttctcttcttaattgaagagctcctgtttgccttccggaaggaggcactgctcaccatgcgcccgaggctgctgctgtctgctgctgtttctggggtcccacacatcgtccaaacatcctatgatgtgcgctttctaggaagactcctggatttcatcaatgtcttgtcttatgacttacatggaagttgggaaaggttcacaggacataatagccccctcttctctctgcctgaagaccccaaatcttcggcatatgctatgaattattggagaaagcttggggcaccctcagagaagctcatcatggggatccccacctatggacgtacctttcgcctcctcaaagcctctaagaatgggttgcaggccagagcgatcggaccagcatctccagggaagtacaccaagcaagaaggcttcttggcttattttgagatttgttcctttgtctggggagcgaagaagcactggattgattaccagtatgtcccgtatgccaacaaggggaaagagtgggttggctatgacaatgccatcagcttcagttacaaggcatggtttataaggcgagagcattttgggggggccatggtgtggacattggacatggatgacgtcaggggcacgttctgtggcactggccctttcccccttgtctacgtattgaatgatatcctggtgcgggctgagttcagttcaacttctttaccacaattttggctgtcatctgctgtgaattcttcaagcactgaccctgaaaggctggctgtgaccacggcatggaccactgatagtaagattttgcccccaggaggagaggctggggtcactgagatccacggaaagtgtgaaaatatgactataacccctagaggtacaactgtgacccctacaaaggaaactgtatcccttggaaagcacactgtagctctaggagagaagactgagatcactggggcaacgaccatgacttctgtgggtcatcagtccatgacccctggagagaaggccctgacccctgtgggtcatcaatctgtgaccactggacagaagaccctgacctctgtgggttatcagtctgtgacccctggggaaaagaccctgacccctgtgggtcatcagtctgtgacccctgtgagtcatcagtctgtgagccctggaggaacgactatgacccctgtccattttcagactgagacccttagacagaatacagtggcccctagaaggaaggctgtggcccgtgaaaaggtgactgtcccctccagaaacatatcagtcacccctgaagggcagactatgcctttaagaggggagaatttgacttctgaggtgggcactcaccccaggatgggtaacttgggtcttcagatggaagctgaaaacaggatgatgctgtcctccagccccgtcatccagctcccggaacaaactcctctagcttttgacaaccgctttgttcccatctatggaaaccattcctctgtcaactcagtaacccctcaaacaagtcctctttctctaaaaaaagaaatcccagaaaactctgctgtggatgaagaagcctaagcccctctggtgtcagaaaccagggaaaacccttgtcttttcttctaagtgacatgttggaagccttctcatcccggggcaaagcaggcatcaaaaccagaataggccaatctcttttccattaaataaactgtaaacacaagaacccaaaaaaa

SEQ ID NO: 43632 - DNA, 420 bp, Homo sapiens
gactactctaggtaccacacataaatggagtcatacagtgtttcttattttgtgcctggcttatttcacttagcatagtgtcttcacgcttcatccatatcgtatgtaatatgtgcatgtaagaatcttttgggtctaaacatgttggacatgttattatcctcttttttttttttcacaaatgaggcagttaagacacataagggttacataacttcttcaggatcccatagctaataaacagtaaaagctagattcaaatgctggctacactcctaaccacccagctacattgcttcctgagggactatcttcagttttttgccattgtacccagtctagagactgacaagtacagcaggttgactgactgttacttttacaggcatggtttataaggcgagagcattttgggggggc

SEQ ID NO: 43633 - DNA, 2181 bp, Homo sapiens
cagaccattgagatgtggaagctgttgctgtgggttgggctggttcttgtgctgaaacaccacgatggtgctgcccataaactcgtgtgttatttcaccaactgggcacacagtcggccaggccctgcctcgatcttgccccatgacctggacccctttctctgcacccacctgatatttgcctttgcctcaatgaacaacaatcagattgttgctaaggatctccaggatgagaaaattctctacccagagttcaacaaactaaaggagaggaacagagagctgaaaacactactgtccatcggcgggtggaactttggcacctcaagattcaccactatgttgtccacatttgccaaccgtgaaaagtttattgcttcagttatatcccttctgaggacacatgactttgatggtcttgaccttttcttcttatatcctggactaagaggcagccccatgcatgaccggtggacttttctcttcttaattgaagagctcctgtttgccttccggaaggaggcactgctcaccatgcgcccgaggctgctgctgtctgctgctgtttctggggtcccacacatcgtccaaacatcctatgatgtgcgctttctaggaagactcctggatttcatcaatgtcttgtcttatgacttacatggaagttgggaaaggttcacaggacataatagccccctcttctctctgcctgaagaccccaaatcttcggcatatgctatgaattattggagaaagcttggggcaccctcagagaagctcatcatggggatccccacctatggacgtacctttcgcctcctcaaagcctctaagaatgggttgcaggccagagcgatcggaccagcatctccagggaagtacaccaagcaagaaggcttcttggcttattttgagatttgttcctttgtctggggagcgaagaagcactggattgattaccagtatgtcccgtatgccaacaaggggaaagagtgggttggctatgacaatgccatcagcttcagttacaaggcatggtttataaggcgagagcattttgggggggccatggtgtggacattggacatggatgacgtcaggggcacgttctgtggcactggccctttcccccttgtctacgtattgaatgatatcctggtgcgggctgagttcagttcaacttctttaccacaattttggctgtcatctgctgtgaattcttcaagcactgaccctgaaaggctggctgtgaccacggcatggaccactgatagtaagattttgcccccaggaggagaggctggggtcactgagatccacggaaagtgtgaaaatatgactataacccctagaggtacaactgtgacccctacaaaggaaactgtatcccttggaaagcacactgtagctctaggagagaagactgagatcactggggcaacgaccatgacttctgtgggtcatcagtccatgacccctggagagaaggccctgacccctgtgggtcatcaatctgtgaccactggacagaagaccctgacctctgtgggttatcagtctgtgacccctggggaaaagaccctgacccctgtgggtcatcagttctgtgagccctggaggaacgactatgacccctgtccattttcagactgagacccttagacagaatacagtggcccctagaaggaaggctgtggcccgtgaaaaggtgactgtcccctccagaaacatatcagtcacccctgaagggcagactatgcctttaagaggggagaatttgacttctgaggtgggcactcaccccaggatgggtaacttgggtcttcagatggaagctgaaaacaggatgatgctgtcctccagccccgtcatccagctcccggaacaaactcctctagcttttgacaaccgctttgttcccatctatggaaaccattcctctgtcaactcagtaacccctcaaacaagtcctctttctctaaaaaaagaaatcccagaaaactctgctgtggatgaagaagcctaagcccctctggtgtcagaaaccagggaaaacccttgtcttttcttctaagtgacatgttggaagccttctcatcccggggcaaagcaggcatcaaaaccagaataggccaatctcttttccattaaataaactgtaaacacaagaacccaaaaaaa

SEQ ID NO: 43634 - DNA, 278 bp, Homo sapiens
ttaatttgatgtgacctttattttactgtgttcagaagggacagtaactatgagagaaaaacatatctcattaaaagagagagaaggcatcttagtttttctttgtttcatagtgcttagggaagtgtatatcaaacaaatgaaaaaaatgctttgtagggaaatgggataattaagtaatttaaaagtatccttttttttttttttttttttgagacggagtcttgctctgttgcccaggctggagtgcagtgatgcaatctcggctctcggcaacc

SEQ ID NO: 43635 - DNA, 2144 bp, Homo sapiens
gaattccacaataaaacacttgcttttctttttgagaaaaattaggttccttttcatctatttaattattgcccatgtcaaatgcttggttttgaaaactgaggaattctatctgacaaagatgaaaccagctatagttgcttgtaaatcatcctttctagtgatcacataaaatgaacagtagacagcaaataatttaggaattgaacctatacatttatcttataattttgctgacttaagtttccctttcttggtttatgatgccagcagaacttctgtgtaaaattatagtctgttctactgttctcagtttcaggcaactgatttcaaatgcctatgaaaccactccaattaagccacatgggggtgctagaaacttatagtatgccagtcacagcagtggaaaagacctggggtggaaaatagcagatgttattgtgatttaaatttccacttgacatacgttctgatttttggacaaattcaatgttttaattgaatagttttcgttacaaccagaaggcaggttgagattctaactaagcataaataagggtatattgatagtgaaaaaggtccttggaggattaaaacaacacactgttacagatcatttataatatttttctgacttccacattctgttgcatttatttgccgacaatttgacattttcaatctccattttctggcataaatatatttgtaaatagggatattttctattgttcataatgatctacatttaaaactctttatgtaaagctttatatcatttcaaaaatttcaaaaacttacacttaaaatcatctctactgtataaatttgtttttgatccagggaggttgaagtgtctattatatagcaaaagctaaagtaaacctgaagtggaactcacagatgatccacggcgttagcaaacctaaaccctgaactcattatctgagtgtcactttatggtttaattcctttctttttgaagtgtcattgatgcacgcatagcaatttgataatgattgttatttagcggtattagataaataacaagaatagatggccactaaagctacctgtctccatcattttgtggcacataggggtctgaagttgaaagaatacgacagctgatggaatgaatgttaagtatgtaaggccttgagtttccttgccctattttaattatactcaccattagtctgggtctgagtcctctgctttttctcggcccctcaatatccagggaggcttagtcatcaaggtacgtactgctccaacagtaacaagagctccctattaatgacctatagctgacttacatattgcgagtttggagagaggctgagaagattagttgttctttttcatttgtatttatttatggtttactttgaagatctcaactgcttctgtgttagaatggctgtctttagctgtaggcctaggagctagcgatttatttggtgtgcgttcagagaactccaaaattctcctgcctcaacatctatctctgctgccaatgtaccgcactccctttgtacttttcatagagatccttgagaagacaggcagtggggctctcacttgggaaaagagaagtaaattaagagaaaaaatatagaatgctagacgtgggttttctggttccacccttgtgcattggaaggagcagactatggagccagagattggtgcgcagtcctccccactgtagaatcagacgtacatcacctctttcatttctccagattcatgttctttctcttaatctctgcttctagtttttttgtgaagcttaatttatataagtataaatgacatctgacatattgtgagggcccaagaaaatttttcctcttttcccctgaaaataaaaatgctacttgttgtaataaaggttactttatgattttagatatgtattatatattatgattttagatatgtagatatgatagttaaatatttaaagattcattttcagactcacaatttttatttgcttttatattttgcaatgtatcatttcttaatttcctttatgatgcatcacttattttaatatcagacctattttttaaaggaagcaattgatagctacgatgcaaatgctattcttattaaaagataaatagctttccctt

SEQ ID NO: 43636 - DNA, 2465 bp, Homo sapiens
gaattccacaataaaacacttgcttttctttttgagaaaaattaggttccttttcatctatttaattattgcccatgtcaaatgcttggttttgaaaactgaggaattctatctgacaaagatgaaaccagctatagttgcttgtaaatcatcctttctagtgatcacataaaatgaacagtagacagcaaataatttaggaattgaacctatacatttatcttataattttgctgacttaagtttccctttcttggtttatgatgccagcagaacttctgtgtaaaattatagtctgttctactgttctcagtttcaggcaactgatttcaaatgcctatgaaaccactccaattaagccacatgggggtgctagaaacttatagtatgccagtcacagcagtggaaaagacctggggtggttggacaaattcaatgttttaattgaatagttttcgttacaaccagaaggcaggttgagattctaactaagcataaataagggtatattgatagtgaaaaaggtccttggaggattaaaacaacacactgttacagatcatttataatatttttctgacttccacattctgttgcatttatttgccgacaatttgacattttcaatctccattttctggcataaatatatttgtaaatagggatattttctattgttcataatgatctacatttaaaactctttatgtaaagctttatatcatttcaaaaatttcaaaaacttacacttaaaatcatctctactgtataaatttgtttttgatccagggaggttgaagtgtctattatatagcaaaagctaaagtaaacctgaagtggaactcacagatgatccacggcgttagcaaacctaaaccctgaactcattatctgagtgtcactttatggtttaattcctttctttttgaagtgtcattgatgcacgcatagcaatttgataatgattgttatttagcggtattagataaataacaagaatagatggccactaaagctacctgtctccatcattttgtggcacataggggtctgaagttgaaagaatacgacagctgatggaatgaatgttaagtatgtaaggccttgagtttccttgccctattttaattatactcaccattagtctgggtctgagtcctctgctttttctcggcccctcaatatccagggaggcttagtcatcaaggtacgtactgctccaacagtaacaagagctccctattaatgacctatagctgacttacatattgcgagtttggagagaggctgagaagattagttgttctttttcatttgtatttatttatggtttactttgaagatctcaactgcttctgtgttagaatggctgtctttagctgtaggcctaggagctagcgatttatttggtgtgcgttcagagaactccaaaattctcctgcctcaacatctatctctgctgccaatgtaccgcactccctttgtacttttcatagagatccttgagaagacaggcagtggggctctcacttgggaaaagagaagtaaattaagagaaaaaatatagaatgctagacgtgggttttctggttccacccttgtgcattggaaggagcagactatggagccagagattggtgcgcagtcctccccactgtagaatcagacgtacatcacctctttcatttctccagattcatgttctttctcttaatctctgcttctagtttttttgtgaagcttaatttatataagtataaatgacatctgacatattgtgagggcccaagaaaatttttcctcttttcccctgaaaataaaaatgctacttgttgtaataaaggttactttatgattttagatatgtattatatattatgattttagatatgtagatatgatagttaaatatttaaagattcattttcagactcacaatttttatttgcttttatattttgcaatgtatcatttcttaatttcctttatgatgcatcacttattttaatatcagacctattttttaaaggaagcaattgatagctacgatgcaaatgctattcttattaaaagataaatagctttcccttatgctaatgaataaaaattcctactcctacagttgttaatcaatcctcgagttcctaaagtcccgataaacacatttaatagcagaggatgagcatatcattaaattgatggtcagtctctgacttgtgtttacatatagtcatctgaaatgaagttcagaatttgagtcccaaatagactatacccacgcatggacacagggaggggaacatcacacaccggggcctgttggggggtggggggctaagggagggatagcattaggaaaaatacctaatgtagatgacgggttgatgggtgcaacaaatcaccatggcacgtgtatacctatgtaacaagcctgcatgttctgtacatgtatcccagaacttaaa

SEQ ID NO: 43637 - DNA, 2519 bp, Homo sapiens
gaattccacaataaaacacttgcttttctttttgagaaaaattaggttccttttcatctatttaattattgcccatgtcaaatgcttggttttgaaaactgaggaattctatctgacaaagatgaaaccagctatagttgcttgtaaatcatcctttctagtgatcacataaaatgaacagtagacagcaaataatttaggaattgaacctatacatttatcttataattttgctgacttaagtttccctttcttggtttatgatgccagcagaacttctgtgtaaaattatagtctgttctactgttctcagtttcaggcaactgatttcaaatgcctatgaaaccactccaattaagccacatgggggtgctagaaacttatagtatgccagtcacagcagtggaaaagacctggggtggaaaatagcagatgttattgtgatttaaatttccacttgacatacgttctgatttttggacaaattcaatgttttaattgaatagttttcgttacaaccagaaggcaggttgagattctaactaagcataaataagggtatattgatagtgaaaaaggtccttggaggattaaaacaacacactgttacagatcatttataatatttttctgacttccacattctgttgcatttatttgccgacaatttgacattttcaatctccattttctggcataaatatatttgtaaatagggatattttctattgttcataatgatctacatttaaaactctttatgtaaagctttatatcatttcaaaaatttcaaaaacttacacttaaaatcatctctactgtataaatttgtttttgatccagggaggttgaagtgtctattatatagcaaaagctaaagtaaacctgaagtggaactcacagatgatccacggcgttagcaaacctaaaccctgaactcattatctgagtgtcactttatggtttaattcctttctttttgaagtgtcattgatgcacgcatagcaatttgataatgattgttatttagcggtattagataaataacaagaatagatggccactaaagctacctgtctccatcattttgtggcacataggggtctgaagttgaaagaatacgacagctgatggaatgaatgttaagtatgtaaggccttgagtttccttgccctattttaattatactcaccattagtctgggtctgagtcctctgctttttctcggcccctcaatatccagggaggcttagtcatcaaggtacgtactgctccaacagtaacaagagctccctattaatgacctatagctgacttacatattgcgagtttggagagaggctgagaagattagttgttctttttcatttgtatttatttatggtttactttgaagatctcaactgcttctgtgttagaatggctgtctttagctgtaggcctaggagctagcgatttatttggtgtgcgttcagagaactccaaaattctcctgcctcaacatctatctctgctgccaatgtaccgcactccctttgtacttttcatagagatccttgagaagacaggcagtggggctctcacttgggaaaagagaagtaaattaagagaaaaaatatagaatgctagacgtgggttttctggttccacccttgtgcattggaaggagcagactatggagccagagattggtgcgcagtcctccccactgtagaatcagacgtacatcacctctttcatttctccagattcatgttctttctcttaatctctgcttctagtttttttgtgaagcttaatttatataagtataaatgacatctgacatattgtgagggcccaagaaaatttttcctcttttcccctgaaaataaaaatgctacttgttgtaataaaggttactttatgattttagatatgtattatatattatgattttagatatgtagatatgatagttaaatatttaaagattcattttcagactcacaatttttatttgcttttatattttgcaatgtatcatttcttaatttcctttatgatgcatcacttattttaatatcagacctattttttaaaggaagcaattgatagctacgatgcaaatgctattcttattaaaagataaatagctttcccttatgctaatgaataaaaattcctactcctacagttgttaatcaatcctcgagttcctaaagtcccgataaacacatttaatagcagaggatgagcatatcattaaattgatggtcagtctctgacttgtgtttacatatagtcatctgaaatgaagttcagaatttgagtcccaaatagactatacccacgcatggacacagggaggggaacatcacacaccggggcctgttggggggtggggggctaagggagggatagcattaggaaaaatacctaatgtagatgacgggttgatgggtgcaacaaatcaccatggcacgtgtatacctatgtaacaagcctgcatgttctgtacatgtatcccagaacttaaa

SEQ ID NO: 43638 - DNA, 487 bp, Homo sapiens
caaaactcacctgaattgcccaggctgtggcccattctatcaaatagcctagagtggggctaatctccaaaggtccaagttttcatcagagaggagaggagccactggtcctctcatggcagtgactctcatggcacatccctgagggtcacttttagcagtggaattgtgggccaaatatgccatttgtctccctcgggctctccactgtgccagtccccaagccagtcatgaccaaggtgggctgtctgtcagattcttactccagccagctggcaaggagggtacccattctgctgtcccagcccaggatatgctggagggcagcatgggtttaaatgccagctctatccctttccacctctcgggctttggtcaaattacttaatcatgttaagcgtcagttttcctgcctgtaaaatgggtatatgagatatcacttttatggagttgttgtaaggattaaaggagtcaatatgtaaatggt

SEQ ID NO: 43639 - DNA, 376 bp, Homo sapiens
ccactgctcccttgcccaacatggtaccatcagcctctttgctggagcagccctgtcgttattaggtggttctgatgccacctatctgtcttgttctatcactcatttcactagctgctgtatcgcatacacccaaaattaaaagctagagatgctcttctggactttagcctctcttttgccagtttctgccaatgatcccaaggtgtctgcacagctaaagacaacgtgttcagccaggaactctctgggtagtggccacttggagccatggtctccagggccttcctactccaagtgcaggagtaggctgcagcctactgggggctgttagagatgcgggatctcagactcaccccagaccttctgatcagaa

SEQ ID NO: 43640 - DNA, 369 bp, Homo sapiens
ggaatgcatctatcttgagtgaacactatgtgagttttaacaaatgcctgcatctctgtgaactgaaaccctatcaaggtttaccatcactccagaaagttctctcatacttccttccagtctcagctcccttctgcccacattccccaagaggcaaccagtgttctggtttttttctactgtagattagttttgtcttttctagaacttgatatgaatggagcatctactcttttgatgacgtttcttttgctctgcattttttttagatttatccacatcttatgtctcatttgcccagtatgtgaatatatgacagttgttgatgtattcttttcatgacagttatctgggctctttgtagttcag

SEQ ID NO: 43641 - DNA, 348 bp, Homo sapiens
caaatagtaatataccatttacttaacttatttaaacaattccttagtgatggatgtttaaagtgttttcaacttttgctattatgaacaaaacaacaatgaataactggagtgcaattttttttaaagaaatgggtgaagaagataaactaatgaagagccttgaggaggtcgtcaatggctcttgctcccacagtgccactcaaactacagtaacaggagccatccataatctccaccccagctcgtctctcttggacattgcatgctgtcatgcttctcccttggctgtcacacccccttcccattggttttccactcgcttatctactctttgccagacccctg

SEQ ID NO: 43642 - DNA, 1094 bp, Homo sapiens
agcctgggcgacagagcaagactccatctcaaaaacaaaacaaaacaaaacaaaaactctttgccttgtaaatagcctgcctttttcaaaaaaatcaatattatcaaatgatacaagagctatcacaaaaggcacccaaacttctgaatatgtgagacctttagctgagaacatttgtatctaattttgaacaatcctattcaaaaagctcctattttcgttaatggaaatgccatgtttctcttagagttacgaaagatctcagaaagtggcaaaagatatttaatgtagccagagctatatatttctgtttttctcgtacttcaagtattctgaaaaacatataactgaccttggtggtgttcacaatgggatgaaacagtatcttaggaattgactttgaaattagtatggaaattcattgtttttaatataacattgagcaacagaaagccttgaatgataagatcaagagtctcccatgaagtctcagctcactgcaactctgtctcccgggttcaagcgattctccctcctcagcctcctgagtagctgggattacaggtgcccgcttgtatttttagtatagacagggtttcaccatgttggtcaggctggtctcgaactcctgacctcaagtgatccgcccaccttggcctcccaaatgcaattacttttgcaccaacctaagaacagtaatctcagtcaatagtggcttaaaccattagaaccaaaaccaggcagagatcagagaaggttcaacgctcaacaatgttatcaagaacccagcttctttttgccttttcttttcaccatcctctgcatgttggccatctgaccctgtgcttgaaacctcatggtcacaaaatggcttgcccctgtgctggacatcatattttttttcaaagaaggtagaatgggaaaggagcagtcataaaaggttttctttcagaagagtctgttggttttggttagaaaaggaagtcccctggcagatttaccattgcttctcattgatcagacctgggtgtcatgcccatcccagcatgagtcctgctgtagggctggaaggaagggcctacgagcaccaaggg

SEQ ID NO: 43643 - DNA, 1113 bp, Homo sapiens
agcctgggcgacagagcaagactccatctcaaaaacaaaacaaaacaaaacaaaaactctttgccttgtaaatagcctgcctttttcaaaaaaatcaatattatcaaatgatacaagagctatcacaaaaggcacccaaacttctgaatatgtgagacctttagctgagaacatttgtatctaattttgaacaatcctattcaaaaagctcctattttcgttaatggaaatgccatgtttctcttagagttacgaaagatctcagaaagtggcaaaagatatttaatgtagccagagctatatatttctgtttttctcgtacttcaagtattctgaaaaacatataactgaccttggtggtgttcacaatgggatgaaacagtatcttaggaattgactttgaaattagtatggaaattcattgtttttaatataacattgagcaacagaaagccttgaatgataagatcaagagtctcccatgaagtctcagctcactgcaactctgtctcccgggttcaagcgattctccctcctcagcctcctgagtagctgggattacaggtgcccgccttgatgcttggctaatttttgtatttttagtatagacagggtttcaccatgttggtcaggctggtctcgaactcctgacctcaagtgatccgcccaccttggcctcccaaatgcaattacttttgcaccaacctaagaacagtaatctcagtcaatagtggcttaaaccattagaaccaaaaccaggcagagatcagagaaggttcaacgctcaacaatgttatcaagaacccagcttctttttgccttttcttttcaccatcctctgcatgttggccatctgaccctgtgcttgaaacctcatggtcacaaaatggcttgcccctgtgctggacatcatattttttttcaaagaaggtagaatgggaaaggagcagtcataaaaggttttctttcagaagagtctgttggttttggttagaaaaggaagtcccctggcagatttaccattgcttctcattgatcagacctgggtgtcatgcccatcccagcatgagtcctgctgtagggctggaaggaagggcctacgagcaccaaggg

SEQ ID NO: 43644 - DNA, 403 bp, Homo sapiens
actgggtgagaaacttcaggagagagccccagcaatctgcattttaataagccctcccaggtgattctgaggcacaaatttgagaactcctgaattagataggctcaatctgatccaaggagaggatttttatctcatggatgtgagaaaggtttcgtctgttcctattgatttgaatcaggaactaaattatccccactgctgctggcagcctttctgacagcatcagagattttggcctgttgattgcaaaagtcaaaatgtttgtcgtcttcacctcaaattaacagattgataccaaatccccaatgtgttggtatttggaggtggggcctttgggaagtgattgggtcacaagggtggagccctgttccgcaggtggtaagtgccacaataaagcaaa

SEQ ID NO: 43645 - DNA, 418 bp, Homo sapiens
tcagcagtacctgcttctagcttcaagtccagcaaatgaggggatgtctctcttttccgtcaacctatggtctgaaagttaagccagccattgcaacacattggcacacaacgggggagagaagacagggttgctgcaataacatcttataaaaaggaggagagaatggacatattccatagatgctgtgttccatcccattgaatgagaattgcaagacctcctgcacactagctgtggcgtgaactcccgagttggcccggttggctgcttttggttttgttctctgagaagatctcccttgtccattgtcctttgtggctcatctaggatgggtgtatacgtcatatttcagctcagatgtcatctcctcaggcagcttttctctggcgtccgagtagaaagtaggcatccagtt

SEQ ID NO: 43646 - DNA, 440 bp, Homo sapiens
tttgggagaatacccaggagtggaatggctgacaacagggcaggtagttactgaacttttctagaaggtgtgagacagttctccaaagtggtggtgccattgaccagtggtggacaatcgtttcacttgcaccatagcctcaccaacttttggtgtttctagtcttttaaatgtttagctgttgtaatggatgagatatggttgcttagttgttttttaaggacattttaaagaattttccagcatgtcagtcaatgccagctcagacactgaaaaggtcccataggagggaaaccaggtgttaaatgtttagggacaggaggtttctactaatcatccctgtccctaaagcagagtctttccagccctgagggctgtctgtgggctgcctcagggcaagctcaaggccgaagccctagagcggggaactagggaagggg

SEQ ID NO: 43647 - DNA, 403 bp, Homo sapiens
gcgtcgaccgcccaggctggagtgcagtggccaatcgcggctcactgcaaactccgcctcccgggttcacgcctttctcctgcctcagcctcccgagtagctgggactacaggcgcccgccaccaagcccggctaattttttgtatttttagtagagacggggtttcaccatgttagccaggatggtctccatctcctgaccttgtgatccgcccgcctcgtcctcccaaagtgctgggattacaggcttgagccaccgcgcccggcctgtgatcagaattttaagaagggcaggaagaaacaaaactattggtggtctagattagaggtcacaaattattttatgtaaaggtccagagagcaaataatttaggttttgtgggtcatacagtctcgtcgacgc

SEQ ID NO: 43648 - DNA, 367 bp, Homo sapiens
  misc_feature (328)..(328): n is a, c, g, or t
gttttacaaacattcatcacatgacatagatttctagccatcccaatatgctgtatgtgttcctcactgcccaacccttaggccaatgtcatatactttgggatcttgttacagtagcaacacaattcaaaatgtcaatttctatgttgatcagggtaagtaactctctctgctgtaacaactaactccaaagcttcagtggcttacacaacaaaagttttccctcttatgtcacaatcaatttgggacagggaaagatggtctttcactatgtgattcaatgacattttgtctactagtgtctatcctagggccttggaaactcccnactaaatattcctcaatgaggagagtatggaaagttttg

SEQ ID NO: 43649 - DNA, 361 bp, Homo sapiens
gacctttcagatctttccagttctttttttgctgtcgtgaataatgtagcaatggaaattcttgcatatcttgactacttgtgtagacacatcagtacaacgtgttgaaagaattggaattgctggattaaaaggtctccgcatttaaaagtttaatagatactggcaaggacttaaaggatggagtggtgcaaggggtcccccctaagtacaggaagtaagggggtatatcatttatatagaattttaaaacagtaataaaaccagtgtgggtctgttttttattatcaccatgcgctggcagtgaaaaagtcagagtaagttcttaatggtgtgtacagctttcactagagctttgggg

SEQ ID NO: 43650 - DNA, 719 bp, Homo sapiens
aaggaataagataagtggaggagcgtacataaaattgcaaagtactttctcccctttcttccttttcctgctttttcttatagtacttggcaccttctggcacactaaataatatactttttaggataatttattgtactcctccctgtcccactagattataagcatcaagagaacagagctatttctatcttgttttgttttattttgttcactgctttgccttcaacatataaaagtatctggtgcagaataagcactaaatagatatttgttgaatgaatgaagacttctgtgaagattctttcagagctactaatgaagatgaaaagaagaaggaaagtgggaggaagcagggaagtgaagaaaggaaaggagggaagaaggaaagaagttaagaagcaaacgaagacattgacaacacttttataggcacttttcataaatgttgttttatttcatcttctcagcaccctgaaaggcagaagcaattgtttgctttccacagatagaaaaattgagatttgatggctccggaatgaataataagggccctgctgatcatacgtagtagccaacttcccattaaaaacaaccatctctgtagttagacagaatttgttttgaacctcagttttgtcttttgccaactatgataacttggtcaagtcacctctttctgagtcttcatttccaaataaagactgtcatactaaatg

SEQ ID NO: 43651 - DNA, 182 bp, Homo sapiens
tcacagagttatgccaaggttatgcagctggtatccccatcaaacctcgagttctttcgaggcagagcccctggggactgggctcaggggtctgggcccagtacaggagccttgtgtggcacagtgagataggactagattcctgccctcccaggggaactcagcaggctgagggggcatca

SEQ ID NO: 43652 - DNA, 587 bp, Homo sapiens
gacatttaacattgtttctagtttggggctgctgcatgtctttggatgaatatgtgtacacatttttgttggaaatagaattgctggtccaacatagatagatagataggtaggtagatacatagatagatagatagatttattattgaatatatataacaaaatgttcttattgttcatcataatttccaaatgacattttttttctatttggtgtggaataactttcatatcttccattaatttttttagacatagttcttttatttgaacatgtttttgatacctggtttaatgtctttgtctaataagtccaacatctgggcttactctgggacaatttcttttgactacttttttatgtttataggccatacttgcctgttcttttgtgtgtctcctaattatttggttgaaaactagacactttaaataatatatcgactctggaaattagagttgttgctgtttttgtgattgctgttgtggtggtggtttatttgtttagtgatgtttctggattggtattgtaaagtctgtattcttttttgtgtgcagccactaaagtatttacttggttaaaaaaa

SEQ ID NO: 43653 - DNA, 439 bp, Homo sapiens
gtgggaggatggcttgagttccagaccagcctgggcaacacagcgaggccccgcctcccaaaaatatttataaaaattagccaggcatagtagcacctagctactcaggaggctgagacaggaggactgcttgagttcaggagtgtcaggttacaatgagctatgattgcaccactgcactccagcctgcatgacagagcgaggccatgtctcaaaaaaagttgtaaaagtaaaatcagtcaatcaattttatcttccatttaaacaggaacaatattgcaaatttctgtcctttactgatggcaactatgcaaaaattttaagacatgtaagatccacacatgattataataaaaacctgtgagggccacatcataaccgtacgtatgcaaagagcacacaactcaaaggggagcaatttacacagagtctaacagca

SEQ ID NO: 43654 - DNA, 162 bp, Homo sapiens
ctccagcgtctgcgacttgccacacactccattcaagctgaagcggctgcccagtccctcgcataatttggagttaatcatttgtacttcacagcctctgagaggccttagacttgggaggtggggacagatttggcttttaatcgctttgtatattgtgcg

SEQ ID NO: 43655 - DNA, 229 bp, Homo sapiens
cccttgttgtggcccctgaacaggctgctgctggcccaccacggtgcctctagtttgtgtaaaatgcatatgttaatttataatatatgaggcttttttagctctaaaaggctattattcactagttgctgtgtgaatcagtatttctgggtgcagttagaaattattagagttgatgcccaagactcatctccatcagcacgggggaggcatctgctcgttttatggt

SEQ ID NO: 43656 - DNA, 391 bp, Homo sapiens
actctaagtaaaatgtacagtatgaatattctaccttgtatgagtaattcatatagggttggaagacctgaatgtctttctggtaatcttagtactacaatattcttttatacttaagtaattatcatattgagcatctgttttttttattcattgcatgcaaccaatgcatattatgaagggaagaattattattgggtttacacattgatcttttttttttttttgagacggagtcttgctctgtctccaggctggagtgcagtggtgccatctcagctcactgcaacctctgcctcatgggttcaagcgattctcctgcctcagccttccgagtagctgggactacaggtgtgcgccaccacgcccaccaagttttgtatttttagta

SEQ ID NO: 43657 - DNA, 429 bp, Homo sapiens
tcgtgaggcttctgcaagttaacttatgtaaaacactgaaaacaggtcctggcacagaataatccctcagtaaggtggtaacttgtttttatgtattgaaacaaaaaacattgttaatagagtattagcacaaccatgcttagcatattcccaagtactatgagacaacatagtctccataattgctccatcatccagaaggaaaagatcatttcatggatgctctagagtggagaaattgtgacttcaaaaccctggagtgagtcaatcacaaaatcagatagaggacccagacttctaattccttgtcaggtgctagaccccgatcaggatgaatgatgctgaacaatggcctggctgttcagagcctgaccttccaggtccaaacggagactgcaacacaaacaaacatgagttcttgtttttgtt

SEQ ID NO: 43658 - DNA, 319 bp, Homo sapiens
gtggttaggtgcatagatttttgaaatcagttaaattagtttttgatacttgatgtgtgacaggggaaactgtgtaagctgtacttgttatttctttgtaaaatgtcttagataataaaactaaatcataaagtagatattggtttaaaggatgtatacattgtcccttttacattgtaagcattcaataagaactagctgcggatgtaattttttttaaaaaagtccaaaagcagctatgggcagttgacaaaagaaaatgtaatgactacgtaacttgcgaatctgtttaccctcacttgcaaataaaataagtgca

SEQ ID NO: 43659 - DNA, 494 bp, Homo sapiens
ggggtcaatttatcaagaggcataacaatccaaaatatttattcccctaataagagagcttaaaaatacatgaaacagaagctgaagcccctatgagaacaaatagataaagtcacagttgtagtcagagataactgacagaaatagaagtagacagaaaattagtaaggttatagaagactagaagaatgctgtgaaacaacttaattaacatttatagaccactccacctaacattagaatgaacattttttttcaaatgttccatggcacatggaacatttttcatgatagaccaaattcaggcccataaaatagttctcaataaatttaaaaaatgttttaagtcatacaatatatgtccttttaccacagtggaattaagttagaaattaaaaacaaaaaatatctggaaaatctccacctatttggaagctaacacatttataaataatccaccggttaaagaatgaatcaaaagataaacagaaagt

SEQ ID NO: 43660 - DNA, 388 bp, Homo sapiens
cgctgaggtgtagccatattccagagcctgaaaagccttgtgtggcctagtggttaagagcatgactctagagtcagcctgccaattccagatgtgctcactgggtgaccctgggcaagtaatttaatcacctggtgctgccctgtcttcatctgtaaaggacactgatggcagtccctgcctcaaatgatggttgtaggatgatggggaaaacaacaagtgtttagaagggtgactagcaagtagaattcaactctgctttgatgactcaatgtacgatgccaatcaccctgactgggccatgaatgggcacctactatgcgcaggcactgagtgaggggtgggccatagacagaaagagaccaaagcgttgaggaacgcagtctag

SEQ ID NO: 43661 - DNA, 501 bp, Homo sapiens
ggatcaaagatgtaggaaacgatggatccatgtaggcctcagccttcaagtttctcctctgagatttcagggattatcctttaaaggagtcaggaagagggtagagatcacaaagataataagctcagacagtttgtatgttaaataaacctcaggaggttttagtcttaaggtccttaatctgaccttccaaactgacttttccagaaacttccaaaagcctctctggtgtctctttcttcccctcctttaatgtggccctggctcacaagtcacccctctctctaagaagtccccttctctgttttattcttcagctttgccccaggaggacctggggtgtagccccatgtcccctccctctgccactggtgactcatggtcatttcattcccctcagtcctcaaatagggtgaaccctacaggccccagaactaccccagtcaacctgtagagaaactccacaatgaccctcacaggaaatgaaattgaaagtcccat

SEQ ID NO: 43662 - DNA, 263 bp, Homo sapiens
tttcattaccagctgcccattaataaccatcaaattagaagtgtctctagcagcatgacaatttagtgaggggaataagaacagaaaatcacaaattgttcagaaaagttgctgcatagcaggcctcctggggccggggcccgatgccccttggtgtttagttcaaggccatggggctctcttgggtgacatcacttctaacatagatactgtgtaattcagttacacaaaagcagcccagacaagcaggctcacatcatctc

SEQ ID NO: 43663 - DNA, 331 bp, Homo sapiens
tccactgcacaccctccttctgtccgctccgtgaacaggaaacagaaatacagctccaatttttttttttaatggaggaagagaaaccacaacccgaacaaaaaactcaaaaactaaactccaaccaaactaaactctcaagatagaatcatgagagatgcaaaatgtccaaaatgtcctaagtggctcaaaccacccgccccttaacaggtctgcctctcttcctgggagtcagaagtgaccttgatgaactggatgttaggtccaaaaatgacaaacaagccctccactgggaaacatcagtccaacccctttcttttgacagcaggac

SEQ ID NO: 43664 - DNA, 306 bp, Homo sapiens
ccccagatggatatcaaattaatccagaacaatttatttaaaagactttccctttccagctactctacagagccaattttgtcataagtcaaagattcatgtgtggatatgtttctggactttcttttttgtcctgttggtctctttgtaagtctttaagtcactctcttcattctcataacttgaaggtcttgctatctgatagtgaaagtcttccactgtgttgcttctccaagagtctcttggcttttcctggtcctttgcatttcatttaattttagaattagcttgccaatttctaccaaa

SEQ ID NO: 43665 - DNA, 596 bp, Homo sapiens
aattaggcttgggctccatatatctacagctgagaggtaaggatgaaccagaactaaccgcttttcatcacctacctcccaatcaaatatcaaggaatttcaagacaagttgtgttggtactgagcagagcaggaggaaaaaagagaaaggaaacaagcaaacaaaagtctttacaaagcataggtgggaaagggaaccgtaagccatacttaatttaggttggttcctgactccaggtgcttgtcagaagcaaatgcaaatgttcttcaaaggaaggctccttcatcttaggcctccccacaattttttaaggacagtaatcagcacatagtcaaagataactagacgtacgaggagacaaggaaccataggcatgaaccagtagaaacaacagacagcagaaaaagataaacatcatataatagaattaaaagatatataataaaacaaccaagcttactgtgtttacagaaataagtgacaaatttgagaatagggaacaggaaatgattgtttttaagtggcattatagttttgaaaaaaccaaatcgaatttttggaataaaaactgactcaggagtttgaggccagcctg

SEQ ID NO: 43666 - DNA, 2266 bp, Homo sapiens
ggacagaaaactccctccttttccaagttagccttatagtctagggcttaaaatactggtttaatggtgaaggtaagtgcttttcttctttttgggtagaaggattattactaacttaccaaaggtccattaaggggagggaacagttttaggagaagtcagagaaaagacattaacagcaacataaggatctccatctggtaatattgcctaattccaaaatgaagagactctctgaaaaagataactgattcaatgaagaccctagggcaaggcttgagaagccactggtaccaatggacactgtggacaatggtcatttctccaaggacgctataaaagactgtcgtagtaaaagagattcagggcacagggaaactccaccacaaagcgtggtaccatttcccacagaagctaaatggacgggaagcctgccaccaggaaaggtccagatttctgttcattacgctatgggctggctcttatcatgcacttctcaaacttcaccatgataacgcagcgtgtgagtctgagcattgcgatcatcgccatggtgaacaccactcagcagcaaggtctatctaatgcctccactgaggggcctgttgcagatgccttcaataactccagcatatccatcaaggaatttgatacaaaggcctctgtgtatcaatggagcccagaaactcagggtatcatctttagctccatcaactatgggataatactgactctgatcccaagtggatatttagcagggatatttggagcaaaaaaaatgcttggtgctggtttgctgatctcttcccttctcaccctctttacaccactggctgctgacttcggagtgattttggtcatcatggttcggacagtccagggcatggcccagggaatggcatggacaggtcagtttactatttgggcaaagtgggctcctccacttgaacgaagcaagctcaccaccattgcaggatcagggtcagcatttggatccttcatcatcctctgtgtggggggactaatctcacaggccttgagctggccttttatcttctacatctttggtagcactggctgtgtctgctgtctcctatggttcacagtgatttatgatgaccccatgcatcacccgtgcataagtgttagggaaaaggagcacatcctgtcctcactggctcaacagcccagttctcctggacgagctgtccccataaaggcgatggtcacatgcctaccactttgggccattttcctgggttttttcagccatttctggttatgcaccatcatcctaacatacctaccaacgtatatcagtactctgctccatgttaacatcagagatagtggagttctgtcctccctgccttttattgctgctgcaagctgtacaattttaggaggtcagctggcagatttccttttgtccaggaatcttctcagattgatcactgtgcgaaagctcttttcatctcttgatatgcaagtttcctcatgggaatctcaaggggatttgggctcatcgcaggaatcatctcttccactgccactggattcctcatcagtcaggattttgagtctggttggaggaatgtctttttcctgtctgctgcagtcaacatgtttggcctggtcttttacctcacgtttggacaagcagaacttcaagactgggccaaagagaggacccttacccgcctctgaggacataaagttacaaacttaaatgtggtactgagcatgaactttttaaacattttttacttctctccatattcctgaccatagactcagcagttcttaactctggctgtgtgttagtcttccctggggagcctttataagacactgatacttgggacccactccagagattctgaatgaattggtctggggtggaacccagatactactaatttttagatactccttagaggtttctagcatgcgcccggggttgacaacagctggacaaacttgaaaagtcaattcatgtggcctttgaattttcctcattggaaagtactaaataaataaaaattcatgtgaaaatgatcactgataaatatcttcatggtggggcaggttattggatgcagagaagatctgctcggaattgtagccatatgttacagatctcagcaccgatcagaactgtaaagctataatccccagaattaaagtttttattattttttatacattgtaaaacatagacgtttatttatgtgattaaattctattaaaatttacatgctaaaat

SEQ ID NO: 43667 - DNA, 1901 bp, Homo sapiens
  misc_feature (1)..(3): n is a, c, g, or t
  misc_feature (321)..(321): n is a, c, g, or t
nnnaatagctggatttattcacaattgtagtaattagtccctgttcattataattttctaggtgatatgaagactttgtcagtccaagcaagtgtccatattgtgtgtagcaaacatgagaataaacattttaaacttttaaatgtaatacatattagtgttatgtaatgtcatccttcatgttcgaaggcacatggaacattgttctggtggtacagaggggagaggaacaccatcagaatgaaaggaaagaccgctctggaaccttcctccttagctcttgagcttagtttaattgtcctgtcttatggtctgctacangcaataccactcttcaccttcgcatgcttctctgtggtttgataaagtacatgcaatttttcatttaattcttccagctgcactaagaaaggagccttatctttattgaacagatgaggaaatgaatgattagagaatttaaatgactagctctaggtcacacagctggaacttacagccagatttccttttaacaatcctgtaaccaaaagcataccagtagtgccccataaaatgtaagttatagagctgtgttgggtcaaaacttttactgatgctaagaggaggcaacattaacaaggggaaattatttgtgtattatgttttggattatgttctctccatagataaaagactgtcgtagtaaaagagattcagggcacagggaaactccaccacaaagcgtggtaccatttcccacagaagctaaatggacgggaagcctgccaccaggaaaggtccagatttctgttcattacgctatgggctggctcttatcatgcacttctcaaacttcaccatgataacgcagcgtgtgagtctgagcattgcgatcatcgccatggtgaacaccactcagcagcaaggtctatctaatgcctccactgaggggcctgttgcagatgccttcaataactccagcatatccatcaaggaatttgatacaaaggcctctgtgtatcaatggagcccagaaactcagggtatcatctttagctccatcaactatgggataatactgactctgatcccaagtggatatttagcagggatatttggagcaaaaaaaatgcttggtgctggtttgctgatctcttcccttctcaccctctttacaccactggctgctgacttcggagtgattttggtcatcatggttcggacagtccagggcatggcccagggaatggcatggacaggtcagtttactatttgggcaaagtgggctcctccacttgaacgaagcaagctcaccaccattgcaggatcagggtcagcatttggatccttcatcatcctctgtgtggggggactaatctcacaggccttgagctggccttttatcttctacatctttggtagcactggctgtgtctgctgtctcctatggttcacagtgatttatgatgaccccatgcatcacccgtgcataagtgttagggaaaaggagcacatcctgtcctcactggctcaacagcccagttctcctggacgagctgtccccataaaggcgatggtcacatgcctaccactttgggccattttcctgggttttttcagccatttctggttatgcaccatcatcctaacatacctaccaacgtatatcagtactctgctccatgttaacatcagagatagtggagttctgtcctccctgccttttattgctgctgcaagctgtacaattttaggaggtcagctggcagatttccttttgtccaggaatcttctcagattgatcactgtgcgaaagctcttttcatctcttgggctcctccttccatcaatatgtgctgtggccctgccctttgtggcctccagttacgtgataaccattattttgctgatacttattc

SEQ ID NO: 43668 - DNA, 863 bp, Homo sapiens
ttgcattaaagttgagttgctgcagaagctgtaggtggctttctatataaaatcatttataaaatcatcttcccacagatatgcaagtttcctcatgggaatctcaaggggatttgggctcatcgcaggaatcatctcttccactgccactggattcctcatcagtcaggattttgagtctggttggaggaatgtctttttcctgtctgctgcagtcaacatgtttggcctggtcttttacctcacgtttggacaagcagaacttcaagactgggccaaagagaggacccttacccgcctctgaggacataaagttacaaacttaaatgtggtactgagcatgaactttttaaacattttttacttctctccatattcctgaccatagactcagcagttcttaactctggctgtgtgttagtcttccctggggagcctttataagacactgatacttgggacccactccagagattctgaatgaattggtctggggtggaacccagatactactaatttttagatactccttagaggtttctagcatgcgcccggggttgacaacagctggacaaacttgaaaagtcaattcatgtggcctttgaattttcctcattggaaagtactaaataaataaaaattcatgtgaaaatgatcactgataaatatcttcatggtggggcaggttattggatgcagagaagatctgctcggaattgtagccatatgttacagatctcagcaccgatcagaactgtaaagctataatccccagaattaaagtttttattattttttatacattgtaaaacatagacgtttatttatgtgattaaattctattaaaatttacatgctaaaat

SEQ ID NO: 43669 - DNA, 809 bp, Homo sapiens
ttgcattaaagttgagttgctgcagaagctgtaggtggctttctatataaaatcatttattgggctcatcgcaggaatcatctcttccactgccactggattcctcatcagtcaggattttgagtctggttggaggaatgtctttttcctgtctgctgcagtcaacatgtttggcctggtcttttacctcacgtttggacaagcagaacttcaagactgggccaaagagaggacccttacccgcctctgaggacataaagttacaaacttaaatgtggtactgagcatgaactttttaaacattttttacttctctccatattcctgaccatagactcagcagttcttaactctggctgtgtgttagtcttccctggggagcctttataagacactgatacttgggacccactccagagattctgaatgaattggtctggggtggaacccagatactactaatttttagatactccttagaggtttctagcatgcgcccggggttgacaacagctggacaaacttgaaaagtcaattcatgtggcctttgaattttcctcattggaaagtactaaataaataaaaattcatgtgaaaatgatcactgataaatatcttcatggtggggcaggttattggatgcagagaagatctgctcggaattgtagccatatgttacagatctcagcaccgatcagaactgtaaagctataatccccagaattaaagtttttattattttttatacattgtaaaacatagacgtttatttatgtgattaaattctattaaaatttacatgctaaaat

SEQ ID NO: 43670 - DNA, 2410 bp, Homo sapiens
  misc_feature (1)..(3): n is a, c, g, or t
  misc_feature (321)..(321): n is a, c, g, or t
  misc_feature (1912)..(1912): n is a, c, g, or t
  misc_feature (1970)..(1970): n is a, c, g, or t
nnnaatagctggatttattcacaattgtagtaattagtccctgttcattataattttctaggtgatatgaagactttgtcagtccaagcaagtgtccatattgtgtgtagcaaacatgagaataaacattttaaacttttaaatgtaatacatattagtgttatgtaatgtcatccttcatgttcgaaggcacatggaacattgttctggtggtacagaggggagaggaacaccatcagaatgaaaggaaagaccgctctggaaccttcctccttagctcttgagcttagtttaattgtcctgtcttatggtctgctacangcaataccactcttcaccttcgcatgcttctctgtggtttgataaagtacatgcaatttttcatttaattcttccagctgcactaagaaaggagccttatctttattgaacagatgaggaaatgaatgattagagaatttaaatgactagctctaggtcacacagctggaacttacagccagatttccttttaacaatcctgtaaccaaaagcataccagtagtgccccataaaatgtaagttatagagctgtgttgggtcaaaacttttactgatgctaagaggaggcaacattaacaaggggaaattatttgtgtattatgttttggattatgttctctccatagataaaagactgtcgtagtaaaagagattcagggcacagggaaactccaccacaaagcgtggtaccatttcccacagaagctaaatggacgggaagcctgccaccaggaaaggtccagatttctgttcattacgctatgggctggctcttatcatgcacttctcaaacttcaccatgataacgcagcgtgtgagtctgagcattgcgatcatcgccatggtgaacaccactcagcagcaaggtctatctaatgcctccactgaggggcctgttgcagatgccttcaataactccagcatatccatcaaggaatttgatacaaaggcctctgtgtatcaatggagcccagaaactcagggtatcatctttagctccatcaactatgggataatactgactctgatcccaagtggatatttagcagggatatttggagcaaaaaaaatgcttggtgctggtttgctgatctcttcccttctcaccctctttacaccactggctgctgacttcggagtgattttggtcatcatggttcggacagtccagggcatggcccagggaatggcatggacaggtcagtttactatttgggcaaagtgggctcctccacttgaacgaagcaagctcaccaccattgcaggatcagggtcagcatttggatccttcatcatcctctgtgtggggggactaatctcacaggccttgagctggccttttatcttctacatctttggtagcactggctgtgtctgctgtctcctatggttcacagtgatttatgatgaccccatgcatcacccgtgcataagtgttagggaaaaggagcacatcctgtcctcactggctcaacagcccagttctcctggacgagctgtccccataaaggcgatggtcacatgcctaccactttgggccattttcctgggttttttcagccatttctggttatgcaccatcatcctaacatacctaccaacgtatatcagtactctgctccatgttaacatcagagatagtggagttctgtcctccctgccttttattgctgctgcaagctgtacaattttaggaggtcagctggcagatttccttttgtccaggaatcttctcagattgatcactgtgcgaaagctcttttcatctcttgatatgcaagtttcctcatgggaatctcaaggggatttgggctcatcgcaggaatcatctcttccactgccactggattcctcatcagtcaggttgggncagtttattgaacatcttcaagtggcaggtattgttttaggtgttggagatacacacngtgctctaaagatctggatggcaacacaattactctatttacatgagcctctaaatcagactctggtaggtcagatttcccagaggaagaaaaatataagcttattttctcaagatgaatagatgttagattgattaaaatgagctgttccggtgcagaagacagcacgtatgactacctagaggtacatgagcatgaaacagttcttagttatgaccagaatgaaagacacatgtcaaggaatagcaagagacgaagacagaggggcaaaagaagatcatgaagaatatgttcagactaatccaatttctaaaaaaacacaaaagggaaacaaagtgtcctaggccagtttaaagataatttaatgtctggaaacagatcggctgtgagacattgcaaggaggcttgctcggtgtttggaaatgcaggctcatgaggaa

SEQ ID NO: 43671 - DNA, 346 bp, Homo sapiens
aggtggagaagaccattctcaacatggcccaaatgtagaaactattttttaaaaaaagagtgggccaggcacggtggctcacacctgtaatcccagcactttgggaggctgaggggggtggatcacgaggtcaggagatcgagaccatcctggctaacacggtgaaacccgtctctactaaaaaaatacaaaaaaattagccgggcttggtggcgggcgcttgtagtcccagctactcgggaggctgaggcaggagaatggctgaacccgagaggcggagcttgcagtgagccaagatcgcgccactgcgttccagcctgggaaacagagtgaggctctgtctcaa

SEQ ID NO: 43672 - DNA, 817 bp, Homo sapiens
atatatatgtatgtgtatatataacatgttatatatgcatatatattaatgtatacatgcacacacattgtggaatgtctaaatcaaactatttaagatatgcattacctcacatacttatttttttgtggtgagaatactccaaatcttagcaattttaaagtactcaatatagtggtatgaattcatcattgaatcactatgatgtacaagagatgtcttgaatgtattccttctgtcctaatgaaattttgtgtcctttaaccaacatctccccaattcccagcctctagaaatctttaaagtgattttccaaggaaaagtattggtacgaatattgttggcatagtttgaattgttcatgcattctgttctcactcataagtgggagttgaacaatgagaacacatggacacagggaggggaacaacacaggccagggcctgttgggttgagattgggtgctgaaaggagagcatcaaagtagctcatgcatgcggggcttaaaacctaggtgataagttgacaggtgcagcaaatctccatggcacacgtatacctatgtaacaagcctgtacattctgcacatctgcccatgtatcccggaacttaaagtgaaaaaaaattgctcatgcattcaaaggtaatataattttattaaaaaaataactgagtatgataggttgcacctgtaattgcagctactcaggactcaggaagctaaggagggaggcttgcttgagtccaggagttcgaggatacagtacagtgagctataatcccaacaccctcagcaacagaatgaaaccttatttca

SEQ ID NO: 43673 - DNA, 553 bp, Homo sapiens
ggggttttaccaccttgcccaggctggtctcgaactcctgagctcatgtagtccacccacctgggcctcctgaagtgctaggattacaggcatgagccaccgcgcctggccactctttcttttaaaatttaaagataaaaatattttatttaaggccaggatcatatgccattttagaggggacaaaaactgaagatgctatagggagaaaatctgttgaaatactatttgaataagatgaatatatttaaagctagaaggccagttacttgcattttagggtagtaaagaaattgaccaagtttatcaaaacaccattggctatccatcttgaaaacgcaaagagtattacaaaagtgcataaaactgacaaagagcccaaggcggatcaatacttttagaaaatggagaattatgctttagaaagccacagacctgaagttttgctactcttctttcaaaaactgttttccagaaatcagtcttaaaacactaagaacaaaatgaaatcaagcaaggcagaaccagccccaattaaaaatttgactttcag

SEQ ID NO: 43674 - DNA, 481 bp, Homo sapiens
gagggatctttccctcctaggtttcctgaaacagtttgaattaatggccctggcatatttgaaaagactttctgatttttctttcctctcttgtctgttttcttagcttagtttggggaaagggcaatagagcaaattgtggtaaaggtccatctctttgataatttgactatttaaaaggtatttgcttttctgtcatctatggaaaaaaaaacaatgaaaatataagatactctaggattttttcagctctcctgaaaaatgcttttctgcagaaaaatgtcatagatctgttggccccatagctattaaaataatattcatcacccactcagccacaccagacccaagaattccctgcctcagaggatgaactggaaagtgttcatttgaaacctcacaccaggcttcctataatcaggattgcagctttttcgcctcccctccacaaaacactcagagttatccggaggagacaatc

SEQ ID NO: 43675 - DNA, 377 bp, Homo sapiens
gctagttgatgaattcagtacctcacacacttatctttttttgaggtaaaacatttgaaatctacttcttcggcaattttgaaatatgcaatgcgacccagtgcagtggctcacccctgtaattctaacactttgggaggccaagtcaggtggatcacttgaggtcagagttcaagatcagcctagccaacatggcaaaaatcccgtctctactaaaaatacaaaaattagccaggcatggtgttgctcatctgtagtcccagctacttggggagctgaggcaggagagtcgcttgaaccggggaggtggaggttgcagtgagctgagattgcaccactgcactccggcatgggcaacaaaatgaaaccatgtctca

SEQ ID NO: 43676 - DNA, 308 bp, Homo sapiens
gctacttcaccaattttctcaagggctttgattcagttttctatatcagaaggtaaaaggcgagaggcttccatggctgcctgtcaacagggtttgtggagagaaggggctgggaacctgggcaagcagcactttcagcaataaacagtatcctcaggggcccacagagggaagatggtttcagtgccaaaggcttgagtccccttaattttttcattccacttcactcatcacctgtctcctttctatgctagcaaaagaacaattattcatagatggtaaaattatttatagagccggtgtaatta

SEQ ID NO: 43677 - DNA, 454 bp, Homo sapiens
gggtcctggcccagccttgggcattttcttggcccgcaaaagcagaggggtcagagttagctcccagaagggtttggagttagctcagcacagtgcaggctggtggttgctacctgtcagtggatcctgagatcaagtcgatagacttcagccagctgcctgtgttctcctttccattagcatagaacagaaagcagcatagggcagagtggagtggcgtggcatggggcaggtcagagtgcagtgtgaccctaggttccagcccttatgtgtgtacctagtcccaatgcacaaggagtcctttgtgtgggtggatgcaaacgtatcagagtcgtaagttaagtcagaagaccatgagaagaccctataaatcactgactgggaggcctgctcggcccacagaagctggcttacttaggtcttgctggctgcaaagccctcttcttgttaatta

SEQ ID NO: 43678 - DNA, 674 bp, Homo sapiens
ctctagcgcattacagctaagtgttagtctatgaatgtaatataacagtggtttaaaatcaacagattataacaaaagtccctcacaggagacaaagctggtgccgtgatctctattgcattaatgagacaaatgaggataggaaacatcatgtggcttcccagggctccatggcaggggcgtggcaggggggatttgagtccaggctcctactccagtgctgacctttcccgtcactttcctgctgcccagtgtgagctctatcctgtccagagtcatgaagtattagagcacatggatgtcttatagatgatcttgtccaagtcattcattttagaagagctgatggaacttcagagaggttaaattcacctgttgcaggtcacctatctccttagtgacaagtttgagattacagcccaacttcaagtcacactgactcttgtgattataagtgaaatcatacttggccactcattcctgagcaagatgcctgtttctgaaattagtctctagagtaccaacttttcaggagaaaagatggtaccttacttaccttcaagagcaaagcctttcccatgtttcataagtgtttcttggcagcctaactgactcagtgactgattaaaggaaagactgaaggacatgaaaggcattgacttgctccctcctaa

SEQ ID NO: 43679 - DNA, 442 bp, Homo sapiens
cttttagatgcaaattgattttcttggattttcttgctaagagtcatgaagtattagagcacatggatgtcttatagatgatcttgtccaagtcattcattttagaagagctgatggaacttcagagaggttaaattcacctgttgcaggtcacctatctccttagtgacaagtttgagattacagcccaacttcaagtcacactgactcttgtgattataagtgaaatcatacttggccactcattcctgagcaagatgcctgtttctgaaattagtctctagagtaccaacttttcaggagaaaagatggtaccttacttaccttcaagagcaaagcctttcccatgtttcataagtgtttcttggcagcctaactgactcagtgactgattaaaggaaagactgaaggacatgaaaggcattgacttgctccctcctaa

SEQ ID NO: 43680 - DNA, 396 bp, Homo sapiens
gaaatacaagaatggatgccttctcttacttctcttgcaaatcagtgcctagcaaacttctaaaaggtgaattgttgatagattatatgacttatttttcttcaagctttttaatatgacaagggaattccagccagtatttttacctcttctttcttttcagagtcatgaagtattagagcacatggatgtcttatagatgatcttgtccaagtcattcattttagaagagctgatggaacttcagagaggttaaattcacctgttgcaggtcacctatctccttagtgacaagtttgagattacagcccaacttcaagtcacactgactcttgtgattataagtgaaatcatacttggccactcattcctgagcaagatgcctgtttctgaaat

SEQ ID NO: 43681 - DNA, 475 bp, Homo sapiens
acttcagcacccactacgatgcattagccagagtggagctagagtacaggttacagaagaggccaaccctctgtccctgcattcatgaactcggctctgaggaatcttctgttatttccaaatttgcagaaagaaaccttgggcaaactgcttcttttccaccttaccattccaacaccagccttaggtattaccgtaattagtcaagaacatgtcttggttagtcaagaacacttcatgtgttaagctgggaatgaggatgctacttaggcaaaggactagtgatcaggaacctctctacctgtgtggctcctctggggatggcattaggtttacctttccaggatttctttttttttttctaatttttaagttctgggatacatgtgcagaacatgcaggtttgttacataggtatacatgtgccatggtggtttgctgcacctatcaacccgtcatctaggttttaatcccc

SEQ ID NO: 43682 - DNA, 500 bp, Homo sapiens
gcatttccttctgtcatccattgcaaagacgtaccagcttcagggtagtatggaaagatccctggtctcgcagtcagaagacccgagttcaagatgtgggatctctgaacatggcccttcagttctttcttccgagagctgtgctgatggccaagtaagatgagggctatgaaaagcctctgtagactgcaaaatgagcatgggagaggctgtcattattctggaattgggagacagatttacagagggcctgaacacaggattgaaggtggtgaatttccattcggctgcctgggcgtctgcatgtataaaaagcaaacctaagtggtttttttctcctccaagtgaagatgaaagtgttaaaaatagcaaggaggtgaaagtgttcaaaatagcaaagtggcctgtctcctcttctcctaagcagactgtccaaacagacgcccagtagaaggagcaccttttgatactgggcacgtggtggtgatgcctcctctctc

SEQ ID NO: 43683 - DNA, 328 bp, Homo sapiens
actttcccttcttggcttcacctttactcttgagcttggtaagcaacactgataatgataacatcatgatcaatcagcttgattgatgaattcctctgggactccccactttccatctctgacccctgctcaactttaagaacagtctcttagaaacacagaaaactttcctatgtacttttaagtaaattggcaaatgacagggcatgagccacgcacctaacctgttttcattctctatccccacatacccattcattccccaggtgctaccacaattacctcgtgtgtctgtggtttgggacttcattatctcttccacactctg

SEQ ID NO: 43684 - DNA, 956 bp, Homo sapiens
tttaggtaatcttcagtgctgaaaataactaatgtactgaaagcttgctgtgggttcagtactttcataggagtttgcaatttactgtctcaaaaactctggaatagatttggacctcattttacaacaaagagtttgaagctatgagaggttaagttgcattacctgtcacatatctaacagcaaataaaatggggaagccgtgagtagaacctgggcagcctgtttcccagtcccaggcactcagccattttattgtggctagctgttgctttaagaggctaaaattatacatttgtaattctgaaataagtacccaagaaaatgttctgtatttatgtttttagacaaaatcctgatcagtggtgaataaggggaaaaaaaggtagacaaaatattgttttaaaatacttaaccacgtagactatagtagtaatgttgagataataagatacttatggagaaaaaatgacaaattccttccatctgctcttttcagataagtagaacgtcagccaactggagttccactcttgtcgagggaatgttttcaggactcagagaccctgaaagtgaggccaaaggactggaagttctggtggtcagataactcattcagactggataaaagccagagtgtaaatgtgaaaaccctgaattgtagtcaatggctaaatattgagccacatgcaaggcaactggggtaggtaatgaggaaaccaaaaaatgccactgctgtttccaacgagtacaacaagatggtaataaccaatattcattgagctcttcacatggcaggcagtattctgagtccttgacagtcacttaacccaatcatcacaaccaccatacaagggaaatatggaaattccatgtctttgttgcaggataagttactaagacagtgatttctgaaatattttatgcatacaatgaacagtaaatggtttgagtaa

SEQ ID NO: 43685 - DNA, 221 bp, Homo sapiens
aagccattgccatgcccccagctgaagagccatctagaaggcagagagagagagaggcatagctgctgctagaccgtgataacaaagcaaagtggggagaaggcagaggaagacatgcctggagtctttcttctttcctttcatcttttactggtttatcctactggccaaacccagctagaagccagaaagcaaagggggtacccagcattcagccttta

SEQ ID NO: 43686 - DNA, 428 bp, Homo sapiens
ttttgaaaaacctaggcaggccagctgaaacgggataatgtgggcccccagttgacctcagtggctgtcatctactgtgtttttcaacccaggaatttcaaatactgtgtattttagaaagaaaggaaagagccaaagtgcagccttttctcacttgatcagtaacttgtgttagaaactcagtgggggagaattctttgcgtttttcagttgactgattattttcctttttttcttttttgcttttctcgagtcactctgtgtggtgcttgtgggagaagggagagggtgggagagcgttggtggatgtgttctgcatgttcctttctgtacagtaacttctgcatttactctgtttaggatggttccttcaccactatccctgtctgtagccagtaaatttctggaatattcatcccagagtgcca

SEQ ID NO: 43687 - DNA, 742 bp, Homo sapiens
agaaaccatccctgtccttcagtttataatctagttggagagataagaaacgtacaaaccaaaagataacagaatatctgaagcatgtactcattgtcagatgttccctctgagagcacagaggaggcaaaagcttctgtgggatgtgctagtcggctaaagcttcacagaggaggtggcaattgaaaatgagtcctgaatggggtagggtggttagggaattccatgagacaagacaaggggggcatggtgtgagaaaggcatggaagtaggaaccctcttcctatgacaggagtctacactgcttggactgcaccaaggacttcccttgacagttgtgcttctggttgaatttggccaatggagaggccattcaggaaagcagaaagaaaaaggagagtgaagatggaatacttacttgaagtatttatctggatggtgcctctcaaacaaaagtccaattcccatgggatgccttctccaaacagctatatttctagcttctctccttccccttttagacctaggactgccaaagcttccctattgctgctagtcatggagtactgcactaccgcctgtagtttcccttcactctatccacgcatttcatgaactctcttcaaattactccatatgggtagccatcgacttcttaccaaggccctgactgagacactttcattcttttaaaaatatccgagtcaactaatatattaaaatagaccagcatctcttctca

SEQ ID NO: 43688 - DNA, 277 bp, Homo sapiens
gctcccgtgtacactctcaaggagatgctggtcttccttatctggatgccatctggcttctccacctacctccttctccagggagaggcctctgacctcacccatgtcctctctcagagataaccaccccggtgagcccagcctgtcttccagcctctgcatgcctcagttctgaaagaacatttgaagggatgacaggccaggcgtggtggctcatgcctgcaatcccaacaccttcagaggccgaagcaggcagatcacttgaggccaggagttc

SEQ ID NO: 43689 - DNA, 445 bp, Homo sapiens
aattttacatgcttcaagcgccacaaaacctggatccacccctgggtgaggttataagaggaggactcagtcagctttgggtatgacctcattatatggttgcactttgattatctctgggcatatgggcaactgaagcttctaggttgaggtgacaaagtattttgcaaagctgggaaaaggaaacttccttcatttctgcatggatcccagcacctcccagcactttgaggactggaagctttggaaacactgcaggcagcatccttggatacattggcgttttcataggagtgaggggcctccgctgcagtgtcatgggtatagggcagtggttggcaaactgcagccagtgggaaaacctggcctgctccctgtctttgttttatggcctgtgagctaagaacgttttttacatttcaaaaagattgggggaaaaaaagca

SEQ ID NO: 43690 - DNA, 446 bp, Homo sapiens
ctttttgagacagcgtcttgccctgtcacccaggatggagtgcagaggcacaatcacagctcactgcagccttgacctcctgggttcaggtgatcctcccacctcagcctcccaagtggctgggactacgggtgtgcaccaccatgcctggctaagtttttgtatttttggtagaaatggagtttcgccatgttgcccaggctggtctcgagctcctgggctcaatcaattctcccaccttggcctcccagaattctgggattacagacgtgagccactgtgcccattccttttttaaaatcctacagggaatccaaagcaggtagtttgagcatttaaagagttttaacttatttcagatcttatttcagctggaatgctgcttacctaattcgctggatgtcagcatttcagacaagatttacatttccaagggacttcaggac

SEQ ID NO: 43691 - DNA, 409 bp, Homo sapiens
gaaatcctccgtacagaaagaaaattattccagatggaaatacaggtgtgcagaaaggaattagtgtacaggaatcggtacttaccctggtaaatgtataagattttccccttttacttagatatctttcaaagttaattggctgtttaaagaaaaaataagatagtgtagagttgataacacatgaataaatgaaatatttgacaaaaatagcttaccaactgagaggagaaagatggtaggtgctatgttaaggctctcctgtgtgcagaagtatggtgtctcttcaagatagactgtgataaattaaagatgaatgctataaatcctacagtaatcaccaaatttttaaaaagcattataaccaataagccaacagatgagtaaaattataacatatctaccatga

SEQ ID NO: 43692 - DNA, 632 bp, Homo sapiens
agccagagctgttcccacccagccagggcatgaaacatcaaccccccacatgtgaacccatcattcctaaaccctgggtaggctccatgccaagtaacagcagagggagttaagccataggaatttggctgtggagtaagagggaatgcggtgaggcactctggaatatgaccctaccagaggttggagaacaaacttgggcagccggaacccgtcactattctagacttccctggcattcgaggagccctttgaactttccaaagtgcagccacagctacaatgctgttaaatcctcccacattcttggatgccccttcaccttgtgtggacagtgtctggtttctccattttacagacaggaaaactgagcttcagacagggggtgggctttgcctaaggacacacaaatttggttgggagttgatggggccagatgagccagcattccagctctttcacccttcagcaacatgcagagtccctgagcccacctcccagccctctcctcattctctgaacccactgtggtgagaagaatttgctccggccaaattggccgttagccacctgggtccacatcctgctaagacgtttaaaacagcctaacaaagacacttgcctctggattt

SEQ ID NO: 43693 - DNA, 472 bp, Homo sapiens
cactatgctgtaatgattgtcatatgtgcatattcaatgcctgtattatttcatttcttttttttaaagtttatgtcgtttgttcagctaccttttctatttaggggttgacaaaagaaatttttttttttttttttttttgagaaggagtctcactctgttgcccaggctggagtgcagtggctcctgggactacaggcacccgccaccacacccagctaattttgtttttgtattttttggtagagacagggtttcaccatgttagccaatatggtctcaatctcctgacctcgtgatctgaccacctaggcctcccaaagaaaaatggttttaaacaaagttgggaacatagaaattatggataattaattaaactgtgttgttttagttatttattactggttgatatttattaaattaggaaaagcccttttgaatgtgctatcacataagctgactttgtctaaaa

SEQ ID NO: 43694 - DNA, 620 bp, Homo sapiens
cctgggcaacatggtgaaaccctgtttctataaaaaatacaataattagccaggcttggtggcgtatgcctgtactcccagctacgcggaaggctgaaacggtaggactgcttgagcccgggaggcagaggttgtagtgagccaagatcacgccattgcattccagcctggacaacagagtgagaccccatctcaaaaaataaataaataaaaatgaatgctcatatttctagttaaaggtgcagactaaagacataacattagttccacgccttccttaagtctattgatgtaagattaaaggacttctaaaaaggcataaatccactataacagagagtgggagaagacacagcaacaaaactttgaagctaaaaagaagataggttagtgatacctgggtaatccaaatcctaaaccagccgtaaagaaagtaaagaaacaacctgatttttatcacaggacctcaaaaaaggaaatggtggcaacaaggacctctggaaatggaaatgaacaaggagctaaaaattgcaaggtggttcaatgtttaagaaacagattcccggatcccctcccctatgctgtaaagctagacgactgcacctcccccactcccgtgg

SEQ ID NO: 43695 - DNA, 1635 bp, Homo sapiens
tagtagctgggattacaggcatgtgccacacctggctaatttttgtggttttagtagagacagggtttctccatgttggtcagtctggtctcaaactcccaacctcaggtgatatgcccgcctcggcctcccaaaatgttgggattacaggcatgagccactgcacccggcgcatgttttttcttcattcctattgtattcacatgtgaaagcatgtgatcaacttgctgcatcaaagatatgagatttttttttttattaggtgggcattatttatgaccttttctgtggaagagtaagaacattaaaatgaaagatgcatgatgaaaatctaagtagagaggctcttgtggttaactgataatattgagtgatgcatgaggtaggtgttcagagtaatattctgcattatagtgaaaaatttttaatattaaaattcaattatatcattttatgaattgtgcttttcataatgcagtacatttcaaaatttttagattatgtatgaacttagatttttaaacatgttttaacatgttaagacttgtgcattcagtgaagcgttattatgccacaaactaacctacctcaccttactcaatggtgtaggtaaaagatgatagcaatatattatttggttacatagtggactaacatttttagtaatctcttttgccagtggctttaaactgcagataagttaaatattcccataggttttacatttatattttttcttatttaaatttattgttcttatttttcatgggtacatagtatgtttttatgctgtatatggcatgttttgatacaggtatataatatgtaataatcacatcagggtaaatgaggtatccattactagcatttatcctttgtattttattttaaaatgtacaactaaattgttatggactacagggttatttttatggtcataataaaaattacaaaagtatgaataaaatacatacatttctgagtcctgaatatttttaaaaattgttatatatttttcttctaacatgtggcctctttgcctgcaaacatataaagactcagttttgatttacatagagttaaatatacatatattttactttaaagataaatcttaagtgtaagaaaattgtagagtaagtgtgcttgtgtgagtatgtttgtacctgttttcagaagaaaacagcaatattggaacaaaacaaatcattttaataaggtgactaatttattagaaaactaacaacctcaaaaatgctgaaagcaaatctatactctctctgctttgtactgaattcattactgtaaaatattatggcttatggttcagaatctccccatgcagatgttctgtttttacttgcctggtactcatggtagagccatacatttcttttttcttacaatttcttttacagtttatgaagtattatatgagctggtcagggattacaacaattattttttttataaaatttagtagtgcacaaaaagtaatttttagatgtaattttactattagtctattaagttatattttatttatttagttaaaacattgccctttgttcttttaattggagaaccctatgtaagccgacttttttaaagttattctttctttcacttttcata

SEQ ID NO: 43696 - DNA, 1798 bp, Homo sapiens
tagtagctgggattacaggcatgtgccacacctggctaatttttgtggttttagtagagacagggtttctccatgttggtcagtctggtctcaaactcccaacctcaggtgatatgcccgcctcggcctcccaaaatgttgggattacaggcatgagccactgcacccggcgcatgttttttcttcattcctattgtattcacatgtgaaagcatgtgatcaacttgctgcatcaaagatatgagatttttttttttattaggtgggcattatttatgaccttttctgtggaagagtaagaacattaaaatgaaagatgcatgatgaaaatctaagtagagaggctcttgtggttaactgataatattgagtgatgcatgaggtaggtgttcagagtaatattctgcattatagtgaaaaatttttaatattaaaattcaattatatcattttatgaattgtgcttttcataatgcagtacatttcaaaatttttagattatgtatgaacttagatttttaaacatgttttaacatgttaagacttgtgcattcagtgaagcgttattatgccacaaactaacctacctcaccttactcaatggtgtaggtaaaagatgatagcaatatattatttggttacatagtggactaacatttttagtaatctcttttgccagtggctttaaactgcagataagttaaatattcccataggttttacatttatattttttcttatttaaatttattgttcttatttttcatgggtacatagtatgtttttatgctgtatatggcatgttttgatacaggtatataatatgtaataatcacatcagggtaaatgaggtatccattactagcatttatcctttgtattttattttaaaatgtacaactaaattgttatggactacagggttatttttatggtcataataaaaattacaaaagtatgaataaaatacatacatttctgagtcctgaatatttttaaaaattgttatatatttttcttctaacatgtggcctctttgcctgcaaacatataaagactcagttttgatttacatagagttaaatatacatatattttactttaaagataaatcttaagtgtaagaaaattgtagagtaagtgtgcttgtgtgagtatgtttgtacctgttttcagaagaaaacagcaatattggaacaaaacaaatcattttaataaggtgactaatttattagaaaactaacaacctcaaaaatgctgaaagcaaatctatactctctctgctttgtactgaattcattactgtaaaatattatggcttatggttcagaatctccccatgcagatgttctgtttttacttgcctggtactcatggtagagccatacatttcttttttcttacaatttcttttacagtttatgaagtattatatgagctggtcagggattacaacaattattttttttataaaatttagtagtgcacaaaaagtaatttttagatgtaattttactattagtctattaagttatattttatttatttagttaaacatggcttgtctttaatgggacctagtagcgatttttaagtatcttcttcatttcataattcatagtaattattattatgaattggcaggagaaagggggccggcagaggaggggctattaaattggaaaggggggggttagaggcagagaaaattggggggggcaaagaaatagggaagagtggggatggggaaggaaagggaatggagcaatgcttgtgtcttttgtatgtttgatatatg

SEQ ID NO: 43697 - DNA, 1029 bp, Homo sapiens
ttactaaatgatttattaggtgcgggaatctattaggtaagtgaatatggacatgagggtagtaagttaaagatatcctgtaggttgaatattgataggattcttaataaaaataaatggtcgtgataacccgatggttataggtaagaatgttcagaattggctgtgtatgatggtcatgtactgaattacaagtctaatatggatgaattgtaagtagatcatcgttagtgaataagacgcgctatcccatgaatagcatttatcctttgtattttattttaaaatgtacaactaaattgttatggactacagggttatttttatggtcataataaaaattacaaaagtatgaataaaatacatacatttctgagtcctgaatatttttaaaaattgttatatatttttcttctaacatgtggcctctttgcctgcaaacatataaagactcagttttgatttacatagagttaaatatacatatattttactttaaagataaatcttaagtgtaagaaaattgtagagtaagtgtgcttgtgtgagtatgtttgtacctgttttcagaagaaaacagcaatattggaacaaaacaaatcattttaataaggtgactaatttattagaaaactaacaacctcaaaaatgctgaaagcaaatctatactctctctgctttgtactgaattcattactgtaaaatattatggcttatggttcagaatctccccatgcagatgttctgtttttacttgcctggtactcatggtagagccatacatttcttttttcttacaatttcttttacagtttatgaagtattatatgagctggtcagggattacaacaattattttttttataaaatttagtagtgcacaaaaagtaatttttagatgtaattttactattagtctattaagttatattttatttatttagttaaaacattgccctttgttcttttaattggagaaccctatgtaagccgacttttttaaagttattctttctttcacttttcata

SEQ ID NO: 43698 - DNA, 421 bp, Homo sapiens
ccatggcagtatctggcctgtcacagtcattgcagcatcccctggctcagtgcctggaaagaatgaattcagtctaaatgacccttaaagaagtaccctttaattccctctaaagctgagggggccggagcctgcatagagggtcagtgcagagtaggccagccaccaggccagcttccttggagtgcatgaccccctggtccatatttggttgaaagaggagggtgatgtgatggttaagtttatgtgtcaacttgactgggccacaggatgcccaggtagctggctaagcgtcatttccgggtgtttacataaaggtgtttccagaagagatgagcatttgaatcggtgggctgaggatagcagatagtctccctaatgtgggcgggcaacatgcaacctgttaagggcctgatgagaa

SEQ ID NO: 43699 - DNA, 2668 bp, Homo sapiens
gctcccggggccacgggatgacgcctcctccgcccggacgtgccgcccccagcgcaccgcgcgcccgcgtccctggcccgccggctcggttggggcttccgctgcggctgcggctgctgctgctgctctgggcggccgccgcctccgcccagggccacctaaggagcggaccccgcatcttcgccgtctggaaaggccatgtagggcaggaccgggtggactttggccagactgagccgcacacggtgcttttccacgagccaggcagctcctctgtgtgggtgggaggacgtggcaaggtctacctctttgacttccccgagggcaagaacgcatctgtgcgcacggtgaatatcggctccacaaaggggtcctgtctggataagcgggactgcgagaactacatcactctcctggagaggcggagtgaggggctgctggcctgtggcaccaacgcccggcaccccagctgctggaacctggtgaatggcactgtggtgccacttggcgagatgagaggctacgcccccttcagcccggacgagaactccctggttctgtttgaaggggacgaggtgtattccaccatccggaagcaggaatacaatgggaagatccctcggttccgccgcatccggggcgagagtgagctgtacaccagtgatactgtcatgcagaacccacagttcatcaaagccaccatcgtgcaccaagaccaggcttatccgacgacaggttccgagcttcttccgagaggacaatcctgacaagaatcctgaggctcctctcaatgtgtcccgtgtggcccagttgtgcaggggggaccagggtggggaaagttcactgtcagtctccaagtggaacacttttctgaaagccatgctggtatgcagtgatgctgccaccaacaagaacttcaacaggctgcaagacgtcttcctgctccctgaccccagcggccagtggagggacaccagggtctatggtgttttctccaacccctggaactactcagccgtctgtgtgtattccctcggtgacattgacaaggtcttccgtacctcctcactcaagggctaccactcaagccttcccaacccgcggcctggcaagtgcctcccagaccagcagccgatacccacagagaccttccaggtggctgaccgtcacccagaggtggcgcagagggtggagcccatggggcctctgaagacgccattgttccactctaaataccactaccagaaagtggccgtccaccgcatgcaagccagccacggggagacctttcatgtgctttacctaactacagacaggggcactatccacaaggtggtggaaccgggggagcaggagcacagcttcgccttcaacatcatggagatccagcccttccgccgcgcggctgccatccagaccatgtcgctggatgctgagcggaggaagctgtatgtgagctcccagtgggaggtgagccaggtgcccctggacctgtgtgaggtctatggcgggggctgccacggttgcctcatgtcccgagacccctactgcggctgggaccaaggccgctgcatctccatctacagctccgaacggtcagtgctgcaatccattaatccagccgagccacacaaggagtgtcccaaccccaaaccagacaaggccccactgcagaaggtttccctggccccaaactctcgctactacctgagctgccccatggaatcccgccacgccacctactcatggcgccacaaggagaacgtggagcagagctgcgaacctggtcaccagagccccaactgcatcctgttcatcgagaacctcacggcgcagcagtacggccactacttctgcgaggcccaggagggctcctacttccgcgaggctcagcactggcagctgctgcccgaggacggcatcatggccgagcacctgctgggtcatgcctgtgccctggccgcctccctctggctgggggtgctgcccacactcactcttggcttgctggtccactagggcctcccgaggctgggcatgcctcaggcttctgcagcccagggcactagaacgtctcacactcagagccggctggcccgggagctccttgcctgccacttcttccaggggacagaataacccagtggaggatgccaggcctggagacgtccagccgcaggcggctgctgggccccaggtggcgcacggatggtgaggggctgagaatgagggcaccgactgtgaagctggggcatcgatgacccaagactttatcttctggaaaatatttttcagactcctcaaacttgactaaatgcagcgatgctcccagcccaagagcccatgggtcggggagtgggtttggataggagagctgggactccatctcgaccctggggctgaggcctgagtccttctggactcttggtacccacattgcctccttcccctccctctctcatggctgggtggctggtgttcctgaagacccagggctaccctctgtccagccctgtcctctgcagctccctctctggtcctgggtcccacaggacagccgccttgcatgtttattgaaggatgtttgctttccggacggaaggacggaaaaagctctatttttatgttaggcttatttcatgtatagctacttccgactgcatctgta

SEQ ID NO: 43700 - DNA, 549 bp, Homo sapiens
tactcaggggcgagctgcgggcgatcatcaagaagatctggaagcggacccgcatgaagctgctggaccaggtggtgccacctgcagggatggtgaggggctgagaatgagggcaccgactgtgaagctggggcatcgatgacccaagactttatcttctggaaaatatttttcagactcctcaaacttgactaaatgcagcgatgctcccagcccaagagcccatgggtcggggagtgggtttggataggagagctgggactccatctcgaccctggggctgaggcctgagtccttctggactcttggtacccacattgcctccttcccctccctctctcatggctgggtggctggtgttcctgaagacccagggctaccctctgtccagccctgtcctctgcagctccctctctggtcctgggtcccacaggacagccgccttgcatgtttattgaaggatgtttgctttccggacggaaggacggaaaaagctctatttttatgttaggcttatttcatgtatagctacttccgactgcatctgta

SEQ ID NO: 43701 - DNA, 1455 bp, Homo sapiens
gctcccggggccacgggatgacgcctcctccgcccggacgtgccgcccccagcgcaccgcgcgcccgcgtccctggcccgccggctcggttggggcttccgctgcggctgcggctgctgctgctgctctgggcggccgccgcctccgcccagggccacctaaggagcggaccccgcatcttcgccgtctggaaaggccatgtagggcaggaccgggtggactttggccagactgagccgcacacggtgcttttccacgagccaggcagctcctctgtgtgggtgggaggacgtggcaaggtctacctctttgacttccccgagggcaagaacgcatctgtgcgcacggtgaatatcggctccacaaaggggtcctgtctggataagcgggactgcgagaactacatcactctcctggagaggcggagtgaggggctgctggcctgtggcaccaacgcccggcaccccagctgctggaacctggtgaatggcactgtggtgccacttggcgagatgagaggctacgcccccttcagcccggacgagaactccctggttctgtttgaaggggacgaggtgtattccaccatccggaagcaggaatacaatgggaagatccctcggttccgccgcatccggggcgagagtgagctgtacaccagtgatactgtcatgcagaacccacagttcatcaaagccaccatcgtgcaccaagaccaggcttatccgacgacaggttccgagcttcttccgagaggacaatcctgacaagaatcctgaggctcctctcaatgtgtcccgtgtggcccagttgtgcaggggggaccagggtggggaaagttcactgtcagtctccaagtggaacacttttctgaaagccatgctggtatgcagtgatgctgccaccaacaagaacttcaacaggctgcaagacgtcttcctgctccctgaccccagcggccagtggagggacaccagggtctatggtgttttctccaacccctggaactactcagccgtctgtgtgtattccctccctggacttctcatcttcacaagatggggatcatgggggtttcttaccccacctatgtccccctcttccccaccctgtccctgtagaaaaccagtgaagcaggtacggagctgaggactgggccccaggaggtggggacaggggtctgaatgccgagtccctgaattcacccaggaccatccaaggggccaccgcagcattggccccatcaccacgtcctcacccaactctccctgatgaatagaatatacacactgtgctaggtgtatatatacatatatatatatataaatatatatataatatataaaatatagatatggaaatgactgttctgctgttaagataatgtatactcttttattttcttcctttcatggttaagattttttttttaagaaaagttaaatatccaaaaaa

SEQ ID NO: 43702 - DNA, 2324 bp, Homo sapiens
ttctgctggtcgattctagaggtatccctgtcgtcggataagcgggactgcgagaactacatcactctcctggagaggcggagtgaggggctgctggcctgtggcaccaacgcccggcaccccagctgctggaacctggtgaatggcactgtggtgccacttggcgagatgagaggctacgcccccttcagcccggacgagaactccctggttctgtttgaaggggacgaggtgtattccaccatccggaagcaggaatacaatgggaagatccctcggttccgccgcatccggggcgagagtgagctgtacaccagtgatactgtcatgcagaacccacagttcatcaaagccaccatcgtgcaccaagaccaggcttatccgacgacaggttccgagcttcttccgagaggacaatcctgacaagaatcctgaggctcctctcaatgtgtcccgtgtggcccagttgtgcaggggggaccagggtggggaaagttcactgtcagtctccaagtggaacacttttctgaaagccatgctggtatgcagtgatgctgccaccaacaagaacttcaacaggctgcaagacgtcttcctgctccctgaccccagcggccagtggagggacaccagggtctatggtgttttctccaacccctggaactactcagccgtctgtgtgtattccctcggtgacattgacaaggtcttccgtacctcctcactcaagggctaccactcaagccttcccaacccgcggcctggcaagtgcctcccagaccagcagccgatacccacagagaccttccaggtggctgaccgtcacccagaggtggcgcagagggtggagcccatggggcctctgaagacgccattgttccactctaaataccactaccagaaagtggccgtccaccgcatgcaagccagccacggggagacctttcatgtgctttacctaactacagacaggggcactatccacaaggtggtggaaccgggggagcaggagcacagcttcgccttcaacatcatggagatccagcccttccgccgcgcggctgccatccagaccatgtcgctggatgctgagcggaggaagctgtatgtgagctcccagtgggaggtgagccaggtgcccctggacctgtgtgaggtctatggcgggggctgccacggttgcctcatgtcccgagacccctactgcggctgggaccaaggccgctgcatctccatctacagctccgaacggtcagtgctgcaatccattaatccagccgagccacacaaggagtgtcccaaccccaaaccagacaaggccccactgcagaaggtttccctggccccaaactctcgctactacctgagctgccccatggaatcccgccacgccacctactcatggcgccacaaggagaacgtggagcagagctgcgaacctggtcaccagagccccaactgcatcctgttcatcgagaacctcacggcgcagcagtacggccactacttctgcgaggcccaggagggctcctacttccgcgaggctcagcactggcagctgctgcccgaggacggcatcatggccgagcacctgctgggtcatgcctgtgccctggccgcctccctctggctgggggtgctgcccacactcactcttggcttgctggtccactagggcctcccgaggctgggcatgcctcaggcttctgcagcccagggcactagaacgtctcacactcagagccggctggcccgggagctccttgcctgccacttcttccaggggacagaataacccagtggaggatgccaggcctggagacgtccagccgcaggcggctgctgggccccaggtggcgcacggatggtgaggggctgagaatgagggcaccgactgtgaagctggggcatcgatgacccaagactttatcttctggaaaatatttttcagactcctcaaacttgactaaatgcagcgatgctcccagcccaagagcccatgggtcggggagtgggtttggataggagagctgggactccatctcgaccctggggctgaggcctgagtccttctggactcttggtacccacattgcctccttcccctccctctctcatggctgggtggctggtgttcctgaagacccagggctaccctctgtccagccctgtcctctgcagctccctctctggtcctgggtcccacaggacagccgccttgcatgtttattgaaggatgtttgctttccggacggaaggacggaaaaagctctatttttatgttaggcttatttcatgtatagctacttccgactgcatctgta

SEQ ID NO: 43703 - DNA, 2315 bp, Homo sapiens
cgcagtcaggatgctgtgcattgtgcaaggaagctagatgaatcacagtgtacgaaggttggacccggtgggactcgtgtcgtgtgtcgtttgccggctgcatctgagtacctcagcgtggtaccgagcgcatgttcgtgatcatgctcttggctatatcatgtgttataacccctgtcagcccggacgagtaactccttggtactgcctgaaggggacgaggtgtattccaccatccggaagcaggaatacaatgggaagatccctcggttccgccgcatccggggcgagagtgagctgtacaccagtgatactgtcatgcagaacccacagttcatcaaagccaccatcgtgcaccaagaccaggcttatccgacgacaggttccgagcttcttccgagaggacaatcctgacaagaatcctgaggctcctctcaatgtgtcccgtgtggcccagttgtgcaggggggaccagggtggggaaagttcactgtcagtctccaagtggaacacttttctgaaagccatgctggtatgcagtgatgctgccaccaacaagaacttcaacaggctgcaagacgtcttcctgctccctgaccccagcggccagtggagggacaccagggtctatggtgttttctccaacccctggaactactcagccgtctgtgtgtattccctcggtgacattgacaaggtcttccgtacctcctcactcaagggctaccactcaagccttcccaacccgcggcctggcaagtgcctcccagaccagcagccgatacccacagagaccttccaggtggctgaccgtcacccagaggtggcgcagagggtggagcccatggggcctctgaagacgccattgttccactctaaataccactaccagaaagtggccgtccaccgcatgcaagccagccacggggagacctttcatgtgctttacctaactacagacaggggcactatccacaaggtggtggaaccgggggagcaggagcacagcttcgccttcaacatcatggagatccagcccttccgccgcgcggctgccatccagaccatgtcgctggatgctgagcggaggaagctgtatgtgagctcccagtgggaggtgagccaggtgcccctggacctgtgtgaggtctatggcgggggctgccacggttgcctcatgtcccgagacccctactgcggctgggaccaaggccgctgcatctccatctacagctccgaacggtcagtgctgcaatccattaatccagccgagccacacaaggagtgtcccaaccccaaaccagacaaggccccactgcagaaggtttccctggccccaaactctcgctactacctgagctgccccatggaatcccgccacgccacctactcatggcgccacaaggagaacgtggagcagagctgcgaacctggtcaccagagccccaactgcatcctgttcatcgagaacctcacggcgcagcagtacggccactacttctgcgaggcccaggagggctcctacttccgcgaggctcagcactggcagctgctgcccgaggacggcatcatggccgagcacctgctgggtcatgcctgtgccctggccgcctccctctggctgggggtgctgcccacactcactcttggcttgctggtccactagggcctcccgaggctgggcatgcctcaggcttctgcagcccagggcactagaacgtctcacactcagagccggctggcccgggagctccttgcctgccacttcttccaggggacagaataacccagtggaggatgccaggcctggagacgtccagccgcaggcggctgctgggccccaggtggcgcacggatggtgaggggctgagaatgagggcaccgactgtgaagctggggcatcgatgacccaagactttatcttctggaaaatatttttcagactcctcaaacttgactaaatgcagcgatgctcccagcccaagagcccatgggtcggggagtgggtttggataggagagctgggactccatctcgaccctggggctgaggcctgagtccttctggactcttggtacccacattgcctccttcccctccctctctcatggctgggtggctggtgttcctgaagacccagggctaccctctgtccagccctgtcctctgcagctccctctctggtcctgggtcccacaggacagccgccttgcatgtttattgaaggatgtttgctttccggacggaaggacggaaaaagctctatttttatgttaggcttatttcatgtatagctacttccgactgcatctgta

SEQ ID NO: 43704 - DNA, 2977 bp, Homo sapiens
gctcccggggccacgggatgacgcctcctccgcccggacgtgccgcccccagcgcaccgcgcgcccgcgtccctggcccgccggctcggttggggcttccgctgcggctgcggctgctgctgctgctctgggcggccgccgcctccgcccagggccacctaaggagcggaccccgcatcttcgccgtctggaaaggccatgtagggcaggaccgggtggactttggccagactgagccgcacacggtgcttttccacgagccaggcagctcctctgtgtgggtgggaggacgtggcaaggtctacctctttgacttccccgagggcaagaacgcatctgtgcgcacggtgaatatcggctccacaaaggggtcctgtctggataagcgggactgcgagaactacatcactctcctggagaggcggagtgaggggctgctggcctgtggcaccaacgcccggcaccccagctgctggaacctggtgaatggcactgtggtgccacttggcgagatgagaggctacgcccccttcagcccggacgagaactccctggttctgtttgaaggggacgaggtgtattccaccatccggaagcaggaatacaatgggaagatccctcggttccgccgcatccggggcgagagtgagctgtacaccagtgatactgtcatgcagaacccacagttcatcaaagccaccatcgtgcaccaagaccaggcttatccgacgacaggttccgagcttcttccgagaggacaatcctgacaagaatcctgaggctcctctcaatgtgtcccgtgtggcccagttgtgcaggggggaccagggtggggaaagttcactgtcagtctccaagtggaacacttttctgaaagccatgctggtatgcagtgatgctgccaccaacaagaacttcaacaggctgcaagacgtcttcctgctccctgaccccagcggccagtggagggacaccagggtctatggtgttttctccaacccctggaactactcagccgtctgtgtgtattccctcggtgacattgacaaggtcttccgtacctcctcactcaagggctaccactcaagccttcccaacccgcggcctggcaagtgcctcccagaccagcagccgatacccacagagaccttccaggtggctgaccgtcacccagaggtggcgcagagggtggagcccatggggcctctgaagacgccattgttccactctaaataccactaccagaaagtggccgtccaccgcatgcaagccagccacggggagacctttcatgtgctttacctaactacagacaggggcactatccacaaggtggtggaaccgggggagcaggagcacagcttcgccttcaacatcatggagatccagcccttccgccgcgcggctgccatccagaccatgtcgctggatgctgagcggaggaagctgtatgtgagctcccagtgggaggtgagccaggtgcccctggacctgtgtgaggtctatggcgggggctgccacggttgcctcatgtcccgagacccctactgcggctgggaccaaggccgctgcatctccatctacagctccgaacggtcagtgctgcaatccattaatccagccgagccacacaaggagtgtcccaaccccaaaccaggtacctgatctggccctgctggcggctgtggcccaatgagtggggtactgccctgccctgattgtcctggtctgagggagacatggccttgtcctgtgggccccaggtacatggggcaggatacagtcctgcagagggagccctcttggtgggatgagcgagacgggagaaaaaaggaggacgctgagggctgggttccccacgttcattcagaagccttgtcctgggatcccagtccgtggggaggacacatcctcccctgggagctctttgtccctcctcacggctgcttccccactgcctccccagacaaggccccactgcagaaggtttccctggccccaaactctcgctactacctgagctgccccatggaatcccgccacgccacctactcatggcgccacaaggagaacgtggagcagagctgcgaacctggtcaccagagccccaactgcatcctgttcatcgagaacctcacggcgcagcagtacggccactacttctgcgaggcccaggagggctcctacttccgcgaggctcagcactggcagctgctgcccgaggacggcatcatggccgagcacctgctgggtcatgcctgtgccctggccgcctccctctggctgggggtgctgcccacactcactcttggcttgctggtccactagggcctcccgaggctgggcatgcctcaggcttctgcagcccagggcactagaacgtctcacactcagagccggctggcccgggagctccttgcctgccacttcttccaggggacagaataacccagtggaggatgccaggcctggagacgtccagccgcaggcggctgctgggccccaggtggcgcacggatggtgaggggctgagaatgagggcaccgactgtgaagctggggcatcgatgacccaagactttatcttctggaaaatatttttcagactcctcaaacttgactaaatgcagcgatgctcccagcccaagagcccatgggtcggggagtgggtttggataggagagctgggactccatctcgaccctggggctgaggcctgagtccttctggactcttggtacccacattgcctccttcccctccctctctcatggctgggtggctggtgttcctgaagacccagggctaccctctgtccagccctgtcctctgcagctccctctctggtcctgggtcccacaggacagccgccttgcatgtttattgaaggatgtttgctttccggacggaaggacggaaaaagctctatttttatgttaggcttatttcatgtatagctacttccgactgcatctgta

SEQ ID NO: 43705 - DNA, 2302 bp, Homo sapiens
gctagctgagcgtgacgtcgatatgtcatagtctatatcatcgtctcctggagaggcggagtgaggggctgctggcctgtggcaccaacgcccggcaccccagctgctggaacctggtgaatggcactgtggtgccacttggcgagatgagaggctacgcccccttcagcccggacgagaactccctggttctgtttgaaggggacgaggtgtattccaccatccggaagcaggaatacaatgggaagatccctcggttccgccgcatccggggcgagagtgagctgtacaccagtgatactgtcatgcagaacccacagttcatcaaagccaccatcgtgcaccaagaccaggcttatccgacgacaggttccgagcttcttccgagaggacaatcctgacaagaatcctgaggctcctctcaatgtgtcccgtgtggcccagttgtgcaggggggaccagggtggggaaagttcactgtcagtctccaagtggaacacttttctgaaagccatgctggtatgcagtgatgctgccaccaacaagaacttcaacaggctgcaagacgtcttcctgctccctgaccccagcggccagtggagggacaccagggtctatggtgttttctccaacccctggaactactcagccgtctgtgtgtattccctcggtgacattgacaaggtcttccgtacctcctcactcaagggctaccactcaagccttcccaacccgcggcctggcaagtgcctcccagaccagcagccgatacccacagagaccttccaggtggctgaccgtcacccagaggtggcgcagagggtggagcccatggggcctctgaagacgccattgttccactctaaataccactaccagaaagtggccgtccaccgcatgcaagccagccacggggagacctttcatgtgctttacctaactacagacaggggcactatccacaaggtggtggaaccgggggagcaggagcacagcttcgccttcaacatcatggagatccagcccttccgccgcgcggctgccatccagaccatgtcgctggatgctgagcggaggaagctgtatgtgagctcccagtgggaggtgagccaggtgcccctggacctgtgtgaggtctatggcgggggctgccacggttgcctcatgtcccgagacccctactgcggctgggaccaaggccgctgcatctccatctacagctccgaacggtcagtgctgcaatccattaatccagccgagccacacaaggagtgtcccaaccccaaaccagacaaggccccactgcagaaggtttccctggccccaaactctcgctactacctgagctgccccatggaatcccgccacgccacctactcatggcgccacaaggagaacgtggagcagagctgcgaacctggtcaccagagccccaactgcatcctgttcatcgagaacctcacggcgcagcagtacggccactacttctgcgaggcccaggagggctcctacttccgcgaggctcagcactggcagctgctgcccgaggacggcatcatggccgagcacctgctgggtcatgcctgtgccctggccgcctccctctggctgggggtgctgcccacactcactcttggcttgctggtccactagggcctcccgaggctgggcatgcctcaggcttctgcagcccagggcactagaacgtctcacactcagagccggctggcccgggagctccttgcctgccacttcttccaggggacagaataacccagtggaggatgccaggcctggagacgtccagccgcaggcggctgctgggccccaggtggcgcacggatggtgaggggctgagaatgagggcaccgactgtgaagctggggcatcgatgacccaagactttatcttctggaaaatatttttcagactcctcaaacttgactaaatgcagcgatgctcccagcccaagagcccatgggtcggggagtgggtttggataggagagctgggactccatctcgaccctggggctgaggcctgagtccttctggactcttggtacccacattgcctccttcccctccctctctcatggctgggtggctggtgttcctgaagacccagggctaccctctgtccagccctgtcctctgcagctccctctctggtcctgggtcccacaggacagccgccttgcatgtttattgaaggatgtttgctttccggacggaaggacggaaaaagctctatttttatgttaggcttatttcatgtatagctacttccgactgcatctgta

SEQ ID NO: 43706 - DNA, 1841 bp, Homo sapiens
ggtaaggtgcctcgcaggcacgtgagggcctctctaatcgttagctattgtcaccgattgtattgttatgacttctaccaccaccactccccctcctcctgggatggtgattccagggccaggcggcaggctataactagcgcccttccaggtggaacccgccagagccccgaggcagcctaggattttctgagatcagacacacttgggccgggttgggaggaactggcaggaaaaggactgaacccttaatgtcaggcggttttgaagcacctggggcaagctatggaaatccccacaggaaggctcacgcagtctcttaggcggctgccctccacctgccacgttctttttgattgactaaaaaacgctgaatgaagaacgaagtcgcgtggaaaccctcgccgcgcgcctgcagcggacagcgcagcccgggaggttcggctgcggacttgcgcccgggggctgcgctgcgagcggccacgcatggcggctggacccgggcggccgcaagggcttggctgggccgcgggaggcgggaggttcttcgtcctcccgagccatctccctgaactgacaagcaggactcccgggtccagggggcacagggcccggggcggtgacccggcggatcgggctgccggaggagcccactgtaaatgccgcaactggccccaaacactgcgttcctggactgcaccagcagctcctggcgcggccgcagagttggtggatattttccaagggggaaaaaaatcttttaaatgccatctgtttactttaaaaatgttgattacttaagaaaaacgaatggatgtctgggcaaaggtatggacgtcacaattattttgaaggcgtcctttttaactttaaacagaccacgccaggaggagactgctgacccagagcgcattacctaaaatctggtacccagagtgcacccttcgccctcgttggagttctctcctctctgccaagctttgctccgtgccagaggtgtgctccattgtacctccgctctgtccctgcagtcaggcaaccaattggagaagagtataaatagtaattaaccagggagagttgtaattcagaaacctagttaaaacaagtcctcaaaaactagagaatatgagagtggggagacattttgaaggcattaagaacaaaaaacgatggggacgaatggttgagtctgaggatcagcatcgtaatctgttagagaacgaggtcgtggctgtgtctgtgagtcgttaatgggtttaatcggttgatacacagcctgctagtggcctaaccagtaacccagggcctggcagatttgcatgacatctcggagtttgattgctcttccttccacttggcaaaaggagacaccatcagccggatcaggaggggtcatggtgagatggaacccaccgaggtggtgtacagagctggcgctgccaatggccagagtggcagcctttctacctccttaaccctgcaaaaatcaaacgtgctagtacgcactgtccatccacactggaactccagttggttttagtctgcgatgatgactcttctgggttgacttttccagttcattatgcagccctcttgaagcaggcctcccaaacttagcagacaccaatgagaacctcacagagaggctcatcaagcaggctggtgaaactgggtgttacttcctgttccatgggtaccccatagtgtttgggaaacaccgggctgtggttcaggagaatttcacatatgctaagatggagaaagaacctgccctttacatttaggcttgggatgttaatttaaagtttgaatgaccaaaaattaaatctgtaactttt

SEQ ID NO: 43707 - DNA, 2502 bp, Homo sapiens
ggtaaggtgcctcgcaggcacgtgagggcctctctaatcgttagctattgtcaccgattgtattgttatgacttctaccaccaccactccccctcctcctgggatggtgattccagggccaggcggcaggctataactagcgcccttccaggtggaacccgccagagccccgaggcagcctaggattttctgagatcagacacacttgggccgggttgggaggaactggcaggaaaaggactgaacccttaatgtcaggcggttttgaagcacctggggcaagctatggaaatccccacaggaaggctcacgcagtctcttaggcggctgccctccacctgccacgttctttttgattgactaaaaaacgctgaatgaagaacgaagtcgcgtggaaaccctcgccgcgcgcctgcagcggacagcgcagcccgggaggttcggctgcggacttgcgcccgggggctgcgctgcgagcggccacgcatggcggctggacccgggcggccgcaagggcttggctgggccgcgggaggcgggaggttcttcgtcctcccgagccatctccctgaactgacaagcaggactcccgggtccagggggcacagggcccggggcggtgacccggcggatcgggctgccggaggagcccactgtaaatgccgcaactggccccaaacactgcgttcctggactgcaccagcagctcctggcgcggccgcagagttggtggatattttccaagggggaaaaaaatcttttaaatgccatctgtttactttaaaaatgttgattacttaagaaaaacgaatggatgtctgggcaaaggtatggacgtcacaattattttgaaggcgtcctttttaactttaaacagaccacgccaggaggagactgctgacccagagcgcattacctaaaatctggtacccagagtgcacccttcgccctcgttggagttctctcctctctgccaagctttgctccgtgccagaggtgtgctccattgtacctccgctctgtccctgcagtcaggcaaccaattggagaagagtataaatagtaattaaccagggagagttgtaattcagaaacctagttaaaacaagtcctcaaaaactagagaatatgagagtggggagacattttgaaggcattaagaacaaaaaacgatggggacgaatggttgagtctgaggatcagcatcgtaatctgttagagaacgaggtcgtggctgtgtctgtgagtcgttaatgggtttaatcggttgatacacagcctgctagtggcctaaccagtaacccagggcctggcagatttgcatgacatctcggagtttgattgctcttccttccacttggcaaaaggagacaccatcagccggatcaggaggggtcatggtgagatggaacccaccgaggtggtgtacagagctggcgctgccaatggccagagtggcagcctttctacctccttaaccctgcaaaaatcaaacgtgctagtacgcactgtccatccacactggaactccagttggttttagtctgcgatgatgactcttctgggttgacttttccagttcattatgcagccctcttgaagcaggcctcccaaacttagcagacaccaatgagaacctcacagagaggctcatcaagcaggctggtgaaactgggtgttacttcctgttccatgggtaccccatagtgtttgggaaacaccgggctgtggttcaggagaatttcacatatgctaagatggagaaagaacctgccctttacatttaggcttgggatgttaatttaaagtttgaatgaccaaaaattaaatctgtaacttttaaagtttctctttgtgattttacttaagtgttggtagatattcttaaattgtaatgacctcagtttgggaattaagttagccaaatattgtgtaattattgtttgttatacaaaaatatgccttagactgtacagcggcagaaactccctctaccacctcggtccccctttccattctgcgttatacaaaataagctgacacgttaatgctgtggcccacattaaacaaagtataccgtacgtgtgtgtgtgtgtatgtggcataataaatggtggtagctaacacttaccgaatgttttccctatgttccaggcactgtttcaagttttacaggattagcaaatttaatcctcattacagttctgtgaagtaggtacttttacaggtgaggaaacacaggcacagagaggttaagcaatttgcccaagatctcacagctgggaagtaccaaagctaatataccaacccaggcagtcctgctccagagatcgttctggaccattctggatcacacttcctcgcttaagtgattgaagcaagatatttatcatatagcatgggtccaaaactgagtttgctttagaagagtttgacagctttctgacatgcctttagtggtctcagcgcagactgcagattttgtcattcacttgaaaagaa

SEQ ID NO: 43708 - DNA, 320 bp, Homo sapiens
gatactgctaaatcaataaacacaacagtcatttaagtgtgtatgttatataatatttggttaattatattataactcaaattctttcagtgcacttgtcttttaaattgaatgctaaatataactggagtacttgtaaaaatagaatggtcagaaaaatgcagagtatattatgtcatttttctaagctatattaagttaatatttggagttagcaacagattttgtcatacacatcattttatgtaccatgaaatgtcatatttcagaagtactcatgtttaataataaaaataaatagccctgttttatgttactga

SEQ ID NO: 43709 - DNA, 252 bp, Homo sapiens
tgcgtgtgctattccctctgcctggagtgcctttccctgtcctctttgcttggagacctcctatttatcacttaggtctcagctcaaatgctcttttttttttgaaacggagtcccactctgtcacccaggctggagtgcagtggtgcgatctcggctcactgcaacctccacctcctgggttcaagcgattctcctgcctcagcctccagggtagttgggactataggtgcctggctaatttttttttttt

SEQ ID NO: 43710 - DNA, 479 bp, Homo sapiens
tacttttctgcttagcatgttttcaccgtccttcagggtgggggaacagtgcttacaatgacgttctctccattggcttcacaaacaccctaaccactatgtgccctgaatgtgattacattttgctacctttgaagagaagaaaaaaaacattgagaagaaaaagaaatctggctggctctaaagaaaaagcctttaagtacagctttaaacattttaataagcagtttatttcccttccgctgattgccctggaaaaaaataaaataaaataacacgcaaacaaagccaggattgattagttcttctcctcccccattcccaactgctgttcactcagcaggaaaaagaaaatcacagtatgggactcagaatcttattcattagcatgtgtggcccttcctggtggatggtctactttctccacagccccctccatcagtgtttgctgaaatctgagagggggagattctgaagtc

SEQ ID NO: 43711 - DNA, 256 bp, Homo sapiens
taaataaaagagaaaatgagttaatgatcatttatttttctaattacatatatatgttagtaccatgcttggatattttcatgacagccccgtgttaatgacctaatttcaaatatgacccacagtatattctaacccaacagtttgtttctcttcacctaaaaagtaattcttagcttttgtatagaactttataatttgtaaaataattccacatgatcgtcacaactacccctagattaaagcaaggaggtat

SEQ ID NO: 43712 - DNA, 433 bp, Homo sapiens
tgtatctggggccaaaataaataaaatcctcgccgatatttttctggttaatatagctggattcttctcttttaaaaaattattttccaagaatgtaatatttctatgatggttgtacctagtcaacattattagtttcgtttgctccctgcaggggcagaattgaccctcaggtctatggggatggatccagctttctcccctgtggggttctctaagttggcagcctttcctacctcacccccaagctcccttttgcacgtgcagccacactcatcacattggggtgcagctcatctttcatggctggcaggctgccaacactgctttgaactgtggaaaatctgagaagtgcttgatagctttttatatagcttggtttgataccaataactcttgagtgtggatgtcaaggcaacaaagctgcagctca

SEQ ID NO: 43713 - DNA, 652 bp, Homo sapiens
acaataaaagaaattggagttttatgaaaatttgggggagtgagaaagaaagctcacatctggttggttgtaggactggaaaagattcaaggaggaagttccatgggagtttggctgggaggaatttctggagatgaaagtgtagaagaaggcattccaaggtgatggaacagcatgaggtgggaggaaagtacaggaacactaaacatagaacttaggtaggagggcaatgggtggggaggaagatttaaagaagtaaaacacttggggaaatgctaaagtaggaatttggatgagagtccacggacaacaaggacctattgaaggatttcataggagggaaataagtgcttgcagctgtgccctggacagtgaatttggcagtgatggaggcctggagtggagaagggaagaagactgaggtcgtgaatatcagtaaagagactattccaggatccagataagagggttaaggcacaggcaacagaaaaaaaggggaaaattaagaggtaatggatggctgggcatgatggctcatgcctgtaatcccagcactttgggaggcagaggcaggcagatcacctgaggtcaggagttcaaaaccagcctgaccaacgtggtgaaaccccatctctactaaaaatacaaaagt

SEQ ID NO: 43714 - DNA, 417 bp, Homo sapiens
gggggcaggagcatttggaaaaagaaaggtcaaatggagcaaatggttgtgccagagtagcaggtaagggatccatacccaggactggaggctccagatgggttaccagcactgaagcccacagcagctgtctttccttcaaaggttttactcaggttctcctctgaggatttctgcaaatgtcccctaaaatgatcccaggtcatgtataggagcactgaactactaaaactcaccacattccacacacccaccacctcagcactcctgccacacaggtgagatccatttccccaagcttagagagggaagccctttgatgagacacaggcttaaagcagactaatttcatccaaagcagaagctccacacatcacagggcttacggcagagtcatctcagtagagcactcctgga

SEQ ID NO: 43715 - DNA, 326 bp, Homo sapiens
aaaaattgagtaacaagcataagcctagttttataagaaggctcagatgaaggctttctgagaatgttacctgaatagagattctaagtcatactctgatttcagatttagcttctctgagagtttacaaaagcccctctagagaattcagttggacaggtcataagccagttctgataaacctaggggtccactacagttagaatatctgacacatttggctgggcatagtagctcactcctgtaatcccagcacttttggaggccaaggcgggcagattacctgaggtcaggagtttgagaccagcctggccaacatggtgaaa

SEQ ID NO: 43716 - DNA, 96 bp, Homo sapiens
gcctcaaagcagggagttaggaagtgatgaagctgtaacacaaatcttatcatttatagaccaataataaaagccaatgtttattgaccatctata

SEQ ID NO: 43717 - DNA, 900 bp, Homo sapiens
caagcgattctcttgcctcagcctcctgagtagctgggattataggcaggtgccaccatgtctagctaatttttgtattttttgtagagatggggtttcaccatgttggccaggctggtcttgaactcctgacctcaaattttcctcctgcttcggcctcccaaagtgctgggattataggtgtgagccaccgtgcactgacatgttttgtctgagcagtgcctttgtggtagttaccctcctgggtcaccctagtctatcctcagagagaaagacttggctatggcttaccccacagggtgtccacagggaaggtggtggcgtcttgtgtggggatgttcctggagaaggggacattgtggcaaatgtggaccagccggaagacaccccctccccccagctggagtttataccatttatggcctcctaactcattcattcaggtatacactaactcatccattcaggtatacactaactcattcattcaggtatacactaactcactaactcatccaggtatgcactcactaactcacatatccccagggcctcctaaggcatctaaaatatgcaaatctttggtgagcccccagtgaggctcctggctctgaatttgactcctgaaaggtgaggccctaggagagggggatggggactgagccacagaaagccttgctcagctcccctagaccggggtgagccggggtctgtttcatagagggccaagctgaggcccagacactctgagaggaagctagactctgaacttcctccttggcaccctggattctggggatctgctatacaagtccccagaggtggcgaagaggatgggagaggcagggccctggctgggggcctccaagcctccatcccactccttgggccacccccgcc

SEQ ID NO: 43718 - DNA, 488 bp, Homo sapiens
tggtccataatttttttttgaatactgagaccatggtatagataaaatattcataacagttaagatctgttggagtatagatgagttaaaatctgtagaatataaatcatatataaaacaaagtattcagactatgtatatgtaagggaatagcaaaagctctgagtcatgctagaaataagcttttattattcctcttgactatagtaagtctggtttctcaagtcagaaatgaaaatggactaaaaaacaggtgtgtgttggcatgactttgagaagagggcaatgaaataaatcaggcagacatcacgcttacttctttcttttagatttcatttccttctatcttgtaatgaaggcttttgttttttaaatgcatcctgaggcactggttctaccaccccacaaacagctgaattttaaacaactcctttaatatgaagttattttattttgaattggattttccagagtcgtgtttactgcct

SEQ ID NO: 43719 - DNA, 431 bp, Homo sapiens
gatctaggttgcaagctccctatgagaatctaatgcctgatgatctgtcacggtctcccatcacccctagatgggaccatctagttgcaggaaaacaagctcagggctcccactgattctacacgatggtgaattgtggaattatttcattatatatattacaatgtaataataatagaaataaagcacacaataaatgtaatgtgcttgaatcatcccgaaaccatcccaccctggtctgtgaaaaaattgtcttccatgaaaccagtccctggtgccaaaaacgttgaggaccactgctccacagaatctatcggtcactcttcctcccctcacccccttgccctaaaagcacaccctgcaaacctgccatgaattgacactctgtttctatcccttttccccttgtgtctgtgtctggaggaagagga

SEQ ID NO: 43720 - DNA, 474 bp, Homo sapiens
attgctcttttgtttaaattattgggagttggcctctattgcctgcaaccaaaatctctcattcttatacttctcaacagagcaaactgctatgcatccttcagctgcaagggattgaatgctatcaacaaccatacaagtggagaagcagatgcttccctagctgagcctcaggtaagaacccagacctggccaacacattaatggcagctttgtgaaaccctgagttgatctctctaggtcatgcctggacttctgatccacagaaagagtgagataataaatgtgtgttgttttgagctgttgagtttgtggtaatttgttatataaacagagacagaggaacgagttaacaatactatgatcatacaatgaaccaattatggaatgtagaattttccatgctataaataactttgtatctgcaaaatatcaatggcttcacaaaaggaaacaagggcatcattaaaagaa

SEQ ID NO: 43721 - DNA, 326 bp, Homo sapiens
agttctaaatatctacatttaaaaagaaaattctcaattacttaactttacaccttaagcaagtagaaaagcaagggaatagttaagattagacaacagataaatgaaatagagaacagcaaagcaatagagagaacagataaacctaaaagttggttctttgtaaagattaataaatttgataaacttttatctagattaagaagaaaagaaagaagcaaataactaaaataaataaaaatggagatattaccaccaaacctttacacagattaaaagaattacaagaaggctgggcacagtggctcacgcctgtaatcctagca

SEQ ID NO: 43722 - DNA, 828 bp, Homo sapiens
ggaatgtagtagatgataaaagtaccatttctaatctgttgagaaaagatgagttaataaaagacattaggaagaaaagggagcaatctggaaaaaaagtaagttggattcataatttgtatcttagaaaaaattacagatgaactcaatttataggtttggaatatgttgttcctaatgaaaaaaacatttaaaaaggctgggtgtggtggctaacacctgtaatcctagcactttgggaggccaaggtagatggatcacctgaggtcaggagttcacgaccagcccggccaatatggtgaaacctcgtctctactaaaaatacaaaaaaaaaaaaaaaaaaagctgggcatggtgggtggcaggcgtttgtaatcccagctactcgggaggctgaggcaggagaattgtttgaacccagggggcggaggttgcagtgagccgagattgcaccacttcactccagcctgagcaaaagagtgagactccgtctcaaaaaaataaataaaaatttttttaaaaattaaaaaataaaaactctaggtctggtgtggtatctcacaccacctgtaatcccagcattttcggagcctgaggtgggaggctctcttgagcctaggggttcaaggcctcagtgagcaccgctgcacttccagcctcggcgacagagtgagacaacgtctcaaaaaaaataaataaataaaaataaaaattaaatgttaaccttcaatatttaaacgtacaaaaatgaaaacgaaaatacagccagaagctggctgggcacggtggctcatgcctgtaatcctagcactttgggaggctgaggtg

SEQ ID NO: 43723 - DNA, 284 bp, Homo sapiens
cgtggtggcgggcgcctgtagtcccagccacttgggaggctgaggcaggagaatggcgtgaacccaggaggcagagcttgcagtgagccaagattgcgccactgcactccagcctcggcgacagagtgagacaacgtctcaaaaaaaataaataaataaaaataaaaattaaatgttaaccttcaatatttaaacgtacaaaaatgaaaacgaaaatacagccagaagctggctgggcacggtggctcatgcctgtaatcctagcactttgggaggctgaggtg

SEQ ID NO: 43724 - DNA, 406 bp, Homo sapiens
ggtttcatcatgttggtcaggctggtctcaaattcttgacctcaggtgatccaccctccttggcctcccaaagtgttgggattacaggtgtgagccactgtgcccagcctcatgtgctatatttttacttcgttccaggacactaatatgcttttgttttccatctatttcctggttgcactttctcaatatttttgtggtctccctggctttttaactttgaggtattacaggcttctaaactaaattcttctcttctcacctattcttattttagtgttcagttcatccaatttcgttgctccaaatgccaactttgtgtcaatgttctctaagttcataaggccaataaaatgcctcttgtgaacttcaggctgcatatacaaatgacttctctatatatctg

SEQ ID NO: 43725 - DNA, 555 bp, Homo sapiens
taatagtatggtacaggattattatctccatctgactggtgcgttgatatatctcaggtagttccaaatgtgggagaaggcaaaaagagagtattatttactgttacttccccaagtcctacctataattttttacttttttcagaaagaaacatttaaaaggggcttaaaaacagaagccatatttgtgtcttgggtgagggtaagacaagatggtggatcccctcgccattactactgagacccatggcttataaactatcctacttataattttttatttttatgtatttactttttgagacagagtcttgttccatcacctgttgaggctcactgaagcctcgacctcccaagctcaagtgatcctcccacctctgcctctccagtagctgggactacaggtgtgtaccaccacacccagctaatttttaaacttttttttggaatctttactatgttgcccagggtggtctttgaactcctagggtcaaacagtttttcccgacttggcctcccaaagttctgggattacaggtttaagcaactgtcctc

SEQ ID NO: 43726 - DNA, 360 bp, Homo sapiens
taaattaatcacacattaatgtaaaaaataagagctttctcttttcaccttatgagaatgtaagaaaaaaaagttggactagaaatttaaatttaggtgctaagaaactggatatccacatgcagaagaatgaaactagacccccacctttcaccccatacgaaaatcaacttaaaatggatcaaagacctaattgtaagacttgaaactataaaactattagaagaaaacacaggggacactgatgtggggaaagggtttatgagttaagatctgaaaagtacagggtgggcacggtggctcatgcctgtaatcccagcactttgggaggccgaggcaggcggatcatgaggtcaggag

SEQ ID NO: 43727 - DNA, 469 bp, Homo sapiens
acagctagaaagcaaagttattttttagaactattatttctgttgtgaccttttcttcaagttaactgataatacacagtgagttgctttttctaatacagaaacccgtggcattctaggagcttatttataaccccctgcgaggagcaggcagtaaggaagaaagcttcattatgcattttaaacactgtgcttcgtgtggtcagatgaaatgttattctgcttgcactgtggtatcttttacgtctgagcaaacatacctggcttactttccccaacttccccctctcttttttctctgttcaggaaatcaatttggttgaatttcttgtgtagggtgaaatccatggactcgtacagagttggtgagtgggccatcaatgggatctctgttagctcatttttcatcagggagatacatttctttcccaaagctgtgatctaggagagttgccaagcagctagagtt

SEQ ID NO: 43728 - DNA, 442 bp, Homo sapiens
atgaaaatgggttaattggtcactaatgagctgcattactgggaatagggttagagttttatgaaatgcgtagtttcactttagacttacctactctcaggagtaggcagttatttaagtagtagccagtttgaaagaaaaaaatctaccttttcagtttgtttcctttttatggataaaatgaaaaaattccatcctgaaatcagattttaaggaacagatatatatagtgattaaccacccagcttccttttgcctacacacacacatgcacacacacactttatcttctgtttttcattcagaatatgactgcacaagctgtaggggttagctaacagcacactgaacagctttttgctgccagtttgggggatgattgaaattattgacccttacacgaagacaaaatgaaatatttttatgcaagaatactagaaaa

SEQ ID NO: 43729 - DNA, 694 bp, Homo sapiens
gagaggaggagaagacagaagaggaaaacagtcctaactattaaaaataccaattaactacttaataacacatctttcagtgtcttgcataataatttcttagatattttgcaaaattcggcatggttaagggattttgtaatggttaaataattttattagttgtttgaaattgactgtctttgttttcctatctgtgtgctgagatttatctcaattatatgtgtgaataatgttatgcatgggggttacttttaatatgggatttaactgaggattctaggactatattctttgtaaatatggaaccattaggaaacttgttcaattgtgggtcgtcattaattcaagtcaggaaggctcaccctttgtcctcacaccatctcttaagaagataagtcctgtggataagctggagaggtcagatgttggtgttgacttaaagcattgccacccgaggagggcagaatgctgtaaaacaaagcagaaggaactgtgtggagagaaggtgaatgactgggggacttgaagttgaaagaaaagtcaggcgctgagcctgcaagggcaaaatgaggcttgtgggataagaatggtttgtcagaagtcacctgtttgctcagaagtcatctttccctaacaagggtctgtttggtatgttcctgtattacaatttataataactgtttttttacct

SEQ ID NO: 43730 - DNA, 853 bp, Homo sapiens
ctcatcttcatttctctgaatgattattaagattacagcagttatatcccagttccaagctataggattgaggaaaggaagaagggtacactttttcaagacttcctgtgacaaaacatttccacttttactcattagcatatggttaaacctcactccaggggaaagtgagaaaggtcatgttatatctggacatcagtatgcccatatataaatgggggttctgttcctaaaaatgaagggaaaagtagtttatcagacacaagcctgaaacagctcgtcatgtttaatttagcaactttttttaggcacgtttggtcatcgttcagttattttatttgggatacatataattctcccctcccctcgttccctccttccttcccttctttctcttccttcttctctccctccctcccttcgtctttctttccctcccttctttccttccttacttccctccctcattctctccatccctttctttttttttttttgctagtaaaattgttcatacctcatataataaatcagtatttcctgacattcctcagattactactctttcaggtggattttttccaggttttgccgttggaaaaaatttgagatacattcaactggatactccctaggatgttctcaggcgtaaaaatctaagaattttaccatgtttaaatgtttcaaacacagtgtcaataacttgaaagagaatcagtgctttaaatattaactgagacatcttacagatggccactggactcttttaagttagcactaaattatgtctacaatgttaggaagatggttgtgatattttcatggaacttttaaattttttttcctttttctt

SEQ ID NO: 43731 - DNA, 520 bp, Homo sapiens
acatatatcatgatatatcaaaataataacatattcagaaaaatatgactaaaaaattaaactccattatttatttgagatttgacaatgcttcccatatgattttaacataccaaataagctaaatatatctttcttagatttctagaggttacttttggaaaagatttaattttagaaactgaaatttgactttgggtagtatatcaaatattaaaggtttaaaacacttgatcaaattaggatcacagttcactgtaaataatagtcattcatttaaccaaagcaataattcaaaaatttcaaacaacctttactctttgagagagaagactcagttatctaaataatcaaaagacctaataaagatctttttttgcagtttactcaaaagttgaacaaaagccttttactatccttattaatactacattaaaatcttgttcaaaagaggaaagcatattctacatttgtgtcagtatattattaatgctaaagctaagtttaataaagacttata

SEQ ID NO: 43732 - DNA, 469 bp, Homo sapiens
gatagtaaagatggtggcccctgtgctttcaagtttctcaagccagatcccgactaggctcacagtgtgtatttgggacttttagaatttgggaagttgagacctatgaaagtttgagaacctgggaaacttcagagctttcaggatcttttgaaatcttggacattttagaatctggagcatctttaaacctggggaactttaagaagcttgaactcttctgacgttgtggaatttgagggatttcattttggggctctgttggccttggagtggatgctgtcctcttggtgtagaggaggacattcgtcagcagacctgagccctctcctcccaccggccctcagagcccagtatttcaaatatctcgacgttatgcagttttaaacttcagatttttgaaatgaaattgtattagttatcttgaatgttcgatgttgtgtttctcaaacatgtgttggcctactgg

SEQ ID NO: 43733 - DNA, 162 bp, Homo sapiens
aatcttgaaagggttatccctagatctagtagcagtttatttccaggtcatatatgagaactggtctggggaaagggcccagttcctttctccacctccaggggcatggatttggaggccaatgtatatccagttgtctcggcatacctccctgaggctagg

SEQ ID NO: 43734 - DNA, 374 bp, Homo sapiens
gagtggtgggtgtggaagggagtacctggcacggattttgcacctggaggatgcttgacaccttaggctgcttctgtggaagaggaggtgaggaccctgtcctgggagcaggtggttctacgaagcccagctgtgggggtctatgaagcctctcctgagttggtctcggactcatcttcccagagccatgggtctttctctatctctgtgatacggggttcagtgcccccatcccagcaggaccccaagtctacactgggcagcaaccctgagccagtgataataatgacttatggcccctgtttacggagcatttcctgtgcacgtgcatatgggcctaatcttgttatgtccttcaacaactctgtgagagt

SEQ ID NO: 43735 - DNA, 268 bp, Homo sapiens
cgtccactagaaagggaaaggtggcagaaccatatatatgagcctgttacttgttcaaggacttggtcaggggcctcacagaacttggaaaagagcaacggactcttcagagaagttcttcagagaagagctctgaactggagagcaagagctgggagcacctcccatggctgcagtctctggtcatttccaaagcccaggagaaggctgcatttggtcaaccacccacttccatttagccagggcctttaattcattcccaaatcct

SEQ ID NO: 43736 - DNA, 1008 bp, Homo sapiens
cttgttgggaggaattaacaatcatgcatcgagccctgggcctcaggcttcaatgtattagttattagagctaatcattatttaatgttttaaacacccccaaggaagtagagaacattcctgtcacattctgcagaaaaagaaattgaggcaaggggcaaagccatttgccaaggtcatagatcctgcaagccaatggcaaggcaggatctgaacctggggcttcagatcctggggctttacctgattaaataccaagagagagtgctgagatttttttggtggtggacagtccctgaggcaagccatttttagagcatctgggccacttggggaattgaatctttaccagggcttcccacctcctgttgccccttctctgaaggtgacccccctcccacagtagcaccccaaccactcagaacccccaagccaccttctttgcacatgctgaagctaatattgccctccactccaccccaacatcagggaccctggcccaagcccttccctgggagcccttcctcctctcatgaggcctccttcccagcccctcagaacagcctcctttatgagagtggccaagatcccactgaaaccttccctatcaactttataaaattaatcaggggagaagggaggggcgaaatggaaatcagcccagcttgcagcacacacagcattggtcatgaggtcagctgctctctgacccacttgctcagagttgtttgctgcctgttgctccagagtcacatagaccctgtcacaaggtcatagttccccttcactgctcatagataacaactggaacattataaaacgttaacttttccatttgagatattctttcaggtcctgcgtagcaatgaaactgaggcaggataggtacttaagggagtgaccgtgttctcaggatgcagcgaccatggcacccatacagtcaacacagtgagcctcagcattcgcattgtcattgcgctcattcaagcaaagctgtcttcattaggg

SEQ ID NO: 43737 - DNA, 424 bp, Homo sapiens
ttttgagacagggtctcaccatgtcacccaggttcaagaacagtagcatgatcatggctcactgcagcctcaacctcccaggctcaagtgaccctccagcctcagtctcccaagtacccaggatcacaggtgcatgctaccacgcccagctaattttctagttttttgtagagatggggtcttgctatgctgtggctggtctcaaactcctgacctcaagaaatcctcccatcttggcctcccaaagtgctgggattacaggtgtgagcaaccatgcctggccgaagaaagtcattctttcatattctttaacatcctaacctttctcatctttgcctcttgatattgggtatatcttgcttttgtggtctgtagcccacactattcactgctttcaaagaagaggaaaagaggtaggttagtc

SEQ ID NO: 43738 - DNA, 415 bp, Homo sapiens
actttatgaaatatgttgtttactgaaaaatgctgaacttattgaaaaatatttatagtggtctggggccagtggcagctagttacacaagtaagatcttctttgagcttgctgtagaacaaaggcattagccgggcgcggtggctcacgcccgtaatcccagcactttgggaggccgaggcgggcggatcatgaggtcaggagatcgagaccatcctggctaacacagcgaaaccccaactctactaaaaatgcaaagaattagttgggcgtggtggcaggcgcctgtagtcccggctactcgggaggctgaggcaggagaatggcatgaacccaggaggcggagcttgcagtgagccgagatagcgccactgcactccagcctgggtgacagagcgagattccgtctcaaaaa

SEQ ID NO: 43739 - DNA, 1135 bp, Homo sapiens
attccagcctcattgtaacacacattctacgcctagcctggctttcttgctctccctcatctcattgtttcagcggaggccaaatctgaagtcctttccagggagtggctctgttcatcttattcgccagccaaagtaggaacagcgtaagaggagagagacacattcagcagccaaaggactcggtggaaagagcagaacaccatagacaatatgtcgctcttgggacccaaggtgctgctgtttcttgctgcattcatcatcacctctgactggatacccctgggggtcaatagtcaacgaggagacgatgtgactcaagcgactccagaaacattcacagaagatcctaatctggtgaatgatcccgctacagatgaaacagttttggctgttttggctgatattgcaccttccacagatgacttggcctccctcagtgaaaaaaataccactgcagagtgctgggatgagaaatttacctgcacaaggctctactctgtgcatcggccggttaaacaatgcattcatcagttatgcttcaccagtttacgacgtatgtacatcgtcaacaaggagatctgctctcgtcttgtctgtaaggaacacgaagctatgaaagatgagctttgccgtcagatggctggtctgccccctaggagactccgtcgctccaattacttccgacttcctccctgtgaaaatgtggatttgcagagacccaatggtctgtgatcattgaaaaagaggaaagaagaaaaaatgtatgggtgagaggaaggaggatctccttcttctccaaccattgacagctaacccttagacagtatttcttaaaccaatccttttgcaatgtccagcttttacccctacttccttacagtctctagaattaaatgtactcatttagacaacatattaaatgcatattttagccactttagagaaacctcataggcacagagtttccaagattaattttaagaatatcttcacgaacttgaccctcctactccacattgcaacatttccatcagacagcatttcaattccagtattatgtatattgcaaattaaacattttaaaatatttttttccaatttatttctcaaaataaaatgtcttttgttctgg

SEQ ID NO: 43740 - DNA, 3093 bp, Homo sapiens
attccagcctcattgtaacacacattctacgcctagcctggctttcttgctctccctcatctcattgtttcagcggaggccaaatctgaagtcctttccagggagtggctctgttcatcttattcgccagccaaagtaggaacagcgtaagaggagagagacacattcagcagccaaaggactcggtggaaagagcagaacaccatagacaatatgtcgctcttgggacccaaggtgctgctgtttcttgctgcattcatcatcacctctgactggatacccctgggggtcaatagtcaacgaggagacgatgtgactcaagcgactccagaaacattcacagaagatcctaatctggtgaatgatcccgctacagatgaaacagttttggctgttttggctgatattgcaccttccacagatgacttggcctccctcagtgaaaaaaataccactgcagagtgctgggatgagaaatttacctgcacaaggctctactctgtgcatcggccggttaaacaatgcattcatcagttatgcttcaccagtttacgacgtatgtacatcgtcaacaaggagatctgctctcgtcttgtctgtaaggaacacgaagctatgaaagatgagctttgccgtcagatggctggtctgccccctaggagactccgtcgctccaattacttccgacttcctccctgtgaaaatgtggatttgcagagacccaatggtctgtgatcattgaaaaagaggaaagaagaaaaaatgtatgggtgagaggaaggaggatctccttcttctccaaccattgacagctaacccttagacagtatttcttaaaccaatccttttgcaatgtccagcttttacccctactctctactttttcacccaaactgataacatttatctcattttctagcacttaaaatacaaagtctatattattgcataattttgctgcttctcaatatcatagacacagtgaatagatgatgactatatggcttatatacaaacattctatgtacaatttcaagggagactaaactttaggctaataatctttactattgaatctgtctgatatagatcttagggttgaagaagctatctttgtctatttgggctaaccatagaatttcatttattttcctcacaatattttcctagaccaactccccatcattcacgtgttcctctttactcttactttaactattttgctggcttgcccgaaaatttgcctggcaagtcttccttataagacacatcatggtaagttttgtagtcctgtaagattctgcaacacagtcaagaattatacaatcctactagcaatatataaggacccaaaatgtcttctgctaagctcagaggctggggctaaagcatgaggactatgccagctatagaacttggactcataattcgctatccaatttttcatgcagttgtctagtcgggaagtaaggttggaaactaagtctcatttactgattcgtttatgggtagtaccgggatgaacccaccaccacaaagcaaattagacaacttaatgtgaaatcataccattggttgacgtttccttgagttgctacttcgttcatcttcacaacttaacaagtgcacggtcgaattattgtgcaagtggcttttggatatcctgattggggcctaagaagggcattcagacttgaattttaataggcagacagaaagtttgcctaatagttaatacgaaagaatgaaagaaacacagatattcagacaacccacattcttatcctggctctagcagtaaccacgtagccttggataagccattttccttcattaggtcctggtttaatttcctcatctttaaaatgagaaggttaaatttatcttagtactgctgggcgcagtggctcatgcctgtaatctgagcactttgggaagctgaggcgggtggatcacttgaggtcagaaatttgagacgagcctggccaacatggtgaaaccccatctctactaaaaatacaaaaattagctgggcgtggtggcacgtgcctgtaatcccagctactcgggaggctgaggcaggagaatcaattgaacctgggaggcagaggttgcagtgagccgagatggcgccattgcactccagcctgggtgacaaaagcaaaagtccatcttaagaaatatatatatatattatatatattcttagttctaagatttcctttaattctatgattctctggatttaaatgcattattcatatttcttgaagcttagatacagtctaattcatagcaaccatatctgctttatcctaggtgagggtagcagtccacaatggaatagaagaaaatcccattataacaaatgacaaattatatatcatgaatccttctgtctgactaactcaataactttctataaaagccaatggaattcaaataggagctaggagacaacaagttatatatgacagtggaggttgtattccttttatattgctgagaaaactagttaaatgatcagattcttgctgttaagaaacaatttcgtttaatgggatctgtacaactgattttaaaaaaatgctacaaaaagccccaaagcatataatctctactccttacagtctctagaattaaatgtactcatttagacaacatattaaatgcatattttagccactttagagaaacctcataggcacagagtttccaagattaattttaagaatatcttcacgaacttgaccctcctactccacattgcaacatttccatcagacagcatttcaattccagtattatgtatattgcaaattaaacattttaaaatatttttttccaatttatttctcaaaataaaatgtcttttgttctggaaaaaaaaaagggagaaaaaaaattggggggcggcacagaggccccagaagaggtctctgcaaaccactctggtggggggcggggggcccaaagagtcagcgagacacggccaaaaggggctcccaggagaacacgcgggcagcgacaaagggcggggatcctccacagataaaaagcgccgggggagacacgagcgcttggaaaaaaccg

SEQ ID NO: 43741 - DNA, 2852 bp, Homo sapiens
attccagcctcattgtaacacacattctacgcctagcctggctttcttgctctccctcatctcattgtttcagcggaggccaaatctgaagtcctttccagggagtggctctgttcatcttattcgccagccaaagtaggaacagcgtaagaggagagagacacattcagcagccaaaggactcggtggaaagagcagaacaccatagacaatatgtcgctcttgggacccaaggtgctgctgtttcttgctgcattcatcatcacctctgactggatacccctgggggtcaatagtcaacgaggagacgatgtgactcaagcgactccagaaacattcacagaagatcctaatctggtgaatgatcccgctacagatgaaacagttttggctgttttggctgatattgcaccttccacagatgacttggagtgctgggatgagaaatttacctgcacaaggctctactctgtgcatcggccggttaaacaatgcattcatcagttatgcttcaccagtttacgacgtatgtacatcgtcaacaaggagatctgctctcgtcttgtctgtaaggaacacgaagctatgaaagatgagctttgccgtcagatggctggtctgccccctaggagactccgtcgctccaattacttccgacttcctccctgtgaaaatgtggatttgcagagacccaatggtctgtgatcattgaaaaagaggaaagaagaaaaaatgtatgggtgagaggaaggaggatctccttcttctccaaccattgacagctaacccttagacagtatttcttaaaccaatccttttgcaatgtccagcttttacccctactctctactttttcacccaaactgataacatttatctcattttctagcacttaaaatacaaagtctatattattgcataattttgctgcttctcaatatcatagacacagtgaatagatgatgactatatggcttatatacaaacattctatgtacaatttcaagggagactaaactttaggctaataatctttactattgaatctgtctgatatagatcttagggttgaagaagctatctttgtctatttgggctaaccatagaatttcatttattttcctcacaatattttcctagaccaactccccatcattcacgtgttcctctttactcttactttaactattttgctggcttgcccgaaaatttgcctggcaagtcttccttataagacacatcatggtaagttttgtagtcctgtaagattctgcaacacagtcaagaattatacaatcctactagcaatatataaggacccaaaatgtcttctgctaagctcagaggctggggctaaagcatgaggactatgccagctatagaacttggactcataattcgctatccaatttttcatgcagttgtctagtcgggaagtaaggttggaaactaagtctcatttactgattcgtttatgggtagtaccgggatgaacccaccaccacaaagcaaattagacaacttaatgtgaaatcataccattggttgacgtttccttgagttgctacttcgttcatcttcacaacttaacaagtgcacggtcgaattattgtgcaagtggcttttggatatcctgattggggcctaagaagggcattcagacttgaattttaataggcagacagaaagtttgcctaatagttaatacgaaagaatgaaagaaacacagatattcagacaacccacattcttatcctggctctagcagtaaccacgtagccttggataagccattttccttcattaggtcctggtttaatttcctcatctttaaaatgagaaggttaaatttatcttagtactgctgggcgcagtggctcatgcctgtaatctgagcactttgggaagctgaggcgggtggatcacttgaggtcagaaatttgagacgagcctggccaacatggtgaaaccccatctctactaaaaatacaaaaattagctgggcgtggtggcacgtgcctgtaatcccagctactcgggaggctgaggcaggagaatcaattgaacctgggaggcagaggttgcagtgagccgagatggcgccattgcactccagcctgggtgacaaaagcaaaagtccatcttaagaaatatatatatatattatatatattcttagttctaagatttcctttaattctatgattctctggatttaaatgcattattcatatttcttgaagcttagatacagtctaattcatagcaaccatatctgctttatcctaggtgagggtagcagtccacaatggaatagaagaaaatcccattataacaaatgacaaattatatatcatgaatccttctgtctgactaactcaataactttctataaaagccaatggaattcaaataggagctaggagacaacaagttatatatgacagtggaggttgtattccttttatattgctgagaaaactagttaaatgatcagattcttgctgttaagaaacaatttcgtttaatgggatctgtacaactgattttaaaaaaatgctacaaaaagccccaaagcatataatctctactccttacagtctctagaattaaatgtactcatttagacaacatattaaatgcatattttagccactttagagaaacctcataggcacagagtttccaagattaattttaagaatatcttcacgaacttgaccctcctactccacattgcaacatttccatcagacagcatttcaattccagtattatgtatattgcaaattaaacattttaaaatatttttttccaatttatttctcaaaataaaatgtcttttgttctgg

SEQ ID NO: 43742 - DNA, 2848 bp, Homo sapiens
gtgtttcacttgagtgtagtgcccatttcatcctcttgtatggttcctagattcagctctttgcatgctcttatcttgtttctattctgtagtcgggatcattcaaccagattaggatctgtctgtgaatgtttctggatgtcgcttgagtcacatcgtctcctcgttgactagttgaccctccaggtggtatccagtcagagtgtgatgatgaattgcagcaagtatacatgtcagcaccttgtgtcccaagagcgacatatttgtctatgttcttctgctctttccaccgagtcctttggctcgctgaatgtgtctctctcctcttacgctgttcctactttggctggcgaataagatgaacagagccactccctggaaaggacttcagatttggcctccctcagtgaattaataccactgcagagtgctgggatgagaaatttacctgcacaaggctctactctgtgcatcggccggttaaacaatgcattcatcagttatgcttcaccagtttacgacgtatgtacatcgtcaacaaggagatctgctctcgtcttgtctgtaaggaacacgaagctatgaaagatgagctttgccgtcagatggctggtctgccccctaggagactccgtcgctccaattacttccgacttcctccctgtgaaaatgtggatttgcagagacccaatggtctgtgatcattgaaaaagaggaaagaagaaaaaatgtatgggtgagaggaaggaggatctccttcttctccaaccattgacagctaacccttagacagtatttcttaaaccaatccttttgcaatgtccagcttttacccctactctctactttttcacccaaactgataacatttatctcattttctagcacttaaaatacaaagtctatattattgcataattttgctgcttctcaatatcatagacacagtgaatagatgatgactatatggcttatatacaaacattctatgtacaatttcaagggagactaaactttaggctaataatctttactattgaatctgtctgatatagatcttagggttgaagaagctatctttgtctatttgggctaaccatagaatttcatttattttcctcacaatattttcctagaccaactccccatcattcacgtgttcctctttactcttactttaactattttgctggcttgcccgaaaatttgcctggcaagtcttccttataagacacatcatggtaagttttgtagtcctgtaagattctgcaacacagtcaagaattatacaatcctactagcaatatataaggacccaaaatgtcttctgctaagctcagaggctggggctaaagcatgaggactatgccagctatagaacttggactcataattcgctatccaatttttcatgcagttgtctagtcgggaagtaaggttggaaactaagtctcatttactgattcgtttatgggtagtaccgggatgaacccaccaccacaaagcaaattagacaacttaatgtgaaatcataccattggttgacgtttccttgagttgctacttcgttcatcttcacaacttaacaagtgcacggtcgaattattgtgcaagtggcttttggatatcctgattggggcctaagaagggcattcagacttgaattttaataggcagacagaaagtttgcctaatagttaatacgaaagaatgaaagaaacacagatattcagacaacccacattcttatcctggctctagcagtaaccacgtagccttggataagccattttccttcattaggtcctggtttaatttcctcatctttaaaatgagaaggttaaatttatcttagtactgctgggcgcagtggctcatgcctgtaatctgagcactttgggaagctgaggcgggtggatcacttgaggtcagaaatttgagacgagcctggccaacatggtgaaaccccatctctactaaaaatacaaaaattagctgggcgtggtggcacgtgcctgtaatcccagctactcgggaggctgaggcaggagaatcaattgaacctgggaggcagaggttgcagtgagccgagatggcgccattgcactccagcctgggtgacaaaagcaaaagtccatcttaagaaatatatatatatattatatatattcttagttctaagatttcctttaattctatgattctctggatttaaatgcattattcatatttcttgaagcttagatacagtctaattcatagcaaccatatctgctttatcctaggtgagggtagcagtccacaatggaatagaagaaaatcccattataacaaatgacaaattatatatcatgaatccttctgtctgactaactcaataactttctataaaagccaatggaattcaaataggagctaggagacaacaagttatatatgacagtggaggttgtattccttttatattgctgagaaaactagttaaatgatcagattcttgctgttaagaaacaatttcgtttaatgggatctgtacaactgattttaaaaaaatgctacaaaaagccccaaagcatataatctctactccttacagtctctagaattaaatgtactcatttagacaacatattaaatgcatattttagccactttagagaaacctcataggcacagagtttccaagattaattttaagaatatcttcacgaacttgaccctcctactccacattgcaacatttccatcagacagcatttcaattccagtattatgtatattgcaaattaaacattttaaaatatttttttccaatttatttctcaaaataaaatgtcttttgttctgg

SEQ ID NO: 43743 - DNA, 883 bp, Homo sapiens
attccagcctcattgtaacacacattctacgcctagcctggctttcttgctctccctcatctcattgtttcagcggaggccaaatctgaagtcctttccagggagtggctctgttcatcttattcgccagccaaagtaggaacagcgtaagaggagagagacacattcagcagccaaaggactcggtggaaagagcagaacaccatagacaatatgtcgctcttgggacccaaggtgctgctgtttcttgctgcattcatcatcacctctgactggatacccctgggggtcaatagtcaacgaggagacgatgtgactcaagcgactccagaaacattcacagaagatcctaatctggtgaatgatcccgctacagatgaaacagttttggctgttttggctgatattgcaccttccacagatgacttggcctccctcagtgaaaaaaataccactgcagagtgctgggatgagaaatttacctgcacaaggctctactctgtgcatcggccggttaaacaatgcattcatcagttatgcttcaccagtttacgacgtatgtacatcgtcaacaaggagatctgctctcgtcttgtctgtaaggaacacgaagctatgaaagatgagctttgccgtcagatggctggtctgccccctaggagactccgtcgctccaattacttccgacttcctccctgtgaaaatgtggatttgcagagacccaatggtctgtgatcattgaaaaagaggaaagaagaaaaaattttgcttgcacttgctgtccttccaccatgggatgactctcatcagatgatggcaccatgttcttggacttctcagcctccagaactgtgagaaataaatttcttttctttataaatta

SEQ ID NO: 43744 - DNA, 919 bp, Homo sapiens
attccagcctcattgtaacacacattctacgcctagcctggctttcttgctctccctcatctcattgtttcagcggaggccaaatctgaagtcctttccagggagtggctctgttcatcttattcgccagccaaagtaggaacagcgtaagaggagagagacacattcagcagccaaaggactcggtggaaagagcagaacaccatagacaatatgtcgctcttgggacccaaggtgctgctgtttcttgctgcattcatcatcacctctgactggatacccctgggggtcaatagtcaacgaggagacgatgtgactcaagcgactccagaaacattcacagaagatcctaatctggtgaatgatcccgctacagatgaaacagttttggctgttttggctgatattgcaccttccacagatgacttggagtgctgggatgagaaatttacctgcacaaggctctactctgtgcatcggccggttaaacaatgcattcatcagttatgcttcaccagtttacgacgtatgtacatcgtcaacaaggagatctgctctcgtcttgtctgtaaggaacacgaagctatgaaagatgagctttgccgtcagatggctggtctgccccctaggagactccgtcgctccaattacttccgacttcctccctgtgaaaatgtggatttgcagagacccaatggtctgtgatcattgaaaaagaggaaagaagaaaaaatgtatgggtgagaggaaggaggatctccttcttctccaaccattgacagctaacccttagacagtatttcttaaaccaatccttttgcaatgtccagcttttacccctactctctactttttcacccaaactgataacatttatctcattttctagcacttaaaatacaaagtctatattattgca

SEQ ID NO: 43745 - DNA, 397 bp, Homo sapiens
caagcatgagccaccgtgcccagcctattttatatttcataacggacaattctagaaagactttattcctagaagtgctctcagagattattttatccacttctacttccaagtagggaagcgccaaaacttcatttagtcaattccctcttgctgtgtttttggtggacggaaaggatgtagcccaatttataatgattctctgtagagattactctgtatttttttcctactctatctatccttcccaattccttcaatccttcatttatgctgcttctatttggacctccttatttttttgtattgggcttcctcagagtgctgggatgagaaatttacctgcacaaggctctactctgtgcatcggccggttaaacaatgcattcatcagtta

SEQ ID NO: 43746 - DNA, 357 bp, Homo sapiens
atgatgttctgcttctcttctagatgagctttgccgtcagatggctggtctgccccctaggagactccgtcgctccaattacttccgacttcctccctgtgaaaatgtggatttgcagagacccaatggtctgtgatcattgaaaaagaggaaagaagaaaaaatgtatgggtgagaggaaggaggatctccttcttctccaaccattgacagctaacccttagacagtatttcttaaaccaatccttttgcaatgtccagcttttacccctactctctactttttcacccaaactgataacatttatctcattttctagcacttaaaatacaaagtctatattattgcataatttt

SEQ ID NO: 43747 - DNA, 949 bp, Homo sapiens
attccagcctcattgtaacacacattctacgcctagcctggctttcttgctctccctcatctcattgtttcagcggaggccaaatctgaagtcctttccagggagtggctctgttcatcttattcgccagccaaagtaggaacagcgtaagaggagagagacacattcagcagccaaaggactcggtggaaagagcagaacaccatagacaatatgtcgctcttgggacccaaggtgctgctgtttcttgctgcattcatcatcacctctgactggatacccctgggggtcaatagtcaacgaggagacgatgtgactcaagcgactccagaaacattcacagaagatcctaatctggtgaatgatcccgctacagatgaaacagttttggctgttttggctgatattgcaccttccacagatgacttggcctccctcagtgaaaaaaataccactgcagagtgctgggatgagaaatttacctgcacaaggctctactctgtgcatcggccggttaaacaatgcattcatcagttatgcttcaccagtttacgacgtatgtacatcgtcaacaaggagatctgctctcgtcttgtctgtaaggaacacgaagctatgaaagatgagctttgccgtcagatggctggtctgccccctaggagactccgtcgctccaattacttccgacttcctccctgtgaaaatgtggatttgcagagacccaatggtctgtgatcattgaaaaagaggaaagaagaaaaaatgtatgggtgagaggaaggaggatctccttcttctccaaccattgacagctaacccttagacagtatttcttaaaccaatccttttgcaatgtccagcttttacccctactctctactttttcacccaaactgataacatttatctcattttctagcacttaaaatacaaagtctatattattgca

SEQ ID NO: 43748 - DNA, 2882 bp, Homo sapiens
attccagcctcattgtaacacacattctacgcctagcctggctttcttgctctccctcatctcattgtttcagcggaggccaaatctgaagtcctttccagggagtggctctgttcatcttattcgccagccaaagtaggaacagcgtaagaggagagagacacattcagcagccaaaggactcggtggaaagagcagaacaccatagacaatatgtcgctcttgggacccaaggtgctgctgtttcttgctgcattcatcatcacctctgactggatacccctgggggtcaatagtcaacgaggagacgatgtgactcaagcgactccagaaacattcacagaagatcctaatctggtgaatgatcccgctacagatgaaacagttttggctgttttggctgatattgcaccttccacagatgacttggcctccctcagtgaaaaaaataccactgcagagtgctgggatgagaaatttacctgcacaaggctctactctgtgcatcggccggttaaacaatgcattcatcagttatgcttcaccagtttacgacgtatgtacatcgtcaacaaggagatctgctctcgtcttgtctgtaaggaacacgaagctatgaaagatgagctttgccgtcagatggctggtctgccccctaggagactccgtcgctccaattacttccgacttcctccctgtgaaaatgtggatttgcagagacccaatggtctgtgatcattgaaaaagaggaaagaagaaaaaatgtatgggtgagaggaaggaggatctccttcttctccaaccattgacagctaacccttagacagtatttcttaaaccaatccttttgcaatgtccagcttttacccctactctctactttttcacccaaactgataacatttatctcattttctagcacttaaaatacaaagtctatattattgcataattttgctgcttctcaatatcatagacacagtgaatagatgatgactatatggcttatatacaaacattctatgtacaatttcaagggagactaaactttaggctaataatctttactattgaatctgtctgatatagatcttagggttgaagaagctatctttgtctatttgggctaaccatagaatttcatttattttcctcacaatattttcctagaccaactccccatcattcacgtgttcctctttactcttactttaactattttgctggcttgcccgaaaatttgcctggcaagtcttccttataagacacatcatggtaagttttgtagtcctgtaagattctgcaacacagtcaagaattatacaatcctactagcaatatataaggacccaaaatgtcttctgctaagctcagaggctggggctaaagcatgaggactatgccagctatagaacttggactcataattcgctatccaatttttcatgcagttgtctagtcgggaagtaaggttggaaactaagtctcatttactgattcgtttatgggtagtaccgggatgaacccaccaccacaaagcaaattagacaacttaatgtgaaatcataccattggttgacgtttccttgagttgctacttcgttcatcttcacaacttaacaagtgcacggtcgaattattgtgcaagtggcttttggatatcctgattggggcctaagaagggcattcagacttgaattttaataggcagacagaaagtttgcctaatagttaatacgaaagaatgaaagaaacacagatattcagacaacccacattcttatcctggctctagcagtaaccacgtagccttggataagccattttccttcattaggtcctggtttaatttcctcatctttaaaatgagaaggttaaatttatcttagtactgctgggcgcagtggctcatgcctgtaatctgagcactttgggaagctgaggcgggtggatcacttgaggtcagaaatttgagacgagcctggccaacatggtgaaaccccatctctactaaaaatacaaaaattagctgggcgtggtggcacgtgcctgtaatcccagctactcgggaggctgaggcaggagaatcaattgaacctgggaggcagaggttgcagtgagccgagatggcgccattgcactccagcctgggtgacaaaagcaaaagtccatcttaagaaatatatatatatattatatatattcttagttctaagatttcctttaattctatgattctctggatttaaatgcattattcatatttcttgaagcttagatacagtctaattcatagcaaccatatctgctttatcctaggtgagggtagcagtccacaatggaatagaagaaaatcccattataacaaatgacaaattatatatcatgaatccttctgtctgactaactcaataactttctataaaagccaatggaattcaaataggagctaggagacaacaagttatatatgacagtggaggttgtattccttttatattgctgagaaaactagttaaatgatcagattcttgctgttaagaaacaatttcgtttaatgggatctgtacaactgattttaaaaaaatgctacaaaaagccccaaagcatataatctctactccttacagtctctagaattaaatgtactcatttagacaacatattaaatgcatattttagccactttagagaaacctcataggcacagagtttccaagattaattttaagaatatcttcacgaacttgaccctcctactccacattgcaacatttccatcagacagcatttcaattccagtattatgtatattgcaaattaaacattttaaaatatttttttccaatttatttctcaaaataaaatgtcttttgttctgg

SEQ ID NO: 43749 - DNA, 830 bp, Homo sapiens
  misc_feature (778)..(778): n is a, c, g, or t
  misc_feature (789)..(789): n is a, c, g, or t
  misc_feature (826)..(826): n is a, c, g, or t
attccagcctcattgtaacacacattctacgcctagcctggctttcttgctctccctcatctcattgtttcagcggaggccaaatctgaagtcctttccagggagtggctctgttcatcttattcgccagccaaagtaggaacagcgtaagaggagagagacacattcagcagccaaaggactcggtggaaagagcagaacaccatagacaatatgtcgctcttgggacccaaggtgctgctgtttcttgctgcattcatcatcacctctgactggatacccctgggggtcaatagtcaacgaggagacgatgtgactcaagcgactccagaaacattcacagaagatcctaatctggtgaatgatcccgctacagatgaaacagttttggctgttttggctgatattgcaccttccacagatgacttggcctccctcagtgaaaaaaataccactgcagagtgctgggatgagaaatttacctgcacaaggctctactctgtgcatcggccggttaaacaatgcattcatcagttatgcttcaccagtttacgacgtatgtacatcgtcaacaaggagatctgctctcgtcttgtctgtaaggaacacgaagctatgaaagatgagctttgccgtcagatggctggtctgccccctaggagactccgtcgctccaattacttccgacttcctccctgtgaaaatgtggatttgcagagacccaatggtctgtgatcattgaaaaagaggaaagaagaaaaaatgtgtggccaagatnccctctcgcangcacatgactgcctcattcacaaatcttgtcaccaangcgg

SEQ ID NO: 43750 - DNA, 907 bp, Homo sapiens
tagtagggcagaaaagtgggtatagctgcctgcacgcacgcttggtgcgtgcgcggcgactgcgacgggcagtggcagtcatggcggctcagtgcgtgaggttggcgcggcgcagtcttcctgctttggcgttgtctctcaggccatctccccggttgttgtgcacagccacgaaacaaaagaacagtggccagaacctggaagaggacatgggtcagagtgaacagaaggcagatcctcctgctacagagaagaccctcctggaagagaaggtcaagttggaggaacagctgaaggagactgtggaaaaatataaacgagctttggcagacactgagaacttacggcagaggagccagaaattggtggaggaggcaaaattatacggcattcaagccttctgcaaggacttgttggaggtggcagacgttctggagaaggcaacacagtgtgttccaaaagaagaaattaaagacgataaccctcacctgaagaacctctatgaggggctggtcatgactgaagtccagatccagaaggtgttcacaaagcatggcttgctcaagttgaaccctgtcggagccaagttcgacccttatgaacatgaggccttgttccacacaccggttgaggggaaggagccaggcacagtggccctagttagcaaagtggggtacaagctgcatgggcgcactctgagacccgccctggtgggggtggtgaaggaagcttagctgctgttgatggggtgggtgtttttaaactcacttgatgtaaaaaaaaaaaaaaaaaaatcgggggcttattgcggggcggggaaaaggggtttgaaatggcctgggtcttgttgtcctggccctttttggtacagggggatttgcgggccctaagggcgttaatgaaaccg

SEQ ID NO: 43751 - DNA, 1542 bp, Homo sapiens
tagtagggcagaaaagtgggtatagctgcctgcacgcacgcttggtgcgtgcgcggcgactgcgacgggcagtggcagtcatggcggctcagtgcgtgaggttggcgcggcgcagtcttcctgctttggcgttgtctctcaggccatctccccggttgttgtgcacagccacgaaacaaaagaacagtggccagaacctggaagaggacatgggtcagagtgaacagaaggcagatcctcctgctacagagaagaccctcctggaagagaaggtcaagttggaggaacagctgaaggagactgtggaaaaatataaacgagctttggcagacactgagaacttacggcagaggagccagaaattggtggaggaggcaaaattatacggcattcaagccttctgcaaggacttgttggaggtggcagacgttctggagaaggcaacacagtgtgttccaaaagaagaaattaaagacgataaccctcacctgaagaacctctatgaggggctggtcatgactgaagtccagatccagaaggtgttcacaaagcatggcttgctcaagttgaaccctgtcggagccaagttcgacccttatgaacatgaggccttgttccacacaccggttgaggggaaggagccaggcacagtggccctagttagcaaagtggggtacaagctgcatgggcgcactctgagacccgccctggtgggggtggtgaaggaagcttagctgctgttgatggggtgggtgtttttaaactcacttgatgtaactctcaaggctggttcattgtttctcatctatgagtacgtgtgaccttttcccaaaccttattggaaaccttaagtaaccagtggctaaacagaaaagccggttgcccaactgcattaatgaactctaattcgggagtctgttcccttttagtgccacgcgttgaatagttccacatactttcagaagagctcagcagggccctgcctggtctcccgagcatcatgagtaacgtgtctgctcagactctgctgacaccaaagtattttaaacaaataaaaggtcttggggaattctgtttggctacctgggcacgccagtctgcaccatgtgtccctgcggcgcatgagtgactggcgtatttagcccgtcacatttcattcgctgaaggaaaggcaagagagttgaaacatttttcttacttaaaaaaaatgatctttgtgaagaacatagtgagttcgtttgtcttcagtcaacagcggctgaaactgaccactgagaaatgggtgtgggcactgacagttctcccccattatttggccaggaattgagcttggcttggcaaagttccttttaccctgttctgttcatctaaatgcagacatatttaaatcatattcaactagttactaatgacctcaagttgtattccctggcaaaatggactttctcaaaataggactgcacgcttggtgtactttaaatgttaatgtttaatttaaaatttttatttaagaggattaaagccctaatgtttattttccta

SEQ ID NO: 43752 - DNA, 1260 bp, Homo sapiens
tagtagggcagaaaagtgggtatagctgcctgcacgcacgcttggtgcgtgcgcggcgactgcgacgggcagtggcagtcatggcggctcagtgcgtgaggttggcgcggcgcagtcttcctgctttggcgttgtctctcaggccatctccccggttgttgtgcacagccacgaaacaaaagaacagtggccagaacctggaagaggacatgggtcagagtgaacagaaggcagatcctcctgctacagagaagaccctcctggaagagaaggtcaagttggaggaacagctgaaggagactgtggaaaaatataaacgagctttggcagacactgagaacttacggcagaggagccagaaattggtggaggaggcaaaattatacggcattcaagccttctgcaaggacttgttggaggtggcagacgttctggagaaggcaacacagtgtgttccaaaagaagaaattaaagacgataaccctcacctgaagaacctctatgaggggctggtcatgactgaagtccagatccagaaggtgttcacaaagcatggcttgctcaagttgaaccctgtcggagccaagttcgacccttatgaacatgaggccttgttccacacaccggttgaggggaaggagccaggcacagtggccctagttagcaaagtggggtacaagctgcatgggcgcactctgagacccgccctggtgggggtggtgaaggaagcttagctgctgttgatggggtgggtgtttttaaactcacttgatgtaactctcaaggctggttcattgtttctcatctatgagtacgtgtgaccttttcccaaaccttattggaaaccttaagtaaccagtggctaaacagaaaagccggttgcccaactgcattaatgaactctaattcgggagtctgttcccttttagtgccacgcgttgaatagttccacatactttcagaagagctcagcagggccctgcctggtctcccgagcatcatgagtaacgtgtctgctcagactctgctgacaccaaagtattttaaacaaataaaaggtcttgggaaaaaaaaaataaaaaaaaaaaaaaaccgtcaccatcccttctttctcccaatctccctttccatcctcattttccattctcacttgccctcctccctcaaccttctcttccttgcacaaccctctgcgctccctcgctctccttctccttccgcttcctccctttccggtgcggttatatctgtgcctctccc

SEQ ID NO: 43753 - DNA, 2220 bp, Homo sapiens
tagtagggcagaaaagtgggtatagctgcctgcacgcacgcttggtgcgtgcgcggcgactgcgacgggcagtggcagtcatggcggctcagtgcgtgaggttggcgcggcgcagtcttcctgctttggcgttgtctctcaggccatctccccggttgttgtgcacagccacgaaacaaaagaacagtggccagaacctctatgaggggctggtcatgactgaagtccagatccagaaggtgttcacaaacttagctgctgttgatggggtgggtgtttttaaactcacttgatgtaactctcaaggctggttcattgtttctcatctatgagtacgtgtgaccttttcccaaaccttattggaaaccttaagtaaccagtggctaaacagaaaagccggttgcccaactgcattaatgaactctaattcgggagtctgttcccttttagtgccacgcgttgaatagttccacatactttcagaagagctcagcagggccctgcctggtctcccgagcatcatgagtaacgtgtctgctcagactctgctgacaccaaagtattttaaacaaataaaaggtcttggggaattctgtttggctacctgggcacgccagtctgcaccatgtgtccctgcggcgcatgagtgactggcgtatttagcccgtcacatttcattcgctgaaggaaaggcaagagagttgaaacatttttcttacttaaaaaaaatgatctttgtgaagaacatagtgagttcgtttgtcttcagtcaacagcggctgaaactgaccactgagaaatgggtgtgggcactgacagttctcccccattatttggccaggaattgagcttggcttggcaaagttccttttaccctgttctgttcatctaaatgcagacatatttaaatcatattcaactagttactaatgacctcaagttgtattccctggcaaaatggactttctcaaaataggactgcacgcttggtgtactttaaatgttaatgtttaatttaaaatttttatttaagaggattaaagccctaatgtttattttcctactttctgaaaacaattttgtgtcctctcatggagatccttgccgctgaggcaagcatggcttagccttcccattctctactccagcccagaagctgtcagcttgacacgtgcgtgcgtgcacattcacgtacacacatatacaggcttctacacagaaagggagagccacactcccccagtgcagctgcagcccgtccggtaagaatacgaaacacccaggagccacagcaagggcacaggatttgcaaaatcatcttgccaaagggctgttcctcatttacacggtcatccagggcttagaaaaaggctgaatgattggcgtctgttacaaaaaagagaaaagaacctttcgctgcctttgcttctagaatggaagatacttgtgaaagccatttgctgcataggaaagatggggcagtttatttcacttctaattttaaaagacgcaagtaatggtcccataatacttcatcttgggataccattcccaaacatgttccacctttaagatgccttaagttaatttggtcagaaacaactaaaggcagcatcgtgtattggagaaaacatgactgggagctccagcgctgcctgttttcacgctgtggggttgtgagtgcatcatcacccctggagctcccgagttaaatggaggctaagaaaagtaatttatcaactcatttctgtgaatgtttgcagtctcctaccgtctcaactacagctgcagttgctaaaaagcacttaactcgtaacctagaggcaatatagcttaagtagcaaaatatttttttacagtaagcttcagtcatccatagtcactataagttggttatcatctgaaatggttagaaccagaattgtttcaaacttggggggttttcggattttggaatatagtcaagcatggcttaaccacagggatgtgttctgagaaatgcgctgtcaggcagtttttcctgtgaacaccatgtgtacctacatggacctaaaaaacaggtggtggagcctcctccacacctaggctatatggtgtatgtagcctgttgctctagactggagggcacgttactgtactgatactgtaggcaactgttaacacaatggtatctgtgtatctgaacataacatagtaaaggtacagtgcaaactgtgttct

SEQ ID NO: 43754 - DNA, 872 bp, Homo sapiens
  misc_feature (24)..(24): n is a, c, g, or t
  misc_feature (105)..(105): n is a, c, g, or t
  misc_feature (135)..(135): n is a, c, g, or t
aattgagcttggcttggcaaagtnccttttaccctgttctgttcatctaaatgcaaacatatttaaatcatattcaactagttactaatgacctcaagttgtatnccctggcaaaatgcactttctcaaaatagnactgcacgcttggtgtattttaaattaaacttattggaaaccttaagtaaccagtggctaaacagaaaagccggttgcccaactgcattaatgaactctaattcgggagtctgttcccttttagtgccacgcgttgaatagttccacatactttcagaagagctcagcagggccctgcctggtctcccgagcatcatgagtaacgtgtctgctcagactctgctgacaccaaagtattttaaacaaataaaaggtcttggggaattctgtttggctacctgggcacgccagtctgcaccatgtgtccctgcggcgcatgagtgactggcgtatttagcccgtcacatttcattcgctgaaggaaaggcaagagagttgaaacatttttcttacttaaaaaaaatgatctttgtgaagaacatagtgagttcgtttgtcttcagtcaacagcggctgaaactgaccactgagaaatgggtgtgggcactgacagttctcccccattatttggccaggaattgagcttggcttggcaaagttccttttaccctgttctgttcatctaaatgcagacatatttaaatcatattcaactagttactaatgacctcaagttgtattccctggcaaaatggactttctcaaaataggactgcacgcttggtgtactttaaatgttaatgtttaatttaaaatttttatttaagaggattaaagccctaatgtttattttccta

SEQ ID NO: 43755 - DNA, 642 bp, Homo sapiens
aatagtaaatagtttgaagctattttaagtttctaaagtcatacatctgactttaataagcacaaaaactaagtcttcgtttctcacgtgtggacttccctgtaggccatctccccggttgttgtgcacagccacgaaacaaaagaacagtggccagaacctggaagaggacatgggtcagagtgaacagaaggcagatcctcctgctacagagaagaccctcctggaagagaaggtcaagttggaggaacagctgaaggagactgtggtgaggactgtgaggctcctgtgggggcgggctcggctgaactgtttctctcctgggccacataaaggttccaggtttcattggtgacagactaaagccagagttaagccgttgtccatggcctgcagtgggcccaggtggcaagttactgccaaagcaaagactaaaacccaaatcctgtgcaactctggttctggcaagagactaatctttacacgctgttatttgtcattgaatgaaaacttaaaatcatctttacaaatgaggaatgctcagtatggttgtttaggctgggacttaggagaggaagcagaaaattgcaagtacaagagttgggagcaggagtgtggttttatgtgatgctctcataggca

SEQ ID NO: 43756 - DNA, 2699 bp, Homo sapiens
tagtagggcagaaaagtgggtatagctgcctgcacgcacgcttggtgcgtgcgcggcgactgcgacgggcagtggcagtcatggcggctcagtgcgtgaggttggcgcggcgcagtcttcctgctttggcgttgtctctcaggccatctccccggttgttgtgcacagccacgaaacaaaagaacagtggccagaacctggaagaggacatgggtcagagtgaacagaaggcagatcctcctgctacagagaagaccctcctggaagagaaggtcaagttggaggaacagctgaaggagactgtggaaaaatataaacgagctttggcagacactgagaacttacggcagaggagccagaaattggtggaggaggcaaaattatacggcattcaagccttctgcaaggacttgttggaggtggcagacgttctggagaaggcaacacagtgtgttccaaaagaagaaattaaagacgataaccctcacctgaagaacctctatgaggggctggtcatgactgaagtccagatccagaaggtgttcacaaagcatggcttgctcaagttgaaccctgtcggagccaagttcgacccttatgaacatgaggccttgttccacacaccggttgaggggaaggagccaggcacagtggccctagttagcaaagtggggtacaagctgcatgggcgcactctgagacccgccctggtgggggtggtgaaggaagcttagctgctgttgatggggtgggtgtttttaaactcacttgatgtaactctcaaggctggttcattgtttctcatctatgagtacgtgtgaccttttcccaaaccttattggaaaccttaagtaaccagtggctaaacagaaaagccggttgcccaactgcattaatgaactctaattcgggagtctgttcccttttagtgccacgcgttgaatagttccacatactttcagaagagctcagcagggccctgcctggtctcccgagcatcatgagtaacgtgtctgctcagactctgctgacaccaaagtattttaaacaaataaaaggtcttggggaattctgtttggctacctgggcacgccagtctgcaccatgtgtccctgcggcgcatgagtgactggcgtatttagcccgtcacatttcattcgctgaaggaaaggcaagagagttgaaacatttttcttacttaaaaaaaatgatctttgtgaagaacatagtgagttcgtttgtcttcagtcaacagcggctgaaactgaccactgagaaatgggtgtgggcactgacagttctcccccattatttggccaggaattgagcttggcttggcaaagttccttttaccctgttctgttcatctaaatgcagacatatttaaatcatattcaactagttactaatgacctcaagttgtattccctggcaaaatggactttctcaaaataggactgcacgcttggtgtactttaaatgttaatgtttaatttaaaatttttatttaagaggattaaagccctaatgtttattttcctactttctgaaaacaattttgtgtcctctcatggagatccttgccgctgaggcaagcatggcttagccttcccattctctactccagcccagaagctgtcagcttgacacgtgcgtgcgtgcacattcacgtacacacatatacaggcttctacacagaaagggagagccacactcccccagtgcagctgcagcccgtccggtaagaatacgaaacacccaggagccacagcaagggcacaggatttgcaaaatcatcttgccaaagggctgttcctcatttacacggtcatccagggcttagaaaaaggctgaatgattggcgtctgttacaaaaaagagaaaagaacctttcgctgcctttgcttctagaatggaagatacttgtgaaagccatttgctgcataggaaagatggggcagtttatttcacttctaattttaaaagacgcaagtaatggtcccataatacttcatcttgggataccattcccaaacatgttccacctttaagatgccttaagttaatttggtcagaaacaactaaaggcagcatcgtgtattggagaaaacatgactgggagctccagcgctgcctgttttcacgctgtggggttgtgagtgcatcatcacccctggagctcccgagttaaatggaggctaagaaaagtaatttatcaactcatttctgtgaatgtttgcagtctcctaccgtctcaactacagctgcagttgctaaaaagcacttaactcgtaacctagaggcaatatagcttaagtagcaaaatatttttttacagtaagcttcagtcatccatagtcactataagttggttatcatctgaaatggttagaaccagaattgtttcaaacttggggggttttcggattttggaatatagtcaagcatggcttaaccacagggatgtgttctgagaaatgcgctgtcaggcagtttttcctgtgaacaccatgtgtacctacatggacctaaaaaacaggtggtggagcctcctccacacctaggctatatggtgtatgtagcctgttgctctagactggagggcacgttactgtactgatactgtaggcaactgttaacacaatggtatctgtgtatctgaacataacatagtaaaggtacagtgcaaactgtgttct

SEQ ID NO: 43757 - DNA, 2955 bp, Homo sapiens
tagtagggcagaaaagtgggtatagctgcctgcacgcacgcttggtgcgtgcgcggcgactgcgacgggcagtggcagtcatggcggctcagtgcgtgaggttggcgcggcgcagtcttcctgctttggcgttgtctctcaggccatctccccggttgttgtgcacagccacgaaacaaaagaacagtggccagaacctggaagaggacatgggtcagagtgaacagaaggcagatcctcctgctacagagaagaccctcctggaagagaaggtcaagttggaggaacagctgaaggagactgtggaaaaatataaacgagctttggcagacactgagaacttacggcagaggagccagaaattggtggaggaggcaaaattatacggcattcaagccttctgcaaggacttgttggaggtggcagacgttctggagaaggcaacacagtgtgttccaaaagaagaaattaaagacgataaccctcacctgaagaacctctatgaggggctggtcatgactgaagtccagatccagaaggtgttcacaaagcatggcttgctcaagttgaaccctgtcggagccaagttcgacccttatgaacatgaggccttgttccacacaccggttgaggggaaggagccaggcacagtggccctagttagcaaagtggggtacaagctgcatgggcgcactctgagacccgccctggtgggggtggtgaaggaagcttagctgctgttgatggggtgggtgtttttaaactcacttgatgtaactctcaaggctggttcattgtttctcatctatgagtacgtgtgaccttttcccaaaccttattggaaaccttaagtaaccagtggctaaacagaaaagccggttgcccaactgcattaatgaactctaattcgggagtctgttcccttttagtgccacgcgttgaatagttccacatactttcagaagagctcagcagggccctgcctggtctcccgagcatcatgagtaacgtgtctgctcagactctgctgacaccaaagtattttaaacaaataaaaggtcttggggaattctgtttggctacctgggcacgccagtctgcaccatgtgtccctgcggcgcatgagtgactggcgtatttagcccgtcacatttcattcgctgaaggaaaggcaagagagttgaaacatttttcttacttaaaaaaaatgatctttgtgaagaacatagtgagttcgtttgtcttcagtcaacagcggctgaaactgaccactgagaaatgggtgtgggcactgacagttctcccccattatttggccaggaattgagcttggcttggcaaagttccttttaccctgttctgttcatctaaatgcagacatatttaaatcatattcaactagttactaatgacctcaagttgtattccctggcaaaatggactttctcaaaataggactgcacgcttggtgtactttaaatgttaatgtttaatttaaaatttttatttaagaggattaaagccctaatgtttattttcctactttctgaaaacaattttgtgtcctctcatggagatccttgccgctgaggcaagcatggcttagccttcccattctctactccagcccagaagctgtcagcttgacacgtgcgtgcgtgcacattcacgtacacacatatacaggcttctacacagaaagggagagccacactcccccagtgcagctgcagcccgtccggtaagaatacgaaacacccaggagccacagcaagggcacaggatttgcaaaatcatcttgccaaagggctgttcctcatttacacggtcatccagggcttagaaaaaggctgaatgattggcgtctgttacaaaaaagagaaaagaacctttcgctgcctttgcttctagaatggaagatacttgtgaaagccatttgctgcataggaaagatggggcagtttatttcacttctaattttaaaagacgcaagtaatggtcccataatacttcatcttgggataccattcccaaacatgttccacctttaagatgccttaagttaatttggtcagaaacaactaaaggcagcatcgtgtattggagaaaacatgactgggagctccagcgctgcctgttttcacgctgtggggttgtgagtgcatcatcacccctggagctcccgagttaaatggaggctaagaaaagtaatttatcaactcatttctgtgaatgtttgcagtctcctaccgtctcaactacagctgcagttgctaaaaagcacttaactcgtaacctagaggcaatatagcttaagtagcaaaatatttttttacagtaagcttcagtcatccatagtcactataagttggttatcatctgaaatggttagaaccagaattgtttcaaacttggggggttttcggattttggaatatagtcaagcatggcttaaccacagggatgtgttctgagaaatgcgctgtcaggcagtttttcctgtgaacaccatgtgtacctacatggacctaaaaaacaggtggtggagcctcctccacacctaggctatatggtgtatgtagcctgttgctctagactggagggcacgttactgtactgatactgtaggcaactgttaacacaatggtatctgtgtatctgaacataacatagtaaaggtacagtgcaaactgtgttctaatatgtggcccctcattgactgaaaagagattctctgcttgactatttgcattgtatttgctggttaagtatccccaatcccaaaatccaaaatgctctaaatgagcatctcctttgagcaccatgtaggcactcagaaagtttcagattttgcagcctttcagatttggggatactcaacctgtaataggaaaatgtcttttaattatgtgcatatttacagtaggaattaaagatttgtttagctaccttcta

SEQ ID NO: 43758 - DNA, 5006 bp, Homo sapiens
gaatgcaggtgagaaaaggcacggactctgcggctgcgaacccaaacttgggcaccgcacggtgcgcactgctcagccttcgcccccgtgggcgaaaggctgctgcggtttcaggcggctgcttcgtgactaatgaccttgcgcagagttgttaagaaaaaagagaaacccgcgctctccggggtgagaagggactgactctgggcgtctctgaagatggctcgggcttctctttggcgcgccggggggaccctgacactgaccgctctgtgacgcgagtagtctcccctgcaccgtgcccgaagcgacgtgccgggggatttttcattctcgatctgttgactggctcccccgctgcatgagcagagtcggagttgagactggcttgttgctggccccagcgcctggtgcaggaagcgactcacgtttgtctgggtggccggagccggagcagagcctgggtttggagtgagtgcctggaacgtgaattggactcaactcgagtagcagcaaagaccagcgggctggcaggcgggggaggctgcaggctcattccccacctcttcccagccccactgcccgtctgccggagcggttctggccccttccgacagagcggggactagagccggggattctccgcccgctgaggggatgactctgggttgggggagcgccgaacccgcggcgcgcagtgtcccgtgaactgtgagtactgcgactgaacggcggcaggcgagcgggcgattagcacccattgcatgaattatgaaacaataactttcggaagaagcaggaggaaaaaaagaagcatctatcgctgccctcccacccccattcccggccaactctccacgccgcttttgccccctccctcccctccctctcgctccttcctttccgggagaggggagaggactcgggggagggcaggcggccggccccggaggaggggggcgccgagggggctgtggttagaaggagcagtagcagcagcagcaggagaagatgctgaggatgcggaccgcgggatgggcgcgcggctggtgcttgggctgctgcctcctcctgccgctctcgctcagcctggcggccgccaagcagctcctccggtaccggctggccgaggagggccccgccgacgtccgcatcggcaacgtggcttcagacctgggcatcgtgaccggatcgggtgaggtgactttcagcctggagtccggttccgagtacctgaagatcgacaacctcactggcgagctgagcacgagcgagcggcgcatcgaccgcgagaagctgccccagtgtcagatgatcttcgacgagaacgagtgcttcctggacttcgaggtgtcggtgatcgggccctcgcagagctgggtggacctgtttgagggtcaggtcatcgtgcttgacatcaacgacaacacgcccaccttcccgtcgcccgtgctcacgctcacggtggaggagaatcggccggtgggcacactttacctgctgcccacagccaccgaccgcgacttcggccgcaacggcatcgagcgctacgagctgctccaggagcccggaggcggcggcagcggcggcgagagccggcgcgccggggcggccgacagcgccccctaccccgggggcggcgggaacggcgcgagcggcggcggctcgggaggctccaagcggcggctggacgcatcagagggcggcggcggcaccaaccccggcggccgcagcagcgtgttcgagctgcaggtggcggacaccccggacggcgagaagcagccgcagctgatcgtgaagggggcgctggaccgcgagcagcgcgactcctacgagctgaccctgcgagtgcgcgacggcggcgacccgcctcgctcctcgcaggccatcctacgggtcctcatcaccgacgtgaacgacaacagcccccgcttcgagaagagcgtgtacgaggccgacttggctgagaacagcgccccggggacccccatcctgcaactgcgcgcagccgacttggacgtgggggtcaacgggcagatcgaatacgtgttcggggcggccaccgagtcggtgaggcggctgctgcgccttgacgagacgtccggctggctcagcgtcctgcaccggatcgaccgcgaggaggtgaaccagctgcgcttcacggtcatggcccgcgaccgcgggcagccccccaagaccgacaaggccaccgtggtccttaacatcaaagacgagaacgacaacgtgccgtccattgaaatccgcaagattgggcgcatccccctcaaggacggggtggccaacgtggccgaggacgttctggtcgacacccccatcgctctggtgcaggtgtccgaccgagaccaaggcgagaacggggtggtcacctgcaccgtggtgggcgacgtgcccttccagctcaagccagccagcgacaccgagggcgaccagaacaagaaaaagtacttcttgcacacctcgacccctctggactatgaggccacccgggagttcaacgtggtcatcgtggcggtggactcaggcagccccagcctctcgagcaacaactccctgattgtcaaggtgggagacaccaacgacaacccgcccatgttcggccagtcggtggtggaggtttacttccctgagaacaacatcccgggcgagagggtggccacggtgctggcgacagacgcagacagcggtaagaacgccgagatcgcctactcgctggactcctctgtgatggggatctttgccatcgatcccgattctggggacatcctggtcaataccgtgctggaccgcgagcagactgacaggtatgagtttaaagttaacgccaaagacaaaggcatccccgtgctgcagggcagcactacggtgattgtgcaggtggctgataaaaatgacaatgaccctaagtttatgcaggacgtcttcaccttttatgtgaaagaaaacttgcagcccaacagccctgtggggatggtcaccgtgatggatgctgacaaggggcggaatgcagagatgagcctgtacatagaggagaacaataacattttttctattgaaaatgacacggggaccatttactccacaatgtcttttgaccgggaacatcagaccacatacactttcagagtcaaggctgtggatgggggagatcctcccagatctgccacagctacagtctcgctttttgtgatggatgaaaatgacaatgctcccacagttacccttcccaaaaacatttcctacactttactgccaccttcgagtaatgtcaggacagtagtagctacagtgttggcaacagacagtgatgatggcatcaatgcagacctgaactacagcattgtgggaggaaatcccttcaagctgtttgaaattgatcccactagtggtgtggtttccttagtgggaaaactcacccaaaagcattatggcttgcacaggttggtggtgcaagtgaatgacagtgggcagccttcccagtccaccacgactctggtgcacgtgtttgtcaatgaaagtgtttctaatgcaactgcgattgactcccagatagctagaagtttgcacatcccactcacccaggatatagctggtgacccaagctatgaaattagcaaacagagactcagtattgtcattggcgtggttgctggcattatgacggtgattctaatcatcttaattgtagtgatggcaaggtactgcaggtccaaaaataaaaatggctatgaagccggcaaaaaagatcacgaagacttttttacaccccaacagcatgacaaatctaaaaagcctaaaaaggacaagaaaaacaaaaaatctaagcagcctctctacagcagcattgtcactgtggaggcttctaagccaaatggacagaggtatgatagtgtcaatgagaagctgtcagacagcccaagcatggggcgatacaggtccgttaatggtgggcccggcagtcctgacctggcaaggcattacaaatctagttccccattgcctactgttcagcttcatccccagtcaccaactgcaggaaaaaaacaccaggccgtacaagatctaccaccagccaacacatttgtgggagcaggagacaacatttcaattggatcagatcactgctctgagtacagctgtcaaaccaataacaagtacagcaaacaggtaagatgtatcccaaatatatttaaatatcccagggagggctaataactctgagacagattatcttctgtaaagttttgtcttctcgtttttaaagttattaaaattttaacagtaggaatttaatgttaatttttgcaccattaatttagcaaaggccatctacaagaggtataccactgtattttgcaaattagaattaaggttcactaaactactgaaagaagtattcagagtaggcagtgtttggcagttctctttgcacttgacatccctaattcatactacatttttttgtttccagaataaatatgtgtgtattacttagatggttagttttcacctgaaattattttcttctgtggcaactaagtggataattacatccagagaaaaagtttctaaagttactactggtgtctatgcaaattggattccatagaagttttagctatgttatttacaatgcaggattttacagataaatagatgctgattcatgcagatgtagtactaagtctgagatattgaaatactgactactttgatgaaactgctggtttaaaaatatttactgatatgcaaatgtcatgcaaaactccactttcaatcttttatatctataataatcgatacctataacaattagtgttctataatgatatgcaattaccatttgcattctttctgtttggtattaaaagtttgcaaacaaaaatacattgcatgagccatttattatttaagccaagtaatgaaaatattcatgattgatgtactgtgtgcaagactattttggtatgcattatgatatattgagaatg

SEQ ID NO: 43759 - DNA, 1240 bp, Homo sapiens
gctcccctttcctcatggcaagacgcatggaagaagagtgctgttaaggcctctccattaatcaacagattcaaggcctcttccagatgtagccctgactgggaagtgcactcgtgagtgtgatgagtatggccactcagactcctgctggatgccggtccgcacttctccggagaggaagaagagccagcctaaactgtccactttcatgcctgttgatgaacgaggaagccaggaaaagctggccaatggggaggccgccatcatgggtgaccgcaacagaaacctcctgaacaaaaagttgacctcatcctatgagaccttcagtgcagctagtttcagcaaaaatgaggaagccaaccctgaggatattccccttacaaaaacaggggaatataagccatctcctgtcaatactctcactagaagagaagtttacctgtaggctataaaggagcaacagcaaagttctttacatgtatgaaaaggagaataaggggcaaaaaccttacaaagcaaaacgtttaatcacaaagagggggctaccaaagagacaaagctttgcctgccacttctgcctccagatcaggcctttagtgatactgttagcctgattctactgtacaatgtagaaaccatccttgttacttgcatgtctaaccccttcactgattcccaacactcactttctcttccccacccctctccaaaaaaaaaaaaaccaaaagaaaagaaaaaaaaagggggatagttgcaagtttctttcacagtaactgtacgaagcctgattagcagaacacaacacaccctcattatccctaagctgaagcatgattttagtcactttgattttgttcgagtgtcatctggctggtcaaaaataagcaggacagataaaatgtatttcagacataccatcagaaaatggtttatcaccatcaaaggcaatcctttgaaagtgatagagtccctctaaaggtacagtccttagaaagagggactgtattaaaaagtattttgggaatatcaaagctttaatatctccaacaaagactaagagaaaaacaatactcagtgggtgattgcagtcctaaattgtcatatgttgttattttcaggtcaagagcatcaacttcaattccatacattcaccaaatattctcagtatacacacagtcttgattacatgtatcaatttcaccagttatgacttctaagaattatatatattttttcagaa

SEQ ID NO: 43760 - DNA, 653 bp, Homo sapiens
cttcccccaccccccaagtgtatttattatttacaaacacaaagttggcattaaaatttttcttagctccgaaatctctactaaagctttccaattgggcataagacactggggaaaatttctttatcgatttttttttacctgcataaatctttattttccttctttcagatgcgtctacatccatacattactgtgtttggctgaattccactctaatatgatgctccattatgcaccatactgtgatgacctttctactccgaaacctgctggagcctgcccttggccgtggggtgtcagccaatcactgcttgttccacttgttgtacattttatttttgagtctttttctttctcatatacagaaaaatagtatgaaaataaaataaatgtatgaaacagtattaatgcagaaatgtgctactaatggatgtctgagtcaccagaaattccattcttaaagaggcggttagcacctattagacgtaacagtgatgtcttttaaaaaatccaaaagcatattgcaacaataagtttgagactttgtgtgaacaaagggaaattcagcctcttatgtctttgtctttaatacattaaatactgattttgaataaaaatctaaattgatcaatattgttaagtgccagtaa

SEQ ID NO: 43761 - DNA, 5406 bp, Homo sapiens
gaatgcaggtgagaaaaggcacggactctgcggctgcgaacccaaacttgggcaccgcacggtgcgcactgctcagccttcgcccccgtgggcgaaaggctgctgcggtttcaggcggctgcttcgtgactaatgaccttgcgcagagttgttaagaaaaaagagaaacccgcgctctccggggtgagaagggactgactctgggcgtctctgaagatggctcgggcttctctttggcgcgccggggggaccctgacactgaccgctctgtgacgcgagtagtctcccctgcaccgtgcccgaagcgacgtgccgggggatttttcattctcgatctgttgactggctcccccgctgcatgagcagagtcggagttgagactggcttgttgctggccccagcgcctggtgcaggaagcgactcacgtttgtctgggtggccggagccggagcagagcctgggtttggagtgagtgcctggaacgtgaattggactcaactcgagtagcagcaaagaccagcgggctggcaggcgggggaggctgcaggctcattccccacctcttcccagccccactgcccgtctgccggagcggttctggccccttccgacagagcggggactagagccggggattctccgcccgctgaggggatgactctgggttgggggagcgccgaacccgcggcgcgcagtgtcccgtgaactgtgagtactgcgactgaacggcggcaggcgagcgggcgattagcacccattgcatgaattatgaaacaataactttcggaagaagcaggaggaaaaaaagaagcatctatcgctgccctcccacccccattcccggccaactctccacgccgcttttgccccctccctcccctccctctcgctccttcctttccgggagaggggagaggactcgggggagggcaggcggccggccccggaggaggggggcgccgagggggctgtggttagaaggagcagtagcagcagcagcaggagaagatgctgaggatgcggaccgcgggatgggcgcgcggctggtgcttgggctgctgcctcctcctgccgctctcgctcagcctggcggccgccaagcagctcctccggtaccggctggccgaggagggccccgccgacgtccgcatcggcaacgtggcttcagacctgggcatcgtgaccggatcgggtgaggtgactttcagcctggagtccggttccgagtacctgaagatcgacaacctcactggcgagctgagcacgagcgagcggcgcatcgaccgcgagaagctgccccagtgtcagatgatcttcgacgagaacgagtgcttcctggacttcgaggtgtcggtgatcgggccctcgcagagctgggtggacctgtttgagggtcaggtcatcgtgcttgacatcaacgacaacacgcccaccttcccgtcgcccgtgctcacgctcacggtggaggagaatcggccggtgggcacactttacctgctgcccacagccaccgaccgcgacttcggccgcaacggcatcgagcgctacgagctgctccaggagcccggaggcggcggcagcggcggcgagagccggcgcgccggggcggccgacagcgccccctaccccgggggcggcgggaacggcgcgagcggcggcggctcgggaggctccaagcggcggctggacgcatcagagggcggcggcggcaccaaccccggcggccgcagcagcgtgttcgagctgcaggtggcggacaccccggacggcgagaagcagccgcagctgatcgtgaagggcgtgtacgaggccgacttggctgagaacagcgccccggggacccccatcctgcaactgcgcgcagccgacttggacgtgggggtcaacgggcagatcgaatacgtgttcggggcggccaccgagtcggtgaggcggctgctgcgccttgacgagacgtccggctggctcagcgtcctgcaccggatcgaccgcgaggaggtgaaccagctgcgcttcacggtcatggcccgcgaccgcgggcagccccccaagaccgacaaggccaccgtggtccttaacatcaaagacgagaacgacaacgtgccgtccattgaaatccgcaagattgggcgcatccccctcaaggacggggtggccaacgtggccgaggacgttctggtcgacacccccatcgctctggtgcaggtgtccgaccgagaccaaggcgagaacggggtggtcacctgcaccgtggtgggcgacgtgcccttccagctcaagccagccagcgacaccgagggcgaccagaacaagaaaaagtacttcttgcacacctcgacccctctggactatgaggccacccgggagttcaacgtggtcatcgtggcggtggactcaggcagccccagcctctcgagcaacaactccctgattgtcaaggtgggagacaccaacgacaacccgcccatgttcggccagtcggtggtggaggtttacttccctgagaacaacatcccgggcgagagggtggccacggtgctggcgacagacgcagacagcggtaagaacgccgagatcgcctactcgctggactcctctgtgatggggatctttgccatcgatcccgattctggggacatcctggtcaataccgtgctggaccgcgagcagactgacaggtatgagtttaaagttaacgccaaagacaaaggcatccccgtgctgcagggcagcactacggtgattgtgcaggtggctgataaaaatgacaatgaccctaagtttatgcaggacgtcttcaccttttatgtgaaagaaaacttgcagcccaacagccctgtggggatggtcaccgtgatggatgctgacaaggggcggaatgcagagatgagcctgtacatagaggagaacaataacattttttctattgaaaatgacacggggaccatttactccacaatgtcttttgaccgggaacatcagaccacatacactttcagagtcaaggctgtggatgggggagatcctcccagatctgccacagctacagtctcgctttttgtgatggatgaaaatgacaatgctcccacagttacccttcccaaaaacatttcctacactttactgccaccttcgagtaatgtcaggacagtagtagctacagtgttggcaacagacagtgatgatggcatcaatgcagacctgaactacagcattgtgggaggaaatcccttcaagctgtttgaaattgatcccactagtggtgtggtttccttagtgggaaaactcacccaaaagcattatggcttgcacaggttggtggtgcaagtgaatgacagtgggcagccttcccagtccaccacgactctggtgcacgtgtttgtcaatgaaagtgtttctaatgcaactgcgattgactcccagatagctagaagtttgcacatcccactcacccaggatatagctggtgacccaagctatgaaattagcaaacagagactcagtattgtcattggcgtggttgctggcattatgacggtgattctaatcatcttaattgtagtgatggcaaggtactgcaggtccaaaaataaaaatggctatgaagccggcaaaaaagatcacgaagacttttttacaccccaacagcatgacaaatctaaaaagcctaaaaaggacaagaaaaacaaaaaatctaagcagcctctctacagcagcattgtcactgtggaggcttctaagccaaatggacagaggtatgatagtgtcaatgagaagctgtcagacagcccaagcatggggcgatacaggtccgttaatggtgggcccggcagtcctgacctggcaaggcattacaaatctagttccccattgcctactgttcagcttcatccccagtcaccaactgcaggaaaaaaacaccaggccgtacaagatctaccaccagccaacacatttgtgggagcaggagacaacatttcaattggatcagatcactgctctgagtacagctgtcaaaccaataacaagtacagcaaacagccatttcgtagagtgacgttttctgttgtgagtcagcctcaggacccacatcaggggtcactgcagagttgctatgacagcgggctggaggagtcagaaacaccaagcagtaagagttcatcagggccaagactgggtgcgcttccactcccagaggacaactatgaaaggaccacgccggatggcagtgttgattcaaggcctcttccagatgtagccctgactgggaagtgcactcgtgagtgtgatgagtatggccactcagactcctgctggatgccggtccgcacttctccggagaggaagaagagccagcctaaactgtccactttcatgcctgttgatgaacgaggaagccaggaaaagctggccaatggggaggccgccatcatgggtgaccgcaacagaaacctcctgaacaaaaagttgacctcatcctatgagaccttcagtgcagctagtttcagcaaaaatgaggaagccaaccctgaggatattccccttacaaaaacaggggaatataagccatctcctgtcaatactctcactagaagagaagtttacctgtaggctataaaggagcaacagcaaagttctttacatgtatgaaaaggagaataaggggcaaaaaccttacaaagcaaaacgtttaatcacaaagagggggctaccaaagagacaaagctttgcctgccacttctgcctccagatcaggcctttagtgatactgttagcctgattctactgtacaatgtagaaaccatccttgttacttgcatgtctaaccccttcactgattcccaacactcactttctcttccccacccctctccaaaaaaaaaaaaaccaaaagaaaagaaaaaaaaagggggatagttgcaagtttctttcacagtaactgtacgaagcctgattagcagaacacaacacaccctcattatccctaagctgaagcatgattttagtcactttgattttgttcgagtgtcatctggctggtcaaaaataagcaggacagataaaatgtatttcagacataccatcagaaaatggtttatcaccatcaaaggcaatcctttgaaagtgatagagtccctctaaaggtacagtccttagaaagagggactgtattaaaaagtattttgggaatatcaaagctttaatatctccaacaaagactaagagaaaaacaatactcagtgggtgattgcagtcctaaattgtcatatgttgttattttcaggtcaagagcatcaacttcaattccatacattcaccaaatattctcagtatacacacagtcttgattacatgtatcaatttcaccagttatgacttctaagaattatatatattttttcagaa

SEQ ID NO: 43762 - DNA, 4664 bp, Homo sapiens
gaatgcaggtgagaaaaggcacggactctgcggctgcgaacccaaacttgggcaccgcacggtgcgcactgctcagccttcgcccccgtgggcgaaaggctgctgcggtttcaggcggctgcttcgtgactaatgaccttgcgcagagttgttaagaaaaaagagaaacccgcgctctccggggtgagaagggactgactctgggcgtctctgaagatggctcgggcttctctttggcgcgccggggggaccctgacactgaccgctctgtgacgcgagtagtctcccctgcaccgtgcccgaagcgacgtgccgggggatttttcattctcgatctgttgactggctcccccgctgcatgagcagagtcggagttgagactggcttgttgctggccccagcgcctggtgcaggaagcgactcacgtttgtctgggtggccggagccggagcagagcctgggtttggagtgagtgcctggaacgtgaattggactcaactcgagtagcagcaaagaccagcgggctggcaggcgggggaggctgcaggctcattccccacctcttcccagccccactgcccgtctgccggagcggttctggccccttccgacagagcggggactagagccggggattctccgcccgctgaggggatgactctgggttgggggagcgccgaacccgcggcgcgcagtgtcccgtgaactgtgagtactgcgactgaacggcggcaggcgagcgggcgattagcacccattgcatgaattatgaaacaataactttcggaagaagcaggaggaaaaaaagaagcatctatcgctgccctcccacccccattcccggccaactctccacgccgcttttgccccctccctcccctccctctcgctccttcctttccgggagaggggagaggactcgggggagggcaggcggccggccccggaggaggggggcgccgagggggctgtggttagaaggagcagtagcagcagcagcaggagaagatgctgaggatgcggaccgcgggatgggcgcgcggctggtgcttgggctgctgcctcctcctgccgctctcgctcagcctggcggccgccaagcagctcctccggtaccggctggccgaggagggccccgccgacgtccgcatcggcaacgtggcttcagacctgggcatcgtgaccggatcgggtgaggtgactttcagcctggagtccggttccgagtacctgaagatcgacaacctcactggcgagctgagcacgagcgagcggcgcatcgaccgcgagaagctgccccagtgtcagatgatcttcgacgagaacgagtgcttcctggacttcgaggtgtcggtgatcgggccctcgcagagctgggtggacctgtttgagggtcaggtcatcgtgcttgacatcaacgacaacacgcccaccttcccgtcgcccgtgctcacgctcacggtggaggagaatcggccggtgggcacactttacctgctgcccacagccaccgaccgcgacttcggccgcaacggcatcgagcgctacgagctgctccaggagcccggaggcggcggcagcggcggcgagagccggcgcgccggggcggccgacagcgccccctaccccgggggcggcgggaacggcgcgagcggcggcggctcgggaggctccaagcggcggctggacgcatcagagggcggcggcggcaccaaccccggcggccgcagcagcgtgttcgagctgcaggtggcggacaccccggacggcgagaagcagccgcagctgatcgtgaagggggcgctggaccgcgagcagcgcgactcctacgagctgaccctgcgagtgcgcgacggcggcgacccgcctcgctcctcgcaggccatcctacgggtcctcatcaccgacgtgaacgacaacagcccccgcttcgagaagagcgtgtacgaggccgacttggctgagaacagcgccccggggacccccatcctgcaactgcgcgcagccgacttggacgtgggggtcaacgggcagatcgaatacgtgttcggggcggccaccgagtcggtgaggcggctgctgcgccttgacgagacgtccggctggctcagcgtcctgcaccggatcgaccgcgaggaggtgaaccagctgcgcttcacggtcatggcccgcgaccgcgggcagccccccaagaccgacaaggccaccgtggtccttaacatcaaagacgagaacgacaacgtgccgtccattgaaatccgcaagattgggcgcatccccctcaaggacggggtggccaacgtggccgaggacgttctggtcgacacccccatcgctctggtgcaggtgtccgaccgagaccaaggcgagaacggggtggtcacctgcaccgtggtgggcgacgtgcccttccagctcaagccagccagcgacaccgagggcgaccagaacaagaaaaagtacttcttgcacacctcgacccctctggactatgaggccacccgggagttcaacgtggtcatcgtggcggtggactcaggcagccccagcctctcgagcaacaactccctgattgtcaaggtgggagacaccaacgacaacccgcccatgttcggccagtcggtggtggaggtttacttccctgagaacaacatcccgggcgagagggtggccacggtgctggcgacagacgcagacagcggtaagaacgccgagatcgcctactcgctggactcctctgtgatggggatctttgccatcgatcccgattctggggacatcctggtcaataccgtgctggaccgcgagcagactgacaggtatgagtttaaagttaacgccaaagacaaaggcatccccgtgctgcagggcagcactacggtgattgtgcaggtggctgataaaaatgacaatgaccctaagtttatgcaggacgtcttcaccttttatgtgaaagaaaacttgcagcccaacagccctgtggggatggtcaccgtgatggatgctgacaaggggcggaatgcagagatgagcctgtacatagaggagaacaataacattttttctattgaaaatgacacggggaccatttactccacaatgtcttttgaccgggaacatcagaccacatacactttcagagtcaaggctgtggatgggggagatcctcccagatctgccacagctacagtctcgctttttgtgatggatgaaaatgacaatgctcccacagttacccttcccaaaaacatttcctacactttactgccaccttcgagtaatgtcaggacagtagtagctacagtgttggcaacagacagtgatgatggcatcaatgcagacctgaactacagcattgtgggaggaaatcccttcaagctgtttgaaattgatcccactagtggtgtggtttccttagtgggaaaactcacccaaaagcattatggcttgcacaggttggtggtgcaagtgaatgacagtgggcagccttcccagtccaccacgactctggtgcacgtgtttgtcaatgaaagtgtttctaatgcaactgcgattgactcccagatagctagaagtttgcacatcccactcacccaggatatagctggtgacccaagctatgaaattagcaaacagagactcagtattgtcattggcgtggttgctggcattatgacggtgattctaatcatcttaattgtagtgatggcaaggtactgcaggtccaaaaataaaaatggctatgaagccggcaaaaaagatcacgaagacttttttacaccccaacagcatgacaaatctaaaaagcctaaaaaggacaagaaaaacaaaaaatctaagcagcctctctacagcagcattgtcactgtggaggcttctaagccaaatggacagaggtatgatagtgtcaatgagaagctgtcagacagcccaagcatggggcgatacaggtccgttaatggtgggcccggcagtcctgacctggcaaggcattacaaatctagttccccattgcctactgttcagcttcatccccagtcaccaactgcaggaaaaaaacaccaggccgtacaagatctaccaccagccaacacatttgtgggagcaggagacaacatttcaattggatcagatcactgctctgagtacagctgtcaaaccaataacaagtacagcaaacagatgcgtctacatccatacattactgtgtttggctgaattccactctaatatgatgctccattatgcaccatactgtgatgacctttctactccgaaacctgctggagcctgcccttggccgtggggtgtcagccaatcactgcttgttccacttgttgtacattttatttttgagtctttttctttctcatatacagaaaaatagtatgaaaataaaataaatgtatgaaacagtattaatgcagaaatgtgctactaatggatgtctgagtcaccagaaattccattcttaaagaggcggttagcacctattagacgtaacagtgatgtcttttaaaaaatccaaaagcatattgcaacaataagtttgagactttgtgtgaacaaagggaaattcagcctcttatgtctttgtctttaatacattaaatactgattttgaataaaaatctaaattgatcaatattgttaagtgccagtaa

SEQ ID NO: 43763 - DNA, 4915 bp, Homo sapiens
gcattagtcaagggaggaggaaatttaccagcccgagggagggaaaacaagtcccccagagaagacggcggtactcgctagggagggggactgggctttggcttaaagaggactggctgggattgggcacactttgagcggcccctggagctgaggctgggctttcccgagcgcggcggctggctgacgctccctcccgcccccattcccggccaactctccacgccgcttttgccccctccctcccctccctctcgctccttcctttccgggagaggggagaggactcgggggagggcaggcggccggccccggaggaggggggcgccgagggggctgtggttagaaggagcagtagcagcagcagcaggagaagatgctgaggatgcggaccgcgggatgggcgcgcggctggtgcttgggctgctgcctcctcctgccgctctcgctcagcctggcggccgccaagcagctcctccggtaccggctggccgaggagggccccgccgacgtccgcatcggcaacgtggcttcagacctgggcatcgtgaccggatcgggtgaggtgactttcagcctggagtccggttccgagtacctgaagatcgacaacctcactggcgagctgagcacgagcgagcggcgcatcgaccgcgagaagctgccccagtgtcagatgatcttcgacgagaacgagtgcttcctggacttcgaggtgtcggtgatcgggccctcgcagagctgggtggacctgtttgagggtcaggtcatcgtgcttgacatcaacgacaacacgcccaccttcccgtcgcccgtgctcacgctcacggtggaggagaatcggccggtgggcacactttacctgctgcccacagccaccgaccgcgacttcggccgcaacggcatcgagcgctacgagctgctccaggagcccggaggcggcggcagcggcggcgagagccggcgcgccggggcggccgacagcgccccctaccccgggggcggcgggaacggcgcgagcggcggcggctcgggaggctccaagcggcggctggacgcatcagagggcggcggcggcaccaaccccggcggccgcagcagcgtgttcgagctgcaggtggcggacaccccggacggcgagaagcagccgcagctgatcgtgaagggggcgctggaccgcgagcagcgcgactcctacgagctgaccctgcgagtgcgcgacggcggcgacccgcctcgctcctcgcaggccatcctacgggtcctcatcaccgacgtgaacgacaacagcccccgcttcgagaagagcgtgtacgaggccgacttggctgagaacagcgccccggggacccccatcctgcaactgcgcgcagccgacttggacgtgggggtcaacgggcagatcgaatacgtgttcggggcggccaccgagtcggtgaggcggctgctgcgccttgacgagacgtccggctggctcagcgtcctgcaccggatcgaccgcgaggaggtgaaccagctgcgcttcacggtcatggcccgcgaccgcgggcagccccccaagaccgacaaggccaccgtggtccttaacatcaaagacgagaacgacaacgtgccgtccattgaaatccgcaagattgggcgcatccccctcaaggacggggtggccaacgtggccgaggacgttctggtcgacacccccatcgctctggtgcaggtgtccgaccgagaccaaggcgagaacggggtggtcacctgcaccgtggtgggcgacgtgcccttccagctcaagccagccagcgacaccgagggcgaccagaacaagaaaaagtacttcttgcacacctcgacccctctggactatgaggccacccgggagttcaacgtggtcatcgtggcggtggactcaggcagccccagcctctcgagcaacaactccctgattgtcaaggtgggagacaccaacgacaacccgcccatgttcggccagtcggtggtggaggtttacttccctgagaacaacatcccgggcgagagggtggccacggtgctggcgacagacgcagacagcggtaagaacgccgagatcgcctactcgctggactcctctgtgatggggatctttgccatcgatcccgattctggggacatcctggtcaataccgtgctggaccgcgagcagactgacaggtatgagtttaaagttaacgccaaagacaaaggcatccccgtgctgcagggcagcactacggtgattgtgcaggtggctgataaaaatgacaatgaccctaagtttatgcaggacgtcttcaccttttatgtgaaagaaaacttgcagcccaacagccctgtggggatggtcaccgtgatggatgctgacaaggggcggaatgcagagatgagcctgtacatagaggagaacaataacattttttctattgaaaatgacacggggaccatttactccacaatgtcttttgaccgggaacatcagaccacatacactttcagagtcaaggctgtggatgggggagatcctcccagatctgccacagctacagtctcgctttttgtgatggatgaaaatgacaatgctcccacagttacccttcccaaaaacatttcctacactttactgccaccttcgagtaatgtcaggacagtagtagctacagtgttggcaacagacagtgatgatggcatcaatgcagacctgaactacagcattgtgggaggaaatcccttcaagctgtttgaaattgatcccactagtggtgtggtttccttagtgggaaaactcacccaaaagcattatggcttgcacaggttggtggtgcaagtgaatgacagtgggcagccttcccagtccaccacgactctggtgcacgtgtttgtcaatgaaagtgtttctaatgcaactgcgattgactcccagatagctagaagtttgcacatcccactcacccaggatatagctggtgacccaagctatgaaattagcaaacagagactcagtattgtcattggcgtggttgctggcattatgacggtgattctaatcatcttaattgtagtgatggcaaggtactgcaggtccaaaaataaaaatggctatgaagccggcaaaaaagatcacgaagacttttttacaccccaacagcatgacaaatctaaaaagcctaaaaaggacaagaaaaacaaaaaatctaagcagcctctctacagcagcattgtcactgtggaggcttctaagccaaatggacagaggtatgatagtgtcaatgagaagctgtcagacagcccaagcatggggcgatacaggtccgttaatggtgggcccggcagtcctgacctggcaaggcattacaaatctagttccccattgcctactgttcagcttcatccccagtcaccaactgcaggaaaaaaacaccaggccgtacaagatctaccaccagccaacacatttgtgggagcaggagacaacatttcaattggatcagatcactgctctgagtacagctgtcaaaccaataacaagtacagcaaacagccatttcgtagagtgacgttttctgttgtgagtcagcctcaggacccacatcaggggtcactgcagagttgctatgacagcgggctggaggagtcagaaacaccaagcagtaagagttcatcagggccaagactgggtgcgcttccactcccagaggacaactatgaaaggaccacgccggatggcagtgttgattcaaggcctcttccagatgtagccctgactgggaagtgcactcgtgagtgtgatgagtatggccactcagactcctgctggatgccggtccgcacttctccggagaggaagaagagccagcctaaactgtccactttcatgcctgttgatgaacgaggaagccaggaaaagctggccaatggggaggccgccatcatgggtgaccgcaacagaaacctcctgaacaaaaagttgacctcatcctatgagaccttcagtgcagctagtttcagcaaaaatgaggaagccaaccctgaggatattccccttacaaaaacaggggaatataagccatctcctgtcaatactctcactagaagagaagtttacctgtaggctataaaggagcaacagcaaagttctttacatgtatgaaaaggagaataaggggcaaaaaccttacaaagcaaaacgtttaatcacaaagagggggctaccaaagagacaaagctttgcctgccacttctgcctccagatcaggcctttagtgatactgttagcctgattctactgtacaatgtagaaaccatccttgttacttgcatgtctaaccccttcactgattcccaacactcactttctcttccccacccctctccaaaaaaaaaaaaaccaaaagaaaagaaaaaaaaagggggatagttgcaagtttctttcacagtaactgtacgaagcctgattagcagaacacaacacaccctcattatccctaagctgaagcatgattttagtcactttgattttgttcgagtgtcatctggctggtcaaaaataagcaggacagataaaatgtatttcagacataccatcagaaaatggtttatcaccatcaaaggcaatcctttgaaagtgatagagtccctctaaaggtacagtccttagaaagagggactgtattaaaaagtattttgggaatatcaaagctttaatatctccaacaaagactaagagaaaaacaatactcagtgggtgattgcagtcctaaattgtcatatgttgttattttcaggtcaagagcatcaacttcaattccatacattcaccaaatattctcagtatacacacagtcttgattacatgtatcaatttcaccagttatgacttctaagaattatatatattttttcagaa

SEQ ID NO: 43764 - DNA, 436 bp, Homo sapiens
atctttgttgtccagagtgttataactcccaacaactgttcatgcttagaggctaaagtcagcagacttagtattttaaaaaccacatgcaaaattatgagtcttgttggtaattagtagtgacagctgactgtattgtttcaagcaatgttttcattggttacagaaaactgaggcactgtgttgtatttccagctcccttagttcagaggtgagaggacgggcatgaactttattaatgtggggcctcaggcagccccagtctctctaggcttccagggcttcatttatgaaaaggaagaactggcttataaggtttattctagccttacaatgatgtttatgactaataagattctatctctccatctaaagactgatgaggaagtgagtaatggtctagcaaatccagaaaataagaaatatttggattaaa

SEQ ID NO: 43765 - DNA, 419 bp, Homo sapiens
ctggaagaacacaatccaatagtcctagcatttctctaataaatgcactcctagagtggcagggaatgatttagtaatagttatattctgtcacatgcattttactgttacccaaaaatggggaggtcttaaatggacatgagtctccactttccttcagtgtgagaagggctggttctaaaaaatttatctttaattctcagcaagagacaacctaggtgaagaaaaacgtaccttaatccaagagctttggtctgagacctcaaggaatttaaataatctctacaaaatgaggtattatcaagcacacacaactcatccaacaggttttaaaaaattgaaatgacaccctgagaggaagaaaaataaaacaggttacgtgtttgtttactcttcttctaatcatcttcccagataca

SEQ ID NO: 43766 - DNA, 782 bp, Homo sapiens
cttgagcctaggagttcaaggctgcagtgagctatgaacttgccactgcactccagcctgggtgacagagtgagaacctgtctcaaaaagaaaaaaaaaaaaaggaaaaaaattttaaaaaaatatttaaaagtaatcaccgaaaaaatagaactcgcttgaaagacaagaccaaaaacgaagaggacgtttccctagatggtgaaaacaagtggggcggaatcactgcagcgtcctgcacagaactctggaattgccactttgcagttgctgccttctagtgtgtattgttgaaagacagttttattgaggcataattggcatacaataagctgcatataaaaatgtgtacgtgatgacttttgacatacgtgtacacccgtgaagctatttccacaatcaagataatcaccatccccttcactctggaaagtttcccatgcccttggtaagcccaccctcctgcttcttgcctcccatccccaagtaacaactgtgctgctttctgtcactacaggttaatctgcactttctagaatgtatgtaaatagaatcacacagtatgtacttgtgttttgtctggcttcttgcttagctgagcataaggatttgcgagtcatccctgttgcatgcattaatattttattcctttttattgccaagtagtattccattgtttggatgcaccagtttggttagctgttcacctgttgatggacatttggaccatgttccgttgtgaactattacaaataaagctgctataaacattcaaaagtacc

SEQ ID NO: 43767 - DNA, 414 bp, Homo sapiens
gcttctggatgctggtcaccctgttcacttagtgatgagtccattgtgagtggtgggactttcacggtttgtgcacttttctgtatgtatgttacacttcaattaaaaactttaaaaatttttgacaagacaggccagatgcagtggctcatacctgtaatcccaatgctttgggaggcccaggtgggaggatcatttgagatcaggagttcgagaccagcctgggcaacatagcgagactcctgtctttactaaaaacaaaaaatcagccgggcatggtggtgcaaacctgtaatcctagctacttgggaggctgaggcaggagcatcgcttgagcccaggagggtgaggctacagtgagctatgattgcgccactgcactccagcctggatgacagagcgagaccctgtctc

SEQ ID NO: 43768 - DNA, 273 bp, Homo sapiens
tttgaaatggtgcagaggaatgcacagcttttcagaagtccttcaggatgtcgtgaaggtacaaaactgtgtcaagaccctggaggcagggccaacagaggctgctttaaaagcatgcaaatggattttgggtccttccccaccctgcctgtgagtggtgaactgaggaccccagaaaggcgagacagtgcggcctcctcatttgtctggctgtgtcttgttaaatgtgcatgagttttcctgaatttcaccaacattgagccagacctgcac

SEQ ID NO: 43769 - DNA, 349 bp, Homo sapiens
ggggaaaagtacagtcttttcaataaatggtcttgcaaagacctatatctaagaactaaaattataaaatctttggaagaaaacaggagaaaaacttcatgacattgagtttagcagtgatttcttggatttgacaccaaaagttcaggaaatgaaagaaaaaatagataaagtggattacatcaaaatttaaaacttgttttaaagcctggcgtgtggtggtgggatgcctgtaatcccagctactcggaaggctgagacaggcgaatcacgtgaccccaagaggctgaggttgcagtgagccgagatggtgccactgcactccagcctgggcgacagagcaaaactc

SEQ ID NO: 43770 - DNA, 475 bp, Homo sapiens
ggatggtgttaaattggcctggggacttctttattattttttttaatcgtagcattggtttgtaatattcatggtttagcctgaatgacttaaaggatttattttttaatttaacgtgggttaaaagaacatgagcaatagacctgccaataactattttaaaatataaacagataactgtttgttttgctcaaaggtcacattgaggattcagagctcatgactcaggatggctatttttcttagaggaatgatttagacaagttgaattgaatagctcctaggccactgacatttattcaattttgtctttaacatttgtttactttttgaacctgtaaaacaggggtgtccaatcttttggcttccctagaagaagaattagaagaagaattgtcttaggccacacagaaaatacactaacaacagcttatgagcttaaataaataaataaataaataaatgcaaaaaaaaa

SEQ ID NO: 43771 - DNA, 408 bp, Homo sapiens
ctctaacaatggttttgtggcaaagttataggcaaatggcatcttggacctttctgaatgaataaaaccaaatttttagaatagagtattaaatacaagaggtaaaattttctactaagtaagaaattattcaagtggccgggcgcggtggctcacgcctgtaatcccagcactttgggaggccgaggcgggtggatcttgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacag

SEQ ID NO: 43772 - DNA, 280 bp, Homo sapiens
agatggggtttcacgttgttagccaggatggtctcaatctcctgacctcgtgatctgcccgcctcagccttccaaagtgctgggattacaggtatgagccactgcgcccagccagtaaattctttttattactgtagtagatgatacttgattaaatgccatctcgggtgctttcattgtcaacaaaggtgctcccatctctaagcttacataaaatgtaattttaaaaagacatttctttagatgtacctgttcacatttttgttaatagtctctcatg

SEQ ID NO: 43773 - DNA, 501 bp, Homo sapiens
tcccctgcacctagctgagagtcaggagcttttcttcagagtgtggagaaaaaatactaaaattgaatacccaaattcccattatcgatatgagtaataattatccaagctgtgacccatacgccaagctcagaagtaagcccacgtacccgcactgcctccctggaatcatcagggcagccctgtaaggaaggcactgtcatttccattttataaaagtggaaacggggatcgagaggttagtaaatgctgaagtcacaggtaacaaatagagctgggatacagatgcaggtctcattgactcagaagtccatactcatactctttaatttctccatctctgccagcctgagggacactgtagactatgtaaactggaataaagctgaactcaggctgggtgcagtggtggttcatgcctgtaatcccaatgctttgggaggcccagagttcgagatcagcctgggcaaaacagtgagacccccatctctacaaaaaaca

SEQ ID NO: 43774 - DNA, 327 bp, Homo sapiens
ccaagttaaatggcaagagaaattggtgcttatgtcaacatggtttaagaaaaattagtgcctggtgtggggcgtggtgtctcacccttataatcccaacactttgggaggttgggccgggtagatcacttgaggccaggagacggcaaaaacctgtctctactaaaaatacaaaaattagttgggtgtgatcgcacactcttgtaatcccagcttcttgggaggctgaggtgggagaattgcttgaacctacaagagaggtggccgtgagctgaggtctggccactgcactctagcctgggtgacagggcaatgccctgtctcaaa

SEQ ID NO: 43775 - DNA, 689 bp, Homo sapiens
ggacagcaaggaagaaaggggtatacccagctgggagatcttggtgctgccttagaaacacctgatgtggcttcatgaggtgacttctgttttggaggtgaagtggaagacagcagcagtggaaaatgatgatgggtagagatatgtagggccaatgagttggagacattttagagtatgccataactgagaaactatggatatagagggaaactaaccaatttttaaaggaagatttccaattaaaatcagtgtgaacacccaacccattaccatgttgtctaaataaacttcactggtttctgttttagcaaacattattgagttttgaggatttgaactctagtttctacgactgccaaattatgcaaagactagactacataggctcctagtatttattgggattatacattggtgagcatatcatgtgaggatcacataaaggtgtcgttagtaagaatggaaacttctaagtaagcaagtgagatttgggagtaaatcctggcccatcgtctgtcataaatgttgtcttaaataagcttcattaagttgcaagatgtataaacctattcagactagcaaaaagtattctatttcaaggacccgtggataatttcacaggattgaggaatatggcaatcaaccagctctcataagggcataaccagctacttgttagaaaacca

SEQ ID NO: 43776 - DNA, 339 bp, Homo sapiens
gtggggggtgcacgacgatatattcaaacttatgtacaaggcatttgagctcgaggcatggaaaaatactgaggcactgtgtgtacgttgtttgtgcgtgagaatgtaactccttgacactgaaaacaggacaaggagtggaatgtgtgataaggagcgctgaaaacagcctcctaggaatgtggtctgagtgcttttacaaggccgtatgtgcctcatgaccccacggcaaaaacccatctggtggatgtttgtggtttaacaagccttctaataaatacttggcggatggattttggggcggcactctctcagaggagttgccgcctgccccactca

SEQ ID NO: 43777 - DNA, 5259 bp, Homo sapiens
actcagataccatggagacaaggccaaaggggttaggaaacttttctctagtcttttttggacagcctcagtaagggtagtgtgggatacagaatcaaagagcctcatcttttgagatggaaaactcaaggtccaagcaagactctgtcatttactgtttgatttgtaacagctagccaaaaaaatccgagagaagttcaaccgttacttggatgtggtcaatcggaacaagcaagttgtagaagcatcctatacggctcacctaacctctcccctaactgcaattcaagactgctgtactatcccaccttccatgatggaattcgatgggaactttaataccaatgtgtctagaacaattagttgtgatcgactttctactactgttaatagccgggccttcaatccaggacgagacttaaattcaggggtcgagaactgagctgcagtatctccaagttcttgcagacaacctgaaatccaaccctggaattaagtggcaatatttcagttcagaagaaggaattttcactgttttcccagcacacaagttccggtgtaagggcagctacgaacaccgcagtagacccatctacgtctctacagtccggccgcagtcaaagcacatagtagtgattctggaccacggggcttcagtcacagacactcagcttcagattgccaaggacgctgctcaggtcatcctcagcgccatcgatgaacatgacaagatttctgtgttaactgtggcagataccgtccggacttgctcactagaccagtgctataagaccttcttgtctccagccaccagtgagacaaaaaggaaaatgtccacctttgttagcagcgtgaagtcttcagacagtcctacccagcacgcagtgggattccaaaaggcatttcagctgattcgaagtacaaacaataacacaaagttccaagcaaatacagacatggtcatcatttacctgtcagctggcattacatcaaaggactcttcggaagaagataaaaaagcgactctccaagtcatcaatgaagaaaatagctttctaaacaactctgtaatgattctcacctatgccctcatgaacgatggggtgactggtttgaaagagctggcttttctgagggatctagctgaacagaattcagggaagtacggtgtgccagaccggacggccttgcctgtgattaagggcagcatgatggtgctgaatcagttgagcaacctggagaccacagtgggcaggttctacacaaaccttcccaaccggatgattgatgaagccgtcttcagcctgcccttctctgatgagatgggagatggtttgataatgactgtgagtaaaccctgttattttggaaacctacttctgggaattgtaggtgtggacgtgaatctggcttacattcttgaagacgtgacgtattaccaagactctttggcttcctatacttttctcatagacgacaaaggatatacacttatgcacccatctcttaccaggccatatttattgtcagagcccccacttcatactgacatcatacattatgaaaatattccaaaatttgaattagttcggcaaaatatcctaagcctccctctgggcagccagattatcgcagtccctgtgaactcatccctgtcttggcacataaacaagctgagagaaactggaaaggaagcctacaatgttagctatgcctggaagatggtacaagacacttcctttattctgtgtattgtggtgatacaaccagaaatacctgtgaaacaactgaagaacctcaacactgttcccagcagcaagctgctgtaccaccggctggatctccttggccagcccagtgcttgcctccacttcaaacagctggcaaccctagaaagtcccaccatcatgctgtctgctggcagcttttcctccccctatgagcacctcagccagccagagacaaagcgcatggtagagcactacaccgcctatctcagcgacaacacccgcctcattgctaacccgggcctcaaattctctgtcagaaatgaagtaatggctaccagccacgtcacagatgaatggatgacacaaatggaaatgagtagcctgaacacttacattgtccgccgttacatagcaacacccaatggcgtcctcagaatttatcctggttccctcatggacaaagcatttgatcccactaggagacaatggtatctccatgcagtagctaatccagggttgatttctttgactggtccttacttagatgttggaggagctggttatgttgtgacaatcagtcacacaattcattcatccagtacacagctgtcttctgggcacactgtggctgtgatgggcattgacttcacactcagatacttctacaaagttctgatggacctattacctgtctgtaaccaagatggtggcaacaaaataaggtgcttcataatggaggacaggggttatctggtggcgcacccgactctcatcgaccccaaaggacatgcacctgtggagcagcagcacatcacccacaaggagcccctggtagcaaatgatatcctcaaccaccccaactttgtaaagaaaaacctgtgcaacagcttcagtgacagaacggtccagaggttttataaattcaacaccagccttgcgggggatttgacgaaccttgtgcatggcagccactgttccaaatacagattagcaaggatcccaggaaccaacgcgtttgttggcattgtcaacgaaacctgcgactctcttgccttctgtgcctgcagcatggtggaccgactctgtctcaactgtcaccgaatggaacaaaatgaatgtgaatgtccttgtgagtgccctctagaggtcaatgagtgcactggcaacctcaccaatgcagagaaccgaaaccccagctgcgaggtccaccaggagccggtgacatacacagctattgaccctggcctgcaagatgctcttcaccagtgtgtcaacagcaggtgcagtcagaggctggaaagtggggactgttttggggtgctggattgtgaatggtgcatggtggacagtgatggaaagactcacctggacaaaccctactgtgccccccagaaagaatgcttcggggggattgtgggagccaaaagtccctacgttgatgacatgggagcaataggtgatgaggtgatcacattaaacatgattaaaagcgcccctgtgggtcctgtggctggagggatcatgggatgcatcatggtcttggtcctggcggtgtatgcctaccgccaccagattcatcgccggagccatcagcatatgtctcctcttgctgcccaagaaatgtcagtgcgtatgtccaacctggagaatgacagagatgaaagggacgacgacagccacgaagacagaggcatcatcagcaacactcggtttatagctgcggtcatcgaacgacatgcacacagtccagaaagaaggcgccgctactggggtcgatcaggaacagaaagtgatcatggttacagcaccatgagcccacaggaggacagtgaaaatcctccatgcaacaatgaccccttgtcagccggggtcgatgtgggaaaccatgatgaggacttagacctggataccccccctcagactgctgccctactaagtcacaagttccaccactaccggtcacaccaccctacacttcatcatagccaccacttacaggcggccgtcacggtacacactgtcgatgcagaatgctaacaatctcctcacctccacgccaagatgagatctgggagctacagaatgttctggaaagaaaaagaaccggcttaaaacccacagcaagagacctcccttgtgtttgtgctttgtgcagagttgtttgagtcatttcctgcctgtcgacatggttaaaaacgagagaaacaacaacacagtcacatttgtgaagatgtgaggctggttctgaaatggaggggaaataagcctgatgaacagacctgccataacactaatggaaggtaacagaaggcgaacctccaaacacagagacggaacctgcaagtgaagctgagccagaggaatgttccaaagagccagaagcattcagctctccttaactggaagagagaaaaatctgctcacccagagactggaatgtggcacatgcagatacaaatgtgtgcattgaagatttcgctttgtttcttagcggtacctggataccacagttgctgtatggaactcatgttatgctctaaacgatgcatctcagaatttctaagtaaaggattatttttctactatttattgaactttcaaacattctcaaactttggggaaaaggaaaggaaacacaggagaagttttcagcagttgccccgagctgttttgtgtgtaatgaagtggttctttgattaaggagctctatttcttatttaactgatatcccactgccccactccacaaaataggaaaatgaagaaatctttctctctgacttgtttacatcatttcacggaaacacatctttgtttgtaatgcagtattctttctctgtgtttgacagagatggggaggggcagaggaatttaagaggttttaaaagaaatgttatgtttcttatgacttgtttccactcctcgtacaatgctattcttaggtttctacgaaacctaatgttagaaccgcatcctttcagctaagggagggttggatttattttccttgttttagagactacaaatttttaaatatcccattttgactgagaatattgacatataagggaagaagttttctaaattgtgaaagtctggttcttaattaaagaattttttttttaatatcacggttaaaagctgctgccagttagccaagacattatccaccaaattgctttgtgatttatacagggattaatcaaatctggctactataacatggggcattgtaactttaaagtagtgttttaattacagtgatgtattttagactcacattttgtgattcaaatatgttataaaggcattcttgcaccatggtaaagaatgtgtgtggtaaatctccgtttatatgtagttggaaaaaattcactgaataatgttttaatgatagggtattatgatacaatgtaaaaaacaattggttcttcagcagtacagaaagtaaactatatatgtgctatcaggaaaccccttcatactgtgtataaaattgcaatctagtgaaataaaccgtatgcaatgga

SEQ ID NO: 43778 - DNA, 323 bp, Homo sapiens
caacacccgcctcattgctaacccgggcctcaaagtaagcattggcgcagagctccatttctggtgtccccctccacaggcccagcagggggtgctggcagtgaacctttgaagtaggaaacccagctctgcatctgtgcctctcagctggagagctgcagagtgtgtggcccaggggaggctggtcagcagtgactcttctgatggatgaagaagccccgtgggccacatggagaatctgttacaggccttagaagcactgggggtttccagtgatgttagagggatgtgatttagagactagtgaaactttcccagccctg

SEQ ID NO: 43779 - DNA, 5270 bp, Homo sapiens
gcggccgcccctctggctgctctgcctggtcgcgtgctggctcctgggcgccggggccgaagccgacttctccatcctggacgaggcgcaagtgctggcgagccagatgcggaggctggcggccgaggagctgggggtcgtcaccatgcagcggatattcaactcctttgtttacactgagaaaatctcaaatggagaaagtgaagtacagcagctagccaaaaaaatccgagagaagttcaaccgttacttggatgtggtcaatcggaacaagcaagttgtagaagcatcctatacggctcacctaacctctcccctaactgcaattcaagactgctgtactatcccaccttccatgatggaattcgatgggaactttaataccaatgtgtctagaacaattagttgtgatcgactttctactactgttaatagccgggccttcaatccaggacgagacttaaattcagttcttgcagacaacctgaaatccaaccctggaattaagtggcaatatttcagttcagaagaaggaattttcactgttttcccagcacacaagttccggtgtaagggcagctacgaacaccgcagtagacccatctacgtctctacagtccggccgcagtcaaagcacatagtagtgattctggaccacggggcttcagtcacagacactcagcttcagattgccaaggacgctgctcaggtcatcctcagcgccatcgatgaacatgacaagatttctgtgttaactgtggcagataccgtccggacttgctcactagaccagtgctataagaccttcttgtctccagccaccagtgagacaaaaaggaaaatgtccacctttgttagcagcgtgaagtcttcagacagtcctacccagcacgcagtgggattccaaaaggcatttcagctgattcgaagtacaaacaataacacaaagttccaagcaaatacagacatggtcatcatttacctgtcagctggcattacatcaaaggactcttcggaagaagataaaaaagcgactctccaagtcatcaatgaagaaaatagctttctaaacaactctgtaatgattctcacctatgccctcatgaacgatggggtgactggtttgaaagagctggcttttctgagggatctagctgaacagaattcagggaagtacggtgtgccagaccggacggccttgcctgtgattaagggcagcatgatggtgctgaatcagttgagcaacctggagaccacagtgggcaggttctacacaaaccttcccaaccggatgattgatgaagccgtcttcagcctgcccttctctgatgagatgggagatggtttgataatgactgtgagtaaaccctgttattttggaaacctacttctgggaattgtaggtgtggacgtgaatctggcttacattcttgaagacgtgacgtattaccaagactctttggcttcctatacttttctcatagacgacaaaggatatacacttatgcacccatctcttaccaggccatatttattgtcagagcccccacttcatactgacatcatacattatgaaaatattccaaaatttgaattagttcggcaaaatatcctaagcctccctctgggcagccagattatcgcagtccctgtgaactcatccctgtcttggcacataaacaagctgagagaaactggaaaggaagcctacaatgttagctatgcctggaagatggtacaagacacttcctttattctgtgtattgtggtgatacaaccagaaatacctgtgaaacaactgaagaacctcaacactgttcccagcagcaagctgctgtaccaccggctggatctccttggccagcccagtgcttgcctccacttcaaacagctggcaaccctagaaagtcccaccatcatgctgtctgctggcagcttttcctccccctatgagcacctcagccagccagagacaaagcgcatggtagagcactacaccgcctatctcagcgacaacacccgcctcattgctaacccgggcctcaaattctctgtcagaaatgaagtaatggctaccagccacgtcacagatgaatggatgacacaaatggaaatgagtagcctgaacacttacattgtccgccgttacatagcaacacccaatggcgtcctcagaatttatcctggttccctcatggacaaagcatttgatcccactaggagacaatggtatctccatgcagtagctaatccagggttgatttctttgactggtccttacttagatgttggaggagctggttatgttgtgacaatcagtcacacaattcattcatccagtacacagctgtcttctgggcacactgtggctgtgatgggcattgacttcacactcagatacttctacaaagttctgatggacctattacctgtctgtaaccaagatggtggcaacaaaataaggtgcttcataatggaggacaggggttatctggtggcgcacccgactctcatcgaccccaaaggacatgcacctgtggagcagcagcacatcacccacaaggagcccctggtagcaaatgatatcctcaaccaccccaactttgtaaagaaaaacctgtgcaacagcttcagtgacagaacggtccagaggttttataaattcaacaccagccttgcgggggatttgacgaaccttgtgcatggcagccactgttccaaatacagattagcaaggatcccaggaaccaacgcgtttgttggcattgtcaacgaaacctgcgactctcttgccttctgtgcctgcagcatggtggaccgactctgtctcaactgtcaccgaatggaacaaaatgaatgtgaatgtccttgtgagtgccctctagaggtcaatgagtgcactggcaacctcaccaatgcagagaaccgaaaccccagctgcgaggtccaccaggagccggtgacatacacagctattgaccctggcctgcaagatgctcttcaccagtgtgtcaacagcaggtgcagtcagaggctggaaagtggggactgttttggggtgctggattgtgaatggtgcatggtggacagtgatggaaagactcacctggacaaaccctactgtgccccccagaaagaatgcttcggggggattgtgggagccaaaagtccctacgttgatgacatgggagcaataggtgatgaggtgatcacattaaacatgattaaaagcgcccctgtgggtcctgtggctggagggatcatgggatgcatcatggtcttggtcctggcggtgtatgcctaccgccaccagattcatcgccggagccatcagcatatgtctcctcttgctgcccaagaaatgtcagtgcgtatgtccaacctggagaatgacagagatgaaagggacgacgacagccacgaagacagaggcatcatcagcaacactcggtttatagctgcggtcatcgaacgacatgcacacagtccagaaagaaggcgccgctactggggtcgatcaggaacagaaagtgatcatggttacagcaccatgagcccacaggaggacagtgaaaatcctccatgcaacaatgaccccttgtcagccggggtcgatgtgggaaaccatgatgaggacttagacctggataccccccctcagactgctgccctactaagtcacaagttccaccactaccggtcacaccaccctacacttcatcatagccaccacttacaggcggccgtcacggtacacactgtcgatgcagaatgctaacaatctcctcacctccacgccaagatgagatctgggagctacagaatgttctggaaagaaaaagaaccggcttaaaacccacagcaagagacctcccttgtgtttgtgctttgtgcagagttgtttgagtcatttcctgcctgtcgacatggttaaaaacgagagaaacaacaacacagtcacatttgtgaagatgtgaggctggttctgaaatggaggggaaataagcctgatgaacagacctgccataacactaatggaaggtaacagaaggcgaacctccaaacacagagacggaacctgcaagtgaagctgagccagaggaatgttccaaagagccagaagcattcagctctccttaactggaagagagaaaaatctgctcacccagagactggaatgtggcacatgcagatacaaatgtgtgcattgaagatttcgctttgtttcttagcggtacctggataccacagttgctgtatggaactcatgttatgctctaaacgatgcatctcagaatttctaagtaaaggattatttttctactatttattgaactttcaaacattctcaaactttggggaaaaggaaaggaaacacaggagaagttttcagcagttgccccgagctgttttgtgtgtaatgaagtggttctttgattaaggagctctatttcttatttaactgatatcccactgccccactccacaaaataggaaaatgaagaaatctttctctctgacttgtttacatcatttcacggaaacacatctttgtttgtaatgcagtattctttctctgtgtttgacagagatggggaggggcagaggaatttaagaggttttaaaagaaatgttatgtttcttatgacttgtttccactcctcgtacaatgctattcttaggtttctacgaaacctaatgttagaaccgcatcctttcagctaagggagggttggatttattttccttgttttagagactacaaatttttaaatatcccattttgactgagaatattgacatataagggaagaagttttctaaattgtgaaagtctggttcttaattaaagaattttttttttaatatcacggttaaaagctgctgccagttagccaagacattatccaccaaattgctttgtgatttatacagggattaatcaaatctggctactataacatggggcattgtaactttaaagtagtgttttaattacagtgatgtattttagactcacattttgtgattcaaatatgttataaaggcattcttgcaccatggtaaagaatgtgtgtggtaaatctccgtttatatgtagttggaaaaaattcactgaataatgttttaatgatagggtattatgatacaatgtaaaaaacaattggttcttcagcagtacagaaagtaaactatatatgtgctatcaggaaaccccttcatactgtgtataaaattgcaatctagtgaaataaaccgtatgcaatgga

SEQ ID NO: 43780 - DNA, 1947 bp, Homo sapiens
gcggccgcccctctggctgctctgcctggtcgcgtgctggctcctgggcgccggggccgaagccgacttctccatcctggacgaggcgcaagtgctggcgagccagatgcggaggctggcggccgaggagctgggggtcgtcaccatgcagcggatattcaactcctttgtttacactgagaaaatctcaaatggagaaagtgaagtacagcagctagccaaaaaaatccgagagaagttcaaccgttacttggatgtggtcaatcggaacaagcaagttgtagaagcatcctatacggctcacctaacctctcccctaactgcaattcaagactgctgtactatcccaccttccatgatggaattcgatgggaactttaataccaatgtgtctagaacaattagttgtgatcgactttctactactgttaatagccgggccttcaatccaggacgagacttaaattcagttcttgcagacaacctgaaatccaaccctggaattaagtggcaatatttcagttcagaagaaggaattttcactgttttcccagcacacaagttccggtgtaagggcagctacgaacaccgcagtagacccatctacgtctctacagtccggccgcagtcaaagcacatagtagtgattctggaccacggggcttcagtcacagacactcagcttcagattgccaaggacgctgctcaggtcatcctcagcgccatcgatgaacatgacaagatttctgtgttaactgtggcagataccgtccggacttgctcactagaccagtgctataagaccttcttgtctccagccaccagtgagacaaaaaggaaaatgtccacctttgttagcagcgtgaagtcttcagacagtcctacccagcacgcagtgggattccaaaaggcatttcagctgattcgaagtacaaacaataacacaaagttccaagcaaatacagacatggtcatcatttacctgtcagctggcattacatcaaaggactcttcggaagaagataaaaaagcgactctccaagtcatcaatgaagaaaatagctttctaaacaactctgtaatgattctcacctatgccctcatgaacgatggggtgactggtttgaaagagctggcttttctgagggatctagctgaacagaattcagggaagtacggtgtgccagaccggacggccttgcctgtgattaagggcagcatgatggtgctgaatcagttgagcaacctggagaccacagtgggcaggttctacacaaaccttcccaaccggatgattgatgaagccgtcttcagcctgcccttctctgatgagatgggagatggtttgataatgactgtgagtaaaccctgttattttggaaacctacttctgggaattgtaggtgtggacgtgaatctggcttacattcttgaagacgtgacgtattaccaagactctttggcttcctatacttttctcatagacgacaaaggatatacacttatgcacccatctcttaccaggccatatttattgtcagagcccccacttcatactgacatcatacattatgaaaatattccaaaatttgaattagttcggcaaaatatcctaagaatcaaatctggctactataacatggggcattgtaactttaaagtagtgttttaattacagtgatgtattttagactcacattttgtgattcaaatatgttataaaggcattcttgcaccatggtaaagaatgtgtgtggtaaatctccgtttatatgtagttggaaaaaattcactgaataatgttttaatgatagggtattatgatacaatgtaaaaaacaattggttcttcagcagtacagaaagtaaactatatatgtgctatcaggaaaccccttcatactgtgtataaaattgcaatctagtgaaataaaccgtatgcaatgga

SEQ ID NO: 43781 - DNA, 934 bp, Homo sapiens
tggatactaatattacaataactctcttgtgccctattttggtgttttaaacttctttgctgtacatttaagaaaatcagaatttcagtagactcctcgtgcagtctgaggaggcagtttcctatctggtttgacttaaggggctgcagaagacattcttatcccacatatttcttctgctgatcagtcagcaactgaaattccaactaatggattccattcttccagttaagacatcatctccagaaaactgtgctagttggcatccagcagtgcccaagtattatttaacccactagaacctgtgactgcatcagctttatatcctggacctcagcctggaacaaaggagagctacacttggatactaaacacaagtggtctggatagattatgctgggaaaagaagcctggagcaggcagtacagtgggagaacaagacagaagtgcttgccttggtgatccaaaaaaggcaggatccggccgggggcaaggtgattattctgtctgatgaggagaataagagccagtttgtggtattgacagaagaatgaaagtaaagttcaaccaatctacaaaggccaaaaatattttcacaggcccccaaaagatgaactccaatctgctgcccctaaacgcattctccactgtctggaagatgtgcaaaggcaacggcacagcgttctccatctcaaatccttcaaagtgctgtcagaataaaagaatccccaccaaaagccccagggaaatctatctgtctgtatggtatggtaatgactgaggttattccagataggattctgggagaaactcagctattgaaatctaatgaatggaactgagaatttcttgttataatactgtttgtttgattgaatatatccttgcatataggaagacataaaaataaataataaaagcaagatattatttg

SEQ ID NO: 43782 - DNA, 523 bp, Homo sapiens
tcagtcttgaagatgggaagatcaggagcagtctggagtcatggtatatgaatgaactagtgagagtgggcacaaagtctgaagatctttgtagtgcagctaatgtctaagggagaatatacctaccctagaagagacattaaacaaccagttcaaccaatctacaaaggccaaaaatattttcacaggcccccaaaagatgaactccaatctgctgcccctaaacgcattctccactgtctggaagatgtgcaaaggcaacggcacagcgttctccatctcaaatccttcaaagtgctgtcagaataaaagaatccccaccaaaagccccagggaaatctatctgtctgtatggtatggtaatgactgaggttattccagataggattctgggagaaactcagctattgaaatctaatgaatggaactgagaatttcttgttataatactgtttgtttgattgaatatatccttgcatataggaagacataaaaataaataataaaagcaagatattatttg

SEQ ID NO: 43783 - DNA, 746 bp, Homo sapiens
tcagtcttgaagatgggaagatcaggagcagtctggagtcatggtatatgaatgaactagtgagagtgggcacaaagtctgaagatctttgtagtgcagctaatgtctaagggagaatatacctaccctagaagagacattaaacaaccaggaagcttactgcaggaaagaaatccctcagagtcctgaagatacagctttcagaacttaggtgaagcaagaggactcaaggtgtgcaagaatggacagtacagaatgctctgctacactgctcagattcccccttcaggaaggaaggacaaattcactcaacttctgggagcattgatggttgagctctcagccatcagacctttttggaagttgccctcttctgaaaagaggcacattgcccaagatctttcctcctccagagcgcaggctgcacctgaagtctgattgatgtggggtatgatggtctggtctcctttccccatctaaaggactgttctaacctcagggctctccttgagtttccttagttagttcttattactatgttgcagtccaacttcttctttggcctaattctactttcctcccattccccaattgttgatcctgacagcaatttccccccaaatttctgtaaactaagcatgatctcagagtcacctgacctgcaacattattacatacactatagtccgtgcacttaaagatttagtgaaagtatgctgctgaagcttgccagaacttcccttctt

SEQ ID NO: 43784 - DNA, 8642 bp, Homo sapiens
  misc_feature (799)..(799): n is a, c, g, or t
tgggtatcaggactcagcccatttccccctctggtgctgagaaatggaggccgaaggagtgatctagaagtgttaattgagcccctaatctatgctagttactgggggtgttgggggagacaggagagagatcccacggggttccggcctcccagggactcaggtcactaatggaggtggcttggcttgtctatgtgctgggccaacagccactggcgaggcaaggcgagggtcagtcacggctggtgccaggaagagggctggttctttggctccctggtctcccgcggtctagcccaagctggccagcggttgacctggctcccctggccccggccaggcctcgtggacccctcatatgccacacgggacatgagcaggccggccgggagccgggtcccgggagctccacgaaggggcctgtcctccatgaccaggacacccgctgcgccttcctcccgaggcctcccgggcctctccagacgcggcgctactgcagacaccagggccgccaagggagcggactcggagccggccctggggcgggcacatgggccccggcgccccccggcgtctccaagccgcgctgcccgggtcgggccaggccaggggagggacagcagcaggtgacgacggcccggccaccggctataaataggggcgcgcgtcagccgcgggcgggagcggcggcggcgggcaggggcccgggggccggggcctggaggacaggcgaggcagcggcgagtgcggggccggcggtcggggagggcggtgccatggggtcgcggagggcccccanccggggctggggcgcgggtgggcggtcgggggcggggggcgacggtgaggacgacggccccgtgtggatccccagcccagccagccggagctacctgctcagcgtgcggcccgagaccagcttatcaagcaaccggttgtctcaccccagctctggaaggagcaccttctgctccatcattgctcagctcacagaggagacccagccgctatttgagaccacgctcaagtcccggtctgtgtccgaggacagcgacgtcaggttcacctgcatcgtcacaggatacccagagccagaggtgacctggtacaaggatgatacggagctggaccgctactgtggcttgccaaaatatgagatcactcatcagggcaaccgccacacactgcagctgtacaggtgtcgagaagaagatgccgccatctaccaggcctctgcccagaacagcaagggcattgtgtcctgctcaggggtcctggaggtgggcaccatgactgagtacaagatccaccagcgctggttcgccaagttgaagcgcaaggctgcggcaaagctgcgcgagatcgagcagagctggaagcacgagaaggcggtgcctggggaggtcgacactctgcgcaagctcagccccgaccgcttccagcgaaagcggcgattgagcggggctcaagcgccgggcccctcggtccctaccagggagcctgagggtgggaccctggcggcttggcaggagggagagactgagactgctcagcactcaggtttgggcctgatcaacagttttgcttctggagaagtgaccaccaacggggaggctgcccccgagaatggagaggacggagagcatggcttgctgacatacatctgtgacgccatggagctggggcctcagagagccctcaaagaggagagtggggccaagaagaaaaagaaagatgaggaatccaagcaaggcctgcggaagccagagttagagaaggcagcccaaagccgccgttcttcagaaaactgcatccccagctcagacgagcctgactcctgtgggactcaggggcccgtgggcgtggagcaggttcagacccagcccagaggcagggctgcacgggggcctgggtcctctggcacagatagtaccaggaagccagcctctgctgtgggcactccagacaaggcccagaaggcccctggcccaggcccaggccaggaagtgtatttctccttgaaggacatgtacctggagaacacccaggcagtcaggcctcttggggaagagggaccccagaccctgagtgtccgggcgcctggggagagtcccaaggggaaggcacccctcagggctagaagcgagggggtgcctggcgctcctggccagcccacacactccttgaccccccagccgactaggcctttcaacagaaagagatttgcccctccaaagcccaaaggagaggccaccactgacagcaagcccatttcttctctgagtcaagctccagaatgcggggcccagagcttaggaaaggccccacctcaggcctctgtgcaggtgccgacgccccctgcccggcggagacatggcacccgggacagcacgttgcaggggcaagcaggccacaggactccaggagaggtcctggaatgccagacaaccacggctcctaccatgtcggccagcagcagctctgatgtagcctccattggggttagcacttccggaagtcaaggtatcattgaacccatggatatggaaacccaggaggatgggagaacatctgctaaccagagaactggaagcaagaagaatgtgcaggcagatgggaagatacaagtggatggaaggaccaggggagatggaacacagacagcccagaggacacgtgcagataggaagacgcaggtggatgctgggacacaagaaagcaagaggccacagtcagacaggagtgcacagaagggcatgatgacacagggaagggcagagacacagctagaaacaacacaggcaggtgagaagatacaggaagacaggaaggcccaggcagataagggcacacaggaagacagaaggatgcagggagagaaggggatgcagggagagaaggggacgcagtcagaggggagcgcgcccacagccatggaaggtcagtctgagcaagaggtggcaaccagcctcggcccaccatccagaacccccaaactcccacctacagcgggtcctagagctcctctgaatattgaatgttttgtacagaccccagaagggtcttgtttcccaaaaaaacctggttgcctgcccagatctgaggaggcagtagtaacagcctccaggaaccatgagcaaactgtgctgggtcccctgtcagggaacctcatgctcccagcacagccgccccatgaggggagtgtggagcaggtgggaggagagagatgccgagggccacagtcatcaggcccagtcgaggccaagcaggaggacagcccgttccagtgccccaaggaggagcggccagggggagtgccgtgtatggatcagggtggctgtcctctagctggcctgagccaggaggtacccacgatgccttctcttcctggaactgggctgacagctagcccaaaggcggggccgtgtagcaccccgacttctcagcacgggagcacagccaccttcctgccctctgaggatcaggtcctgatgagttctgccccaacactgcacctggggctggggacccccactcagagtcacccaccagaaaccatggccaccagcagtgagggggcctgcgcccaggtaccagatgtggaggggcggaccccaggtccccggagctgtgaccctggcctcatagattccctgaagaactacctgcttctgctgctgaagctgtccagcacagagacaagtggagcagggggagagtcccaggtgggggcagccaccggaggtctggtgccctcagccactctgacacccactgtggaagtggctgggcttagtccccggacatcgaggcgcatcctggagcgtgtggagaacaaccacctggtgcagagtgcacagaccctgctgctgagcccctgtacctcccgccgcctcaccggcctcctggaccgtgaggtgcaggctggccgccaggcccttgctgctgcccgaggctcctggggtcctggtcccagctccctcactgtccctgccattgtggtagacgaggaggaccctgggctggcctcagaaggagccagtgagggtgaaggagaggtttcccttgaggggcctggcctcctgggggcctctcaggagagcagcatggctggtcgactgggggaggcgggtgggcaggcagcccctggacaggggccctcagcagagagcatagcccaggagccctcccaagaggagaagttcccaggggaggctctgacaggcctcccggcagctacacctgaggaactggctctaggggcccggaggaagagatttctccctaaggtcagagcagcaggagacggggaggcaaccacacctgaagaaagggagagccccacggtttccccccgggggcccaggaaaagcctggtgcctgggtccccagggactccagggcgggagagacgctcccctacgcagggcagaaaggcgagcatgctggaggtgcctcgggcagaggaggagctggcggcaggagacctgggccccagccccaaggccggcggtctggacacagaggtggccctggatgaaggcaagcaggagacactggccaagcccaggaaagccaaagacctgctgaaagccccacaggtgatccggaagattcgggtggagcagtttcctgatgcctccggtagcctgaagctgtggtgccagtttttcaacattcttagtgactcagtcttgacatgggccaaggatcagcgcccagtgggcgaggtgggcaggagcgcaggggatgaggggccggcggccttggccatcgtgcaggcctcccccgtagactgcggtgtgtatcggtgcaccatccacaatgagcacggctcggcctccaccgacttctgcctcagccctgaggtgttgtcaggattcatctccagagaagaaggtgaagttggagaagagattgagatgacccctatggtgtttgctaagggtctggctgactctggctgctggggggacaagctctttgggcgactggtaagcgaggagctccgagggggtggatatgggtgtggccttcggaaggcctcccaggccaaggtcatctacgggctggaacccatcttcgagtcgggccgcacgtgcatcatcaaggtgtccagcctgcttgtgtttgggcccagcagtgagacttctcttgtgggcagaaactacgacgtcaccatccaggggtgcaagatccagaacatgagtcgggagtactgcaaaatcttcgcagcagaagcccgggccgcgcctggctttggggaggtgcctgagatcatcccactgtatctgatctaccggcctgcaaacaatatcccatatgctaccctggaggaagacctgggcaagcccctggagtcttactgttctcgggaatggggctgtgctgaggctccgacagcatctggcagctctgaggccatgcagaaatgccagaccttccaacactggctgtatcagtggacaaatggcagcttccttgtcacagacttggcaggggttgactggaagatgactgatgtgcagattgctaccaaactccgaggataccagggcctcaaggaaagctgcttccctgccctgctggaccggttcgcctcctcccaccagtgcaatgcctactgtgagctgctggggctgacacctctcaagggcccggaggcggcccacccccaagccaaagccaaaggctctaagagtccatctgctggcaggaaaggctcccagctgagtcctcagccccagaagaaaggcctccctagtcctcagggcacccggaagagtgctccaagttccaaggccacccctcaggcctcagagccagtcaccactcagttgttgggacagcctcccacccaagaggagggctccaaggcccagggcatgcggtagcctccgcagaggctgggggcctccacccagcagcagaccaaccaggaagcagcttgaactggatggagactttccaaatatggaactaactggagaaggtgcacgaaggagacaccacttggggacctctctgagcaggctctcgtgaatcagctcgtcatcagatggctttggtgcatggcacatagcccactggcctcttctggtgccactgtcacccagggctcccgggcctcaagcagtccccacctccgagtgcctggcaacctaggccctccttgaagtttacactttgccactgctggaggctcccctgagtcctctgcatgagttctgcaccccaagcccttgccccagcccagtccagcagcagatgttacaatctgagtgaggacatgcaggccaacttttaccctcctgcatttgcctggccctgatctcgcctgtcctcagggatccagacttcctctgctggtctggcctggtgactctcagggtatcttctccttccagctactttcgctcactgatctcagcttatcctgcaactaaccatccttgagcccagatggggctcagggcccttccagagcctgtcatgtccttgtgcagtggcctttgatgtgtgttcacgctcttcccccttcactcactcgcctgcttcccatgctcccttgtaccccctcgccacatccctgtcttggggcccagctgcagcctgctgcctgcccttcatggctctgcacatggccctttgcttgagggctccccactccctgcccaccaatacccaggtgaggaacagaccctctggcctctcaccccacttcagtgctctcttccccaacttctctcgggctctttgctcatgaggtgagagctggtgtgagggttgtgtcagcagctgtagccagagagaggtgttgactctgagagaccttgcactccatactgaaaggaggtggggtcacagtgaatttcacatcccctctcaaccaggagtggagggctaggtcccttccccatggggagtacacttgggtgttctaggagggatgcagtctatccatgcacttgggtggaggggagtctctgtgcctgggaattaggacccctgctccaaccatcgctcttgatcctggggccccagctctgggtcctcatgtatgggctcccaaggacccagcagcctggatccttccagagcatccctcctggaggcctgggatggggtaggtctgcagctagcctactccctttggaatgcaataaaggcagcattgtgtgccctgcttgccctcatctggtgtggttggaggtctgtggagtcaaggtccccctctcccaggcaggctctctgagggcattctgtagtcccaggcccactggaaaaatgaatctatattttggttcctggaccgaagttcagtcgcagccttctgtggccacagaaagacagcttgtgctgcttgcacaactgagctgctggtgtgtaccccttagcagggtgtctggggacttacgcctttggaattgctcttcattcagaagaggaacacaaaggaagccacccaggaaggaagcacagagctgggggctctggaaacgccctgtgtctctggctacagcaagaccagcccaggagcccaccagcacctgcctctcagctacttgctgaccatttcctgcttctcaagctgcagagaagcttttcattcccacccccacccggaacctccccttgcctaacatttcccctctatggtaacatctctgacttctctacctcctctgtgctcaggtgactccacatcttctgccccagtgtgtccccacctctcccagcctgtatacccagattactttggtgaactgagagctggagtactgttcattcatttattcattcacccactcattcagcagaccttggcattttcacatgatttatctcccactctgattcacatatgtttgaccaaggcactgggcagctgccaatttcccgtcccttctgtagtcccagatgaatggatacagacctctttggggaaggctgcaaggaaggttcacaacatgcatctaagtgttaaaataagtttttccttcaaaaatacatttgacttcctctccatttaaggtctggaaatcaagtgggagatcttgactttaccttggcacttgagacagaactgttggcccagaagtctttagttaaggtcattactaggccatatcttaggggcgtctggcctttttcattcctgggacccacagctcgaggtctggtttccatgccctatcccttacgatgagcgccctattttgttccttctgtctatctctgttgctgagatcagggagcccacgttcacagcagctctttcaagcagcctcccaggcctagagaggaaaatcagcagagcctcgtgaatgtatttctcgtggcaagaagggagctcatcttctgggtcctgccagagggcagtgagggggttgatgggctgggtgcatgccagggacccaatcaagcatttttatcttctgaaatctttgaattcctgcctttcttggatgtttggtcttttgatataatttagcatgggccaacatttggtccagatttgtattagccaagccctcctaaaatagtaataacagtatctggcgatttgagcttttacgtagaatgtagaatctctggtgagtgaacatatcaataaagacaacctgaaccaaaaaaaaaac

SEQ ID NO: 43785 - DNA, 10924 bp, Homo sapiens
  misc_feature (799)..(799): n is a, c, g, or t
  misc_feature (8038)..(8038): n is a, c, g, or t
tgggtatcaggactcagcccatttccccctctggtgctgagaaatggaggccgaaggagtgatctagaagtgttaattgagcccctaatctatgctagttactgggggtgttgggggagacaggagagagatcccacggggttccggcctcccagggactcaggtcactaatggaggtggcttggcttgtctatgtgctgggccaacagccactggcgaggcaaggcgagggtcagtcacggctggtgccaggaagagggctggttctttggctccctggtctcccgcggtctagcccaagctggccagcggttgacctggctcccctggccccggccaggcctcgtggacccctcatatgccacacgggacatgagcaggccggccgggagccgggtcccgggagctccacgaaggggcctgtcctccatgaccaggacacccgctgcgccttcctcccgaggcctcccgggcctctccagacgcggcgctactgcagacaccagggccgccaagggagcggactcggagccggccctggggcgggcacatgggccccggcgccccccggcgtctccaagccgcgctgcccgggtcgggccaggccaggggagggacagcagcaggtgacgacggcccggccaccggctataaataggggcgcgcgtcagccgcgggcgggagcggcggcggcgggcaggggcccgggggccggggcctggaggacaggcgaggcagcggcgagtgcggggccggcggtcggggagggcggtgccatggggtcgcggagggcccccanccggggctggggcgcgggtgggcggtcgggggcggggggcgacggtgaggacgacggccccgtgtggatccccagcccagccagccggagctacctgctcagcgtgcggcccgagaccagcttatcaagcaaccggttgtctcaccccagctctggaaggagcaccttctgctccatcattgctcagctcacagaggagacccagccgctatttgagaccacgctcaagtcccggtctgtgtccgaggacagcgacgtcaggttcacctgcatcgtcacaggatacccagagccagaggtgacctggtacaaggatgatacggagctggaccgctactgtggcttgccaaaatatgagatcactcatcagggcaaccgccacacactgcagctgtacaggtgtcgagaagaagatgccgccatctaccaggcctctgcccagaacagcaagggcattgtgtcctgctcaggggtcctggaggtgggcaccatgactgagtacaagatccaccagcgctggttcgccaagttgaagcgcaaggctgcggcaaagctgcgcgagatcgagcagagctggaagcacgagaaggcggtgcctggggaggtcgacactctgcgcaagctcagccccgaccgcttccagcgaaagcggcgattgagcggggctcaagcgccgggcccctcggtccctaccagggagcctgagggtgggaccctggcggcttggcaggagggagagactgagactgctcagcactcaggtttgggcctgatcaacagttttgcttctggagaagtgaccaccaacggggaggctgcccccgagaatggagaggacggagagcatggcttgctgacatacatctgtgacgccatggagctggggcctcagagagccctcaaagaggagagtggggccaagaagaaaaagaaagatgaggaatccaagcaaggcctgcggaagccagagttagagaaggcagcccaaagccgccgttcttcagaaaactgcatccccagctcagacgagcctgactcctgtgggactcaggggcccgtgggcgtggagcaggttcagacccagcccagaggcagggctgcacgggggcctgggtcctctggcacagatagtaccaggaagccagcctctgctgtgggcactccagacaaggcccagaaggcccctggcccaggcccaggccaggaagtgtatttctccttgaaggacatgtacctggagaacacccaggcagtcaggcctcttggggaagagggaccccagaccctgagtgtccgggcgcctggggagagtcccaaggggaaggcacccctcagggctagaagcgagggggtgcctggcgctcctggccagcccacacactccttgaccccccagccgactaggcctttcaacagaaagagatttgcccctccaaagcccaaaggagaggccaccactgacagcaagcccatttcttctctgagtcaagctccagaatgcggggcccagagcttaggaaaggccccacctcaggcctctgtgcaggtgccgacgccccctgcccggcggagacatggcacccgggacagcacgttgcaggggcaagcaggccacaggactccaggagaggtcctggaatgccagacaaccacggctcctaccatgtcggccagcagcagctctgatgtagcctccattggggttagcacttccggaagtcaaggtatcattgaacccatggatatggaaacccaggaggatgggagaacatctgctaaccagagaactggaagcaagaagaatgtgcaggcagatgggaagatacaagtggatggaaggaccaggggagatggaacacagacagcccagaggacacgtgcagataggaagacgcaggtggatgctgggacacaagaaagcaagaggccacagtcagacaggagtgcacagaagggcatgatgacacagggaagggcagagacacagctagaaacaacacaggcaggtgagaagatacaggaagacaggaaggcccaggcagataagggcacacaggaagacagaaggatgcagggagagaaggggatgcagggagagaaggggacgcagtcagaggggagcgcgcccacagccatggaaggtcagtctgagcaagaggtggcaaccagcctcggcccaccatccagaacccccaaactcccacctacagcgggtcctagagctcctctgaatattgaatgttttgtacagaccccagaagggtcttgtttcccaaaaaaacctggttgcctgcccagatctgaggaggcagtagtaacagcctccaggaaccatgagcaaactgtgctgggtcccctgtcagggaacctcatgctcccagcacagccgccccatgaggggagtgtggagcaggtgggaggagagagatgccgagggccacagtcatcaggcccagtcgaggccaagcaggaggacagcccgttccagtgccccaaggaggagcggccagggggagtgccgtgtatggatcagggtggctgtcctctagctggcctgagccaggaggtacccacgatgccttctcttcctggaactgggctgacagctagcccaaaggcggggccgtgtagcaccccgacttctcagcacgggagcacagccaccttcctgccctctgaggatcaggtcctgatgagttctgccccaacactgcacctggggctggggacccccactcagagtcacccaccagaaaccatggccaccagcagtgagggggcctgcgcccaggtaccagatgtggaggggcggaccccaggtccccggagctgtgaccctggcctcatagattccctgaagaactacctgcttctgctgctgaagctgtccagcacagagacaagtggagcagggggagagtcccaggtgggggcagccaccggaggtctggtgccctcagccactctgacacccactgtggaagtggctgggcttagtccccggacatcgaggcgcatcctggagcgtgtggagaacaaccacctggtgcagagtgcacagaccctgctgctgagcccctgtacctcccgccgcctcaccggcctcctggaccgtgaggtgcaggctggccgccaggcccttgctgctgcccgaggctcctggggtcctggtcccagctccctcactgtccctgccattgtggtagacgaggaggaccctgggctggcctcagaaggagccagtgagggtgaaggagaggtttcccttgaggggcctggcctcctgggggcctctcaggagagcagcatggctggtcgactgggggaggcgggtgggcaggcagcccctggacaggggccctcagcagagagcatagcccaggagccctcccaagaggagaagttcccaggggaggctctgacaggcctcccggcagctacacctgaggaactggctctaggggcccggaggaagagatttctccctaaggtcagagcagcaggagacggggaggcaaccacacctgaagaaagggagagccccacggtttccccccgggggcccaggaaaagcctggtgcctgggtccccagggactccagggcgggagagacgctcccctacgcagggcagaaaggcgagcatgctggaggtgcctcgggcagaggaggagctggcggcaggagacctgggccccagccccaaggccggcggtctggacacagaggtggccctggatgaaggcaagcaggagacactggccaagcccaggaaagccaaagacctgctgaaagccccacaggtgatccggaagattcgggtggagcagtttcctgatgcctccggtagcctgaagctgtggtgccagtttttcaacattcttagtgactcagtcttgacatgggccaaggatcagcgcccagtgggcgaggtgggcaggagcgcaggggatgaggggccggcggccttggccatcgtgcaggcctcccccgtagactgcggtgtgtatcggtgcaccatccacaatgagcacggctcggcctccaccgacttctgcctcagccctgaggtgttgtcaggattcatctccagagaagaaggtgaagttggagaagagattgagatgacccctatggtgtttgctaagggtctggctgactctggctgctggggggacaagctctttgggcgactggtaagcgaggagctccgagggggtggatatgggtgtggccttcggaaggcctcccaggccaaggtcatctacgggctggaacccatcttcgagtcgggccgcacgtgcatcatcaaggtgtccagcctgcttgtgtttgggcccagcagtgagacttctcttgtgggcagaaactacgacgtcaccatccaggggtgcaagatccagaacatgagtcgggagtactgcaaaatcttcgcagcagaagcccgggccgcgcctggctttggggaggtgcctgagatcatcccactgtatctgatctaccggcctgcaaacaatatcccatatgctaccctggaggaagacctgggcaagcccctggagtcttactgttctcgggaatggggctgtgctgaggctccgacagcatctggcagctctgaggccatgcagaaatgccagaccttccaacactggctgtatcagtggacaaatggcagcttccttgtcacagacttggcaggggttgactggaagatgactgatgtgcagattgctaccaaactccgaggataccagggcctcaaggaaagctgcttccctgccctgctggaccggttcgcctcctcccaccagtgcaatgcctactgtgagctgctggggctgacacctctcaagggcccggaggcggcccacccccaagccaaagccaaaggctctaagagtccatctgctggcaggaaaggctcccagctgagtcctcagccccagaagaaaggcctccctagtcctcagggcacccggaagagtgctccaagttccaaggccacccctcaggcctcagagccagtcaccactcagttgttgggacagcctcccacccaagaggagggctccaaggcccagggcatgcggtagcctccgcagaggctgggggcctccacccagcagcagaccaaccaggaagcagcttgaactggatggagactttccaaatatggaactaactggagaaggtgcacgaaggagacaccacttggggacctctctgagcaggctctcgtgaatcagctcgtcatcagatggctttggtgcatggcacatagcccactggcctcttctggtgccactgtcacccagggctcccgggcctcaagcagtccccacctccgagtgcctggcaacctaggccctccttgaagtttacactttgccactgctggaggctcccctgagtcctctgcatgagttctgcaccccaagcccttgccccagcccagtccagcagcagatgttacaatctgagtgaggacatgcaggccaacttttaccctcctgcatttgcctggccctgatctcgcctgtcctcagggatccagacttcctctgctggtctggcctggtgactctcagggtatcttctccttccagctactttcgctcactgatctcagcttatcctgcaactaaccatccttgagcccagatggggctcagggcccttccagagcctgtcatgtccttgtgcagtggcctttgatgtgtgttcacgctcttcccccttcactcactcgcctgcttcccatgctcccttgtaccccctcgccacatccctgtcttggggcccagctgcagcctgctgcctgcccttcatggctctgcacatggccctttgcttgagggctccccactccctgcccaccaatacccaggtgaggaacagaccctctggcctctcaccccacttcagtgctctcttccccaacttctctcgggctctttgctcatgaggtgagagctggtgtgagggttgtgtcagcagctgtagccagagagaggtgttgactctgagagaccttgcactccatactgaaaggaggtggggtcacagtgaatttcacatcccctctcaaccaggagtggagggctaggtcccttccccatggggagtacacttgggtgttctaggagggatgcagtctatccatgcacttgggtggaggggagtctctgtgcctgggaattaggacccctgctccaaccatcgctcttgatcctggggccccagctctgggtcctcatgtatgggctcccaaggacccagcagcctggatccttccagagcatccctcctggaggcctgggatggggtaggtctgcagctagcctactccctttggaatgcaataaaggcagcattgtgtgccctgcttgccctcatctggtgtggttggaggtctgtggagtcaaggtccccctctcccaggcaggctctctgagggcattctgtagtcccaggcccactggaaaaatgaatctatattttggttcctggaccgaagttcagtcgcagccttctgtggccacagaaagacagcttgtgctgcttgcacaactgagctgctggtgtgtaccccttagcagggtgtctggggacttacgcctttggaattgctcttcattcagaagaggaacacaaaggaagccacccaggaaggaagcacagagctgggggctctggaaacgccctgtgtctctggctacagcaagaccagcccaggagcccaccagcacctgcctctcagctacttgctgaccatttcctgcttctcaagctgcagagaagcttttcattcccacccccacccggaacctccccttgcctaacatttcccctctatggtaacatctctgacttctctacctcctctgtgctcaggtgactccacatcttctgccccagtgtgtccccacctctcccagcctgtatacccagattactttggtgaactgagagctggagtactgttcattcatttattcattcacccactcattcagcagacatatactgagtgctactttatgccagaccctgggctggcagctgtttggaggcaaagatgtatgaggccatctcaggagagactacttgttaggattcttgagttttgaccaacagaaatgaacttggaccaacttaagcaaggaaaaagcgttcatgggaaggatgctgggatagctcacaaaaccaaaagaatagctgaacaattaattggccntgggaagggtgggagctggggcaactacgaggcttgcctcccaggagctgctgcggttggcagatcaacaccaacttgccattggttctagtgggtccccttccactcaagattcaaattccaagtgaaagaacctggcctggagctcagggcttcatagagtgggaggggggcagtcttccaaaagatgcggactcttgccacatggaatggtggagtacggaagggtggaaagggtttggtaggtaaaccctgaagatgcttctaacacacgtgctgttctcccatctcacgtatgacgactctcccacaggtaaccaaaaccacatttctctctgcttagggaattcaagatcatatctaacttcgaattccaggggtaatgacacggcttctattctccaaagtccagtgtcattagggataatctccctctttcagttttatcacaattccattttgaaattctacaacctgtagattaactggtaaaattaaccatattcaaccaaaattgtataacccagcaagaatggaagaatgggtaaagtctacagtccatttctagaactggtcatgagaactcatgtttatgatgatggacttttgatctggtggagggacccaaaccttcagttctgaagctcattagtggtcctacctgtgtgacaggcatttactattggactggcagtcccaggacaaactccaggaatccccccatgtccatctctactcctgccctcttttacgtagcagcaatcatattttcccttgatagggttcatcattctagatactccgatgacttctttataatgagcctgaagtggcctggtggctgcctcagcttccagttcagttgaatagctactacgtctttgaggatgtgctccttgctgggggactaaactctccacgccagcccagtcccaaacctaaacctcgggtatgagaaaagcattgagatctagcaatagcagggccatgtccacactgcgtcctatccctgaaggagaaacagcgccaggtatggttgccggctccaagcgcatgctgcctcctgcaggcctgacccagcctctcggggtgttgtttctggtgccatagttgaattttcaacaaaccatttcaccaccctctcaagacagctgctgctggtttgtgggttcctgacaagatgagtgaatgcctgcccatcaacccgttactcttcttttagctgtaaagtgaattctctggttgggtgcagtatgtgaggaggtcacatgatgtttatggcatttgagaattccatggatattgatggcaggagaggcatgatgggttagaaaagcaaatccaaatccagaacaagggcccaaaagggccaagacaaattactgcccctctcagagccacaggtgtagacaggtgaaaacactggacagtgagtgagctacccacacacgacccactggtgccttcagagccttagcctggagcgacagtgtaccgttgataatggaacgcactggccatgccagactttatggctaggcggtcagataacactacgaggggcagcatggccaccaagtgtgccagggccaagtgttcaggctctcccagagcccagtggtgagccagaagggcattttgtacaaggataatggttactttttggccagagcatcacttggctccaaatcctgggttcccgtatcatattttcttgtcaggacttaccgcaagctatgtatggctccgcggtatgccacccatggaaagacacctcatgcaccattgacctgccaggtcacgtggcctgatggcagcgtcggctgcacaaaagactttcccagctgcaatgccttcgcctgctctaggcccaccccaaagctggcagccttctaggtcagttggtaaatgggttagaacaagatgccccaaagtggcataaattgcatggaattaggccttagtggcgagggattcgacatacagtcatttgtcctacattgtgaaggaaacattctgacctcaaacagatccctcaaccccagaactttatagaaggggcagaccttggcattttcacatgatttatctcccactctgattcacatatgtttgaccaaggcactgggcagctgccaatttcccgtcccttctgtagtcccagatgaatggatacagacctctttggggaaggctgcaaggaaggttcacaacatgcatctaagtgttaaaataagtttttccttcaaaaatacatttgacttcctctccatttaaggtctggaaatcaagtgggagatcttgactttaccttggcacttgagacagaactgttggcccagaagtctttagttaaggtcattactaggccatatcttaggggcgtctggcctttttcattcctgggacccacagctcgaggtctggtttccatgccctatcccttacgatgagcgccctattttgttccttctgtctatctctgttgctgagatcagggagcccacgttcacagcagctctttcaagcagcctcccaggcctagagaggaaaatcagcagagcctcgtgaatgtatttctcgtggcaagaagggagctcatcttctgggtcctgccagagggcagtgagggggttgatgggctgggtgcatgccagggacccaatcaagcatttttatcttctgaaatctttgaattcctgcctttcttggatgtttggtcttttgatataatttagcatgggccaacatttggtccagatttgtattagccaagccctcctaaaatagtaataacagtatctggcgatttgagcttttacgtagaatgtagaatctctggtgagtgaacatatcaataaagacaacctgaaccaaaaaaaaaac

SEQ ID NO: 43786 - DNA, 10475 bp, Homo sapiens
  misc_feature (799)..(799): n is a, c, g, or t
  misc_feature (8038)..(8038): n is a, c, g, or t
tgggtatcaggactcagcccatttccccctctggtgctgagaaatggaggccgaaggagtgatctagaagtgttaattgagcccctaatctatgctagttactgggggtgttgggggagacaggagagagatcccacggggttccggcctcccagggactcaggtcactaatggaggtggcttggcttgtctatgtgctgggccaacagccactggcgaggcaaggcgagggtcagtcacggctggtgccaggaagagggctggttctttggctccctggtctcccgcggtctagcccaagctggccagcggttgacctggctcccctggccccggccaggcctcgtggacccctcatatgccacacgggacatgagcaggccggccgggagccgggtcccgggagctccacgaaggggcctgtcctccatgaccaggacacccgctgcgccttcctcccgaggcctcccgggcctctccagacgcggcgctactgcagacaccagggccgccaagggagcggactcggagccggccctggggcgggcacatgggccccggcgccccccggcgtctccaagccgcgctgcccgggtcgggccaggccaggggagggacagcagcaggtgacgacggcccggccaccggctataaataggggcgcgcgtcagccgcgggcgggagcggcggcggcgggcaggggcccgggggccggggcctggaggacaggcgaggcagcggcgagtgcggggccggcggtcggggagggcggtgccatggggtcgcggagggcccccanccggggctggggcgcgggtgggcggtcgggggcggggggcgacggtgaggacgacggccccgtgtggatccccagcccagccagccggagctacctgctcagcgtgcggcccgagaccagcttatcaagcaaccggttgtctcaccccagctctggaaggagcaccttctgctccatcattgctcagctcacagaggagacccagccgctatttgagaccacgctcaagtcccggtctgtgtccgaggacagcgacgtcaggttcacctgcatcgtcacaggatacccagagccagaggtgacctggtacaaggatgatacggagctggaccgctactgtggcttgccaaaatatgagatcactcatcagggcaaccgccacacactgcagctgtacaggtgtcgagaagaagatgccgccatctaccaggcctctgcccagaacagcaagggcattgtgtcctgctcaggggtcctggaggtgggcaccatgactgagtacaagatccaccagcgctggttcgccaagttgaagcgcaaggctgcggcaaagctgcgcgagatcgagcagagctggaagcacgagaaggcggtgcctggggaggtcgacactctgcgcaagctcagccccgaccgcttccagcgaaagcggcgattgagcggggctcaagcgccgggcccctcggtccctaccagggagcctgagggtgggaccctggcggcttggcaggagggagagactgagactgctcagcactcaggtttgggcctgatcaacagttttgcttctggagaagtgaccaccaacggggaggctgcccccgagaatggagaggacggagagcatggcttgctgacatacatctgtgacgccatggagctggggcctcagagagccctcaaagaggagagtggggccaagaagaaaaagaaagatgaggaatccaagcaaggcctgcggaagccagagttagagaaggcagcccaaagccgccgttcttcagaaaactgcatccccagctcagacgagcctgactcctgtgggactcaggggcccgtgggcgtggagcaggttcagacccagcccagaggcagggctgcacgggggcctgggtcctctggcacagatagtaccaggaagccagcctctgctgtgggcactccagacaaggcccagaaggcccctggcccaggcccaggccaggaagtgtatttctccttgaaggacatgtacctggagaacacccaggcagtcaggcctcttggggaagagggaccccagaccctgagtgtccgggcgcctggggagagtcccaaggggaaggcacccctcagggctagaagcgagggggtgcctggcgctcctggccagcccacacactccttgaccccccagccgactaggcctttcaacagaaagagatttgcccctccaaagcccaaaggagaggccaccactgacagcaagcccatttcttctctgagtcaagctccagaatgcggggcccagagcttaggaaaggccccacctcaggcctctgtgcaggtgccgacgccccctgcccggcggagacatggcacccgggacagcacgttgcaggggcaagcaggccacaggactccaggagaggtcctggaatgccagacaaccacggctcctaccatgtcggccagcagcagctctgatgtagcctccattggggttagcacttccggaagtcaaggtatcattgaacccatggatatggaaacccaggaggatgggagaacatctgctaaccagagaactggaagcaagaagaatgtgcaggcagatgggaagatacaagtggatggaaggaccaggggagatggaacacagacagcccagaggacacgtgcagataggaagacgcaggtggatgctgggacacaagaaagcaagaggccacagtcagacaggagtgcacagaagggcatgatgacacagggaagggcagagacacagctagaaacaacacaggcaggtgagaagatacaggaagacaggaaggcccaggcagataagggcacacaggaagacagaaggatgcagggagagaaggggatgcagggagagaaggggacgcagtcagaggggagcgcgcccacagccatggaaggtcagtctgagcaagaggtggcaaccagcctcggcccaccatccagaacccccaaactcccacctacagcgggtcctagagctcctctgaatattgaatgttttgtacagaccccagaagggtcttgtttcccaaaaaaacctggttgcctgcccagatctgaggaggcagtagtaacagcctccaggaaccatgagcaaactgtgctgggtcccctgtcagggaacctcatgctcccagcacagccgccccatgaggggagtgtggagcaggtgggaggagagagatgccgagggccacagtcatcaggcccagtcgaggccaagcaggaggacagcccgttccagtgccccaaggaggagcggccagggggagtgccgtgtatggatcagggtggctgtcctctagctggcctgagccaggaggtacccacgatgccttctcttcctggaactgggctgacagctagcccaaaggcggggccgtgtagcaccccgacttctcagcacgggagcacagccaccttcctgccctctgaggatcaggtcctgatgagttctgccccaacactgcacctggggctggggacccccactcagagtcacccaccagaaaccatggccaccagcagtgagggggcctgcgcccaggtaccagatgtggaggggcggaccccaggtccccggagctgtgaccctggcctcatagattccctgaagaactacctgcttctgctgctgaagctgtccagcacagagacaagtggagcagggggagagtcccaggtgggggcagccaccggaggtctggtgccctcagccactctgacacccactgtggaagtggctgggcttagtccccggacatcgaggcgcatcctggagcgtgtggagaacaaccacctggtgcagagtgcacagaccctgctgctgagcccctgtacctcccgccgcctcaccggcctcctggaccgtgaggtgcaggctggccgccaggcccttgctgctgcccgaggctcctggggtcctggtcccagctccctcactgtccctgccattgtggtagacgaggaggaccctgggctggcctcagaaggagccagtgagggtgaaggagaggtttcccttgaggggcctggcctcctgggggcctctcaggagagcagcatggctggtcgactgggggaggcgggtgggcaggcagcccctggacaggggccctcagcagagagcatagcccaggagccctcccaagaggagaagttcccaggggaggctctgacaggcctcccggcagctacacctgaggaactggctctaggggcccggaggaagagatttctccctaaggtcagagcagcaggagacggggaggcaaccacacctgaagaaagggagagccccacggtttccccccgggggcccaggaaaagcctggtgcctgggtccccagggactccagggcgggagagacgctcccctacgcagggcagaaaggcgagcatgctggaggtgcctcgggcagaggaggagctggcggcaggagacctgggccccagccccaaggccggcggtctggacacagaggtggccctggatgaaggcaagcaggagacactggccaagcccaggaaagccaaagacctgctgaaagccccacaggtgatccggaagattcgggtggagcagtttcctgatgcctccggtagcctgaagctgtggtgccagtttttcaacattcttagtgactcagtcttgacatgggccaaggatcagcgcccagtgggcgaggtgggcaggagcgcaggggatgaggggccggcggccttggccatcgtgcaggcctcccccgtagactgcggtgtgtatcggtgcaccatccacaatgagcacggctcggcctccaccgacttctgcctcagccctgaggtgttgtcaggattcatctccagagaagaaggtgaagttggagaagagattgagatgacccctatggtgtttgctaagggtctggctgactctggctgctggggggacaagctctttgggcgactggtaagcgaggagctccgagggggtggatatgggtgtggccttcggaaggcctcccaggccaaggtcatctacgggctggaacccatcttcgagtcgggccgcacgtgcatcatcaaggtgtccagcctgcttgtgtttgggcccagcagtgagacttctcttgtgggcagaaactacgacgtcaccatccaggggtgcaagatccagaacatgagtcgggagtactgcaaaatcttcgcagcagaagcccgggccgcgcctggctttggggaggtgcctgagatcatcccactgtatctgatctaccggcctgcaaacaatatcccatatgctaccctggaggaagacctgggcaagcccctggagtcttactgttctcgggaatggggctgtgctgaggctccgacagcatctggcagctctgaggccatgcagaaatgccagaccttccaacactggctgtatcagtggacaaatggcagcttccttgtcacagacttggcaggggttgactggaagatgactgatgtgcagattgctaccaaactccgaggataccagggcctcaaggaaagctgcttccctgccctgctggaccggttcgcctcctcccaccagtgcaatgcctactgtgagctgctggggctgacacctctcaagggcccggaggcggcccacccccaagccaaagccaaaggctctaagagtccatctgctggcaggaaaggctcccagctgagtcctcagccccagaagaaaggcctccctagtcctcagggcacccggaagagtgctccaagttccaaggccacccctcaggcctcagagccagtcaccactcagttgttgggacagcctcccacccaagaggagggctccaaggcccagggcatgcggtagcctccgcagaggctgggggcctccacccagcagcagaccaaccaggaagcagcttgaactggatggagactttccaaatatggaactaactggagaaggtgcacgaaggagacaccacttggggacctctctgagcaggctctcgtgaatcagctcgtcatcagatggctttggtgcatggcacatagcccactggcctcttctggtgccactgtcacccagggctcccgggcctcaagcagtccccacctccgagtgcctggcaacctaggccctccttgaagtttacactttgccactgctggaggctcccctgagtcctctgcatgagttctgcaccccaagcccttgccccagcccagtccagcagcagatgttacaatctgagtgaggacatgcaggccaacttttaccctcctgcatttgcctggccctgatctcgcctgtcctcagggatccagacttcctctgctggtctggcctggtgactctcagggtatcttctccttccagctactttcgctcactgatctcagcttatcctgcaactaaccatccttgagcccagatggggctcagggcccttccagagcctgtcatgtccttgtgcagtggcctttgatgtgtgttcacgctcttcccccttcactcactcgcctgcttcccatgctcccttgtaccccctcgccacatccctgtcttggggcccagctgcagcctgctgcctgcccttcatggctctgcacatggccctttgcttgagggctccccactccctgcccaccaatacccaggtgaggaacagaccctctggcctctcaccccacttcagtgctctcttccccaacttctctcgggctctttgctcatgaggtgagagctggtgtgagggttgtgtcagcagctgtagccagagagaggtgttgactctgagagaccttgcactccatactgaaaggaggtggggtcacagtgaatttcacatcccctctcaaccaggagtggagggctaggtcccttccccatggggagtacacttgggtgttctaggagggatgcagtctatccatgcacttgggtggaggggagtctctgtgcctgggaattaggacccctgctccaaccatcgctcttgatcctggggccccagctctgggtcctcatgtatgggctcccaaggacccagcagcctggatccttccagagcatccctcctggaggcctgggatggggtaggtctgcagctagcctactccctttggaatgcaataaaggcagcattgtgtgccctgcttgccctcatctggtgtggttggaggtctgtggagtcaaggtccccctctcccaggcaggctctctgagggcattctgtagtcccaggcccactggaaaaatgaatctatattttggttcctggaccgaagttcagtcgcagccttctgtggccacagaaagacagcttgtgctgcttgcacaactgagctgctggtgtgtaccccttagcagggtgtctggggacttacgcctttggaattgctcttcattcagaagaggaacacaaaggaagccacccaggaaggaagcacagagctgggggctctggaaacgccctgtgtctctggctacagcaagaccagcccaggagcccaccagcacctgcctctcagctacttgctgaccatttcctgcttctcaagctgcagagaagcttttcattcccacccccacccggaacctccccttgcctaacatttcccctctatggtaacatctctgacttctctacctcctctgtgctcaggtgactccacatcttctgccccagtgtgtccccacctctcccagcctgtatacccagattactttggtgaactgagagctggagtactgttcattcatttattcattcacccactcattcagcagacatatactgagtgctactttatgccagaccctgggctggcagctgtttggaggcaaagatgtatgaggccatctcaggagagactacttgttaggattcttgagttttgaccaacagaaatgaacttggaccaacttaagcaaggaaaaagcgttcatgggaaggatgctgggatagctcacaaaaccaaaagaatagctgaacaattaattggccntgggaagggtgggagctggggcaactacgaggcttgcctcccaggagctgctgcggttggcagatcaacaccaacttgccattggttctagtgggtccccttccactcaagattcaaattccaagtgaaagaacctggcctggagctcagggcttcatagagtgggaggggggcagtcttccaaaagatgcggactcttgccacatggaatggtggagtacggaagggtggaaagggtttggtaggtaaaccctgaagatgcttctaacacacgtgctgttctcccatctcacgtatgacgactctcccacaggtaaccaaaaccacatttctctctgcttagggaattcaagatcatatctaacttcgaattccaggggtaatgacacggcttctattctccaaagtccagtgtcattagggataatctccctctttcagttttatcacaattccattttgaaattctacaacctgtagattaactggtaaaattaaccatattcaaccaaaattgtataacccagcaagaatggaagaatgggtaaagtctacagtccatttctagaactggtcatgagaactcatgtttatgatgatggacttttgatctggtggagggacccaaaccttcagttctgaagctcattagtggtcctacctgtgtgacaggcatttactattggactggcagtcccaggacaaactccaggaatccccccatgtccatctctactcctgccctcttttacgtagcagcaatcatattttcccttgatagggttcatcattctagatactccgatgacttctttataatgagcctgaagtggcctggtggctgcctcagcttccagttcagttgaatagctactacgtctttgaggatgtgctccttgctgggggactaaactctccacgccagcccagtcccaaacctaaacctcgggtatgagaaaagcattgagatctagcaatagcagggccatgtccacactgcgtcctatccctgaaggagaaacagcgccaggtatggttgccggctccaagcgcatgctgcctcctgcaggcctgacccagcctctcggggtgttgtttctggtgccatagttgaattttcaacaaaccatttcaccaccctctcaagacagctgctgctggtttgtgggttcctgacaagatgagtgaatgcctgcccatcaacccgttactcttcttttagctgtaaagtgaattctctggttgggttcccgtatcatattttcttgtcaggacttaccgcaagctatgtatggctccgcggtatgccacccatggaaagacacctcatgcaccattgacctgccaggtcacgtggcctgatggcagcgtcggctgcacaaaagactttcccagctgcaatgccttcgcctgctctaggcccaccccaaagctggcagccttctaggtcagttggtaaatgggttagaacaagatgccccaaagtggcataaattgcatggaattaggccttagtggcgagggattcgacatacagtcatttgtcctacattgtgaaggaaacattctgacctcaaacagatccctcaaccccagaactttatagaaggggcagaccttggcattttcacatgatttatctcccactctgattcacatatgtttgaccaaggcactgggcagctgccaatttcccgtcccttctgtagtcccagatgaatggatacagacctctttggggaaggctgcaaggaaggttcacaacatgcatctaagtgttaaaataagtttttccttcaaaaatacatttgacttcctctccatttaaggtctggaaatcaagtgggagatcttgactttaccttggcacttgagacagaactgttggcccagaagtctttagttaaggtcattactaggccatatcttaggggcgtctggcctttttcattcctgggacccacagctcgaggtctggtttccatgccctatcccttacgatgagcgccctattttgttccttctgtctatctctgttgctgagatcagggagcccacgttcacagcagctctttcaagcagcctcccaggcctagagaggaaaatcagcagagcctcgtgaatgtatttctcgtggcaagaagggagctcatcttctgggtcctgccagagggcagtgagggggttgatgggctgggtgcatgccagggacccaatcaagcatttttatcttctgaaatctttgaattcctgcctttcttggatgtttggtcttttgatataatttagcatgggccaacatttggtccagatttgtattagccaagccctcctaaaatagtaataacagtatctggcgatttgagcttttacgtagaatgtagaatctctggtgagtgaacatatcaataaagacaacctgaaccaaaaaaaaaac

SEQ ID NO: 43787 - DNA, 10860 bp, Homo sapiens
  misc_feature (799)..(799): n is a, c, g, or t
  misc_feature (7974)..(7974): n is a, c, g, or t
tgggtatcaggactcagcccatttccccctctggtgctgagaaatggaggccgaaggagtgatctagaagtgttaattgagcccctaatctatgctagttactgggggtgttgggggagacaggagagagatcccacggggttccggcctcccagggactcaggtcactaatggaggtggcttggcttgtctatgtgctgggccaacagccactggcgaggcaaggcgagggtcagtcacggctggtgccaggaagagggctggttctttggctccctggtctcccgcggtctagcccaagctggccagcggttgacctggctcccctggccccggccaggcctcgtggacccctcatatgccacacgggacatgagcaggccggccgggagccgggtcccgggagctccacgaaggggcctgtcctccatgaccaggacacccgctgcgccttcctcccgaggcctcccgggcctctccagacgcggcgctactgcagacaccagggccgccaagggagcggactcggagccggccctggggcgggcacatgggccccggcgccccccggcgtctccaagccgcgctgcccgggtcgggccaggccaggggagggacagcagcaggtgacgacggcccggccaccggctataaataggggcgcgcgtcagccgcgggcgggagcggcggcggcgggcaggggcccgggggccggggcctggaggacaggcgaggcagcggcgagtgcggggccggcggtcggggagggcggtgccatggggtcgcggagggcccccanccggggctggggcgcgggtgggcggtcgggggcggggggcgacggtgaggacgacggccccgtgtggatccccagcccagccagccggagctacctgctcagcgtgcggcccgagaccagcttatcaagcaaccggttgtctcaccccagctctggaaggagcaccttctgctccatcattgctcagctcacagaggagacccagccgctatttgagaccacgctcaagtcccggtctgtgtccgaggacagcgacgtcaggttcacctgcatcgtcacaggatacccagagccagaggtgacctggtacaaggatgatacggagctggaccgctactgtggcttgccaaaatatgagatcactcatcagggcaaccgccacacactgcagctgtacaggtgtcgagaagaagatgccgccatctaccaggcctctgcccagaacagcaagggcattgtgtcctgctcaggggtcctggaggtgggcaccatgactgagtacaagatccaccagcgctggttcgccaagttgaagcgcaaggctgcggcaaagctgcgcgagatcgagcagagctggaagcacgagaaggcggtgcctggggaggtcgacactctgcgcaagctcagccccgaccgcttccagcgaaagcggcgattgagcggggctcaagcgccgggcccctcggtccctaccagggagcctgagggtgggaccctggcggcttggcaggagggagagactgagactgctcagcactcaggtttgggcctgatcaacagttttgcttctggagaagtgaccaccaacggggaggctgcccccgagaatggagaggacggagagcatggcttgctgacatacatctgtgacgccatggagctggggcctcagagagccctcaaagaggagagtggggccaagaagaaaaagaaagatgaggaatccaagcaaggcctgcggaagccagagttagagaaggcagcccaaagccgccgttcttcagaaaactgcatccccagctcagacgagcctgactcctgtgggactcaggggcccgtgggcgtggagcaggttcagacccagcccagaggcagggctgcacgggggcctgggtcctctggcacagatagtaccaggaagccagcctctgctgtgggcactccagacaaggcccagaaggcccctggcccaggcccaggccaggaagtgtatttctccttgaaggacatgtacctggagaacacccaggcagtcaggcctcttggggaagagggaccccagaccctgagtgtccgggcgcctggggagagtcccaaggggaaggcacccctcagggctagaagcgagggggtgcctggcgctcctggccagcccacacactccttgaccccccagccgactaggcctttcaacagaaagagatttgcccctccaaagcccaaaggagaggccaccactgacagcaagcccatttcttctctgagtcaagctccagaatgcggggcccagagcttaggaaaggccccacctcaggcctctgtgcaggtgccgacgccccctgcccggcggagacatggcacccgggacagcacgttgcaggggcaagcaggccacaggactccaggagaggtcctggaatgccagacaaccacggctcctaccatgtcggccagcagcagctctgatgtagcctccattggggttagcacttccggaagtcaaggtatcattgaacccatggatatggaaacccaggaggatgggagaacatctgctaaccagagaactggaagcaagaagaatgtgcaggcagatgggaagatacaagtggatggaaggaccaggggagatggaacacagacagcccagaggacacgtgcagataggaagacgcaggtggatgctgggacacaagaaagcaagaggccacagtcagacaggagtgcacagaagggcatgatgacacagggaagggcagagacacagctagaaacaacacaggcaggtgagaagatacaggaagacaggaaggcccaggcagataagggcacacaggaagacagaaggatgcagggagagaaggggatgcagggagagaaggggacgcagtcagaggggagcgcgcccacagccatggaaggtcagtctgagcaagaggtggcaaccagcctcggcccaccatccagaacccccaaactcccacctacagcgggtcctagagctcctctgaatattgaatgttttgtacagaccccagaagggtcttgtttcccaaaaaaacctggttgcctgcccagatctgaggaggcagtagtaacagcctccaggaaccatgagcaaactgtgctgggtcccctgtcagggaacctcatgctcccagcacagccgccccatgaggggagtgtggagcaggtgggaggagagagatgccgagggccacagtcatcaggcccagtcgaggccaagcaggaggacagcccgttccagtgccccaaggaggagcggccagggggagtgccgtgtatggatcagggtggctgtcctctagctggcctgagccaggaggtacccacgatgccttctcttcctggaactgggctgacagctagcccaaaggcggggccgtgtagcaccccgacttctcagcacgggagcacagccaccttcctgccctctgaggatcaggtcctgatgagttctgccccaacactgcacctggggctggggacccccactcagagtcacccaccagaaaccatggccaccagcagtgagggggcctgcgcccaggtaccagatgtggaggggcggaccccaggtccccggagctgtgaccctggcctcatagattccctgaagaactacctgcttctgctgctgaagctgtccagcacagagacaagtggagcagggggagagtcccaggtgggggcagccaccggaggtctggtgccctcagccactctgacacccactgtggaagtggctgggcttagtccccggacatcgaggcgcatcctggagcgtgtggagaacaaccacctggtgcagagtgcacagaccctgctgctgagcccctgtacctcccgccgcctcaccggcctcctggaccgtgaggtgcaggctggccgccaggcccttgctgctgcccgaggctcctggggtcctggtcccagctccctcactgtccctgccattgtggtagacgaggaggaccctgggctggcctcagaaggagccagtgagggtgaaggagaggtttcccttgaggggcctggcctcctgggggcctctcaggagagcagcatggctggtcgactgggggaggcgggtgggcaggcagcccctggacaggggccctcagcagagagcatagcccaggagccctcccaagaggagaagttcccaggggaggctctgacaggcctcccggcagctacacctgaggaactggctctaggggcccggaggaagagatttctccctaaggtcagagcagcaggagacggggaggcaaccacacctgaagaaagggagagccccacggtttccccccgggggcccaggaaaagcctggtgcctgggtccccagggactccagggcgggagagacgctcccctacgcagggcagaaaggcgagcatgctggaggtgcctcgggcagaggaggagctggcggcaggagacctgggccccagccccaaggccggcggtctggacacagaggtggccctggatgaaggcaagcaggagacactggccaagcccaggaaagccaaagacctgctgaaagccccacaggtgatccggaagattcgggtggagcagtttcctgatgcctccggtagcctgaagctgtggtgccagtttttcaacattcttagtgactcagtcttgacatgggccaaggatcagcgcccagtgggcgaggtgggcaggagcgcaggggatgaggggccggcggccttggccatcgtgcaggcctcccccgtagactgcggtgtgtatcggtgcaccatccacaatgagcacggctcggcctccaccgacttctgcctcagccctgaggtgttgtcaggattcatctccagagaagaaggtgaagttggagaagagattgagatgacccctatggtgtttgctaagggtctggctgactctggctgctggggggacaagctctttgggcgactggtaagcgaggagctccgagggggtggatatgggtgtggccttcggaaggcctcccaggccaaggtcatctacgggctggaacccatcttcgagtcgggccgcacgtgcatcatcaaggtgtccagcctgcttgtgtttgggcccagcagtgagacttctcttgtgggcagaaactacgacgtcaccatccaggggtgcaagatccagaacatgagtcgggagtactgcaaaatcttcgcagcagaagcccgggccgcgcctggctttggggaggtgcctgagatcatcccactgtatctgatctaccggcctgcaaacaatatcccatatgctaccctggaggaagacctgggcaagcccctggagtcttactgttctcgggaatggggctgtgctgaggctccgacagcatctggcagctctgaggccatgcagaaatgccagaccttccaacactggctgtatcagtggacaaatggcagcttccttgtcacagacttggcaggggttgactggaagatgactgatgtgcagattgctaccaaactccgaggataccagggcctcaaggaaagctgcttccctgccctgctggaccggttcgcctcctcccaccagtgcaatgcctactgtgagctgctggggctgacacctctcaagggcccggaggcggcccacccccaagccaaagccaaaggctctaagagtccatctgctggcaggaaaggctcccagctgagtcctcagccccagaagaaaggcctccctagtcctcagggcacccggaagagtgctccaagttccaaggccacccctcaggcctcagagccagtcaccactcagttgttgggacagcctcccacccaagaggagggctccaaggcccagggcatgcggtagcctccgcagaggctgggggcctccacccagcagcagaccaaccaggaagcagcttgaactggatggagactttccaaatatggaactaactggagaaggtgcacgaaggagacaccacttggggacctctctgagcaggctctcgtgaatcagctcgtcatcagatggctttggtgcatggcacatagcccactggcctcttctggtgccactgtcacccagggctcccgggcctcaagcagtccccacctccgagtgcctggcaacctaggccctccttgaagtttacactttgccactgctggaggctcccctgagtcctctgcatgagttctgcaccccaagcccttgccccagcccagtccagcagcagatgttacaatctgagtgaggacatgcaggccaacttttaccctcctgcatttgcctggccctgatctcgcctgtcctcagggatccagacttcctctgctggtctggcctggtgactctcagggtatcttctccttccagctactttcgctcactgatctcagcttatcctgcaactaaccatccttgagcccagatggggctcagggcccttccagagcctgtcatgtccttgtgcagtggcctttgatgtgtgttcacgctcttcccccttcactcactcgcctgcttcccatgctcccttgtaccccctcgccacatccctgtcttggggcccagctgcagcctgctgcctgcccttcatggctctgcacatggccctttgcttgagggctccccactccctgcccaccaatacccaggtgaggaacagaccctctggcctctcaccccacttcagtgctctcttccccaacttctctcgggctctttgctcatgaggtgagagctggtgtgagggttgtgtcagcagctgtagccagagagaggtgttgactctgagagaccttgcactccatactgaaaggaggtggggtcacagtgaatttcacatcccctctcaaccaggagtggagggctaggtcccttccccatggggagtacacttgggtgttctaggagggatgcagtctatccatgcacttgggtggaggggagtctctgtgcctgggaattaggacccctgctccaaccatcgctcttgatcctggggccccagctctgggtcctcatgtatgggctcccaaggacccagcagcctggatccttccagagcatccctcctggaggcctgggatggggtaggtctgcagctagcctactccctttggaatgcaataaaggcagcattgtgtgccctgcttgccctcatctggtgtggttggaggtctgtggagtcaaggtccccctctcccaggcaggctctctgagggcattctgtagtcccaggcccactggaaaaatgaatctatattttggttcctggaccgaagttcagtcgcagccttctgtggccacagaaagacagcttgtgctgcttgcacaactgagctgctggtgtgtaccccttagcagggtgtctggggacttacgcctttggaattgctcttcattcagaagaggaacacaaaggaagccacccaggaaggaagcaccagcacctgcctctcagctacttgctgaccatttcctgcttctcaagctgcagagaagcttttcattcccacccccacccggaacctccccttgcctaacatttcccctctatggtaacatctctgacttctctacctcctctgtgctcaggtgactccacatcttctgccccagtgtgtccccacctctcccagcctgtatacccagattactttggtgaactgagagctggagtactgttcattcatttattcattcacccactcattcagcagacatatactgagtgctactttatgccagaccctgggctggcagctgtttggaggcaaagatgtatgaggccatctcaggagagactacttgttaggattcttgagttttgaccaacagaaatgaacttggaccaacttaagcaaggaaaaagcgttcatgggaaggatgctgggatagctcacaaaaccaaaagaatagctgaacaattaattggccntgggaagggtgggagctggggcaactacgaggcttgcctcccaggagctgctgcggttggcagatcaacaccaacttgccattggttctagtgggtccccttccactcaagattcaaattccaagtgaaagaacctggcctggagctcagggcttcatagagtgggaggggggcagtcttccaaaagatgcggactcttgccacatggaatggtggagtacggaagggtggaaagggtttggtaggtaaaccctgaagatgcttctaacacacgtgctgttctcccatctcacgtatgacgactctcccacaggtaaccaaaaccacatttctctctgcttagggaattcaagatcatatctaacttcgaattccaggggtaatgacacggcttctattctccaaagtccagtgtcattagggataatctccctctttcagttttatcacaattccattttgaaattctacaacctgtagattaactggtaaaattaaccatattcaaccaaaattgtataacccagcaagaatggaagaatgggtaaagtctacagtccatttctagaactggtcatgagaactcatgtttatgatgatggacttttgatctggtggagggacccaaaccttcagttctgaagctcattagtggtcctacctgtgtgacaggcatttactattggactggcagtcccaggacaaactccaggaatccccccatgtccatctctactcctgccctcttttacgtagcagcaatcatattttcccttgatagggttcatcattctagatactccgatgacttctttataatgagcctgaagtggcctggtggctgcctcagcttccagttcagttgaatagctactacgtctttgaggatgtgctccttgctgggggactaaactctccacgccagcccagtcccaaacctaaacctcgggtatgagaaaagcattgagatctagcaatagcagggccatgtccacactgcgtcctatccctgaaggagaaacagcgccaggtatggttgccggctccaagcgcatgctgcctcctgcaggcctgacccagcctctcggggtgttgtttctggtgccatagttgaattttcaacaaaccatttcaccaccctctcaagacagctgctgctggtttgtgggttcctgacaagatgagtgaatgcctgcccatcaacccgttactcttcttttagctgtaaagtgaattctctggttgggtgcagtatgtgaggaggtcacatgatgtttatggcatttgagaattccatggatattgatggcaggagaggcatgatgggttagaaaagcaaatccaaatccagaacaagggcccaaaagggccaagacaaattactgcccctctcagagccacaggtgtagacaggtgaaaacactggacagtgagtgagctacccacacacgacccactggtgccttcagagccttagcctggagcgacagtgtaccgttgataatggaacgcactggccatgccagactttatggctaggcggtcagataacactacgaggggcagcatggccaccaagtgtgccagggccaagtgttcaggctctcccagagcccagtggtgagccagaagggcattttgtacaaggataatggttactttttggccagagcatcacttggctccaaatcctgggttcccgtatcatattttcttgtcaggacttaccgcaagctatgtatggctccgcggtatgccacccatggaaagacacctcatgcaccattgacctgccaggtcacgtggcctgatggcagcgtcggctgcacaaaagactttcccagctgcaatgccttcgcctgctctaggcccaccccaaagctggcagccttctaggtcagttggtaaatgggttagaacaagatgccccaaagtggcataaattgcatggaattaggccttagtggcgagggattcgacatacagtcatttgtcctacattgtgaaggaaacattctgacctcaaacagatccctcaaccccagaactttatagaaggggcagaccttggcattttcacatgatttatctcccactctgattcacatatgtttgaccaaggcactgggcagctgccaatttcccgtcccttctgtagtcccagatgaatggatacagacctctttggggaaggctgcaaggaaggttcacaacatgcatctaagtgttaaaataagtttttccttcaaaaatacatttgacttcctctccatttaaggtctggaaatcaagtgggagatcttgactttaccttggcacttgagacagaactgttggcccagaagtctttagttaaggtcattactaggccatatcttaggggcgtctggcctttttcattcctgggacccacagctcgaggtctggtttccatgccctatcccttacgatgagcgccctattttgttccttctgtctatctctgttgctgagatcagggagcccacgttcacagcagctctttcaagcagcctcccaggcctagagaggaaaatcagcagagcctcgtgaatgtatttctcgtggcaagaagggagctcatcttctgggtcctgccagagggcagtgagggggttgatgggctgggtgcatgccagggacccaatcaagcatttttatcttctgaaatctttgaattcctgcctttcttggatgtttggtcttttgatataatttagcatgggccaacatttggtccagatttgtattagccaagccctcctaaaatagtaataacagtatctggcgatttgagcttttacgtagaatgtagaatctctggtgagtgaacatatcaataaagacaacctgaaccaaaaaaaaaac

SEQ ID NO: 43788 - DNA, 6302 bp, Homo sapiens
  misc_feature (799)..(799): n is a, c, g, or t
  misc_feature (3416)..(3416): n is a, c, g, or t
tgggtatcaggactcagcccatttccccctctggtgctgagaaatggaggccgaaggagtgatctagaagtgttaattgagcccctaatctatgctagttactgggggtgttgggggagacaggagagagatcccacggggttccggcctcccagggactcaggtcactaatggaggtggcttggcttgtctatgtgctgggccaacagccactggcgaggcaaggcgagggtcagtcacggctggtgccaggaagagggctggttctttggctccctggtctcccgcggtctagcccaagctggccagcggttgacctggctcccctggccccggccaggcctcgtggacccctcatatgccacacgggacatgagcaggccggccgggagccgggtcccgggagctccacgaaggggcctgtcctccatgaccaggacacccgctgcgccttcctcccgaggcctcccgggcctctccagacgcggcgctactgcagacaccagggccgccaagggagcggactcggagccggccctggggcgggcacatgggccccggcgccccccggcgtctccaagccgcgctgcccgggtcgggccaggccaggggagggacagcagcaggtgacgacggcccggccaccggctataaataggggcgcgcgtcagccgcgggcgggagcggcggcggcgggcaggggcccgggggccggggcctggaggacaggcgaggcagcggcgagtgcggggccggcggtcggggagggcggtgccatggggtcgcggagggcccccanccggggctggggcgcgggtgggcggtcgggggcggggggcgacggtgaggacgacggccccgtgtggatccccagcccagccagccggagctacctgctcagcgtgcggcccgagaccagcttatcaagcaaccggttgtctcaccccagctctggaaggagcaccttctgctccatcattgctcagctcacagaggagacccagccgctatttgagaccacgctcaagtcccggtctgtgtccgaggacagcgacgtcaggttcacctgcatcgtcacaggatacccagagccagaggtgacctggtacaaggatgatacggagctggaccgctactgtggcttgccaaaatatgagatcactcatcagggcaaccgccacacactgcagctgtacaggtgtcgagaagaagatgccgccatctaccaggcctctgcccagaacagcaagggcattgtgtcctgctcaggggtcctggaggtgggcaccatgactgagtacaagatccaccagcgctggttcgccaagttgaagcgcaaggctgcggcaaagctgcgcgagatcgagcagagctggaagcacgagaaggcggtgcctggggaggtcgacactctgcgcaagctcagccccgaccgcttccagcgaaagcggcgattgagcggggctcaagcgccgggcccctcggtccctaccagggagcctgagggtgggaccctggcggcttggcaggagggagagactgagactgctcagcactcaggtttgggcctgatcaacagttttgcttctggagaagtgaccaccaacggggaggctgcccccgagaatggagaggacggagagcatggcttgctgacatacatctgtgacgccatggagctggggcctcagagagccctcaaagaggagagtggggccaagaagaaaaagaaagatgaggaatccaagcaaggcctgcggaagccagagttagagaaggcagcccaaagccgccgttcttcagaaaactgcatccccagctcagacgagcctgactcctgtgggactcaggggcccgtgggcgtggagcaggttcagacccagcccagaggcagggctgcacgggggcctgggtcctctggcacagatagtaccaggaagccagcctctgctgtgggcactccagacaaggcccagaaggcccctggcccaggcccaggccaggaagtgtatttctccttgaaggacatgtacctggagaacacccaggcagtcaggcctcttggggaagagggaccccagaccctgagtgtccgggcgcctggggagagtcccaaggggaaggcacccctcagggctagaagcgagggggtgcctggcgctcctggccagcccacacactccttgaccccccagccgactaggcctttcaacagaaagagatttgcccctccaaagcccaaaggagaggccaccactgacagcaagcccatttcttctctgagtcaagctccagaatgcggggcccagagcttaggaaaggccccacctcaggcctctgtgcaggtgccgacgccccctgcccggcggagacatggcacccgggacagcacgttgcaggggcaagcaggccacaggactccaggagaggtcctggaatgccagacaaccacggctcctaccatgtcggccagcagcagctctgatgtagcctccattggggttagcacttccggaagtcaaggtatcattgaacccatggatatggaaacccaggaggatgggagaacatctgctaaccagagaactggaagcaagaagaatgtgcaggcagatgggaagatacaagtggatggaaggaccaggggagatggaacacagacagcccagaggacacgtgcagataggaagacgcaggtggatgctgggacacaagaaagcaagaggccacagtcagacaggagtgcacagaagggcatgatgacacagggaagggcagagacacagctagaaacaacacaggcaggtgagaagatacaggaagacaggaaggcccaggcagataagggcacacaggaagacagaaggatgcagggagagaaggggatgcagggagagaaggggacgcagtcagaggggagcgcgcccacagccatggaaggtcagtctgagcaagaggtggcaaccagcctcggcccaccatccagaacccccaaactcccacctacagcgggtcctagagctcctctgaatattgaatgttttgtacagaccccagaagggtcttgtttcccaaaaaaacctggttgcctgcccagtgtgtccccacctctcccagcctgtatacccagattactttggtgaactgagagctggagtactgttcattcatttattcattcacccactcattcagcagacatatactgagtgctactttatgccagaccctgggctggcagctgtttggaggcaaagatgtatgaggccatctcaggagagactacttgttaggattcttgagttttgaccaacagaaatgaacttggaccaacttaagcaaggaaaaagcgttcatgggaaggatgctgggatagctcacaaaaccaaaagaatagctgaacaattaattggccntgggaagggtgggagctggggcaactacgaggcttgcctcccaggagctgctgcggttggcagatcaacaccaacttgccattggttctagtgggtccccttccactcaagattcaaattccaagtgaaagaacctggcctggagctcagggcttcatagagtgggaggggggcagtcttccaaaagatgcggactcttgccacatggaatggtggagtacggaagggtggaaagggtttggtaggtaaaccctgaagatgcttctaacacacgtgctgttctcccatctcacgtatgacgactctcccacaggtaaccaaaaccacatttctctctgcttagggaattcaagatcatatctaacttcgaattccaggggtaatgacacggcttctattctccaaagtccagtgtcattagggataatctccctctttcagttttatcacaattccattttgaaattctacaacctgtagattaactggtaaaattaaccatattcaaccaaaattgtataacccagcaagaatggaagaatgggtaaagtctacagtccatttctagaactggtcatgagaactcatgtttatgatgatggacttttgatctggtggagggacccaaaccttcagttctgaagctcattagtggtcctacctgtgtgacaggcatttactattggactggcagtcccaggacaaactccaggaatccccccatgtccatctctactcctgccctcttttacgtagcagcaatcatattttcccttgatagggttcatcattctagatactccgatgacttctttataatgagcctgaagtggcctggtggctgcctcagcttccagttcagttgaatagctactacgtctttgaggatgtgctccttgctgggggactaaactctccacgccagcccagtcccaaacctaaacctcgggtatgagaaaagcattgagatctagcaatagcagggccatgtccacactgcgtcctatccctgaaggagaaacagcgccaggtatggttgccggctccaagcgcatgctgcctcctgcaggcctgacccagcctctcggggtgttgtttctggtgccatagttgaattttcaacaaaccatttcaccaccctctcaagacagctgctgctggtttgtgggttcctgacaagatgagtgaatgcctgcccatcaacccgttactcttcttttagctgtaaagtgaattctctggttgggtgcagtatgtgaggaggtcacatgatgtttatggcatttgagaattccatggatattgatggcaggagaggcatgatgggttagaaaagcaaatccaaatccagaacaagggcccaaaagggccaagacaaattactgcccctctcagagccacaggtgtagacaggtgaaaacactggacagtgagtgagctacccacacacgacccactggtgccttcagagccttagcctggagcgacagtgtaccgttgataatggaacgcactggccatgccagactttatggctaggcggtcagataacactacgaggggcagcatggccaccaagtgtgccagggccaagtgttcaggctctcccagagcccagtggtgagccagaagggcattttgtacaaggataatggttactttttggccagagcatcacttggctccaaatcctgggttcccgtatcatattttcttgtcaggacttaccgcaagctatgtatggctccgcggtatgccacccatggaaagacacctcatgcaccattgacctgccaggtcacgtggcctgatggcagcgtcggctgcacaaaagactttcccagctgcaatgccttcgcctgctctaggcccaccccaaagctggcagccttctaggtcagttggtaaatgggttagaacaagatgccccaaagtggcataaattgcatggaattaggccttagtggcgagggattcgacatacagtcatttgtcctacattgtgaaggaaacattctgacctcaaacagatccctcaaccccagaactttatagaaggggcagaccttggcattttcacatgatttatctcccactctgattcacatatgtttgaccaaggcactgggcagctgccaatttcccgtcccttctgtagtcccagatgaatggatacagacctctttggggaaggctgcaaggaaggttcacaacatgcatctaagtgttaaaataagtttttccttcaaaaatacatttgacttcctctccatttaaggtctggaaatcaagtgggagatcttgactttaccttggcacttgagacagaactgttggcccagaagtctttagttaaggtcattactaggccatatcttaggggcgtctggcctttttcattcctgggacccacagctcgaggtctggtttccatgccctatcccttacgatgagcgccctattttgttccttctgtctatctctgttgctgagatcagggagcccacgttcacagcagctctttcaagcagcctcccaggcctagagaggaaaatcagcagagcctcgtgaatgtatttctcgtggcaagaagggagctcatcttctgggtcctgccagagggcagtgagggggttgatgggctgggtgcatgccagggacccaatcaagcatttttatcttctgaaatctttgaattcctgcctttcttggatgtttggtcttttgatataatttagcatgggccaacatttggtccagatttgtattagccaagccctcctaaaatagtaataacagtatctggcgatttgagcttttacgtagaatgtagaatctctggtgagtgaacatatcaataaagacaacctgaaccaaaaaaaaaac

SEQ ID NO: 43789 - DNA, 7186 bp, Homo sapiens
  misc_feature (799)..(799): n is a, c, g, or t
tgggtatcaggactcagcccatttccccctctggtgctgagaaatggaggccgaaggagtgatctagaagtgttaattgagcccctaatctatgctagttactgggggtgttgggggagacaggagagagatcccacggggttccggcctcccagggactcaggtcactaatggaggtggcttggcttgtctatgtgctgggccaacagccactggcgaggcaaggcgagggtcagtcacggctggtgccaggaagagggctggttctttggctccctggtctcccgcggtctagcccaagctggccagcggttgacctggctcccctggccccggccaggcctcgtggacccctcatatgccacacgggacatgagcaggccggccgggagccgggtcccgggagctccacgaaggggcctgtcctccatgaccaggacacccgctgcgccttcctcccgaggcctcccgggcctctccagacgcggcgctactgcagacaccagggccgccaagggagcggactcggagccggccctggggcgggcacatgggccccggcgccccccggcgtctccaagccgcgctgcccgggtcgggccaggccaggggagggacagcagcaggtgacgacggcccggccaccggctataaataggggcgcgcgtcagccgcgggcgggagcggcggcggcgggcaggggcccgggggccggggcctggaggacaggcgaggcagcggcgagtgcggggccggcggtcggggagggcggtgccatggggtcgcggagggcccccanccggggctggggcgcgggtgggcggtcgggggcggggggcgacggtgaggacgacggccccgtgtggatccccagcccagccagccggagctacctgctcagcgtgcggcccgagaccagcttatcaagcaaccggttgtctcaccccagctctggaaggagcaccttctgctccatcattgctcagctcacagaggagacccagccgctatttgagaccacgctcaagtcccggtctgtgtccgaggacagcgacgtcaggttcacctgcatcgtcacaggatacccagagccagaggtgacctggtacaaggatgatacggagctggaccgctactgtggcttgccaaaatatgagatcactcatcagggcaaccgccacacactgcagctgtacaggtgtcgagaagaagatgccgccatctaccaggcctctgcccagaacagcaagggcattgtgtcctgctcaggggtcctggaggtgggcaccatgactgagtacaagatccaccagcgctggttcgccaagttgaagcgcaaggctgcggcaaagctgcgcgagatcgagcagagctggaagcacgagaaggcggtgcctggggaggtcgacactctgcgcaagctcagccccgaccgcttccagcgaaagcggcgattgagcggggctcaagcgccgggcccctcggtccctaccagggagcctgagggtgggaccctggcggcttggcaggagggagagactgagactgctcagcactcaggtttgggcctgatcaacagttttgcttctggagaagtgaccaccaacggggaggctgcccccgagaatggagaggacggagagcatggcttgctgacatacatctgtgacgccatggagctggggcctcagagagccctcaaagaggagagtggggccaagaagaaaaagaaagatgaggaatccaagcaaggcctgcggaagccagagttagagaaggcagcccaaagccgccgttcttcagaaaactgcatccccagctcagacgagcctgactcctgtgggactcaggggcccgtgggcgtggagcaggttcagacccagcccagaggcagggctgcacgggggcctgggtcctctggcacagatagtaccaggaagccagcctctgctgtgggcactccagacaaggcccagaaggcccctggcccaggcccaggccaggaagtgtatttctccttgaaggacatgtacctggagaacacccaggcagtcaggcctcttggggaagagggaccccagaccctgagtgtccgggcgcctggggagagtcccaaggggaaggcacccctcagggctagaagcgagggggtgcctggcgctcctggccagcccacacactccttgaccccccagccgactaggcctttcaacagaaagagatttgcccctccaaagcccaaaggagaggccaccactgacagcaagcccatttcttctctgagtcaagctccagaatgcggggcccagagcttaggaaaggccccacctcaggcctctgtgcaggtgccgacgccccctgcccggcggagacatggcacccgggacagcacgttgcaggggcaagcaggccacaggactccaggagaggtcctggaatgccagacaaccacggctcctaccatgtcggccagcagcagctctgatgtagcctccattggggttagcacttccggaagtcaaggtatcattgaacccatggatatggaaacccaggaggatgggagaacatctgctaaccagagaactggaagcaagaagaatgtgcaggcagatgggaagatacaagtggatggaaggaccaggggagatggaacacagacagcccagaggacacgtgcagataggaagacgcaggtggatgctgggacacaagaaagcaagaggccacagtcagacaggagtgcacagaagggcatgatgacacagggaagggcagagacacagctagaaacaacacaggcaggtgagaagatacaggaagacaggaaggcccaggcagataagggcacacaggaagacagaaggatgcagggagagaaggggatgcagggagagaaggggacgcagtcagaggggagcgcgcccacagccatggaaggtcagtctgagcaagaggtggcaaccagcctcggcccaccatccagaacccccaaactcccacctacagcgggtcctagagctcctctgaatattgaatgttttgtacagaccccagaagggtcttgtttcccaaaaaaacctggttgcctgcccagatctgaggaggcagtagtaacagcctccaggaaccatgagcaaactgtgctgggtcccctgtcagggaacctcatgctcccagcacagccgccccatgaggggagtgtggagcaggtgggaggagagagatgccgagggccacagtcatcaggcccagtcgaggccaagcaggaggacagcccgttccagtgccccaaggaggagcggccagggggagtgccgtgtatggatcagggtggctgtcctctagctggcctgagccaggaggtacccacgatgccttctcttcctggaactgggctgacagctagcccaaaggcggggccgtgtagcaccccgacttctcagcacgggagcacagccaccttcctgccctctgaggatcaggtcctgatgagttctgccccaacactgcacctggggctggggacccccactcagagtcacccaccagaaaccatggccaccagcagtgagggggcctgcgcccaggtaccagatgtggaggggcggaccccaggtccccggagctgtgaccctggcctcatagattccctgaagaactacctgcttctgctgctgaagctgtccagcacagagacaagtggagcagggggagagtcccaggtgggggcagccaccggaggtctggtgccctcagccactctgacacccactgtggaagtggctgggcttagtccccggacatcgaggcgcatcctggagcgtgtggagaacaaccacctggtgcagagtgcacagaccctgctgctgagcccctgtacctcccgccgcctcaccggcctcctggaccgtgaggtgcaggctggccgccaggcccttgctgctgcccgaggctcctggggtcctggtcccagctccctcactgtccctgccattgtggtagacgaggaggaccctgggctggcctcagaaggagccagtgagggtgaaggagaggtttcccttgaggggcctggcctcctgggggcctctcaggagagcagcatggctggtcgactgggggaggcgggtgggcaggcagcccctggacaggggccctcagcagagagcatagcccaggagccctcccaagaggagaagttcccaggggaggctctgacaggcctcccggcagctacacctgaggaactggctctaggggcccggaggaagagatttctccctaaggtcagagcagcaggagacggggaggcaaccacacctgaagaaagggagagccccacggtttccccccgggggcccaggaaaagcctggtgcctgggtccccagggactccagggcgggagagacgctcccctacgcagggcagaaaggcgagcatgctggaggtgcctcgggcagaggaggagctggcggcaggagacctgggccccagccccaaggccggcggtctggacacagaggtggccctggatgaaggcaagcaggagacactggccaagcccaggaaagccaaagacctgctgaaagccccacaggtgatccggaagattcgggtggagcagtttcctgatgcctccggtagcctgaagctgtggtgccagtttttcaacattcttagtgactcagtcttgacatgggccaaggatcagcgcccagtgggcgaggtgggcaggagcgcaggggatgaggggccggcggccttggccatcgtgcaggcctcccccgtagactgcggtgtgtatcggtgcaccatccacaatgagcacggctcggcctccaccgacttctgcctcagccctgaggtgttgtcaggattcatctccagagaagaaggtgaagttggagaagagattgagatgacccctatggtgtttgctaagggtctggctgactctggctgctggggggacaagctctttgggcgactggtaagcgaggagctccgagggggtggatatgggtgtggccttcggaaggcctcccaggccaaggtcatctacgggctggaacccatcttcgagtcgggccgcacgtgcatcatcaaggtgtccagcctgcttgtgtttgggcccagcagtgagacttctcttgtgggcagaaactacgacgtcaccatccaggggtgcaagatccagaacatgagtcgggagtactgcaaaatcttcgcagcagaagcccgggccgcgcctggctttggggaggtgcctgagatcatcccactgtatctgatctaccggcctgcaaacaatatcccatatgctaccctggaggaagacctgggcaagcccctggagtcttactgttctcgggaatggggctgtgctgaggctccgacagcatctggcagctctgaggccatgcagaaatgccagaccttccaacactggctgtatcagtggacaaatggcagcttccttgtcacagacttggcaggggttgactggaagatgactgatgtgcagattgctaccaaactccgaggataccagggcctcaaggaaagctgcttccctgccctgctggaccggttcgcctcctcccaccagtgcaatgcctactgtgagctgctggggctgacacctctcaagggcccggaggcggcccacccccaagccaaagccaaaggctctaagagtccatctgctggcaggaaaggctcccagctgagtcctcagccccagaagaaaggcctccctagtcctcagggcacccggaagagtgctccaagttccaaggccacccctcaggcctcagagccagtcaccactcagttgttgggacagcctcccacccaagaggagggctccaaggcccagggcatgcggtagcctccgcagaggctgggggcctccacccagcagcagaccaaccaggaagcagcttgaactggatggagactttccaaatatggaactaactggagaaggtgcacgaaggagacaccacttggggacctctctgagcaggctctcgtgaatcagctcgtcatcagatggctttggtgcatggcacatagcccactggcctcttctggtgccactgtcacccagggctcccgggcctcaagcagtccccacctccgagtgcctggcaacctaggccctccttgaagtttacactttgccactgctggaggctcccctgagtcctctgcatgagttctgcaccccaagcccttgccccagcccagtccagcagcagatgttacaatctgagtgaggacatgcaggccaacttttaccctcctgcatttgcctggccctgatctcgcctgtcctcagggatccagacttcctctgctggtctggcctggtgactctcagggtatcttctccttccagctactttcgctcactgatctcagcttatcctgcaactaaccatccttgagcccagatggggctcagggcccttccagagcctgtcatgtccttgtgcagtggcctttgatgtgtgttcacgctcttcccccttcactcactcgcctgcttcccatgctcccttgtaccccctcgccacatccctgtcttggggcccagctgcagcctgctgcctgcccttcatggctctgcacatggccctttgcttgagggctccccactccctgcccaccaatacccaggtgaggaacagaccctctggcctctcaccccacttcagtgctctcttccccaacttctctcgggctctttgctcatgaggtgagagctggtgtgagggttgtgtcagcagctgtagccagagagaggtgttgactctgagagaccttgcactccatactgaaaggaggtggggtcacagtgaatttcacatcccctctcaaccaggagtggagggctaggtcccttccccatggggagtacacttgggtgttctaggagggatgcagtctatccatgcacttgggtggaggggagtctctgtgcctgggaattaggacccctgctccaaccatcgctcttgatcctggggccccagctctgggtcctcatgtatgggctcccaaggacccagcagcctggatccttccagagcatccctcctggaggcctgggatggggtaggtctgcagctagcctactccctttggaatgcaataaaggcagcattgtgtgccctg

SEQ ID NO: 43790 - DNA, 515 bp, Homo sapiens
gctctttgggcgactggtaagcgaggagctccgagggggtggatatgggtgtggccttcggaaggcctcccaggccaaggtcatctacgggctggaacccatcttcgagtcgggccgcacgtgcatcatcaaggtgtccagcctgcttgtgtttgggcccagcagtgagacttctcttgtgggcagaaactacgacgtcaccatccaggtactatgtcccatcttcacaccccattcttttattctctcaccccctcccctttcccagcccaggtcctgttaggatgcccagtatcgaggcagaaggcatctcagtctcaaccttatgaggctcctaggaggaccttgtggaaagcctgagatgcagcccagaattcagatgcttggcctcagagagcttgagagcttcaaaacgacttgggccatagttttcaaactctatgtttgcagcagaaaccttccccctgccccatacataatctctcatggaagccttgtttatatgtgagataaaa

SEQ ID NO: 43791 - DNA, 721 bp, Homo sapiens
agtgtatacagaaaagaagatatattttatttaataaacatccagtgttgaccttttgacaaataattaccattttatattaaatcaagtgagaatcttggaatttttccccctcattttaactcactatgttttacaaacccttccccctcaccttgaccccctcttcctgttgaaaatagtccctctccttccttgtttccttttctttagataatttttgaaaccttttattaagtatttcaagtgggaaggtaagtaatgttagatccttagttcttggagctcagagtctagtgatagataaaaatatgtaaacaaatagttacaacattttgcaacaaagcttagaaagaaacatgatagaagacagtttctgctaatatgacttcaactcaaaattttacggtccagaactgtcttatgatgggcaaagacggaagaaagtggggactgtatcattagttgagaaggtttacagagcactattcccttcagtcagtgttactgagtacctgttctgccttattcactgtgccacatgctggggacagcaggtgaacaacgttggccctcagttactccacagcctattcagggctgtagaaagacaaatagcaatcgcagtgcagccttagagatgtacatgggatacagcaagaatgtggtagccatagtggtgttgccagaagtaattctggagatttaaatctgagtataa

SEQ ID NO: 43792 - DNA, 336 bp, Homo sapiens
ttggctttttaaggtatatagtaatgtcatctacaaatgaataaaatttgttctacttttctgatgtttgtatgtattttgctttctgatctgactgcatagctagaatttacaacacaatattagcttattgtgaagaaagcaagcacattctaatatgtgcatgactttaatagacatgagtttagagttttaatttttaaggtagtatttgatgtatcttgataaatcatgtttatcatgtataaggtttatctgtatccatgttccatggatagaaggtttttctctaatttcttagtgttactgatttcttatttgatgaataggttttta

SEQ ID NO: 43793 - DNA, 1720 bp, Homo sapiens
gcaggatccatttatcattcattggtaaaggatatattccttgttcttaccaagtgtacatttaactcttgctgacatgttcagtgtattttattacttttaatgctgtcttaaaatgaacattctttaaagttggacaggaaggtggcatttcttatttattaacatttttaactttaaacatattgtgactcatctagaccttttaataagacgatcaacttcacacttagggaaaaaattaaaatgtgatggccacttctaataattcaggtagttataagggatctggaagaaatccagtctttatgaatatactattagttgggcattaaaaaatcagtatatattttaactttttgtgacatgctaacacattttcagaataattattgcatagtagaatttattactccagaacagaaagaccttacttcatttcaaatgaagttaattaatttacatttctgggtaaaaactggttctataaattaagtagagtagcttctttatgataaagacaattttctgaaaagtgaacaattctgttaaaagaactttattgatgtgtagatttcgcactttatttctgagactgcgttcatgtagttgttccccaatgtttgagtactaagagaacttgagaaaattacttcataaacatatggaaactgaaaatggactctctttgtgacaaagatattcaacagaaaatattgaccctgcattgcaaaacacaggttcgggttccctaagtcccacagtgtaatgattacaaatatcctagtgtccggtctagaaagactttctagggagaagactagtggaattttctaaaggtttagttttagcttttataacttaaatttggccctgttacggtctttttaatttggaaccataagggtatctcccctcccttcaggaataacttattggaaaactgaaaagaatcactgaatggaatgttcattttatggcagttgttttaagttttaaaatacacagaggaaaatattgtggaaggacctctttgttgctttcccttctaagttgtcttcttcttcttcttcttcttcttcttcttcttctttggtccttaagtgaaataaagactctaaaactaatttgtatattatcagccagagatgcggatggcagtcgagccaaatcgcatggctttcagatcaggtattctgcacattcattccaaggtcatagatttttaaaaggacctggatttgaagagatggcaaatgatgagccatcagaaaacttaatttggaaaacatgtatgtagccagtgtggatattgtggcctctctcaagacacattgacactgtagacttcattcagtccagtgtgagtattttggagtaggttggatgtagattttgtttttatcgttgatttgtaccgacagaaatagacatttcatcatgtaaaattcctgttattctggaaaaacctattgttttgatcttcttgttttctgacttggaagtatcctttcaaaaaaactcttaagatatctaggtctaaaaagcacttcatgagatgctaaagctgacccactggttgaaaatgttgaccctatcctgttatttaaatgtgaacatttattgtacattcagtgagttatagtgttaatagtcttgtgctatgcagcaggtgtaaaaattaataaatatattttttaataaacatgtttgtatgtgt

SEQ ID NO: 43794 - DNA, 413 bp, Homo sapiens
tcgctcccagatacagggatgagtaactggaagtgggcataaaagagtaggggcgtgaattaagaacgcactggatctgcgcggcagagggaggagagagcgaaatttggcggatttggagcagaaatgcacagcggtattgatgagtagatccttggattcagaggttggctgaaacgcaccatgcctgcttccatcttttgctctgtaaagttgtgaattgctcatgcctatagggaggaaggatggcacatgggattccttctcaaggcaaagttaccataacggtggatgagtacagctcaaaccccacccaggcattcacgcactacaacatcaaccagagcagattccagcctccacatgtacatatgtaagtatcgcttatgaacttaacaaaattagcaatcaag

SEQ ID NO: 43795 - DNA, 2371 bp, Homo sapiens
tcgctcccagatacagggatgagtaactggaagtgggcataaaagagtaggggcgtgaattaagaacgcactggatctgcgcggcagagggaggagagagcgaaatttggcggatttggagcagaaatgcacagcggtattgatgagtagatccttggattcagaggttggctgaaacgcaccatgcctgcttccatcttttgctctgtaaagttgtgaattgctcatgcctatagggaggaaggatggcacatgggattccttctcaaggcaaagttaccataacggtggatgagtacagctcaaaccccacccaggcattcacgcactacaacatcaaccagagcagattccagcctccacatgtacatatggtcgaccccatcccatatgacactccaaaaccagcgggccacacgcggtttgtctgcatctcagacacacactccagaacagatggtatccagatgccttatggggacatccttctccacacaggcgatttcaccgagctgggactgccctcagaggttaagaagtttaatgactggttaggaaacctgccatatgaatataaaatagtgattgctgggaatcatgaactgacatttgataaggaattcatggcagaccttgttaaacaggactactaccgtttcccctctgtgtccaaattgaaaccagaggactttgacaatgttcagtccctcctgacaaacagtatttacttacaagattcggaggtaacagtgaagggattcaggatatacggtgcaccttggaccccgtggtttaatggatggggctttaacctacccagaggtcagtctctgctggacaagtggaacctcatccctgagggcattgacatactcatgacacatggacctcctctaggttttcgagactgggttccaaaggagcttcaaagagtgggctgtgtggagctgttaaacacggttcagaggcgagtccggcccaagctccatgtgtttggtggaatccatgaaggttatggcatcatgaccgacggttacacaacgtacatcaatgcctcgacgtgtacagtcagctttcaaccgaccaaccctccaattatatttgaccttccaaacccacagggttcctgaagctctaaatgccctattggaatgtgagggaaggtctataaactgccatttttctaattataaacttacattctcttacttatttacaaaccctgtgagttctttttgtaaattgttggaacacaaatgatgctagaggttgtgcttcttattttattttattttaaatggggcatccatttgaaatcagaggaacattgtgaatttgtaaaatgacttctgttttctcaaaggccatgccattgtaaattgttagtgttcgccaaaggacagccaagctttcttttaaaaagtgataaaagtcttattttaatatgctttaagctgaaagaaaaaaaaataagaaacaggcagtgttttaaaaaccaacacagatttgcacaactgtttaagagtattgtttgaaatattttaattttcaatgttttgttgttgttgttttcttggtaatgcttcttttttgcagatgtggtcccaatttatagcaatcttctcaacagaagtaggcatggaaaagacttcttttcatactctcactataaagaaagctgcattgagaagaaaatggctgtcatttaaaggatggtttaactagtgagattcctattgtggttatacaaggtctcattgtttgtttgtttcttttaaattatttcagctttaaaaatacagaaatggaatctgtcaagagcaggtatttcatacggttaaaaaaatgaacatgcagactccttttcaatatgggtttatatatataagtattttttgtgtattatgactacgttaggagtttattattgtcaaggacagtacaactgcaaagggatgctgtatagcagcacatcagaagtcggaaggaactgacacattctctcagagctcaaggtcttaaagagcttgagttaaatctaggtacagttacaggcatgtatagacttaaatggatgcaatggaagctaactaaaataaggcttagttgtcctttctatttaaataccccaagttgtcttcttacttcctctcccctctcccattttgcactgtgtgtcgatgcaatcttcgctagcacaaaatattgtcgctaatagtcatttctgttttcccattgtaaatgctgttgagctttattctattttatgttactttgttaatgaaatttaggaaagcagttgtttctttaaatttattgtgatattctatatctagcggcctttatatgcaaataaaattgcaagattttt

SEQ ID NO: 43796 - DNA, 2309 bp, Homo sapiens
agcagtgccagcaggagcggcggccgaggaggtgacggaggtggcaacgggggactgagcgaaaatgcacagcggtattgatgagtagatccttggattcagaggttggctgaaacgcaccatgcctgcttccatcttttgctctgtaaagttgtgaattgctcatgcctatagggaggaaggatggcacatgggattccttctcaaggcaaagttaccataacggtggatgagtacagctcaaaccccacccaggcattcacgcactacaacatcaaccagagcagattccagcctccacatgtacatatggtcgaccccatcccatatgacactccaaaaccagcgggccacacgcggtttgtctgcatctcagacacacactccagaacagatggtatccagatgccttatggggacatccttctccacacaggcgatttcaccgagctgggactgccctcagaggttaagaagtttaatgactggttaggaaacctgccatatgaatataaaatagtgattgctgggaatcatgaactgacatttgataaggaattcatggcagaccttgttaaacaggactactaccgtttcccctctgtgtccaaattgaaaccagaggactttgacaatgttcagtccctcctgacaaacagtatttacttacaagattcggaggtaacagtgaagggattcaggatatacggtgcaccttggaccccgtggtttaatggatggggctttaacctacccagaggtcagtctctgctggacaagtggaacctcatccctgagggcattgacatactcatgacacatggacctcctctaggttttcgagactgggttccaaaggagcttcaaagagtgggctgtgtggagctgttaaacacggttcagaggcgagtccggcccaagctccatgtgtttggtggaatccatgaaggttatggcatcatgaccgacggttacacaacgtacatcaatgcctcgacgtgtacagtcagctttcaaccgaccaaccctccaattatatttgaccttccaaacccacagggttcctgaagctctaaatgccctattggaatgtgagggaaggtctataaactgccatttttctaattataaacttacattctcttacttatttacaaaccctgtgagttctttttgtaaattgttggaacacaaatgatgctagaggttgtgcttcttattttattttattttaaatggggcatccatttgaaatcagaggaacattgtgaatttgtaaaatgacttctgttttctcaaaggccatgccattgtaaattgttagtgttcgccaaaggacagccaagctttcttttaaaaagtgataaaagtcttattttaatatgctttaagctgaaagaaaaaaaaataagaaacaggcagtgttttaaaaaccaacacagatttgcacaactgtttaagagtattgtttgaaatattttaattttcaatgttttgttgttgttgttttcttggtaatgcttcttttttgcagatgtggtcccaatttatagcaatcttctcaacagaagtaggcatggaaaagacttcttttcatactctcactataaagaaagctgcattgagaagaaaatggctgtcatttaaaggatggtttaactagtgagattcctattgtggttatacaaggtctcattgtttgtttgtttcttttaaattatttcagctttaaaaatacagaaatggaatctgtcaagagcaggtatttcatacggttaaaaaaatgaacatgcagactccttttcaatatgggtttatatatataagtattttttgtgtattatgactacgttaggagtttattattgtcaaggacagtacaactgcaaagggatgctgtatagcagcacatcagaagtcggaaggaactgacacattctctcagagctcaaggtcttaaagagcttgagttaaatctaggtacagttacaggcatgtatagacttaaatggatgcaatggaagctaactaaaataaggcttagttgtcctttctatttaaataccccaagttgtcttcttacttcctctcccctctcccattttgcactgtgtgtcgatgcaatcttcgctagcacaaaatattgtcgctaatagtcatttctgttttcccattgtaaatgctgttgagctttattctattttatgttactttgttaatgaaatttaggaaagcagttgtttctttaaatttattgtgatattctatatctagcggcctttatatgcaaataaaattgcaagattttt

SEQ ID NO: 43797 - DNA, 2642 bp, Homo sapiens
cgccggggagcgcgcacggagcggcgcctcggccgcctgcttcctggagctgtgctcctttgaccccagtggcagtccctgtcactgcaccgctcgctctccctccggctcgccgcgccctcgctccctctcctcgccccctcgctcgctctctccccagatcgaggctgctcgggtcctttctccccccgcctccctctagcgccgcgccccctggcccccagccccagcctgcggcgggacctccggggtcgaaggttctggcccgctcgcgcccctcgccgcccccgcgcgcccccagcgctcctccagccggctcgggccgctcggctatggatcgcctgctcgccgggcgctgaaggcatccccgggatccggagcgcagcccgggaaagaaatgcacagcggtattgatgagtagatccttggattcagaggttggctgaaacgcaccatgcctgcttccatcttttgctctgtaaagttgtgaattgctcatgcctatagggaggaaggatggcacatgggattccttctcaaggcaaagttaccataacggtggatgagtacagctcaaaccccacccaggcattcacgcactacaacatcaaccagagcagattccagcctccacatgtacatatggtcgaccccatcccatatgacactccaaaaccagcgggccacacgcggtttgtctgcatctcagacacacactccagaacagatggtatccagatgccttatggggacatccttctccacacaggcgatttcaccgagctgggactgccctcagaggttaagaagtttaatgactggttaggaaacctgccatatgaatataaaatagtgattgctgggaatcatgaactgacatttgataaggaattcatggcagaccttgttaaacaggactactaccgtttcccctctgtgtccaaattgaaaccagaggactttgacaatgttcagtccctcctgacaaacagtatttacttacaagattcggaggtaacagtgaagggattcaggatatacggtgcaccttggaccccgtggtttaatggatggggctttaacctacccagaggtcagtctctgctggacaagtggaacctcatccctgagggcattgacatactcatgacacatggacctcctctaggttttcgagactgggttccaaaggagcttcaaagagtgggctgtgtggagctgttaaacacggttcagaggcgagtccggcccaagctccatgtgtttggtggaatccatgaaggttatggcatcatgaccgacggttacacaacgtacatcaatgcctcgacgtgtacagtcagctttcaaccgaccaaccctccaattatatttgaccttccaaacccacagggttcctgaagctctaaatgccctattggaatgtgagggaaggtctataaactgccatttttctaattataaacttacattctcttacttatttacaaaccctgtgagttctttttgtaaattgttggaacacaaatgatgctagaggttgtgcttcttattttattttattttaaatggggcatccatttgaaatcagaggaacattgtgaatttgtaaaatgacttctgttttctcaaaggccatgccattgtaaattgttagtgttcgccaaaggacagccaagctttcttttaaaaagtgataaaagtcttattttaatatgctttaagctgaaagaaaaaaaaataagaaacaggcagtgttttaaaaaccaacacagatttgcacaactgtttaagagtattgtttgaaatattttaattttcaatgttttgttgttgttgttttcttggtaatgcttcttttttgcagatgtggtcccaatttatagcaatcttctcaacagaagtaggcatggaaaagacttcttttcatactctcactataaagaaagctgcattgagaagaaaatggctgtcatttaaaggatggtttaactagtgagattcctattgtggttatacaaggtctcattgtttgtttgtttcttttaaattatttcagctttaaaaatacagaaatggaatctgtcaagagcaggtatttcatacggttaaaaaaatgaacatgcagactccttttcaatatgggtttatatatataagtattttttgtgtattatgactacgttaggagtttattattgtcaaggacagtacaactgcaaagggatgctgtatagcagcacatcagaagtcggaaggaactgacacattctctcagagctcaaggtcttaaagagcttgagttaaatctaggtacagttacaggcatgtatagacttaaatggatgcaatggaagctaactaaaataaggcttagttgtcctttctatttaaataccccaagttgtcttcttacttcctctcccctctcccattttgcactgtgtgtcgatgcaatcttcgctagcacaaaatattgtcgctaatagtcatttctgttttcccattgtaaatgctgttgagctttattctattttatgttactttgttaatgaaatttaggaaagcagttgtttctttaaatttattgtgatattctatatctagcggcctttatatgcaaataaaattgcaagattttt

SEQ ID NO: 43798 - DNA, 2529 bp, Homo sapiens
tcgctcccagatacagggatgagtaactggaagtgggcataaaagagtaggggcgtgaattaagaacgcactggatctgcgcggcagagggaggagagagcgaaatttggcggatttggagcagaaatgcacagcggtattgatgagtagatccttggattcagaggttggctgaaacgcaccatgcctgcttccatcttttgctctgtaaagttgtgaattgctcatgcctatagggaggaaggatggcacatgggattccttctcaaggcaaagttaccataacggtggatgagtacagctcaaaccccacccaggcattcacgcactacaacatcaaccagagcagattccagcctccacatgtacatatggtcgaccccatcccatatgacactccaaaaccagcgggccacacgcggtttgtctgcatctcagacacacactccagaacagatggtatccagatgccttatggggacatccttctccacacaggcgatttcaccgagctgggactgccctcagaggttaagaagtttaatgactggttaggaaacctgccatatgaatataaaatagtgattgctgggaatcatgaactgacatttgataaggaattcatggcagaccttgttaaacaggactactaccgtttcccctctgtgtccaaattgaaaccagaggactttgacaatgttcagtccctcctgacaaacagtatttacttacaagattcggaggtaacagtgaagggattcaggatatacggtgcaccttggaccccgtggtttaatggatggggctttaacctacccagaggtcagtctctgctggacaagtggaacctcatccctgagggcattgacatactcatgacacatggacctcctctaggttttcgagactgggttccaaaggagcttcaaagagtgggctgtgtggagctgttaaacacggttcagaggcgagtccggcccaagctccatgtgtttggtggaatccatgaaggttatggcatcatgaccgacggttacacaacgtacatcaatgcctcgacgtgtacagtcagctttcaaccgaccaaccctccaattatatttgaccttccaaacccacagggttcctgaagctctaaatgccctattggaatgtgagggaaggtctataaactgccatttttctaattataaacttacattctcttacttatttacaaaccctgtgagttctttttgtaaattgttggaacacaaatgatgctagaggttgtgcttcttattttattttattttaaatggggcatccatttgaaatcagaggaacattgtgaatttgtaaaatgacttctgttttctcaaaggccatgccattgtaaattgttagtgttcgccaaaggacagccaagctttcttttaaaaagtgataaaagtcttattttaatatgctttaagctgaaagaaaaaaaaataagaaacaggcagtgttttaaaaaccaacacagatttgcacaactgtttaagagtattgtttgaaatattttaattttcaatgttttgttgttgttgttttcttggtaatgcttcttttttgcagatgtggtcccaatttatagcaatcttctcaacagaagtaggcatggaaaagacttcttttcatactctcactataaagaaagctgcattgagaagaaaatggctgtcatttaaaggatggtttaactagtgagattcctattgtggttatacaaggtctcattgtttgtttgtttcttttaaattatttcagctttaaaaatacagaaatggaatctgtcaagagcaggtatttcatacggttaaaaaaatgaacatgcagactccttttcaatatgggtttatatatataagtattttttgtgtattatgactacgttaggagtttattattgtcaaggacagtacaactgcaaagggatgctgtatagcagcacatcagaagtcggaaggaactgacacattctctcagagctcaaggtcttaaagagcttgagttaaatctaggtacagttacaggcatgtatagacttaaatggatgcaatggaagctaactaaaataaggcttagttgtcctttctatttaaataccccaagttgtcttcttacttcctctcccctctcccattttgcactgtgtgtcgatgcaatcttcgctagcacaaaatattgtcgctaatagtcatttctgttttcccattgtaaatgctgttgagctttattctattttatgttactttgttaatgaaatttaggaaagcagttgtttctttaaatttattgtgatattctatatctagcggcctttatatgcaaataaaattgcaagatttttaaattcgtgctgtttagagggttggatggtggaggatggtagtttcgtcctggggaaggagggatttattcatatgcaacatcagtaatgcctttcagaagaattagaataagtgatttttttccctaattttcaataaatttttattacccaccatt

SEQ ID NO: 43799 - DNA, 2618 bp, Homo sapiens
cgccggggagcgcgcacggagcggcgcctcggccgcctgcttcctggagctgtgctcctttgaccccagtggcagtccctgtcactgcaccgctcgctctccctccggctcgccgcgccctcgctccctctcctcgccccctcgctcgctctctccccagatcgaggctgctcgggtcctttctccccccgcctccctctagcgccgcgccccctggcccccagccccagcctgcggcgggacctccggggtcgaaggttctggcccgctcgcgcccctcgccgcccccgcgcgcccccagcgctcctccagccggctcgggccgctcggctatggatcgcctgctcgccgggcgctgaaggcatccccgggatccggagcgcagcccgggaaagaaatgcacagcggtattgatgagtagatccttggattcagaggttggctgaaacgcaccatgcctgcttccatcttttgctctgtaaagttgtgaattgctcatgcctatagggaggaaggatggcacatgggattccttctcaaggcaaagttaccataacggtggatgagtacagctcaaaccccacccaggcattcacgcactacaacatcaaccagagcagattccagcctccacatgtacatatgaaacctgccatatgaatataaaatagtgattgctgggaatcatgaactgacatttgataaggaattcatggcagaccttgttaaacaggactactaccgtttcccctctgtgtccaaattgaaaccagaggactttgacaatgttcagtccctcctgacaaacagtatttacttacaagattcggaggtaacagtgaagggattcaggatatacggtgcaccttggaccccgtggtttaatggatggggctttaacctacccagaggtcagtctctgctggacaagtggaacctcatccctgagggcattgacatactcatgacacatggacctcctctaggttttcgagactgggttccaaaggagcttcaaagagtgggctgtgtggagctgttaaacacggttcagaggcgagtccggcccaagctccatgtgtttggtggaatccatgaaggttatggcatcatgaccgacggttacacaacgtacatcaatgcctcgacgtgtacagtcagctttcaaccgaccaaccctccaattatatttgaccttccaaacccacagggttcctgaagctctaaatgccctattggaatgtgagggaaggtctataaactgccatttttctaattataaacttacattctcttacttatttacaaaccctgtgagttctttttgtaaattgttggaacacaaatgatgctagaggttgtgcttcttattttattttattttaaatggggcatccatttgaaatcagaggaacattgtgaatttgtaaaatgacttctgttttctcaaaggccatgccattgtaaattgttagtgttcgccaaaggacagccaagctttcttttaaaaagtgataaaagtcttattttaatatgctttaagctgaaagaaaaaaaaataagaaacaggcagtgttttaaaaaccaacacagatttgcacaactgtttaagagtattgtttgaaatattttaattttcaatgttttgttgttgttgttttcttggtaatgcttcttttttgcagatgtggtcccaatttatagcaatcttctcaacagaagtaggcatggaaaagacttcttttcatactctcactataaagaaagctgcattgagaagaaaatggctgtcatttaaaggatggtttaactagtgagattcctattgtggttatacaaggtctcattgtttgtttgtttcttttaaattatttcagctttaaaaatacagaaatggaatctgtcaagagcaggtatttcatacggttaaaaaaatgaacatgcagactccttttcaatatgggtttatatatataagtattttttgtgtattatgactacgttaggagtttattattgtcaaggacagtacaactgcaaagggatgctgtatagcagcacatcagaagtcggaaggaactgacacattctctcagagctcaaggtcttaaagagcttgagttaaatctaggtacagttacaggcatgtatagacttaaatggatgcaatggaagctaactaaaataaggcttagttgtcctttctatttaaataccccaagttgtcttcttacttcctctcccctctcccattttgcactgtgtgtcgatgcaatcttcgctagcacaaaatattgtcgctaatagtcatttctgttttcccattgtaaatgctgttgagctttattctattttatgttactttgttaatgaaatttaggaaagcagttgtttctttaaatttattgtgatattctatatctagcggcctttatatgcaaataaaattgcaagatttttaaattcgtgctgtttagagggttggatggtggaggatggtagtttcgtcctggggaaggagggatttattcatatgcaacatcagtaatgcctttcagaagaattagaataagtgatttttttccctaattttcaataaatttttattacccaccatt

SEQ ID NO: 43800 - DNA, 1888 bp, Homo sapiens
gatgatcttgattgtgtcatggtcaacccagaattatgacagtctgggaagattaggaggagaataaactgctacttaaaccttttctcagcagcattggaaagcatgtgtttccagcaataactcctgggaactatttggaccccgtggtttaatggatggggctttaacctacccagaggtcagtctctgctggacaagtggaacctcatccctgagggcattgacatactcatgacacatggacctcctctaggttttcgagactgggttccaaaggagcttcaaagagtgggctgtgtggagctgttaaacacggttcagaggcgagtccggcccaagctccatgtgtttggtggaatccatgaaggttatggcatcatgaccgacggttacacaacgtacatcaatgcctcgacgtgtacagtcagctttcaaccgaccaaccctccaattatatttgaccttccaaacccacagggttcctgaagctctaaatgccctattggaatgtgagggaaggtctataaactgccatttttctaattataaacttacattctcttacttatttacaaaccctgtgagttctttttgtaaattgttggaacacaaatgatgctagaggttgtgcttcttattttattttattttaaatggggcatccatttgaaatcagaggaacattgtgaatttgtaaaatgacttctgttttctcaaaggccatgccattgtaaattgttagtgttcgccaaaggacagccaagctttcttttaaaaagtgataaaagtcttattttaatatgctttaagctgaaagaaaaaaaaataagaaacaggcagtgttttaaaaaccaacacagatttgcacaactgtttaagagtattgtttgaaatattttaattttcaatgttttgttgttgttgttttcttggtaatgcttcttttttgcagatgtggtcccaatttatagcaatcttctcaacagaagtaggcatggaaaagacttcttttcatactctcactataaagaaagctgcattgagaagaaaatggctgtcatttaaaggatggtttaactagtgagattcctattgtggttatacaaggtctcattgtttgtttgtttcttttaaattatttcagctttaaaaatacagaaatggaatctgtcaagagcaggtatttcatacggttaaaaaaatgaacatgcagactccttttcaatatgggtttatatatataagtattttttgtgtattatgactacgttaggagtttattattgtcaaggacagtacaactgcaaagggatgctgtatagcagcacatcagaagtcggaaggaactgacacattctctcagagctcaaggtcttaaagagcttgagttaaatctaggtacagttacaggcatgtatagacttaaatggatgcaatggaagctaactaaaataaggcttagttgtcctttctatttaaataccccaagttgtcttcttacttcctctcccctctcccattttgcactgtgtgtcgatgcaatcttcgctagcacaaaatattgtcgctaatagtcatttctgttttcccattgtaaatgctgttgagctttattctattttatgttactttgttaatgaaatttaggaaagcagttgtttctttaaatttattgtgatattctatatctagcggcctttatatgcaaataaaattgcaagatttttaaattcgtgctgtttagagggttggatggtggaggatggtagtttcgtcctggggaaggagggatttattcatatgcaacatcagtaatgcctttcagaagaattagaataagtgatttttttccctaattttcaataaatttttattacccaccatt

SEQ ID NO: 43801 - DNA, 1800 bp, Homo sapiens
agtgaccaggggaagagttttgcagaaatttcttcctgaactgataaggaaggaccccgtggtttaatggatggggctttaacctacccagaggtcagtctctgctggacaagtggaacctcatccctgagggcattgacatactcatgacacatggacctcctctaggttttcgagactgggttccaaaggagcttcaaagagtgggctgtgtggagctgttaaacacggttcagaggcgagtccggcccaagctccatgtgtttggtggaatccatgaaggttatggcatcatgaccgacggttacacaacgtacatcaatgcctcgacgtgtacagtcagctttcaaccgaccaaccctccaattatatttgaccttccaaacccacagggttcctgaagctctaaatgccctattggaatgtgagggaaggtctataaactgccatttttctaattataaacttacattctcttacttatttacaaaccctgtgagttctttttgtaaattgttggaacacaaatgatgctagaggttgtgcttcttattttattttattttaaatggggcatccatttgaaatcagaggaacattgtgaatttgtaaaatgacttctgttttctcaaaggccatgccattgtaaattgttagtgttcgccaaaggacagccaagctttcttttaaaaagtgataaaagtcttattttaatatgctttaagctgaaagaaaaaaaaataagaaacaggcagtgttttaaaaaccaacacagatttgcacaactgtttaagagtattgtttgaaatattttaattttcaatgttttgttgttgttgttttcttggtaatgcttcttttttgcagatgtggtcccaatttatagcaatcttctcaacagaagtaggcatggaaaagacttcttttcatactctcactataaagaaagctgcattgagaagaaaatggctgtcatttaaaggatggtttaactagtgagattcctattgtggttatacaaggtctcattgtttgtttgtttcttttaaattatttcagctttaaaaatacagaaatggaatctgtcaagagcaggtatttcatacggttaaaaaaatgaacatgcagactccttttcaatatgggtttatatatataagtattttttgtgtattatgactacgttaggagtttattattgtcaaggacagtacaactgcaaagggatgctgtatagcagcacatcagaagtcggaaggaactgacacattctctcagagctcaaggtcttaaagagcttgagttaaatctaggtacagttacaggcatgtatagacttaaatggatgcaatggaagctaactaaaataaggcttagttgtcctttctatttaaataccccaagttgtcttcttacttcctctcccctctcccattttgcactgtgtgtcgatgcaatcttcgctagcacaaaatattgtcgctaatagtcatttctgttttcccattgtaaatgctgttgagctttattctattttatgttactttgttaatgaaatttaggaaagcagttgtttctttaaatttattgtgatattctatatctagcggcctttatatgcaaataaaattgcaagatttttaaattcgtgctgtttagagggttggatggtggaggatggtagtttcgtcctggggaaggagggatttattcatatgcaacatcagtaatgcctttcagaagaattagaataagtgatttttttccctaattttcaataaatttttattacccaccatt

SEQ ID NO: 43802 - DNA, 1334 bp, Homo sapiens
cgccggggagcgcgcacggagcggcgcctcggccgcctgcttcctggagctgtgctcctttgaccccagtggcagtccctgtcactgcaccgctcgctctccctccggctcgccgcgccctcgctccctctcctcgccccctcgctcgctctctccccagatcgaggctgctcgggtcctttctccccccgcctccctctagcgccgcgccccctggcccccagccccagcctgcggcgggacctccggggtcgaaggttctggcccgctcgcgcccctcgccgcccccgcgcgcccccagcgctcctccagccggctcgggccgctcggctatggatcgcctgctcgccgggcgctgaaggcatccccgggatccggagcgcagcccgggaaagaaatgcacagcggtattgatgagtagatccttggattcagaggttggctgaaacgcaccatgcctgcttccatcttttgctctgtaaagttgtgaattgctcatgcctatagggaggaaggatggcacatgggattccttctcaaggcaaagttaccataacggtggatgagtacagctcaaaccccacccaggcattcacgcactacaacatcaaccagagcagattccagcctccacatgtacatatgaaacctgccatatgaatataaaatagtgattgctgggaatcatgaactgacatttgataaggaattcatggcagaccttgttaaacaggactactaccgtttcccctctgtgtccaaattgaaaccagaggactttgacaatgttcagtccctcctgacaaacagtatttacttacaagattcggaggtaacagtgaagggattcaggatatacggtgcaccttgtgaccacaagtgaagctgaggtggctttgggcagcattaagtgaacaaaaagggcaaaatgagaagaggcaggaaatgggaaaagttttacggctccctcctacttcccacatttctttgaggccgaattaattggtgtgattccattctcaatttaagaaatcaaggttaaatgacttgcccacaattgcattgagctggaactagggcataggtctgctgtctccagatctccagctgacttcccacggcagcctgtcagtcagtgaaattaatctgcagtcattcgcagacacctgaaaatgtcccctcccacccctcaaattgcataataatgagtcctacagcagaaaacagttgtattctttcaaaagtttctctaatgtttttgaaatacacaaggaaatagtaaaagttaagtgaacatttgaaatacaggcttcttttatcattaaaataacgtc

SEQ ID NO: 43803 - DNA, 880 bp, Homo sapiens
agcagtgccagcaggagcggcggccgaggaggtgacggaggtggcaacgggggactgagcgaaaatgcacagcggtattgatgagtagatccttggattcagaggttggctgaaacgcaccatgcctgcttccatcttttgctctgtaaagttgtgaattgctcatgcctatagggaggaaggatggcacatgggattccttctcaaggcaaagttaccataacggtggatgagtacagctcaaaccccacccaggcattcacgcactacaacatcaaccagagcagattccagcctccacatgtacatatggtcgaccccatcccatatgacactccaaaaccagcgggccacacgcggtttgtctgcatctcagacacacactccagaacagatggtatccagatgccttatggggacatccttctccacacaggcgatttcaccgagctgggactgccctcagaggttaagaagtttaatgactggttaggaaacctgccatatgaatataaaatagtgattgctgggaatcatgaactgacatttgataaggaattcatggcagaccttgttaaacaggactactaccgtttcccctctgtgtccaaattgaaaccagaggactttgacaatgttcagtccctcctgacaaacagtatttacttacaagattcggaggtaacagtgaagggattcaggatatacggtgcaccttggtaagtgatgattcaaacagttttccacattgctttttagctcagtaccaagaaaacacagctcagatttagatgctttaaatgaaaatgattaggatgaaaggaaaccttattgctgtatttccaacaaaatacatactgtactgctgcaaaatgcaaca

SEQ ID NO: 43804 - DNA, 358 bp, Homo sapiens
ggtcgaccccatcccatatgacactccaaaaccagcgggccacacgcggtttgtctgcatctcagacacacactccagaacagatggtatccagatgccttatggggacatccttctccacacaggcgatttcaccgagctgggactgccctcagaggttaagaagtttaatgactggttaggtaaggaatgattgcgttctggcggccccaattaacctttcccgtccgagtgtcactcactgcgtcctaattgaattagagcacttggaagccagctcagccatttctcgtatgatatgcggtggtgtctagctttaatccaattctgttaattaaagatgaatttttagatattt

SEQ ID NO: 43805 - DNA, 497 bp, Homo sapiens
caaaaaaaaaaaaaaaaaaattgagaactgaacccattttcttttttaaagacagggtctcccaggctggagcgcagcgtatgatcctagctcactgcagcatcaaactcttggattcaagtgatcctcctgtctcagcctcccaagcagctggaaccacaggcatgcaccaccatacccagctaattttttcttttttctttttttttttgtagagacgggacctcattttttgacccaagctgctttcaaactcctggcctcccaaacagatctccaattaccattaccccaaatcagaaactggatcccaggctatatcaccaaacaagaccaccagattcccaatctgtcacttccaaccagccagctggatcccagactgtcaccaaaatagacaagacctttggtctctgtccccttgatgagacagcaagccctccaatttctcctaccccaaaccaaacctcgaatctcaaggttgttcaggagagaca

SEQ ID NO: 43806 - DNA, 284 bp, Homo sapiens
aattgcttgaacctggggggatggaggttgcaagtcacagtgagcagagattgcaccacttcactccagcctgggcaaaagagcaaaactccgtctcaaaataaataaataaataaaaatagaacaggccatgctgtagctccttaatgtaataatacactttatgtgatttttttcactatgtaggacaatgggttctttctctttcatacataaaaatattagtaaaaagaagatgtcaaaatattttggccctattttcagcagataaaacgagagagaaa

SEQ ID NO: 43807 - DNA, 447 bp, Homo sapiens
atatgtatgtttacattctgatttgctgatatttattgtaatacagcatacatatgaaagagtacagaaattatacatgcacagctcagcaagttttcatcaatttaacatacctgtgtaattggcaccagaaatatgaaacattattatttctcacccatcttatagaattatagattagtaccatctgtttttgaaatttgtatgaatgaaaccatatgatatctatttatttgtatgtatcttatttcatgcaacttaatgattttgagattcattgatgctgttgtgtgcagcagtggtttgttcttttttcatttctcagtagtatttcattgtatgactataccataatttatttactctttctaagactgatggacatttgggtcatgttcagtttttggctattaataataatcatacaattaaaataataaaagctgt

SEQ ID NO: 43808 - DNA, 2257 bp, Homo sapiens
ggctgcttgggaggcgcgggctgcttggggggcggcgcggcggggcccgcgggctgctcggcgctgccggccgcgttgcccatggtggtccccacccagccggccaggcgcctccagcctcggaaatccagctttccgggggacggggacgaggctcccggcccgggcgggggcgagggggcagcggctggcggtggcggcgggggtctcggcagcggggggcgctcggctcagcggcgcgcaggggccggagcgcggcgtcccatcggggcggccccgtccgtgggaccgggcggcgagctgcagggttgggggaggaagtcaggctgcaggccgccggggccagagggctgggccgggggcaggaagctgcggcgctggctcccccctcggcgattttcgaacttctgctgtcgctccccgtgcgcgcaaaccgcagttcgccgccgccgccgccgggcacccagccccaggggggcgggctggagggagggggcgggcgctggccgggggacccccgcaaccatggcgggcggggagtgggctgccgagccgcttcacctgccgcagagggggcggccggcgccgcttcacctgccggagcgggaggccaccgaggcgaggccgaggcggcggcgcgctcggcggcgcctccgggtcctagaaccgcatcctcccgctcgcctcgggcgagggattggccgggtctgggtgaaggggatcacggcctggggattggaggggcacatcttctccgcaccgaggatctcagcgactgcgagcacggctcggagacccacggtggtgcagcgttggggcgccagggctgcgttcccgtctcgcgtcccggactgagaaggtgggaacccccttccaggccccccaccttttatttctctcctcccctgcttagcccagagacgagctgaggacgagggggagccatctccaaacaggaactcctaaacagggtggggggcgcggacgcaggccagtggagacccccgccacctgtcccacctcgaccaaccgtgcgcctgtgcagggcacccctacaggttttagaatgggggcacctatggaatatggcaggctgcgagaagctgggcccgccaaggtggtcccaaggaggagtggggggttgcggaaaggaggatgagagccagccacaaggctggaaaaggagtgggcaccgcagaggagggaaaaagaatcttgacactgtcaccgccagggatctaggggggcctcttaccttggagaataacaatctctgatgtctgctaattacagaaatactttcagagctctttcattcatcctgacaatggccagagaaggtaggtattggtagccttattttagagatggggaaactgaggctgagagtaggtaagtaagctgtccaagggcactcagctaacaaaggacagaagcaagcctcctcactgtctacctccaaaacctacactggcttggagttgctgtcctggccctccactgcccatctcatgtaggacgggagagtatggggggctggggtcccatctatagcctgaatttgagactttcagttgctcctctcattccccatttaatttgtggggatccccaactgacccctccctacacttccagggcactgaggagggagggcccgctgaaggagccccgaattatctctaggccaggtcaggagccattagtgtcccctcccctgacagcatcctcctccttctgccctcacattcagagccactgacaagactttaagcaagagacggagagttaacatctaatctggaggaagaccctggaaggagccagccccttcccccaggctgacctggtttaagcctttcttctgccaaggtcaccagcaccccagatgggtgagagatgtgatcactggtttcgtggcctgaccaaggacctccaagattctgtggcagatgagaaatgccttggtccttgggctgcttgcagcctagcgagggacagacttttaacctctctaggagagtggctgcttcaagtcatcctatgggaccagctgttcatgcttcctcttgcccagaactacttctgtgagaggaaaagagaagggtaggagcgtgccctgcagctggaaacccaagccaggcggggagccacgaatgcagtagttatcagactgtatcttcaatcctgggggcttctcaagccattgccagccactcttcacccaaggcctggtggaataaagctgggctaagta

SEQ ID NO: 43809 - DNA, 2261 bp, Homo sapiens
ggctgcttgggaggcgcgggctgcttggggggcggcgcggcggggcccgcgggctgctcggcgctgccggccgcgttgcccatggtggtccccacccagccggccaggcgcctccagcctcggaaatccagctttccgggggacggggacgaggctcccggcccgggcgggggcgagggggcagcggctggcggtggcggcgggggtctcggcagcggggggcgctcggctcagcggcgcgcaggggccggagcgcggcgtcccatcggggcggccccgtccgtgggaccgggcggcgagctgcagggttgggggaggaagtcaggctgcaggccgccggggccagagggctgggccgggggcaggaagctgcggcgctggctcccccctcggcgattttcgaacttctgctgtcgctccccgtgcgcgcaaaccgcagttcgccgccgccgccgccgggcacccagccccaggggggcgggctggagggagggggcgggcgctggccgggggacccccgcaaccatggcgggcggggagtgggctgccgagccgcttcacctgccgcagagggggcggccggcgccgcttcacctgccggagcgggaggccaccgaggcgaggccgaggcggcggcgcgctcggcggcgcctccgggtcctagaaccgcatcctcccgctcgcctcgggcgagggattggccgggtctgggtgaaggggatcacggcctggggattggaggggcacatcttctccgcaccgaggatctcagcgactgcgagcacggctcggagacccacggtggtgcagcgttggggcgccagggctgcgttcccgtctcgcgtcccggactgagaaggtgggaacccccttccaggccccccaccttttatttctctcctcccctgcttagcccagagacgagctgaggacgagggggagccatctccaaacaggaactcctaaacagggtggggggcgcggacgcaggccagtggagacccccgccacctgtcccacctcgaccaaccgtgcgcctgtgcagggcacccctacaggttttagaatgggggcacctatggaatatggcaggctgcgagaagctgggcccgccaaggtggtcccaaggaggagtggggggttgcggaaaggaggatgagagccagccacaaggctggaaaaggagtgggcaccgcagaggagggaaaaagaatcttgacactgtcaccgccagggatctaggggggcctcttaccttggagaataacaatctctgatgtctgctaattacagaaatactttcagagctctttcattcatcctgacaatggccagagaaggtaggtattggtagccttattttagagatggggaaactgaggctgagagtaggtaagtaagctgtccaagggcactcagctaacaaaggacagaagcaagcctcctcactgtctacctccaaaacctacactggcttggagttgctgtcctggccctccactgcccatctcatgtaggacgggagagtatggggggctggggtcccatctatagcctgaatttgagactttcagttgctcctctcattccccatttaatttgtggggatccccaactgacccctccctacacttccagggcactgaggagggagggcccgctgaaggagccccgaattatctctaggccaggtcaggagccattagtgtcccctcccctgacagcatcctcctccttctgccctcacattcagagccactgacaagactttaagcaagagacggagagttaacatctaatctggaggaagaccctggaaggagccagccccttcccccaggctgacctggtttaagcctttcttctgccaaggtcaccagcaccccagatgggtgagagatgtgatcactggtttcgtggcctgaccaaggacctccaagatggagtctctcgctgttgcccaggctggagtgcagtggctcggtctcagctcactgcaacctccacctcccaggtccaagcaattatccagtctcagcctcctcagtagctgggaccacaggtgcgtgccaccacacccagctcatttttgtatttttagtagagacggggttttgctatgttgaccaagctggtctcgaactcctgacctcaagtgatccgcctgcctcggcctcccaaagtgctgggattacaggcatgaggcaccccgtccagcctggaagacttttttttttaatgaataaaaacacattttttta

SEQ ID NO: 43810 - DNA, 2840 bp, Homo sapiens
  misc_feature (2579)..(2579): n is a, c, g, or t
  misc_feature (2581)..(2582): n is a, c, g, or t
ggctgcttgggaggcgcgggctgcttggggggcggcgcggcggggcccgcgggctgctcggcgctgccggccgcgttgcccatggtggtccccacccagccggccaggcgcctccagcctcggaaatccagctttccgggggacggggacgaggctcccggcccgggcgggggcgagggggcagcggctggcggtggcggcgggggtctcggcagcggggggcgctcggctcagcggcgcgcaggggccggagcgcggcgtcccatcggggcggccccgtccgtgggaccgggcggcgagctgcagggttgggggaggaagtcaggctgcaggccgccggggccagagggctgggccgggggcaggaagctgcggcgctggctcccccctcggcgattttcgaacttctgctgtcgctccccgtgcgcgcaaaccgcagttcgccgccgccgccgccgggcacccagccccaggggggcgggctggagggagggggcgggcgctggccgggggacccccgcaaccatggcgggcggggagtgggctgccgagccgcttcacctgccgcagagggggcggccggcgccgcttcacctgccggagcgggaggccaccgaggcgaggccgaggcggcggcgcgctcggcggcgcctccgggtcctagaaccgcatcctcccgctcgcctcgggcgagggattggccgggtctgggtgaaggggatcacggcctggggattggaggggcacatcttctccgcaccgaggatctcagcgactgcgagcacggctcggagacccacggtggtgcagcgttggggcgccagggctgcgttcccgtctcgcgtcccggactgagaaggtgggaacccccttccaggccccccaccttttatttctctcctcccctgcttagcccagagacgagctgaggacgagggggagccatctccaaacaggaactcctaaacagggtggggggcgcggacgcaggccagtggagacccccgccacctgtcccacctcgaccaaccgtgcgcctgtgcagggcacccctacaggttttagaatgggggcacctatggaatatggcaggctgcgagaagctgggcccgccaaggtggtcccaaggaggagtggggggttgcggaaaggaggatgagagccagccacaaggctggaaaaggagtgggcaccgcagaggagggaaaaagaatcttgacactgtcaccgccagggatctaggggggcctcttaccttggagaataacaatctctgatgtctgctaattacagaaatactttcagagctctttcattcatcctgacaatggccagagaaggtaggtattggtagccttattttagagatggggaaactgaggctgagagtaggtaagtaagctgtccaagggcactcagctaacaaaggacagaagcaagcctcctcactgtctacctccaaaacctacactggcttggagttgctgtcctggccctccactgcccatctcatgtaggacgggagagtatggggggctggggtcccatctatagcctgaatttgagactttcagttgctcctctcattccccatttaatttgtggggatccccaactgacccctccctacacttccagggcactgaggagggagggcccgctgaaggagccccgaattatctctaggccaggtcaggagccattagtgtcccctcccctgacagcatcctcctccttctgccctcacattcagagccactgacaagactttaagcaagagacggagagttaacatctaatctggaggaagaccctggaaggagccagccccttcccccaggctgacctggtttaagcctttcttctgccaaggtcaccagcaccccagatgggtgagagatgtgatcactggtttcgtggcctgaccaaggacctccaaggaggtatctttcccatcttggcccacagaggaggaaatcctagaagggatgactgaagcttgggactaacacattggtggatctgtgctaccccctgctggccgtagacggtatgacagccaagatagggcaaggcttcgaggggcgatggatggattcaccgcagcggcgacatttctggactgttgtcaccttcagtgcagtcactgggaatattcagaacccaggtgattgataaggttttcccagggatctcttctctccccttcaccattactcagtaggagcttccttaaaaacggaaaacgagaggccgggcgcggtggctcacgcctgtaatcccagcactttgggaggcggaggcgggcggatcacgaggtcaggagatcgagaccatcctggctaacacaaccccgtctctacttaaaatacaaaaaattggccgggcgtggtggcacgcgcctgtagttccagctactcaggaggctgaggcaggagaatcgcttgaacccgggaggcagaggaggttgcagtgagctgagatggcgccactgcactccagcctggccgactgagactccatctcaaaaaaaaaaaaaaaaaaaggaaaaaggggccgggcgcggtggctcacgtctntnntcctagcactttgggagaccaaggcgggcagatcacgaggtcaggaatttgagactagtgtggccaacatggtgaaaccccatctctactaaaaatacaaaaaattagccgggtgtggtggcgcatgcctgtaatcctagctactcgggaggccgaggcaggagaatcgcttgaacccaggaggccgaggttgcagtgagccgagatcacgccattgcactccagcctgggcgacagagcaagactccgtcttgaggg

SEQ ID NO: 43811 - DNA, 452 bp, Homo sapiens
ctttcctagattggaatacagattagcattttatttgtgtctcaatttatggctaatttttcattttcttgatgacttgggatgtcttccaggagaaagggcagaatttattttgctgaccttctgaatttaatttgctattgttctttttttaatatttaaaaaagttgtaataatttttattttttctgccatgcttggcaaagatgaggtctcactatgttgcgcaggctggtcctgaactccttagctcaagtgatcaatccgccttggcctcccaaagtgctgggattacaggtgtgtgccaccacacctggcctaatggtaaatgtggccaaaatacaggagtgttctgctttaaaaaaaaatgaaagtttatggggaatttgaagcataaccaaaagcatgaagaataacaaaatgaacccccatgtatccatcatcatttgtta

SEQ ID NO: 43812 - DNA, 190 bp, Homo sapiens
gataacattttgaaaactggaaagatggtatactgtttttagaggaataaacatatttgtggtttttaaaaaaaagagcaacttcctttgcactgtatacccttttgtattattaggattttatactatgtttatatgttgcctatttaataaatcgcttaaagttatatatcttgaatatctttccata

SEQ ID NO: 43813 - DNA, 367 bp, Homo sapiens
tgctctgctgcccaggatggagttcagtggctcaatcatagttcactgcagcctcatactcctggatagagtgtatgtaatcaattattgagagaagatagaagagtacagataatatctatattcacacaaatctgcaaaatatagctttattcatattgtttctgttcattttatgaaacaaacagcttcaagtcattgggcctcatttcagtgccctatgtgaatccactaatgtacagagaggtaggatttgagcattaatcggcctagaacttgaaattgtcatatcagtgttgaagctgtgtaactgacaggcatttgggagaccctgtttaagcatttttggccttctcataaaaagtac

SEQ ID NO: 43814 - DNA, 561 bp, Homo sapiens
atactccagtgacatagaaaacaaattctacctaggttcttttccctgccccagttctgatcagattcaccatttttggaggccttatttaggtctggcctcactctggagtgttcccttacaaaactgatttataaagattcaagtttttgggggtaaatcctgctgactttctagagctgctgctcacagtatcctgaaacccaaaagcagatacataagaaaaataaactatacattttaagatcttaatttttaaattttgtagtaaaaccagtgcttacagaaacgttccatttagcagattttctgttcctgcagatccagtagctgctctacaagtcataaacaagtaaacataaacacaaaaaaatttctctaaactacattctaaatcctgagaattattgaacacttagtatgaactttcaaggtgttagtaggacataataacaaataataacacataatgtgttattcccagcacagtgctctgcaacatactattgagcacatagtacctgcttaataaacattgcattagttcatgtgtaaaaaaaa

SEQ ID NO: 43815 - DNA, 467 bp, Homo sapiens
tagcaccatgagcttcaataccctgtccttttgagtttttacggaggcttcactacataggcattactgattaaaccattggctgttggtgataatcttatcaccaatttaatggtgaaacttaatcttcagctcctctcacctcctgggaggttgcggggtggggatgaaaagtcccaatcctctaatcctgccttggtcttttgctgccagtccccatcctgaagctacctaggggatgccagctaccagtcaattcgtttgcatacaaaaagatatcactttggagtttctaagtgtatacgaggaaatgaggtcaaagaccaaatatatatatttcactatatcacacttacaaacttttgtttactgtttctcttctcctactctattataaacctttgagggtgggggactgtgagttatttatctttatatttcaagccaagtatggactgtgagttatt

SEQ ID NO: 43816 - DNA, 427 bp, Homo sapiens
tgcagtcagcactctccagtgattagaatgggggaaagaatccactatttgtacagggtttatctttatcatactaaaatgctgagtgagtggaggtctgggaatgaaaatcagaagtcttcttcttcttttaattcataagcctcacttaaatcagaacacatttaactatttatatatcaaaaacgtccccaaacaccataagaccagcacagagttgctgccctaaaatgtataattagtgaaaaatttacctctgcttccatttaaagcatggcagtgggttgggtgtcattatgtagtataaaaactggactagataaactgctattttagagcattattagcattctctgaatatatgtatatatacatatatatacgcacacacacacacacacataaatatatatatatatatatatat

SEQ ID NO: 43817 - DNA, 479 bp, Homo sapiens
gtgaagatggtcagatccacagaggcttgtgcatgtgctaggttttttgctaaggggggataaactgtccagccagttccagcactggcttcgaccactgaagacgcaagtaggagtagaaaagatggagggagaagtcagaagctcatattatttatcccggggaatgccatatcgggcatttttattaacataaaaatgtaaatgcctgtttattgtttttgttagacatgacctataaataaactctggaagacaattataattagaagacaaaaggtaaaccttgacaatttaaagtaatgtcggaacggagaaagtctagaagataaaagaacaagtatgtttctaatgtcctcagctcacatagaatgactgcagtaaagcgaaggatgaaagacacaagaatggtatctaaagttatgtataatgtaacagcaagttgtggggactgtgcctttccacactgattgaatttt

SEQ ID NO: 43818 - DNA, 371 bp, Homo sapiens
gctcgacctgcagtgagccaagatcacacctctgtcactccagccttgaattcttgggctcaagcaatcctcccacctcagcctcccgagtagctgggacgacaggtgtgtgccagcacacttggctaattttttattttttttagagatgggagtctcactatattgtccaggctggtctcgaaatcctggcttctagtgctccttctcccttggcctcccaaagtgttgcgattgattacgggtgtgagccaccacactggcctaaaaagcaatctccaaaacggaaagtaacatgatataaatgatctggtagccacttggtagcacaactgcacacacacagacaaatgttacaaatgacgtcgaca

SEQ ID NO: 43819 - DNA, 318 bp, Homo sapiens
acaaagctcatccttgcccaattctcatttaatgaataagaagactaaatacttcagaaaatcaaagactaccttactaatagacttagataaatggatttcagtttagacccaagaagggaagtcaaatctatagatacagcatctaagaagttgagaccttggttctctattctactctccctattattggccttatgaccacaagttggtcagttcgcctccctaagcctcagtttctcacagggaaaataggaatattagcaaatgacagagcaaattcacaggactgctatcataggattaaataaaacaaca

SEQ ID NO: 43820 - DNA, 297 bp, Homo sapiens
gtatcaaagtgacaatgtaccttccatttctctctctctttttttaaaaacaggtatgtgcattcaggtgtcaattgggagaaggaatgctaattttattacctggctgtacagtttcttatgatacgtggcatgtgctgggaactgccagacatagcagcagttttaaaatatatatgaagtaaaagtcaattcctttccttttccttttccttttgtttttctttttctttctttttttttttaaaggcagagtcttacttcgtcaccgggctggagtgcagtggtgcaatctaa

SEQ ID NO: 43821 - DNA, 373 bp, Homo sapiens
gaaccattccacaaaaacatacactactttcctcctagctcaaaggataccacctacatggagccttacttgactgccctcagttatcctttgacataccacgtagagcactttataaaaagatgctacatgtgtttacaactttttattctccctaaactgtaagcaacttgaaggcagattctatgcttatacatcactgtgttcctaaaatctagtatagagactggaacataggaccagtcctccagaaataatctttaagttattttaatgaaatgttttatacatacaaaataatatatgtaatgaataataaagtgaacatcattgagctcaccaactagcttcaaataaatattaccaataccat

SEQ ID NO: 43822 - DNA, 301 bp, Homo sapiens
actttaaaacatttcaaagaaaatgtgatacagatgggaatcaaattgaaaaaaatgactgaccacctgattcaacatagataaaggccatctctgtcggtaaatttaaatgggttagattcatttgcacacccctgcaagctcccaaatcaagaacagcagagatggccaggcacggtggcttacactggtaatctcagcactttgggaggctaaggcgtgtggatcacctgaggtcaggagtttgagaccagcctggccaacatggtgaaaccccatctctactaaaaattaaaaaaaa

SEQ ID NO: 43823 - DNA, 603 bp, Homo sapiens
ttcttatccctagactcttctgatatgtccccagtgagaaggaaaatctgctttgtcaatccacacttactattgacttaattatccaacaacattttaagtgcctactatgggcttaaacaagtgctgaattatattgttgaccactgtgttcactcccacctctaggagagcccaaacttgttgggaaatagtaaaggctaggagaggcagcattttaattagcttctggctagattttacaaacctcaacaaatttatgctctgctcagggctgctgctgaatgcaatggcactggcttactcaaaataataataatggccaggcacggtgtctcacgcctgtaatcccagcactttgggatgctgaggcaggtggatcacctgaggtcaggagttcaagaccagtctgaccaatatggtgaaaccccacctctattaaaaatacaaaaattagctgggcatggtggcatgcacttttagtcccagttactctggaggctgagacaggagaactgcttgcacccaggaggcagaggttgcagtgagctgaggtcgcacaactgcactccagcccaggcaacagagattccgtctcaaaaa

SEQ ID NO: 43824 - DNA, 418 bp, Homo sapiens
tttggcgggccctttgtctcgctcctgccagagttttagttgcctgtctctgctattctgcgtcctccacctcgggagccccaggtgactttgtcacagccggtgggtgtgcgggttgagcatcccgagatgggagagcggcctgtgaaaccggctggaccggcctccccacagtccgctcctgggtcgccgacctgagtccccgctggcacagctccgctccaggccactctggccgcaagatggcggctggactcgcagccaggaccacagcgtcccgccagtttctgcgcggcgccagtccggggctctctgggcagctctgcacccgcaatcccgagtatttcccgggttgttcagggaagacaggcgggtcatcggcagaatccccactcggtgtatgcgttggaggggctgc

SEQ ID NO: 43825 - DNA, 365 bp, Homo sapiens
gcctgatttatctaaggaattcttggcaaaactaatataataccacaagcatgcacagaataccagcttattgagggagaggttaaccagggaaactgaaatcattcagagctatattagttaataaaattctccaagttaatattttcctgggctcccaatatgtgtattgaaattgactaaactttgctaattttaagttagcagtaatattatccaaaagcatttgaaagttaacagtttgttgatcgcaaagtatttagtgacaattattttatagagcaaatgtgtttccaaggagactattttctgtttcgctgtggttttgggttcaggcaactgtgacaatgtccaagtaaagacag

SEQ ID NO: 43826 - DNA, 439 bp, Homo sapiens
tctttttcaatgaatggcacataagtagagaccaagattgatgcctgtggatcctactgtgatagtctagtgttggggaaaacaggtaccagacatccataaaactgtgtggtaagtgttgtgctgggtgaagtatggagtgtcatggggacacagggaaaggccctaacctagacataagaggtccaagaaggcttcctgaaggaagtactcagaacaattaagaaactgaagcacatagaggagaagtcactgtcccaaagtcacatagcctgaaacgaggcagagctggtgcagagcaatgaaatggcattggcacacgggctgtggtcttcgctcgaagcgtgtgctatttagatgctgcagaagtcagtgttaagacaacatgaaggatgttagtcctgtctatgaggagtcaatacaactttggctacaccac

SEQ ID NO: 43827 - DNA, 311 bp, Homo sapiens
gtaatttcagctactcaaaagggtgaggcaggagaatcgctttaacctgggaggccaaggttccagtgagccaagattgcccccctgcactccagcctgggagacagagtgagactttgtttcaaaaaaaaaaaaaaaaaaaaaaaaaaaaggctaactaaggcaaaacctataagaagcaggcaacaaattcaacagatacttttgatgacgagacatccctttttacagagaaaaataggtcacatgcaaagcatcagaaatcaaaagtggcattgtatttttcaacatttacaataaaaacaatgttt

SEQ ID NO: 43828 - DNA, 430 bp, Homo sapiens
ggtctcgtgcagcccctcagactttgcggcaccgcaccaagaggtgcccacagttatccagctcaatgtgatagaatctctttcatttttcttaatgaaggtgaacttaataaaagcaaacacatgatgattgttgatatattttatttctctgagccttctctgccacataatcccactgcctttaactttcttggcctcgttgggcacatgctgtttatttaacatgctgatacgagtgttagagaaatagcacattgctgagccctcaaagaaaagcttcaccctagcaggcccagaaacgaagagaggctgatgatcagctaaagcacgttagccaaaagcattcttaggtgcagtcgtactgagaagccccgcgtgaagtcctgactcagtgttccctgacattaagccccctgaaatgtgagca

SEQ ID NO: 43829 - DNA, 366 bp, Homo sapiens
gtatagaatgagcttgaacgagctttcttaatacaaaatgaaaagaagattaatttcgggtttatagtatatgtgggaaggagagctgttcaagagttaaagacttaaaaaattatagtcttaaatgcatgtctgcaaattatattagaactttattagggctgggcacagtggctcatgccagtaatcccaacactttggaaggctgaggcaggcggatcacttgagtccaggagtttgagatcagcctgagcatcatgatgagacctcatcactacaaaaactcaaaaattacctgagtgtgatggtgagcacctgtggtcccagctactcaggaggctgatgaggcagaattgcttgagccca

SEQ ID NO: 43830 - DNA, 281 bp, Homo sapiens
caaaatggggaaatctgatggtacccatctcacagagctgttgtgaggagtaaatatgtgtaacttaacacagtaccaagtacctatcaacgctgcagtaaatgttgctattaaaaccattattactgctatacacaggcaattaaagaggaaaagccacaagggcctggaatgggccagtgtattttcatgcagaagtgcattttcagggctcctggctgaacctctcttttcaatttgaacatgtaagtgactgtggctagaccacatgcaaactattc

SEQ ID NO: 43831 - DNA, 549 bp, Homo sapiens
ccctcacggattacctcaaactcctgggctcaagcaatccacctcagcctcttgagtagctgggactacaggcatgcaccaccacacctggcttattattattattttttttgtagagcctgggcaacatggcaagacctcttctctacccaaaaaaaaaattaagaagacattagttaggcattgtgacatgtgcctgtaatcccagcttcccaaagtgctgggactacaggcctgagccaccacccccagccttataacactgtttttgttttttgttttttgttttattttgctatctttgttgtccagtttttgttgttatctcttacatatctcttgaatatgtacagttttctcttgctgtttatcttaagcacgtagcgttatgcttggtacatttagcatttttcctgcccaaagaaacttaaagtattgagtagtgcttttggaggtagggaaactcccagttactcatttcattcaagatagattgcccaaaatttttatactgaatccttttttgtgtgtgtttaattaattgaggta

SEQ ID NO: 43832 - DNA, 436 bp, Homo sapiens
agagcagtgagggtattgacattagggtcaaccaagttgattttctgtgccatgttagaggtagtgtaaatcatgaacccatattcttgatggctgtttacttctatgtgttctttgccccctcccacaaattttctagtaaaggtttcctttggcagggcatggtggttcaagtctaaaatctcagcattttggaaaaccaagatgggaggatcacttgatgccaggagttcaagaccagcctgggcaacatagccagatgtcaactctccaaaaatattttaaaaatttagccaagcatggtggtgcacctgtagtcccaggtactcgggaagttgaggtgtgaggattgctttagcccagagttcaaggctgcagtgagtccttattgtgccactgcactccagcctggatgatggagtaaaatccccatctc

SEQ ID NO: 43833 - DNA, 380 bp, Homo sapiens
tggaggcgatagagatgtttagtacctaaattttggtgatggtatcacaggtgtatgcatatgtccaaactcatcaagatgtactctttatatgtatgtgatttttttgtgtatctattatacctcagtaaagctttataaatgatcaaaacaaaactgtgttccccccacacacaccaccccaatacaaacacagaagagctaggcaaaaggaaactctataatggcagggaactgctctgatcctgcctggtgggccacctgctttgtggaagttttcacatctagtgttcattattctttcttctgagactgtcttcctagcccctcccctcctccccctcagccacacccccatcagccagagctgctcagtcagt

SEQ ID NO: 43834 - DNA, 426 bp, Homo sapiens
agggtttcgccacgttggccaggctggtctccaattcctgacctcaggtgatccgcccacctcagcctcccaaagtgccaggattacaggcatgagccactgcacctggctaagttttaattttttgtagagatgaggtctcactatgttccccaggctggtcttgaagtcctgggattacaggtatgaaccaccacgcctggcctcccttcttttttccatactacctaagaaatgcagtgtgtatttacacgtacagcccatctcaatcacacatggctggtggccactgtagtgtgagcacagctcttggttctgggctactccttcaggccttgctctgaactgcagtcactccagcatgaacttatctgattagtctccccttaggagtttgcttctagcatgggcacaactgtttttagc

SEQ ID NO: 43835 - DNA, 464 bp, Homo sapiens
atattcctctgataattacggtatccctgttacagaaatagagaggaagatgcgagaactcgttccttcattcatgtgagcaaacatccccagatactgggcattcaaggccatatcagatatgccacatacctgtgtgggcacagagaggaaaatcctcagttatgtattatccagctagactagatctgaagggggacagtctctataatagcaccttggccacacttcctgagaaattcatccttatttccatcccatttatagctgtcatcataaagtaggtcatccttacaactcactttgggaagtaatgcagggcaagtgaggttagttccagtttaaaggtggagaaacaggatcaaggacttgaccaaatcccagcattatttagtaggggaagacagaatggcatttgcagtccacaggtccaaaggccagcctactccacattttcttatctt

SEQ ID NO: 43836 - DNA, 505 bp, Homo sapiens
aatatatccataattacataaatataataatttcactcttaaaaatacaactctgagacattgagggtacagaactagaagatcatccttggactgtcttttactacaaggacatgaagataggtagctgcatttactatttctgccatgaggcagtaaccaataatgatcatcaccaaatcttctatcaaaatgctgattagccattctcactgaaacccaacaaatcatctaggagagaagagaagatcagcttttaaccacaacttgccatttctacacctattcccaaagcagtagccaagaaggggtaaagacgtttttacggtgaccataataattaaacattccaaacagaaaatgcaaataataaacactctagttgaaagctcaaaaggagaatatacttttgatatagttattatgacatgagtaagcataaatttcagatttaaattaatgaaaacaaaaatgtaattttaaacacattaaaatgctactagat

SEQ ID NO: 43837 - DNA, 602 bp, Homo sapiens
aatatatccataattacataaatataataatttcactcttaaaaatacaactctgagacattgagggtacagaactagaagatcatccttggactgtcttttactacaaggacatgaagataggtagctgcatttactatttctgccatgaggcagtaaccaataatgatcatcaccaaatcttctatcaaaatgctgattagccattctcactgaaacccaacaaatcatctaggagagaagagaagatcagcttttaaccacaacttgccatttctacacctattcccaaagcagtagccaagaaggggtaaagacgtttttacggtgaccataataattaaacattccaaacagaaaatgcaaataataaacactctagttgaaagctcaaaaggagaatatacttttgatatagttattatgacatgagtaagcataaatttcagatttaaattaatgaaaacaaaaatgtaattttaaacacattaaaatgctactagatttttttctttctaattttttttttagacacaaggtctccctctgtcacccaggctgcatttactccttttgctaataaaagtgtttgtagattgtca

SEQ ID NO: 43838 - DNA, 204 bp, Homo sapiens
tttcttacttttgatttttttaaaaaaatacttaaaaatatggactgcttcatgaatttgtgtgtcgtctttgcataggggccatgctaatcttctctgtatcgttccaattttagtacatgtgctgcttaagcaagcaccagtttaccattttatacaatgcaatgtatctttgacattattccataaagatctccatcccta

SEQ ID NO: 43839 - DNA, 309 bp, Homo sapiens
gagcgaaactcagtctaaaaaaaaagtcaccacaaatagttgaaatttaaagccagtccaatactccccctacatagtccaacttttaaagtgacctattccttaaaggggtctcttttgtttaagctgttaacaatgtaaactgttttacatttcacttgctctttttgacattaaccataagaggctgaaggtgaccaaaagaaatgaaaagacattaagccaggtacagtgttgtgcactaccagctactcagaaagctgaagcaggaagatctcttaagctcaagagtttgagatccctgtatct

SEQ ID NO: 43840 - DNA, 434 bp, Homo sapiens
tggcttgctcaaagacacagtaaagaaagagccaactctggtgtcttcagacaagggtcatgcctgctacaactcccacatttcatggctacaatttcccttctgtgacctatatccttggatgctctgacttaattctaaaatagccagttgacacagcccttcaatctggcaaacctaccattgcttaatagaaattaataggccaattttgattcaagaaatactatgtaaagaccagtattttcagtttaactttgaaagaaaattttactatatttgaaaaatataagcaaagcatatttccaaagacaaaggttctggtgggttggaaagggaagaaacaatttgcaaaatcacactctagtatatgaaaagactgcagattttagtctactaaaatcctcaatatatttagcaaatccccaatacag

SEQ ID NO: 43841 - DNA, 491 bp, Homo sapiens
gcacgagatgtaaggtacttggggctaaccaaagttaaatacatatgacaagtacctgaatctagataatctaatggtaagatatcgtttgctctctggacttcatgggctcaccccagcaatggggtgcctggaaatgaagagatctttcttgtgtctcatcctctgggctcccagcctccctcaacatcatgacctccatctgtaacacccaccatcctggagcagcatcctggatattggaactctgaagtctaacctaagagaacaaggacaagcctctctatgaaaggtttgcccttccagatccagttgagctctgctctggagccagactctctgaagcatagcccagctctagctcttaccagttatgtgatcaggaatgagagttaatgtttctatgtttctgattcttcatttgtaaaatgaggataataaaaatttaacttcagaggtttgttgtgaggaataaaagccattagcacaga

SEQ ID NO: 43842 - DNA, 384 bp, Homo sapiens
cttgaactatttgccatggtgtctagtcatcctctctatactttttccagccttggcccaaaacagttagctcacattatttatcttatctgattttgtaatattttttgcctttttccacgtgttctgaattttctttatttgaaattgaaatgccgtctggtgttttatctgtttattcaagtcacagaattttagagtttgttggagtactggaaatttagtaagaaggctgaccttcaagtcttgactatgtgactgataagcttaggacttggtgaagtctcctcttttcgagacagtttccttaactgtaaaatgagaaggtagagttaaatgtcattaactattcccatgattatcaagggataagtatagtagaaa

SEQ ID NO: 43843 - DNA, 936 bp, Homo sapiens
cattctcctagctaattcctatccaaagtgatgatggaatttttattctactttttcatagctacaagtacagctgacactgttcatgacaccgttcaccactaatttcccatctttcaattttcttgttaattttctttccttcccatcccaatcctgatgctgaacctctgcaccagctgtaaaatggttacaggtgattttcattgtcctatcactactttctaattgtctacagtgagtagatagtgcttttaaatgagaaaaaggtgcgtgtaaaatacaccttcagctactaaaattgtatatgaattgtcttattaaacttatcacctttctacacactagctgcccacatctggccaaacagaaaaactgactttatcagtaaaaaacgatctgtgacttcaaaaacaatgttcaaaatataatccacttttcaaacaaagatcaagtaaccccacttttaaactgataactcaatgttttgttaatgtgaattgaattacaaaattcaaaatgttaatatttctttattaagacatctgatgggtataatgagtcaatttaagtagatacaaaatgtaaaattgttatgccaaagttctatttagtaatttttcaaaaatttattcataaaccatattttggtgagtttcagtgttaagaaaattccgatcgccataagtatgggaggccgaggtgggcagatcatgaggtcaggagatcgagaccatcctggctaacacggtgaaacaccgtctctactacaaatacaaaaaaaaattagccgggcgcggtggtgggcgcctgcagtcccagcttctagggaggctgaggcgggagaatggcgtgaacccggcaggcagagcttgcagtgagccgagatcgtgccactgcactccagcctgggcaacagagcgagactccgtctca

SEQ ID NO: 43844 - DNA, 360 bp, Homo sapiens
ttttttaatcgacactcttagagggtcgttatgaggattacctgagtcaatatttgcaaagtgtttagcaaccaggcatgtggtaatcattacatatgtttgctaaataacacaagtgtagtcaatcaacaaggtccatcctgctgatgctgggtctgggaggttgggactgagatttccactttacagatgaggagactgaggacccggagaggaagagacttgccctcagatggcactcaaacctgaggtctgtctcccttcaaccttctctcttccagcacccccaggtcacctccctccctcctcaggcgcctggcctggcccgggtgggcgcagtgccccacactgacagaggcc

SEQ ID NO: 43845 - DNA, 404 bp, Homo sapiens
ggagcctgttaatagcattcctgaggcagcagcagttttaaaaagcaaagtgtttctatttctggtctgacactaagagacctctgacttatggggcttcccaatgcctcccccaattattccttcagggaagtcactcttgactttattagtgccagtaaaggtaaaagtgggggcatgctaccactccttttttcacttgaacttgtggccctaaagagttagggccaatgtgataaaacaagtaggaaggtcgaatgatcagccaagaattcttttccatttcatgtttaaagcaagatacgactaaccactttgtgtacaactagttttaagaattgtttcagggctaatttgggaagcattagaaaataaaaagctattgtagcccttttagaaacatc

SEQ ID NO: 43846 - DNA, 1209 bp, Homo sapiens
ggttcttttccttaccagttaagcctcagtagaatcctcatgacctttggttgaattacatggacacttattaaaggctctcaatggtcccgcactgttctaagcactggacaggacaccaaataagaatgtagcagggaggaactcaagatgctgaccatctcattgaggagacagggcatatttgaatctggaccgtaagtgctacaggacaatgatggggaaaaaagacatctctgtggaatggttggaatggtatcatagaaaaaagactagagaagatagaatttgggccaagccttgaaaagagtatgggtcgaattcagctggtgaaggatggcgaatttccagacctgtaggatgatctaattactccctactcacagagttggagtaattaagtcacaggaccactctgaacagaatggacagagtggaggagtagctgagaggtaaagttcccgcaggcaagatgaaaccttccaccttgacccttggatgcctgcaggaggaggtggaccttgattggagaagctttaaaaagccctagtttacaaaagtaagctgtggtgagaaaaattatagcacctggtattcctgggtgacactatctggaaggggtgggaggaaaggcttaccaggttgttagaaatgttctgtatctctgttacagaggtggttacacaggcgtatacatttaccaaattccatccgacttacacttaaaatcagtgcattttcgtggggcatggccacaagcacctgggtcctgtgtcctagctactccaaaggccaaggtgggaggattgcttgagcccaggagttcaaggctacagttagctatgatcacattccattgcactctagcctgggtgacagtgtgagaccctgtctgtaattcgttctgtgcattttattgtctataaattgtgtttgaattttttaaaaattttaagttgtatttaaacaaagagaacctatggattaaaagactttaaaataatagcaaccaatggaaatacatgactggaattctgatgcgaacaccctattaaagaaattttttagagactattggagattgggcacagtagctcatgcctgtaattccagtactttcagaggccaaggtgggtggatagcttgaacccagcagttcgagactagcctgggcaacatagtgaaacccatctctattaaaaatacgaa

SEQ ID NO: 43847 - DNA, 403 bp, Homo sapiens
taatattcaatgagcccagatccgcggctggttcgccgggttgaggcgggggtagcgggcggggccggcgctggggagcccgcgacccgggcggggagggcgtgtgtcgggggggcggtggcggcgaggcgggcgcgcgggatggaacactgagacaccgacggaatgctccgaatcgccacataatcccctggaacggccgcgcacaacgccattggcttcttccttctccgcgcgccgccgccgtctcccacctccgcctcatcgcctccctctccgcccgctgcctccggagctgggggggaaacgcgaagccccactgcaatggagcccgccgccgcggccacggtacagcgactccccgagctcggcagggaggaccgagcttcggctccggcggccg

SEQ ID NO: 43848 - DNA, 534 bp, Homo sapiens
cctcacagacacaccccaaaataaagttttacttgctatcttcccatcctttaatgcagccacaatgacatataaaattaaccatcatgttatatgaagtcttgggagtggactggaagaatggggcttaggatctagctttaaggaagtcaagcaatgaaatgtcacatatttttaaaaggacaaaccacaaaaactgtgaaaagcaatagtggtgtcatcagcaaatagaaatttttgagaattcctagaaggcagaaagaagatagggttggaaaatctaagagaaaaggaaccaagataagtgtgcttttcccatagggaggccctgcagtagcttcaagttaagtcgataaagacaaagaggaggcatagatcatggggcaaccagtgatcaggtatccaccaaggaacctcagtttagacatcatggtctgtttgggataccatttttgactataagataaagctgtgatccaatctgtaaagaaacctcaagggaggatgctaggataagcattagggcctctactg

SEQ ID NO: 43849 - DNA, 368 bp, Homo sapiens
acaagattcaagtgggattcagttttcagagtgctggcaaacagcctggaaacagctctataagctcctggaatcctccagaggactgcagaactccataaaccatattctgacatcatccctgtctgggtatagacaggaccagcagccacccaggaatggccttaaagaatccctaatgaattaatcatcataaaccagctcgggagcaggagaacatgctcatgccgtcagtctgcctttgcccaggagttccacctcccattcaccaattaactttacagttgcatctgcctttcctgccaagctctcccataaaggaatttatcaccttctgttctgcttttcttcccaaatgtgaatcagaa

SEQ ID NO: 43850 - DNA, 219 bp, Homo sapiens
gataaaccatgccgcaataataaccttgtactagtcatttttaacatgtgaaagtatatctgcaagatacatttccagaaatgggattagccaatcatatgatattaagccaaccttttgatctctttgagctgcatttgttaactaataaattaagctcatatttacctcataggatcattattataatgaaataaccatataaacaattattgtaca

SEQ ID NO: 43851 - DNA, 3168 bp, Homo sapiens
accattcttccggtttcagaagttaaggctggtgtcctggccccagtccacctctgggagcgcctgcgccgctccgcggagagtccgtggatctcacaggttcccagttttccagacctgaagtgttttccaatcaaagcgaagagacgatctgtggatgttgaatatgcaaggagctgaagagagagacattagaagagagacttgtccaggctgggtaaacaagaacaagcctgctctggagcaggatgtctgtaaaattgactcatcagggatagtagtaaagaggttccaagaggatgaataccaagattctacatttgaagaaaaatatgcatgtgagggcatgaaggaaaactctcctagggagattgctgaatcatgccttttccaggaaggaggttttgggagaataactttcatccacaaagaagcaccccctgaaattattagtcaaggatataattttgagaaaagcttgcttttgacctcaagccttgttacacgtctcagggtttctacagaagagagtctgcatcagtgggaaacaagtaatatacaaaccaatgatatttcagaccaaagtaaatgtccaactctctgcacacagaaaaaatcttggaaatgtaatgaatgtggaaaaacctttactcagagctcatcccttacccaacatcagagaactcatactggagagagaccctacacatgtgaggaatgtgggaaagcctttagtcgtagttcattccttgttcaacatcaaagaattcacactggagtgaaaccatatggatgtgagcagtgtgggaaaacatttcgatgtcgatcatttcttactcagcatcaaagaattcacactggagagaaaccttataaatgcaatgaatgtgggaattccttccgcaatcactcacatctcactgaacaccagagaattcacactggagagaaaccttataaatgcaataggtgtgggaaggcattcaatcagaatacacaccttattcatcatcagagaattcacactggtgagaagccttacatatgcagtgaatgtggctcttcttttcgaaaacactcaaatcttacgcaacatcagagaattcacactggggaaaaaccccataaatgtgacgaatgtgggaaaactttccaaacaaaggcaaacctctctcagcatcagagaattcatagtggagagaaaccctataaatgtaaagaatgtggcaaagccttttgtcagagcccatctcttattaaacaccagcgaattcatactggagaaaaaccatataagtgtaaagaatgtggcaaagcgtttactcagagcaccccactcactaaacatcagagaatacatacaggggagagaccctacaaatgcagtgaatgtggtaaagccttcattcagagcatttgccttattcggcaccagagaagtcacactggagaaaaaccctataaatgcaatgaatgtggaaagggctttaatcagaacacctgcctcactcagcatatgagaattcatactggagagaagccctataaatgtaaagaatgtgggaaagcctttgctcatagctcatctcttactgaacatcatagaactcacactggtgagaagctctataaatgtagtgagtgtgagaaaaccttccgcaagtatgcacaccttagtgaacattacagaattcacactggtgagaagccttatgagtgtattgagtgtggaaagttcttcagacatagttcagtccttttcagacatcagaaacttcacagtggtgactaatgctgccatttaggttatgacagtttctctagcgaggatgactacgaatctgactgggagtagaggggcaggtagagttcctggagggaaggatgaaggagccttggctactgtactctgagaggaatgtttccagaaatggaggtgggagcttagggaatgcagagcctacttgaggtgggcatctgggaatacagggtagaaagaaattcctgcttttcagataaagcctacacattgccactgtctccccatgtgactcttacagcttgaggaggcatttgttagcacttctgttcactttactacatcctgccccacattctgacttgtcacccattttcgttggctggcaggttgagatgtttttcttaaacactgcctgtcagtgtgaagtggcacagctctgatgtagtgctaagtctagcctccagatttgaggcagccctgaccatgctaccatgggggaggctcccaacctgtggaagtggtcctgtgaaaaggagacagaaacaagtaagagccaaaaaaaaaaaaaaaaaaaatccatatccattcattaaaaaaatgagatataaagcaacaactgggctgacctctatagatctgccagtaaagaaggctttctttcattatcagggtgaaggtctttcctgattcttccaagctttgaggtgactcagagctaagaatgaaataggagaccaagttagaattcatgatactggtttatggggaggcagtcatacctgttcagagaaccaggaagactcaatatctatctcagaggaaatatggttacccaggaaagaaatggtctgctagagtgataagactcagaacaggaagcctgcatgtgactgagcaagtcacctacataaccctgcctgtactaaggtgtacacctgtctattgtaagtttgcctaggctgttggtgtacagagaccagaggagagagacacactaggactaacaatgtcctaacaaaatggtacttagtttgttggtctttaggagaaagcattagtaatgaaagaagaaagaattttcacttggttggacattggggctgcttaagaaagttgacatttgtcgtggaatgactttggaaagacttctaaaagaatctttttcaaatccctgaaaatcaggatagcacattttgctactgactgtgacagtgttttattcttttgagagaaatgacatagttttccctttatttcccaaattcctttcatgttcttaactgctacccagaaattgagcttcagaagattgaggatagcctttgattggtatttaaaataatttctaagctgtgaagcttatagcatttttaaagtatggctattaaaaacactaagttgataaa

SEQ ID NO: 43852 - DNA, 3244 bp, Homo sapiens
accattcttccggtttcagaagttaaggctggtgtcctggccccagtccacctctgggagcgcctgcgccgctccgcggagagtccgtggatctcacaaaaatgtttgctgacccttgacattgacaaactgctgacagctcagatgatccatgattggaaggatgtggtcatcaccaagatgtctttctttctccggttcccagttttccagacctgaagtgttttccaatcaaagcgaagagacgatctgtggatgttgaatatgcaaggagctgaagagagagacattagaagagagacttgtccaggctgggtaaacaagaacaagcctgctctggagcaggatgtctgtaaaattgactcatcagggatagtagtaaagaggttccaagaggatgaataccaagattctacatttgaagaaaaatatgcatgtgagggcatgaaggaaaactctcctagggagattgctgaatcatgccttttccaggaaggaggttttgggagaataactttcatccacaaagaagcaccccctgaaattattagtcaaggatataattttgagaaaagcttgcttttgacctcaagccttgttacacgtctcagggtttctacagaagagagtctgcatcagtgggaaacaagtaatatacaaaccaatgatatttcagaccaaagtaaatgtccaactctctgcacacagaaaaaatcttggaaatgtaatgaatgtggaaaaacctttactcagagctcatcccttacccaacatcagagaactcatactggagagagaccctacacatgtgaggaatgtgggaaagcctttagtcgtagttcattccttgttcaacatcaaagaattcacactggagtgaaaccatatggatgtgagcagtgtgggaaaacatttcgatgtcgatcatttcttactcagcatcaaagaattcacactggagagaaaccttataaatgcaatgaatgtgggaattccttccgcaatcactcacatctcactgaacaccagagaattcacactggagagaaaccttataaatgcaataggtgtgggaaggcattcaatcagaatacacaccttattcatcatcagagaattcacactggtgagaagccttacatatgcagtgaatgtggctcttcttttcgaaaacactcaaatcttacgcaacatcagagaattcacactggggaaaaaccccataaatgtgacgaatgtgggaaaactttccaaacaaaggcaaacctctctcagcatcagagaattcatagtggagagaaaccctataaatgtaaagaatgtggcaaagccttttgtcagagcccatctcttattaaacaccagcgaattcatactggagaaaaaccatataagtgtaaagaatgtggcaaagcgtttactcagagcaccccactcactaaacatcagagaatacatacaggggagagaccctacaaatgcagtgaatgtggtaaagccttcattcagagcatttgccttattcggcaccagagaagtcacactggagaaaaaccctataaatgcaatgaatgtggaaagggctttaatcagaacacctgcctcactcagcatatgagaattcatactggagagaagccctataaatgtaaagaatgtgggaaagcctttgctcatagctcatctcttactgaacatcatagaactcacactggtgagaagctctataaatgtagtgagtgtgagaaaaccttccgcaagtatgcacaccttagtgaacattacagaattcacactggtgagaagccttatgagtgtattgagtgtggaaagttcttcagacatagttcagtccttttcagacatcagaaacttcacagtggtgactaatgctgccatttaggttatgacagtttctctagcgaggatgactacgaatctgactgggagtagaggggcaggtagagttcctggagggaaggatgaaggagccttggctactgtactctgagaggaatgtttccagaaatggaggtgggagcttagggaatgcagagcctacttgaggtgggcatctgggaatacagggtagaaagaaattcctgcttttcagataaagcctacacattgccactgtctccccatgtgactcttacagcttgaggaggcatttgttagcacttctgttcactttactacatcctgccccacattctgacttgtcacccattttcgttggctggcaggttgagatgtttttcttaaacactgcctgtcagtgtgaagtggcacagctctgatgtagtgctaagtctagcctccagatttgaggcagccctgaccatgctaccatgggggaggctcccaacctgtggaagtggtcctgtgaaaaggagacagaaacaagtaagagccaaaaaaaaaaaaaaaaaaaatccatatccattcattaaaaaaatgagatataaagcaacaactgggctgacctctatagatctgccagtaaagaaggctttctttcattatcagggtgaaggtctttcctgattcttccaagctttgaggtgactcagagctaagaatgaaataggagaccaagttagaattcatgatactgctgttcagagaaccaggaagactcaatatctatctcagaggaaatatggttacccaggaaagaaatggtctgctagagtgataagactcagaacaggaagcctgcatgtgactgagcaagtcacctacataaccctgcctgtactaaggtgtacacctgtctattgtaagtttgcctaggctgttggtgtacagagaccagaggagagagacacactaggactaacaatgtcctaacaaaatggtacttagtttgttggtctttaggagaaagcattagtaatgaaagaagaaagaattttcacttggttggacattggggctgcttaagaaagttgacatttgtcgtggaatgactttggaaagacttctaaaagaatctttttcaaatccctgaaaatcaggatagcacattttgctactgactgtgacagtgttttattcttttgagagaaatgacatagttttccctttatttcccaaattcctttcatgttcttaactgctacccagaaattgagcttcagaagattgaggatagcctttgattggtatttaaaataatttctaagctgtgaagcttatagcatttttaaagtatggctattaaaaacactaagttgataaa

SEQ ID NO: 43853 - DNA, 3146 bp, Homo sapiens
accattcttccggtttcagaagttaaggctggtgtcctggccccagtccacctctgggagcgcctgcgccgctccgcggagagtccgtggatctcacaggttcccagttttccagacctgaagtgttttccaatcaaagcgaagagacgatctgtggatgttgaatatgcaaggagctgaagagagagacattagaagagagacttgtccaggctgggtaaacaagaacaagcctgctctggagcaggatgtctgtaaaattgactcatcagggatagtagtaaagaggttccaagaggatgaataccaagattctacatttgaagaaaaatatgcatgtgagggcatgaaggaaaactctcctagggagattgctgaatcatgccttttccaggaaggaggttttgggagaataactttcatccacaaagaagcaccccctgaaattattagtcaaggatataattttgagaaaagcttgcttttgacctcaagccttgttacacgtctcagggtttctacagaagagagtctgcatcagtgggaaacaagtaatatacaaaccaatgatatttcagaccaaagtaaatgtccaactctctgcacacagaaaaaatcttggaaatgtaatgaatgtggaaaaacctttactcagagctcatcccttacccaacatcagagaactcatactggagagagaccctacacatgtgaggaatgtgggaaagcctttagtcgtagttcattccttgttcaacatcaaagaattcacactggagtgaaaccatatggatgtgagcagtgtgggaaaacatttcgatgtcgatcatttcttactcagcatcaaagaattcacactggagagaaaccttataaatgcaatgaatgtgggaattccttccgcaatcactcacatctcactgaacaccagagaattcacactggagagaaaccttataaatgcaataggtgtgggaaggcattcaatcagaatacacaccttattcatcatcagagaattcacactggtgagaagccttacatatgcagtgaatgtggctcttcttttcgaaaacactcaaatcttacgcaacatcagagaattcacactggggaaaaaccccataaatgtgacgaatgtgggaaaactttccaaacaaaggcaaacctctctcagcatcagagaattcatagtggagagaaaccctataaatgtaaagaatgtggcaaagccttttgtcagagcccatctcttattaaacaccagcgaattcatactggagaaaaaccatataagtgtaaagaatgtggcaaagcgtttactcagagcaccccactcactaaacatcagagaatacatacaggggagagaccctacaaatgcagtgaatgtggtaaagccttcattcagagcatttgccttattcggcaccagagaagtcacactggagaaaaaccctataaatgcaatgaatgtggaaagggctttaatcagaacacctgcctcactcagcatatgagaattcatactggagagaagccctataaatgtaaagaatgtgggaaagcctttgctcatagctcatctcttactgaacatcatagaactcacactggtgagaagctctataaatgtagtgagtgtgagaaaaccttccgcaagtatgcacaccttagtgaacattacagaattcacactggtgagaagccttatgagtgtattgagtgtggaaagttcttcagacatagttcagtccttttcagacatcagaaacttcacagtggtgactaatgctgccatttaggttatgacagtttctctagcgaggatgactacgaatctgactgggagtagaggggcaggtagagttcctggagggaaggatgaaggagccttggctactgtactctgagaggaatgtttccagaaatggaggtgggagcttagggaatgcagagcctacttgaggtgggcatctgggaatacagggtagaaagaaattcctgcttttcagataaagcctacacattgccactgtctccccatgtgactcttacagcttgaggaggcatttgttagcacttctgttcactttactacatcctgccccacattctgacttgtcacccattttcgttggctggcaggttgagatgtttttcttaaacactgcctgtcagtgtgaagtggcacagctctgatgtagtgctaagtctagcctccagatttgaggcagccctgaccatgctaccatgggggaggctcccaacctgtggaagtggtcctgtgaaaaggagacagaaacaagtaagagccaaaaaaaaaaaaaaaaaaaatccatatccattcattaaaaaaatgagatataaagcaacaactgggctgacctctatagatctgccagtaaagaaggctttctttcattatcagggtgaaggtctttcctgattcttccaagctttgaggtgactcagagctaagaatgaaataggagaccaagttagaattcatgatactgctgttcagagaaccaggaagactcaatatctatctcagaggaaatatggttacccaggaaagaaatggtctgctagagtgataagactcagaacaggaagcctgcatgtgactgagcaagtcacctacataaccctgcctgtactaaggtgtacacctgtctattgtaagtttgcctaggctgttggtgtacagagaccagaggagagagacacactaggactaacaatgtcctaacaaaatggtacttagtttgttggtctttaggagaaagcattagtaatgaaagaagaaagaattttcacttggttggacattggggctgcttaagaaagttgacatttgtcgtggaatgactttggaaagacttctaaaagaatctttttcaaatccctgaaaatcaggatagcacattttgctactgactgtgacagtgttttattcttttgagagaaatgacatagttttccctttatttcccaaattcctttcatgttcttaactgctacccagaaattgagcttcagaagattgaggatagcctttgattggtatttaaaataatttctaagctgtgaagcttatagcatttttaaagtatggctattaaaaacactaagttgataaa

SEQ ID NO: 43854 - DNA, 1863 bp, Homo sapiens
tgctactactgaatacgcggccgcctaaacaagcgtttactcagagcaccccactcactaaacatcagagaatacatacaggggagagaccctacaaatgcagtgaatgtggtaaagccttcattcagagcatttgccttattcggcaccagagaagtcacactggagaaaaaccctataaatgcaatgaatgtggaaagggctttaatcagaacacctgcctcactcagcatatgagaattcatactggagagaagccctataaatgtaaagaatgtgggaaagcctttgctcatagctcatctcttactgaacatcatagaactcacactggtgagaagctctataaatgtagtgagtgtgagaaaaccttccgcaagtatgcacaccttagtgaacattacagaattcacactggtgagaagccttatgagtgtattgagtgtggaaagttcttcagacatagttcagtccttttcagacatcagaaacttcacagtggtgactaatgctgccatttaggttatgacagtttctctagcgaggatgactacgaatctgactgggagtagaggggcaggtagagttcctggagggaaggatgaaggagccttggctactgtactctgagaggaatgtttccagaaatggaggtgggagcttagggaatgcagagcctacttgaggtgggcatctgggaatacagggtagaaagaaattcctgcttttcagataaagcctacacattgccactgtctccccatgtgactcttacagcttgaggaggcatttgttagcacttctgttcactttactacatcctgccccacattctgacttgtcacccattttcgttggctggcaggttgagatgtttttcttaaacactgcctgtcagtgtgaagtggcacagctctgatgtagtgctaagtctagcctccagatttgaggcagccctgaccatgctaccatgggggaggctcccaacctgtggaagtggtcctgtgaaaaggagacagaaacaagtaagagccaaaaaaaaaaaaaaaaaaaatccatatccattcattaaaaaaatgagatataaagcaacaactgggctgacctctatagatctgccagtaaagaaggctttctttcattatcagggtgaaggtctttcctgattcttccaagctttgaggtgactcagagctaagaatgaaataggagaccaagttagaattcatgatactgctgttcagagaaccaggaagactcaatatctatctcagaggaaatatggttacccaggaaagaaatggtctgctagagtgataagactcagaacaggaagcctgcatgtgactgagcaagtcacctacataaccctgcctgtactaaggtgtacacctgtctattgtaagtttgcctaggctgttggtgtacagagaccagaggagagagacacactaggactaacaatgtcctaacaaaatggtacttagtttgttggtctttaggagaaagcattagtaatgaaagaagaaagaattttcacttggttggacattggggctgcttaagaaagttgacatttgtcgtggaatgactttggaaagacttctaaaagaatctttttcaaatccctgaaaatcaggatagcacattttgctactgactgtgacagtgttttattcttttgagagaaatgacatagttttccctttatttcccaaattcctttcatgttcttaactgctacccagaaattgagcttcagaagattgaggatagcctttgattggtatttaaaataatttctaagctgtgaagcttatagcatttttaaagtatggctattaaaaacactaagttgataaa

SEQ ID NO: 43855 - DNA, 1947 bp, Homo sapiens
ttttttttttttgagacagagtctcactcttgcccaggctggagtggagtggcataaacacagctcactacggcctcaaccttctgggctcggatgattctcctgcctcagcctcctgagtagcaggaactgcaggtgtgagtcatcacactcagctaatttttttttttttttttttactttttgtagagatggggttctcactgcattgcccaggctggtcttgaatttctgggctcaggtgatcttcccacctcagcctcctgagtagctgggaccacaggtgcatgctaatttttaaaattttttgtttttaaatgctggtcttcaactcttgtccccaagtagctgggattggggcatgaggcactgtgctaacttcatgttgaaattgaattgccattctaacagtgttaagagatggggcctgtaagaggtgattaggctgtgagggctccactctccaagggcggagttaatgttatgaaagggtaagtccagcccgcttgtgcctctcttgccctccagtgttcaaagcaccatcttggaggtggaattcccaagtcggccagttcctggatcttggactgtccggtctccagaaccgtgagccaataaacctctgttccttgtaaatgagtcagcctcaggtattctcttgtagcagcacaaatggaggcagacacttccttcaccaatctcatgggaggcccactcctgtgagctgcctctagttccccaggccacagactccatcagggctcacctggagccgtccctgtctcacctggaagctctcccactcctctggccagcctgggcatctccacccaatatgagtgatggcgactgattcccttactttagcaagctgggaataaggaatgtttgcctgttcttattcaggggtctctgcatctccacacttgcacaggttgtgtgtacatacattttcctgtctttctggtaagcccctggggtggagctctgggccacagggcaggaaaactcagtgttgctaggaactgccagacattttcccggagtgagtgcagcatttacattcccaccagaagtgtgccaggttcttgtcatactgcgtcctcgccagcgcttggtgctgtcagtcttcttagtttccatttagagattcagtgtttaaattttgaacgtcttgggtgaacaccttggtttgagaaaaagaaatgacccaaagtgcagcacagaaagacagagctggaaaatatgagatgggatgagacaagaagatggagagtttagtatgacatccgcaatttacgagtaattccagaaggaggggaaagagaatatggggtggaggcaagtattcagagaaatacggctgagaactttcccaaaccaacaggagcccctgctccttaggttcaggaaccagcagctcccaagcagcatagttaaaaagctctacccaaacagtcacgtcttggtgaaagtacagaatctcatgacaaagagatcttaaggcagaaaagaaagagattatctggaaagaagaaaataagtagttgattaaaagcaacagtggaagccagaaagatagtaaataatatcttcaaagtcctgggagaaaatagtgatagcctagaattgtgtacccagaaaatccgtctttcaagaatgaggggccaggcgcagtggctcacgtctgtattcccagcactttgggaggccaaggcaggtggatcacctgaggtcaggagttcaagaccagcctgatcaacatggtgaaaccctgtctctactaaaaatataaaaattagctgggtgtggtggcatattcctgtagtcccggctgctcgggaggctgaggcaggagaatcacttgagcccaggaggcagaggttgcagtgagccaagattgtgccattgcactccagcctgggcaatagaatgagactctgtctc

SEQ ID NO: 43856 - DNA, 1600 bp, Homo sapiens
ttttttttttttgagacagagtctcactcttgcccaggctggagtggagtggcataaacacagctcactacggcctcaaccttctgggctcggatgattctcctgcctcagcctcctgagtagcaggaactgcaggtgtgagtcatcacactcagctaatttttttttttttttttttactttttgtagagatggggttctcactgcattgcccaggctggtcttgaatttctgggctcaggtgatcttcccacctcagcctcctgagtagctgggaccacaggtgcatgctaatttttaaaattttttgtttttaaatgctggtcttcaactcttgtccccaagtagctgggattggggcatgaggcactgtgctaacttcatgttgaaattgaattgccattctaacagtgttaagagatggggcctgtaagaggtgattaggctgtgagggctccactctccaagggcggagttaatgttatgaaagggtaagtccagcccgcttgtgcctctcttgccctccagtgttcaaagcaccatcttggaggtggaattcccaagtcggccagttcctggatcttggactgtccggtctccagaaccgtgagccaataaacctctgttccttgtaaatgagtcagcctcaggtattctcttgtagcagcacaaatggaggcagacacttccttcaccaatctcatgggaggcccactcctgtgagctgcctctagttccccaggccacagactccatcagggctcacctggagccgtccctgtctcacctggaagctctcccactcctctggccagcctgggcatctccacccaatatgagtgatggcgactgattcccttactttagcaagctgggaataaggaatgtttgcctgttcttattcaggggtctctgcatctccacacttgcacaggttgtgtgtacatacattttcctgtctttctggtaagcccctggggtggagctctgggccacagggcaggaaaactcagtgttgctaggaactgccagacattttcccggagtgagtgcagcatttacattcccaccagaagtgtgccaggttcttgtcatactgcgtcctcgccagcgcttggtgctgtcagtcttcttagtttccatttagagattcagtgtttaaattttgaacgtcttgggtgaacaccttggtttgagaaaagtaagaaaaagggtctgtctggctatgggccatggagacccagggcagtgctccacgtgccaaccctggggcagggagcccaagctaggactgtgactgtctgggctgtgggcatctgaccatctccagtgtccccgtctttgatttccctggcgatggtgctagcttagtttgtgcgcatcggcatttgtgggagaaatgaaggattaatacattttgttttatgtcagactctctcagtgagaagttctcagggacaataatagcagggggtcctgctgaagaaaaactgggagatggctgagctctggtccatctttcattgattcattcatttcttcattcaaccatgtattgaatgcttatagccaatgaaaataaagtacacagtatatttta

SEQ ID NO: 43857 - DNA, 1491 bp, Homo sapiens
gggtagatggattcacatggagggttatggaatagagtatggttaccatctccccaggaaacggcttggtcctgatgcggagatggggttctcactgcattgcccaggctggtcttgaatttctgggctcaggtgatcttcccacctcagcctcctgagtagctgggaccacaggtgcatgctaatttttaaaattttttgtttttaaatgctggtcttcaactcttgtccccaagtagctgggattggggcatgaggcactgtgctaacttcatgttgaaattgaattgccattctaacagtgttaagagatggggcctgtaagaggtgattaggctgtgagggctccactctccaagggcggagttaatgttatgaaagggtaagtccagcccgcttgtgcctctcttgccctccagtgttcaaagcaccatcttggaggtggaattcccaagtcggccagttcctggatcttggactgtccggtctccagaaccgtgagccaataaacctctgttccttgtaaatgagtcagcctcaggtattctcttgtagcagcacaaatggaggcagacacttccttcaccaatctcatgggaggcccactcctgtgagctgcctctagttccccaggccacagactccatcagggctcacctggagccgtccctgtctcacctggaagctctcccactcctctggccagcctgggcatctccacccaatatgagtgatggcgactgattcccttactttagcaagctgggaataaggaatgtttgcctgttcttattcaggggtctctgcatctccacacttgcacaggttgtgtgtacatacattttcctgtctttctggtaagcccctggggtggagctctgggccacagggcaggaaaactcagtgttgctaggaactgccagacattttcccggagtgagtgcagcatttacattcccaccagaagtgtgccaggttcttgtcatactgcgtcctcgccagcgcttggtgctgtcagtcttcttagtttccatttagagattcagtgtttaaattttgaacgtcttgggtgaacaccttggtttgagaaaagtaagaaaaagggtctgtctggctatgggccatggagacccagggcagtgctccacgtgccaaccctggggcagggagcccaagctaggactgtgactgtctgggctgtgggcatctgaccatctccagtgtccccgtctttgatttccctggcgatggtgctagcttagtttgtgcgcatcggcatttgtgggagaaatgaaggattaatacattttgttttatgtcagactctctcagtgagaagttctcagggacaataatagcagggggtcctgctgaagaaaaactgggagatggctgagctctggtccatctttcattgattcattcatttcttcattcaaccatgtattgaatgcttatagccaatgaaaataaagtacacagtatatttta

SEQ ID NO: 43858 - DNA, 243 bp, Homo sapiens
gcaccaagccactcatgaggaatcctctcccatgatccaaacacctcccactaggcccacctccagtactggggatcaaatttcaacaagagacttggcaggaccaaacgaaccatatccaaatcacagcaagtcctttgcctattttttaaaaagttgtttgggtatttttgttgttgagttgtaggaattctttatatattttagatgttaacccctgttcggatatatgatttgcaaata

SEQ ID NO: 43859 - DNA, 430 bp, Homo sapiens
atgtttccttgacctgccttctcagtcttggtagccagttctctctctctgttcagtacatgttcatagagcagtaagtaagagctgagctagctctgggggaccagcagagcatgcctgccctcagtgagtgcaagtgccgtggaagaaaggtacagtgagaaaagttacagtgcagtgcaaatgccctaagagagagttccgaatcactgctttagaaggcagtgggaaaaacacaacttcaatcttgcttacagcaaatatttcagagacacttggtttcctatagtgaattcagtaaagtctgaaccttaaaaggggggtaagcacattattatcttttctatttcatattttaggacattcatagaacacccgaaatgataatatgatgtgaaatgattgttaaatggtttctttagaatttcta

SEQ ID NO: 43860 - DNA, 325 bp, Homo sapiens
catccttctatctccaacagaagagtgaactcatgtttaacttcatgtaggtacagatgggatatttatcaatatgtatatagtacatagattaatagacacacatatttccttgttctgtcagctgacaaggtctagaagcagtgactgctcagtagcagtaagcagaccttacattcaaatcttggtttctaatattctccaacacaaggaaccaggactccttttagaaatggcagattctaggactgggttggaaaaaactacaagatgagcctggagcattttgtagtgccagaaactaaggaagttctcacaaaaaaaa

SEQ ID NO: 43861 - DNA, 1933 bp, Homo sapiens
catgcgccaccacacccggctaattttgtatttttagtagagatgggtttctccatgttggtcgggctggtctcgaactcccgacctcaggtgatctgcctgcctcagcctcccaaagtgctgggattacaggtgtgagccaccgcgcccggccgagaatgacatcttaaagccaccattgcgttcctcatttgtgaactgtcttctcatattttaagtcaagtctataagatcatttttaacctaagttccaactttgttggactccttaaaataagcacccatgaaagccagccagcccttcctccttccctcaccaccctccgtctcttcggctgcttgctctttagtgtagattagtggaagccattcacagaatgtagactcatgtataggtcaccgtttctttcccccactagaaatcacattcactaagcagtggattgaatttaagagtgctgcccctgcccggcgcagtagggcgtgcctctagttccagctactcgggagtctgaggcagaggatggcatgtgccaggagtttgaggctgcagtgcactatgcttgcacctgtgaatagccactgcactccatcttgggcaacacagtgagacccccatctataaaaagagagcactgcctgaacctcggtggcactgggaagctctggcctgagagttaaacacccatgctgaatgatacagtgtgcattctctccagctgcaaactttcttcaactttcctaaattcttactaaattcagaggaataggataaagatcacttagagaaagggtgcttatggacatagcctgagtttcctttaacctctctgcaatgggtgcttttaactagcttctacatggcaagctgtttcagtttgcaaaatcactgcccagcatgtttgaggtcagttggcaccttaaaacacctgttctccagcccttggacagtggagagaatctgtaaaagtgtgaccccctctaagatttcgttttaaatgatcagattcggttccagttttattcttgttgagtttttccctatgaaggctccttttgaatgtgtcttgagacccaaattgagcatgttgctgttattcctgccctgcacctgtggagcaggagtggcagggctggctgtgctgggttccagctcgctcccaccgagggactagcttggcctttgcgctttgattccagatagtaagatgagtggaagtgtttatcgagcatgcaaaagaaaccctcacggctaagggctctgggagttgtgtctgtgtgacctgagagtgatccatctcctgcctgtgtgaggtagcagtgggcacttttcattgagacaaactccagggtgtccagagggggttctgccccttgtgaaggcccattcctggcacttagagacagaaagaactcagcaatctttcgttctagttatattcggtctttgaaactgacaatctttgaaatgtgaatactgtaacaatatgttttcttggattgttgtctttaaaaaggatttttgtgaagcaattgatttatcaaagcaaaaaaattaaaaatagaaacttgctttatggatgttttattttataaagctcatgtcaccaaaagctgcttctccattttatgtaaaacattgagaatgttttcatgttttctggtgacatgtagggtctgtagtcacccctgcatattgagaaactaggaccacactgcatcggactagtcaggtccatttacatgtccaagaatcttttcttaaattccttactttgttcattcattggctgttcaggcagaaaatggaaacaggtagcttttatgttttttattatagttttccacaaatctaattattttgatagttacaagaagataatgattcatcagtaagctaacataatccctttcatagttcatattataaatt

SEQ ID NO: 43862 - DNA, 1898 bp, Homo sapiens
catgcgccaccacacccggctaattttgtatttttagtagagatgggtttctccatgttggtcgggctggtctcgaactcccgacctcaggtgatctgcctgcctcagcctcccaaagtgctgggattacaggtgtgagccaccgcgcccggccgagaatgacatcttaaagccaccattgcgttcctcatttgtgaactgtcttctcatattttaagtcaagtctataagatcatttttaacctaagttccaactttgttggactccttaaaataagcacccatgaaagccagccagcccttcctccttccctcaccaccctccgtctcttcggctgcttgctctttagtgtagattagtggaagccattcacagaatgtagactcatgtataggtcaccgtttctttcccccactagaaatcacattcactaagcagtggattgaatttaagagtgctgcccctgcccggcgcagtagggcgtgcctctagttccagctactcgggagtctgaggcagaggatggcatgtgccaggagtttgccactgcactccatcttgggcaacacagtgagacccccatctataaaaagagagcactgcctgaacctcggtggcactgggaagctctggcctgagagttaaacacccatgctgaatgatacagtgtgcattctctccagctgcaaactttcttcaactttcctaaattcttactaaattcagaggaataggataaagatcacttagagaaagggtgcttatggacatagcctgagtttcctttaacctctctgcaatgggtgcttttaactagcttctacatggcaagctgtttcagtttgcaaaatcactgcccagcatgtttgaggtcagttggcaccttaaaacacctgttctccagcccttggacagtggagagaatctgtaaaagtgtgaccccctctaagatttcgttttaaatgatcagattcggttccagttttattcttgttgagtttttccctatgaaggctccttttgaatgtgtcttgagacccaaattgagcatgttgctgttattcctgccctgcacctgtggagcaggagtggcagggctggctgtgctgggttccagctcgctcccaccgagggactagcttggcctttgcgctttgattccagatagtaagatgagtggaagtgtttatcgagcatgcaaaagaaaccctcacggctaagggctctgggagttgtgtctgtgtgacctgagagtgatccatctcctgcctgtgtgaggtagcagtgggcacttttcattgagacaaactccagggtgtccagagggggttctgccccttgtgaaggcccattcctggcacttagagacagaaagaactcagcaatctttcgttctagttatattcggtctttgaaactgacaatctttgaaatgtgaatactgtaacaatatgttttcttggattgttgtctttaaaaaggatttttgtgaagcaattgatttatcaaagcaaaaaaattaaaaatagaaacttgctttatggatgttttattttataaagctcatgtcaccaaaagctgcttctccattttatgtaaaacattgagaatgttttcatgttttctggtgacatgtagggtctgtagtcacccctgcatattgagaaactaggaccacactgcatcggactagtcaggtccatttacatgtccaagaatcttttcttaaattccttactttgttcattcattggctgttcaggcagaaaatggaaacaggtagcttttatgttttttattatagttttccacaaatctaattattttgatagttacaagaagataatgattcatcagtaagctaacataatccctttcatagttcatattataaatt

SEQ ID NO: 43863 - DNA, 1787 bp, Homo sapiens
  misc_feature (1787)..(1787): n is a, c, g, or t
catgcgccaccacacccggctaattttgtatttttagtagagatgggtttctccatgttggtcgggctggtctcgaactcccgacctcaggtgatctgcctgcctcagcctcccaaagtgctgggattacaggtgtgagccaccgcgcccggccgagaatgacatcttaaagccaccattgcgttcctcatttgtgaactgtcttctcatattttaagtcaagtctataagatcatttttaacctaagttccaactttgttggactccttaaaataagcacccatgaaagccagccagcccttcctccttccctcaccaccctccgtctcttcggctgcttgctctttagtgtagattagtggaagccattcacagaatgtagactcatgtataggtcaccgtttctttcccccactagaaatcacattcactaagcagtggattgaatttaagagtgctgcccctgcccggcgcagtagggcgtgcctctagttccagctactcgggagtctgaggcagaggatggcatgtgccaggagtttgaggctgcagtgcactatgcttgcacctgtgaatagccactgcactccatcttgggcaacacagtgagacccccatctataaaaagagagcactgcctgaacctcggtggcactgggaagctctggcctgagagttaaacacccatgctgaatgatacagtgtgcattctctccagctgcaaactttcttcaactttcctaaattcttactaaattcagaggaataggataaagatcacttagagaaagggtgcttatggacatagcctgagtttcctttaacctctctgcaatgggtgcttttaactagcttctacatggcaagctgtttcagtttgcaaaatcactgcccagcatgtttgaggtcagttggcaccttaaaacacctgttctccagcccttggacagtggagagaatctgtaaaagtgtgaccccctctaagatttcgttttaaatgatcagattcggttccagttttattcttgttgagtttttccctatgaaggctccttttgaatgtgtcttgagacccaaattgagcatgttgctgttattcctgccctgcacctgtggagcaggagtggcagggctggctgtgctgggttccagctcgctcccaccgagggactagcttggcctttgcgctttgattccagatagtaagatgagtggaagtgtttatcgagcatgcaaaagaaaccctcacggctaagggctctgggagttgtgtctgtgtgacctgagagtgatccatctcctgcctgtgtgaggtagcagtgggcacttttcattgagacaaactccagggtgtccagagggggttctgccccttgtgaaggcccattcctggcacttagagacagaaagaactcagcaatctttcgttctagttatattcggtctttgaaactgacaatctttgaaatgtgaatactgtaacaatatgttttcttggattgttgtctttaaaaaggatttttgtgaagcaattgatttatcaaagcaaaaaaattaaaattaaaaaaaaaaaaaaggggggcgacaggaatattcccaagggccaagttaggtatccagctttgtacaagggccattaggagcgttaaaaacagagggcggtaaagtggagggaaatgtacaggattggagaccactggcgggaatgaaacaaaacggaataaagatagaaaatgtggaacagatacaagaacaaagaaaagtgagtgctgatattaggtcttcn

SEQ ID NO: 43864 - DNA, 410 bp, Homo sapiens
tgttccctcacctggtggtggcttttcccacgggcgcactttgatcactcctgggctgctcacgactcatgtctctttctctgtgcttgttatccttgaacacaaagtttcattgaaaaagaattactcgtgttagccaggatggtctcgatctcctgacctcgtgatctgcccccctcggcctcccagagtgctgggattacacaatgaaaccctgtctctactaaaaatacaaaaaattagctgagtgtggtgacaggcacctgtagtcccagctactctggagactgaggcaggagaatggcgtgaacctgggaggcagagcttgcagtgagccgagattgcgccaccgcactccagcctgggcgacagagtgagactccgtctcaaaaaaaataaaaagaaaggaa

SEQ ID NO: 43865 - DNA, 1745 bp, Homo sapiens
acttcccaccgagaggggacggagcgtgcccacctcccaggggtgaggggggacccacctgagatgtgtgcacattttatttatttattgttttgagacagagtctcgctgtgcactccagcttgggtgagagtgggactctgtcttagaaagaaaaaaaaaagtatttggacacagacatgcatgcaaggaaggccaatgatgccggccaccaccaggagctgggagaggcccagggcagatccccttcagccttggagggacctagccctggccacaccttcatctcagacttgcggcccagagaactgaatgagaataaatgtgcgtgaagcccctcagtccacaggatgtggtactggaagcccccactcaagaaggctccagtgaatgctggcacgttcagccaggatgcctccgtgaagctggagacctctgccctgggtcgggaggggaaactgctccaatccagggactgccacatgggaggggacggagcgtgcccacctcccaggggtgaggggggacccacctgagatgtgtgcacattttatttatttattgttttgagacagagtctcgctgtgtcacccaggctggagtgcagtggtgaaatctcggctcattgcagccccttccttccaggctcaagtgatcctcccgcctcagccccgggtagctgggactacaggtgtgcacgagcacacccggctaatctttgtattttttgtagacagaaggtctcaccatgttgcccaggatggtctcgaactcctgggctcaagcgacctacctacctcggcctcacaaagtgtgcacattgtaatatcgtgatttcatatttggagaatcagcaaccaaccagccaaccatgttgcttttataagacagagctgagaaagcaaagcttggctgtcgtcttggctctggtaccacccacgagatgcgggcgattctcagctcagggcgtggaggcgtggtgtgggggagtctatttgccatttttgtttgtcagcagggggcaggggttctcaaagattgcaaaatgctgctgcaggtcaggaaggttattttgggtgcctgtgggggaggtgaaacaaggtcccatgactgttttgcagaaccttgtctgtggagggtagaggttgcggcaggggcctgtgggccttacttggtgagaaggtaggtctagctggctccattcagtatttgagacatttggaatttgtctgcatttaaaaccaagagatcacacacacctgtctggatttggagtttctcttgaaaactcgccagtccggccgtctgagcctgcactgacgcctggtgaagctgtgcaggggccgcccctctccctttcgccacagtcctctccactccctttcgcctctccctggcctgctgcactcactgataggaaattctgaccccagactcggagcagccttcccgtggttcggtttttgcttccgcgaaaaagccaaaggccttggccagagagccagctgttcctacctctaccccacgcttccaaggcaaccttctccacttatcttaggccgagagacagctcttcaagaacgtacatggatcctgattttctcacgaagtcccgatggaaccctgtgctgttgagacatcagtgtgtaaaactctctgtgtccctgttgggctgtccagacagtctggactcttgtaaatttgagatttaattaaaggaaacaaaccaaaaaaaaagcggaaca

SEQ ID NO: 43866 - DNA, 1192 bp, Homo sapiens
tacttgagagatgacgagggaagatcacttgagcccaggagttaagaggctgcatggtgaaatctcggctcattgcagccccttccttccaggctcaagtgatcctcccgcctcagccccgggtagctgggactacaggtgtgcacgagcacacccggctaatctttgtattttttgtagacagaaggtctcaccatgttgcccaggatggtctcgaactcctgggctcaagcgacctacctacctcggcctcacaaagtgtgcacattgtaatatcgtgatttcatatttggagaatcagcaaccaaccagccaaccatgttgcttttataagacagagctgagaaagcaaagcttggctgtcgtcttggctctggtaccacccacgagatgcgggcgattctcagctcagggcgtggaggcgtggtgtgggggagtctatttgccatttttgtttgtcagcagggggcaggggttctcaaagattgcaaaatgctgctgcaggtcaggaaggttattttgggtgcctgtgggggaggtgaaacaaggtcccatgactgttttgcagaaccttgtctgtggagggtagaggttgcggcaggggcctgtgggccttacttggtgagaaggtaggtctagctggctccattcagtatttgagacatttggaatttgtctgcatttaaaaccaagagatcacacacacctgtctggatttggagtttctcttgaaaactcgccagtccggccgtctgagcctgcactgacgcctggtgaagctgtgcaggggccgcccctctccctttcgccacagtcctctccactccctttcgcctctccctggcctgctgcactcactgataggaaattctgaccccagactcggagcagccttcccgtggttcggtttttgcttccgcgaaaaagccaaaggccttggccagagagccagctgttcctacctctaccccacgcttccaaggcaaccttctccacttatcttaggccgagagacagctcttcaagaacgtacatggatcctgattttctcacgaagtcccgatggaaccctgtgctgttgagacatcagtgtgtaaaactctctgtgtccctgttgggctgtccagacagtctggactcttgtaaatttgagatttaattaaaggaaacaaaccaaaaaaaaagcggaaca

SEQ ID NO: 43867 - DNA, 1834 bp, Homo sapiens
acttcccaccgagaggggacggagcgtgcccacctcccaggggtgaggggggacccacctgagatgtgtgcacattttatttatttattgttttgagacagagtctcgctgtgcactccagcttgggtgagagtgggactctgtcttagaaagaaaaaaaaaagtatttggacacagacatgcatgcaaggaaggccaatgatgccggccaccaccaggagctgggagaggcccagggcagatccccttcagccttggagggacctagccctggccacaccttcatctcagacttgcggcccagagaactgaatgagaataaatgtgcgtgaagcccctcagtccacaggatgtggtactggaagcccccactcaagaaggctccagtgaatgctggcacgttcagccaggatgcctccgtgaagctggagacctctgccctgggtcgggaggggaaactgctccaatccagggactgccacatgggaggggacggagcgtgcccacctcccaggggtgaggggggacccacctgagatgtgtgcacattttatttatttattgttttgagacagagtctcgctgtgtcacccaggctggagtgcagtggtgaaatctcggctcattgcagccccttccttccaggctcaagtgatcctcccgcctcagccccgggtagctgggactacaggtgtgcacgagcacacccggctaatctttgtattttttgtagacagaaggtctcaccatgttgcccaggatggtctcgaactcctgggctcaagcgacctacctacctcggcctcacaaagtgtgcacattgtaatatcgtgatttcatatttggagaatcagcaaccaaccagccaaccatgttgcttttataagacagagctgagaaagcaaagcttggctgtcgtcttggctctggtaccacccacgagatgcgggcgattctcagctcagggcgtggaggcgtggtgtgggggagtctatttgccatttttgtttgtcagcagggggcaggggttctcaaagattgcaaaatgctgctgcaggtcaggaaggttattttgggtgcctgtgggggaggtgaaacaaggtcccatgactgttttgcagaaccttgtctgtggagggtagaggttgcggcaggggcctgtgggccttacttggtgagaaggtaggtctagctggctccattcagtatttgagacatttggaatttgtctgcatttaaaaccaagagatcacacacacctgtctggatttggagtttctcttgaaaactcgccagtccggccgtctgagcctgcactgacgcctggtgaagctgtgcaggggccgcccctctccctttcgccacagtcctctccactccctttcgcctctccctggcctgctgcactcactgataggaaattctgaccccagactcggagcagccttcccgtggttcggtttttgcttccgcgaaaaagccaaaggccttggccagagagccagctgttcctacctcttgccgccgttcctaggaacggcggcaagacggaaagaggaggaaatggggtgtgatgggtcaaaggcaggacaggtaagccatggtcctcaaaccaaagagccctctctgtaggtcctctgatctttgagtgtgagctcaagccctcccagtggacacagaaaaaggcctggtagtaagtggtttgcattgtgaggtatgaggatccctggtacattcagcagcatgtgggtcttcggaaatcagcccacaagataagaacactgcaaccaaactcataactaatactggctaatttaactattgtccaaaagag

SEQ ID NO: 43868 - DNA, 1655 bp, Homo sapiens
acttcccaccgagaggggacggagcgtgcccacctcccaggggtgaggggggacccacctgagatgtgtgcacattttatttatttattgttttgagacagagtctcgctgtgcactccagcttgggtgagagtgggactctgtcttagaaagaaaaaaaaaagtatttggacacagacatgcatgcaaggaaggccaatgatgccggccaccaccaggagctgggagaggcccagggcagatccccttcagccttggagggacctagccctggccacaccttcatctcagacttgcggcccagagaactgaatgagaataaatgtgcgtgaagcccctcagtccacaggatgtggtactggaagcccccactcaagaaggctccagtgaatgctggcacgttcagccaggatgcctccgtgaagctggagacctctgccctgggtcgggaggggaaactgctccaatccagggactgccacatgggaggggacggagcgtgcccacctcccaggggtgaggggggacccacctgagatgtgtgcacattttatttatttattgttttgagacagagtctcgctgtgtcacccaggctggagtgcagtggtgaaatctcggctcattgcagccccttccttccaggctcaagtgatcctcccgcctcagccccgggtagctgggactacaggtgtgcacgagcacacccggctaatctttgtattttttgtagacagaaggtctcaccatgttgcccaggatggtctcgaactcctgggctcaagcgacctacctacctcggcctcacaaagtgtgcacattgtaatatcgtgatttcatatttggagaatcagcaaccaaccagccaaccatgttgcttttataagacagagctgagaaagcaaagcttggctgtcgtcttggctctggtaccacccacgagatgcgggcgattctcagctcagggcgtggaggcgtggtgtgggggagtctatttgccatttttgtttgtcagcagggggcaggggttctcaaagattgcaaaatgctgctgcaggtcaggaaggttattttgggtgcctgtgggggaggtgaaacaaggtcccatgactgttttgcagaaccttgtctgtggagggtagaggttgcggcaggggcctgtgggccttacttggtgagaaggtaggtctagctggctccattcagtatttgagacatttggaatttgtctgcatttaaaaccaagagatcacacacacctgtctggatttggagtttctcttgaaaactcgccagtccggccgtggcctgctgcactcactgataggaaattctgaccccagactcggagcagccttcccgtggttcggtttttgcttccgcgaaaaagccaaaggccttggccagagagccagctgttcctacctctaccccacgcttccaaggcaaccttctccacttatcttaggccgagagacagctcttcaagaacgtacatggatcctgattttctcacgaagtcccgatggaaccctgtgctgttgagacatcagtgtgtaaaactctctgtgtccctgttgggctgtccagacagtctggactcttgtaaatttgagatttaattaaaggaaacaaaccaaaaaaaaagcggaaca

SEQ ID NO: 43869 - DNA, 1660 bp, Homo sapiens
acttcccaccgagaggggacggagcgtgcccacctcccaggggtgaggggggacccacctgagatgtgtgcacattttatttatttattgttttgagacagagtctcgctgtgcactccagcttgggtgagagtgggactctgtcttagaaagaaaaaaaaaagtatttggacacagacatgcatgcaaggaaggccaatgatgccggccaccaccaggagctgggagaggcccagggcagatccccttcagccttggagggacctagccctggccacaccttcatctcagacttgcggcccagagaactgaatgagaataaatgtgcgtgaagcccctcagtccacaggatgtggtactggaagcccccactcaagaaggctccagtgaatgctggcacgttcagccaggatgcctccgtgaagctggagacctctgccctgggtcgggaggggaaactgctccaatccagggactgccacatgggaggggacggagcgtgcccacctcccaggggtgaggggggacccacctgagatgtgtgcacattttatttatttattgttttgagacagagtctcgctgtgtcacccaggctggagtgcagtggtgaaatctcggctcattgcagccccttccttccaggctcaagtgatcctcccgcctcagccccgggtagctgggactacaggtgtgcacgagcacacccggctaatctttgtattttttgtagacagaaggtctcaccatgttgcccaggatggtctcgaactcctgggctcaagcgacctacctacctcggcctcacaaagtgtgcacattgtaatatcgtgatttcatatttggagaatcagcaaccaaccagccaaccatgttgcttttataagacagagctgagaaagcaaagcttggctgtcgtcttggctctggtaccacccacgagatgcgggcgattctcagctcagggcgtggaggcgtggtgtgggggagtctatttgccatttttgtttgtcagcagggggcaggggttctcaaagattgcaaaatgctgctgcaggtcaggaaggttattttgggtgcctgtgggggaggtgaaacaaggtcccatgactgttttgcagaaccttgtctgtggagggtagaggttgcggcaggggcctgtgggccttacttggtgagaaggtaggtctagctggctccattcagtatttgagacatttggaatttgtctgcatttaaaaccaagagatcacacacacctgtctggatttggagtttctcttgaaaactcgccagtccggccgtctgagcctgcactgacgcctggtgaagctgtgcaggggccgcccctctccctttcgccacagtcctctccactccctttcgcctctccctggcctgctgcactcactgataggaaattctgaccccagaaccccacgcttccaaggcaaccttctccacttatcttaggccgagagacagctcttcaagaacgtacatggatcctgattttctcacgaagtcccgatggaaccctgtgctgttgagacatcagtgtgtaaaactctctgtgtccctgttgggctgtccagacagtctggactcttgtaaatttgagatttaattaaaggaaacaaaccaaaaaaaaagcggaaca

SEQ ID NO: 43870 - DNA, 1579 bp, Homo sapiens
acttcccaccgagaggggacggagcgtgcccacctcccaggggtgaggggggacccacctgagatgtgtgcacattttatttatttattgttttgagacagagtctcgctgtgcactccagcttgggtgagagtgggactctgtcttagaaagaaaaaaaaaagtatttggacacagacatgcatgcaaggaaggccaatgatgccggccaccaccaggagctgggagaggcccagggcagatccccttcagccttggagggacctagccctggccacaccttcatctcagacttgcggcccagagaactgaatgagaataaatgtgcgtgaagcccctcagtccacaggatgtggtactggaagcccccactcaagaaggctccagtgaatgctggcacgttcagccaggatgcctccgtgaagctggagacctctgccctgggtcgggaggggaaactgctccaatccagggactgccacatgggaggggacggagcgtgcccacctcccaggggtgaggggggacccacctgagatgtgtgcacattttatttatttattgttttgagacagagtctcgctgtgtcacccaggctggagtgcagtggtgaaatctcggctcattgcagccccttccttccaggctcaagtgatcctcccgcctcagccccgggtagctgggactacaggtgtgcacgagcacacccggctaatctttgtattttttgtagacagaaggtctcaccatgttgcccaggatggtctcgaactcctgggctcaagcgacctacctacctcggcctcacaaagtgtgcacattgtaatatcgtgatttcatatttggagaatcagcaaccaaccagccaaccatgttgcttttataagacagagctgagaaagcaaagcttggctgtcgtcttggctctggtaccacccacgagatgcgggcgattctcagctcagggcgtggaggcgtggtgtgggggagtctatttgccatttttgtttgtcagcagggggcaggggttctcaaagattgcaaaatgctgctgcaggtcaggaaggttattttgggtgcctgtgggggaggtgaaacaaggtcccatgactgttttgcagaaccttgtctgtggagggtagaggttgcggcaggggcctgtgggccttacttggtgagaaggtaggtctagctggctccattcagtatttgagacatttggaatttgtggcctgctgcactcactgataggaaattctgaccccagactcggagcagccttcccgtggttcggtttttgcttccgcgaaaaagccaaaggccttggccagagagccagctgttcctacctctaccccacgcttccaaggcaaccttctccacttatcttaggccgagagacagctcttcaagaacgtacatggatcctgattttctcacgaagtcccgatggaaccctgtgctgttgagacatcagtgtgtaaaactctctgtgtccctgttgggctgtccagacagtctggactcttgtaaatttgagatttaattaaaggaaacaaaccaaaaaaaaagcggaaca

SEQ ID NO: 43871 - DNA, 1077 bp, Homo sapiens
acttcccaccgagaggggacggagcgtgcccacctcccaggggtgaggggggacccacctgagatgtgtgcacattttatttatttattgttttgagacagagtctcgctgtgcactccagcttgggtgagagtgggactctgtcttagaaagaaaaaaaaaagtatttggacacagacatgcatgcaaggaaggccaatgatgccggccaccaccaggagctgggagaggcccagggcagatccccttcagccttggagggacctagccctggccacaccttcatctcagacttgcggcccagagaactgaatgagaataaatgtgcgtgaagcccctcagtccacaggatgtggtactggaagcccccactcaagaaggctccagtgaatgctggcacgttcagccaggatgcctccgtgaagctggagacctctgccctgggtcgggaggggaaactgctccaatccagggactgccacatgggaggggacggagcgtgcccacctcccaggggtgaggggggacccacctgagatgtgtgcacattttatttatttattgttttgagacagagtctcgctgtgtcacccaggctggagtgcagtggtgaaatctcggctcattgcagccccttccttccaggctcaagtgatcctcccgcctcagccccgggtagctgggactacaggtgtgcacgagcacacccggctaatctttgtattttttgtagacagaaggtctcaccatgttgcccaggatggtctcgaactcctgggctcaagcgacctacctacctcggcctcacaaagtgtgcacattgtaatatcgtgatttcatatttggagaatcagcaaccaaccagccaaccatgttgcttttataagacagagctgagaaagcaaagcttggctgtcgtcttggctctggtaccacccacgagatgcgggcgattctcagctcagggcgtggaggcgtggtgtgggggagtctatttgccatttttgtttgtcagcagggggcagggactgcttcagtttcgttatcgcgtccgcgtatttagtaatagtagcgccc

SEQ ID NO: 43872 - DNA, 587 bp, Homo sapiens
acttcccaccgagaggggacggagcgtgcccacctcccaggggtgaggggggacccacctgagatgtgtgcacattttatttatttattgttttgagacagagtctcgctgtgcactccagcttgggtgagagtgggactctgtcttagaaagaaaaaaaaaagtatttggacacagacatgcatgcaaggaaggccaatgatgccggccaccaccaggagctgggagaggcccagggcagatccccttcagccttggagggacctagccctggccacaccttcatctcagacttgcggcccagagaactgaatgagaataaatgtgcgtgaagcccctcagtccacaggatgtggtactggaagcccccactcaagaaggctccagtgaatgctggcacgttcagccaggatgcctccgtgaagctggagacctctgccctgggtcgggaggggaaactgctccaatccagggactgccacatgggaggggacggagcgtgcccacctcccaggggtgaggggggacccacctgagattgcaccactgcacttcagcctggtgacagagcgagactcgtctcaaaa

SEQ ID NO: 43873 - DNA, 207 bp, Homo sapiens
gtgaccgatgatcatgccactgcactccagcttgggtgagagtgggactctgtcttagaaagaaaaaaaaaagtatttggacacagacatgcatgcaaggaaggccaatgatgccggccaccaccaggagctgggagaggcccagggcagatccccttcagccttggagggacctagccctggccacaccttcatctcagacttgcg

SEQ ID NO: 43874 - DNA, 2062 bp, Homo sapiens
atttttagtttgttgaagttcgtgactgcttcactctctcattcttagcttgaatttggaaatgacttttgatgacctaaagatccagactgtgaaggaccagcctgatgagaagtcaaatggaaaaaaagctaaaggtcttcagtttctttactctccatggtggtgcctggctgctgcgactctaggggtcctttgcctgggattagtagtgaccattatggtgctgggcatgcaattatcccaggtgtctgacctcctaacacaagagcaagcaaacctaactcaccagaaaaagaaactggagggacagatctcagcccggcaacaagcagaagaagcttcacaggagtcagaaaacgaactcaaggaaatgatagaaacccttgctcggaagctgaatgagaaatccaaagagcaaatggaacttcaccaccagaatctgaatctccaagaaacactgaagagagtagcaaattgttcagctccttgtccgcaagactggatctggcatggagaaaactgttacctattttcctcgggctcatttaactgggaaaagagccaagagaagtgcttgtctttggatgccaagttgctgaaaattaatagcacagctgatctggacttcatccagcaagcaatttcctattccagttttccattctggatggggctgtctcggaggaaccccagctacccatggctctgggaggacggttctcctttgatgccccacttatttagagtccgaggcgctgtctcccagacatacccttcaggtacctgtgcatatatacaacgaggagctgtttatgcggaaaactgcattttagctgccttcagtatatgtcagaagaaggcaaacctaagagcacagtgaatttgaaggctctggaagaaaagaaaaaagtctttgagttttattctggaatttaagctattctttgtcacttgggtgccaaacatgagagcccagaaaactgtcatttagctggctgcagaactcctttgcagaaactggggttccaggtgcctggcacctttatgtcaacatttttgattctagctacctgtattatttcacctagcttgtcccaagcttccctgccagcctgaagtccattttcccctttttattttaaaatttgactcctcttcaagcttgaaaaccctctgaactcagtcttctttacctcattatcaccttcccctcacactcctaaaattgcatgaaagacagaacatggagaacttgctcaagtgcaggcagagagcaaaaaggggaaatatgtctgggaaaaagtgcacgtgaagaaacaaagaaggacagaggccattccgaaatcaagaaactcatgttcttaactttaaaaaaggtatcaatccttggtttttaaactgtggtccatctccagactctaccacttacggacagacagacagacagacacacacacacacacacacacacacattttgggacaagtggggagcccaagaaagtaattagtaagtgagtggtcttttctgtaagctaatccacaacctgttaccacttcctgaatcagttattatttcttcatttttttttctaccagaggacagattaatagatttaacccttcacaacagttcttgttagaatcatgggatgtgtggcccagaggtaagaatagaatttctttccctaaagaacataccttttgtagatgaactcttctcaactctgttttgctatgctataattccgaaacatacaagacaaaaaaaatgaagacactcaatctagaacaaactaagccaggtatgcaaatatcgctgaatagaaacagatggaattagaaatatatcttctatttttaggcttctatttcctttccacccactcttcacaggctattctactttaaaggaagcctttttattttgctgcacacaatctagcaggaatctttttttttttttaagagctgtgtcatccttatgtaggcaagagatgtttgcttttgttaaaagctttattgagatataattaacataaaataaactgaacatattt

SEQ ID NO: 43875 - DNA, 1082 bp, Homo sapiens
atttttagtttgttgaagttcgtgactgcttcactctctcattcttagcttgaatttggaaatgacttttgatgacctaaagatccagactgtgaaggaccagcctgatgagaagtcaaatggaaaaaaagctaaaggtactagggatgggaaaatgtgtacagggaaagaatcccagtgttagccccaaaatgtaaattcaccgaagaatgggattagaaagctaaacacccaagtatgggaaaatagaattaataccatttacttaaaagaaaaacaagaaggctataatgatgatgatgatgacaacttatttataacaatttatactgagtatttactacaggttattctatatgttattcactttcagagtattatttctcagaatcttcgcaataacattttgagattggtactattactatctcccttttacagagagctaactgggcatcaggaggactaacaacatcatccagtttcacggagctaataagtggtagagctaggactgtaccacaaactcccatttatccagaattctatacatcggagggctcgggaaccaaatttatctggtgtatataacgataatttctgtaagagtccttcaggcactacaaaaacctgaagtacctcatgaattatgcaggcaaagtaaatgatattcagtatagtttagcataagttacattttgttgtgtactactgcttggaaaaattgtaagttctgtttgacccatacagtaattaaattgcatagctataaattaattcataatcccaattccacagacaatctgggtaaattgccttttattctatatctgttctgaggaaaatgaacagaatataaggagagaaagagagacaagtattgtcagaaatttggataaagaaattccaaattacatttccaaaaacaaaacagaaatttctctcaatagagaacataagtgtgagcatggagtgatttaacatttgagccaatgaactaaattgctataaaaactgctgatatttataggtaaaaccagaagtgaacaatagtcattcgtttctttactcattcattattt

SEQ ID NO: 43876 - DNA, 477 bp, Homo sapiens
cagaggataatgataggagtaccttatttgtttatctcacaaggtgaggaaaccaaatacattgtatgggatgttttcctacacaaccagtaatatctgtgatttttttttttttagtggtggaacacataattgtatattcatacacctgtgagctatgtgatttttttttcaaaatggtgaatatttctcttgtaaaatcaagcctacacttggcgtgagtgtaggatatgctgttaatataagctaaattaatatcaaggtttcatccctacttttctttgattaataaccccagttccaggttgtaattttggtggactcataattgaatagcataaaattattcataaagttatttgaggtaatctcagttgattaactgaagaaagcttgtttgcttgatgtctgatatttatgttacttttgtgtgcacatgtgtacacgtggtgtaggaggggggatactctagagcgg

SEQ ID NO: 43877 - DNA, 3198 bp, Homo sapiens
cagaggataatgataggagtaccttatttgtttatctcacaaggtgaggaaaccaaatacattgtatgggatgttttcctacacaaccagtaatatctgtgatttttttttttttagtggtggaacacataattgtatattcatacacctgtgagctatgtgatttttttttcaaaatggtgaatatttctcttgtaaaatcaagcctacacttggcgtgagtgtaggatatgctgttaatataagctaaattaatatcaaggtttcatccctacttttctttgattaataaccccagttccaggttgtaattttggtggactcataattgaatagcataaaattattcataaagttatttgaggtaatctcagttgattaactgaagaaagcttgtttgcttgatgtctgatatttatgttacttttgtgtgcacatgtgtacacgtggtgtatattaaaaacttcaggctctctgcactgtggatgaatttgatccaaccaagctagactgtgagtttcttgaggagtaattgtcgggaaagtagataaagtataagctttagaatcatatatttagattcaaatatctggtatcgaatcctggctctgaatttactggctgtgtgaccatgggtaaattacttaaattccttaactctccctgttttccattcctaaatgtgtatgatgaattatttgcagagccatttggaggactagtggtatggaatgcaaactatttatgtctatttactaaaacataaacagagtaaatcaccaagtacagacaggctccaaggaatggtttgcttacttgttcactcttttttgtctttctgattctatcctctgtcactctaggtcttcagtttctttactctccatggtggtgcctggctgctgcgactctaggggtcctttgcctgggattagtagtgaccattatggtgctgggcatgcaattatcccaggtgtctgacctcctaacacaagagcaagcaaacctaactcaccagaaaaagaaactggagggacagatctcagcccggcaacaagcagaagaagcttcacaggagtcagaaaacgaactcaaggaaatgatagaaacccttgctcggaagctgaatgagaaatccaaagagcaaatggaacttcaccaccagaatctgaatctccaagaaacactgaagagagtagcaaattgttcagctccttgtccgcaagactggatctggcatggagaaaactgttacctattttcctcgggctcatttaactgggaaaagagccaagagaagtgcttgtctttggatgccaagttgctgaaaattaatagcacagctgatctggacttcatccagcaagcaatttcctattccagttttccattctggatggggctgtctcggaggaaccccagctacccatggctctgggaggacggttctcctttgatgccccacttatttagagtccgaggcgctgtctcccagacatacccttcaggtacctgtgcatatatacaacgaggagctgtttatgcggaaaactgcattttagctgccttcagtatatgtcagaagaaggcaaacctaagagcacagtgaatttgaaggctctggaagaaaagaaaaaagtctttgagttttattctggaatttaagctattctttgtcacttgggtgccaaacatgagagcccagaaaactgtcatttagctggctgcagaactcctttgcagaaactggggttccaggtgcctggcacctttatgtcaacatttttgattctagctacctgtattatttcacctagcttgtcccaagcttccctgccagcctgaagtccattttcccctttttattttaaaatttgactcctcttcaagcttgaaaaccctctgaactcagtcttctttacctcattatcaccttcccctcacactcctaaaattgcatgaaagacagaacatggagaacttgctcaagtgcaggcagagagcaaaaaggggaaatatgtctgggaaaaagtgcacgtgaagaaacaaagaaggacagaggccattccgaaatcaagaaactcatgttcttaactttaaaaaaggtatcaatccttggtttttaaactgtggtccatctccagactctaccacttacggacagacagacagacagacacacacacacacacacacacacacattttgggacaagtggggagcccaagaaagtaattagtaagtgagtggtcttttctgtaagctaatccacaacctgttaccacttcctgaatcagttattatttcttcatttttttttctaccagaggacagattaatagatttaacccttcacaacagttcttgttagaatcatgggatgtgtggcccagaggtaagaatagaatttctttccctaaagaacataccttttgtagatgaactcttctcaactctgttttgctatgctataattccgaaacatacaagacaaaaaaaatgaagacactcaatctagaacaaactaagccaggtatgcaaatatcgctgaatagaaacagatggaattagaaatatatcttctatttttaggcttctatttcctttccacccactcttcacaggctattctactttaaaggaagcctttttattttgctgcacacaatctagcaggaatctttttttttttttaagagctgtgtcatccttatgtaggcaagagatgtttgcttttgttaaaagctttattgagatataattaacataaaataaactgaacatatttaaagtgtactatttgataagttttcacaccttgtggagaacatgcatactacaattaagagagtgaacatatccatcatccctcaaagtgtcacaatgctcctcctgatgactcctccccagaaaaccaccaatcggctttcattttgcattttgtagttttatgtgaatggaatcatatagtatgtcttttttttttgtctggcttctttcactttgcataattattttgagattcatatgtctccatcttgatgctcgtatgaattcattcttttaaatgttgaatattcccttgtatggatataccacaattcatttacccatttacttgttgatgacatttgggttgttttagttttgggatattacaaataaagctgctgtgaacatttgtgtacaaaaaagtat

SEQ ID NO: 43878 - DNA, 2596 bp, Homo sapiens
ttgagggtaaacctacataaagtgagcccatgggtaaattacttaaattccttaactctccctgttttccattcctaaatgtgtatgatgaattatttgcagagccatttggaggactagtggtatggaatgcaaactatttatgtctatttactaaaacataaacagagtaaatcaccaagtacagacaggctccaaggaatggtttgcttacttgttcactcttttttgtctttctgattctatcctctgtcactctaggtcttcagtttctttactctccatggtggtgcctggctgctgcgactctaggggtcctttgcctgggattagtagtgaccattatggtgctgggcatgcaattatcccaggtgtctgacctcctaacacaagagcaagcaaacctaactcaccagaaaaagaaactggagggacagatctcagcccggcaacaagcagaagaagcttcacaggagtcagaaaacgaactcaaggaaatgatagaaacccttgctcggaagctgaatgagaaatccaaagagcaaatggaacttcaccaccagaatctgaatctccaagaaacactgaagagagtagcaaattgttcagctccttgtccgcaagactggatctggcatggagaaaactgttacctattttcctcgggctcatttaactgggaaaagagccaagagaagtgcttgtctttggatgccaagttgctgaaaattaatagcacagctgatctggacttcatccagcaagcaatttcctattccagttttccattctggatggggctgtctcggaggaaccccagctacccatggctctgggaggacggttctcctttgatgccccacttatttagagtccgaggcgctgtctcccagacatacccttcaggtacctgtgcatatatacaacgaggagctgtttatgcggaaaactgcattttagctgccttcagtatatgtcagaagaaggcaaacctaagagcacagtgaatttgaaggctctggaagaaaagaaaaaagtctttgagttttattctggaatttaagctattctttgtcacttgggtgccaaacatgagagcccagaaaactgtcatttagctggctgcagaactcctttgcagaaactggggttccaggtgcctggcacctttatgtcaacatttttgattctagctacctgtattatttcacctagcttgtcccaagcttccctgccagcctgaagtccattttcccctttttattttaaaatttgactcctcttcaagcttgaaaaccctctgaactcagtcttctttacctcattatcaccttcccctcacactcctaaaattgcatgaaagacagaacatggagaacttgctcaagtgcaggcagagagcaaaaaggggaaatatgtctgggaaaaagtgcacgtgaagaaacaaagaaggacagaggccattccgaaatcaagaaactcatgttcttaactttaaaaaaggtatcaatccttggtttttaaactgtggtccatctccagactctaccacttacggacagacagacagacagacacacacacacacacacacacacacattttgggacaagtggggagcccaagaaagtaattagtaagtgagtggtcttttctgtaagctaatccacaacctgttaccacttcctgaatcagttattatttcttcatttttttttctaccagaggacagattaatagatttaacccttcacaacagttcttgttagaatcatgggatgtgtggcccagaggtaagaatagaatttctttccctaaagaacataccttttgtagatgaactcttctcaactctgttttgctatgctataattccgaaacatacaagacaaaaaaaatgaagacactcaatctagaacaaactaagccaggtatgcaaatatcgctgaatagaaacagatggaattagaaatatatcttctatttttaggcttctatttcctttccacccactcttcacaggctattctactttaaaggaagcctttttattttgctgcacacaatctagcaggaatctttttttttttttaagagctgtgtcatccttatgtaggcaagagatgtttgcttttgttaaaagctttattgagatataattaacataaaataaactgaacatatttaaagtgtactatttgataagttttcacaccttgtggagaacatgcatactacaattaagagagtgaacatatccatcatccctcaaagtgtcacaatgctcctcctgatgactcctccccagaaaaccaccaatcggctttcattttgcattttgtagttttatgtgaatggaatcatatagtatgtcttttttttttgtctggcttctttcactttgcataattattttgagattcatatgtctccatcttgatgctcgtatgaattcattcttttaaatgttgaatattcccttgtatggatataccacaattcatttacccatttacttgttgatgacatttgggttgttttagttttgggatattacaaataaagctgctgtgaacatttgtgtacaaaaaagtat

SEQ ID NO: 43879 - DNA, 2418 bp, Homo sapiens
atttttagtttgttgaagttcgtgactgcttcactctctcattcttagcttgaatttggaaatgacttttgatgacctaaagatccagactgtgaaggaccagcctgatgagaagtcaaatggaaaaaaagctaaaggtcttcagtttctttactctccatggtggtgcctggctgctgcgactctaggggtcctttgcctgggattagtagtgaccattatggtgctgggcatgcaattatcccaggtgtctgacctcctaacacaagagcaagcaaacctaactcaccagaaaaagaaactggagggacagatctcagcccggcaacaagcagaagaagcttcacaggagtcagaaaacgaactcaaggaaatgatagaaacccttgctcggaagctgaatgagaaatccaaagagcaaatggaacttcaccaccagaatctgaatctccaagaaacactgaagagagtagcaaattgttcagctccttgtccgcaagactggatctggcatggagaaaactgttacctattttcctcgggctcatttaactgggaaaagagccaagagaagtgcttgtctttggatgccaagttgctgaaaattaatagcacagctgatctggacttcatccagcaagcaatttcctattccagttttccattctggatggggctgtctcggaggaaccccagctacccatggctctgggaggacggttctcctttgatgccccacttatttagagtccgaggcgctgtctcccagacatacccttcaggtacctgtgcatatatacaacgaggagctgtttatgcggaaaactgcattttagctgccttcagtatatgtcagaagaaggcaaacctaagagcacagtgaatttgaaggctctggaagaaaagaaaaaagtctttgagttttattctggaatttaagctattctttgtcacttgggtgccaaacatgagagcccagaaaactgtcatttagctggctgcagaactcctttgcagaaactggggttccaggtgcctggcacctttatgtcaacatttttgattctagctacctgtattatttcacctagcttgtcccaagcttccctgccagcctgaagtccattttcccctttttattttaaaatttgactcctcttcaagcttgaaaaccctctgaactcagtcttctttacctcattatcaccttcccctcacactcctaaaattgcatgaaagacagaacatggagaacttgctcaagtgcaggcagagagcaaaaaggggaaatatgtctgggaaaaagtgcacgtgaagaaacaaagaaggacagaggccattccgaaatcaagaaactcatgttcttaactttaaaaaaggtatcaatccttggtttttaaactgtggtccatctccagactctaccacttacggacagacagacagacagacacacacacacacacacacacacacattttgggacaagtggggagcccaagaaagtaattagtaagtgagtggtcttttctgtaagctaatccacaacctgttaccacttcctgaatcagttattatttcttcatttttttttctaccagaggacagattaatagatttaacccttcacaacagttcttgttagaatcatgggatgtgtggcccagaggtaagaatagaatttctttccctaaagaacataccttttgtagatgaactcttctcaactctgttttgctatgctataattccgaaacatacaagacaaaaaatagaaacagatggaattagaaatatatcttctatttttaggcttctatttcctttccacccactcttcacaggctattctactttaaaggaagcctttttattttgctgcacacaatctagcaggaatctttttttttttttaagagctgtgtcatccttatgtaggcaagagatgtttgcttttgttaaaagctttattgagatataattaacataaaataaactgaacatatttaaagtgtactatttgataagttttcacaccttgtggagaacatgcatactacaattaagagagtgaacatatccatcatccctcaaagtgtcacaatgctcctcctgatgactcctccccagaaaaccaccaatcggctttcattttgcattttgtagttttatgtgaatggaatcatatagtatgtcttttttttttgtctggcttctttcactttgcataattattttgagattcatatgtctccatcttgatgctcgtatgaattcattcttttaaatgttgaatattcccttgtatggatataccacaattcatttacccatttacttgttgatgacatttgggttgttttagttttgggatattacaaataaagctgctgtgaacatttgtgtacaaaaaagtat

SEQ ID NO: 43880 - DNA, 2143 bp, Homo sapiens
agagtcttaatgcaactgtgattcagtatcccaggtgtctgacctcctaacacaagagcaagcaaacctaactcaccagaaaaagaaactggagggacagatctcagcccggcaacaagcagaagaagcttcacaggagtcagaaaacgaactcaaggaaatgatagaaacccttgctcggaagctgaatgagaaatccaaagagcaaatggaacttcaccaccagaatctgaatctccaagaaacactgaagagagtagcaaattgttcagctccttgtccgcaagactggatctggcatggagaaaactgttacctattttcctcgggctcatttaactgggaaaagagccaagagaagtgcttgtctttggatgccaagttgctgaaaattaatagcacagctgatctgatttagagtccgaggcgctgtctcccagacatacccttcaggtacctgtgcatatatacaacgaggagctgtttatgcggaaaactgcattttagctgccttcagtatatgtcagaagaaggcaaacctaagagcacagtgaatttgaaggctctggaagaaaagaaaaaagtctttgagttttattctggaatttaagctattctttgtcacttgggtgccaaacatgagagcccagaaaactgtcatttagctggctgcagaactcctttgcagaaactggggttccaggtgcctggcacctttatgtcaacatttttgattctagctacctgtattatttcacctagcttgtcccaagcttccctgccagcctgaagtccattttcccctttttattttaaaatttgactcctcttcaagcttgaaaaccctctgaactcagtcttctttacctcattatcaccttcccctcacactcctaaaattgcatgaaagacagaacatggagaacttgctcaagtgcaggcagagagcaaaaaggggaaatatgtctgggaaaaagtgcacgtgaagaaacaaagaaggacagaggccattccgaaatcaagaaactcatgttcttaactttaaaaaaggtatcaatccttggtttttaaactgtggtccatctccagactctaccacttacggacagacagacagacagacacacacacacacacacacacacacattttgggacaagtggggagcccaagaaagtaattagtaagtgagtggtcttttctgtaagctaatccacaacctgttaccacttcctgaatcagttattatttcttcatttttttttctaccagaggacagattaatagatttaacccttcacaacagttcttgttagaatcatgggatgtgtggcccagaggtaagaatagaatttctttccctaaagaacataccttttgtagatgaactcttctcaactctgttttgctatgctataattccgaaacatacaagacaaaaaaaatgaagacactcaatctagaacaaactaagccaggtatgcaaatatcgctgaatagaaacagatggaattagaaatatatcttctatttttaggcttctatttcctttccacccactcttcacaggctattctactttaaaggaagcctttttattttgctgcacacaatctagcaggaatctttttttttttttaagagctgtgtcatccttatgtaggcaagagatgtttgcttttgttaaaagctttattgagatataattaacataaaataaactgaacatatttaaagtgtactatttgataagttttcacaccttgtggagaacatgcatactacaattaagagagtgaacatatccatcatccctcaaagtgtcacaatgctcctcctgatgactcctccccagaaaaccaccaatcggctttcattttgcattttgtagttttatgtgaatggaatcatatagtatgtcttttttttttgtctggcttctttcactttgcataattattttgagattcatatgtctccatcttgatgctcgtatgaattcattcttttaaatgttgaatattcccttgtatggatataccacaattcatttacccatttacttgttgatgacatttgggttgttttagttttgggatattacaaataaagctgctgtgaacatttgtgtacaaaaaagtat

SEQ ID NO: 43881 - DNA, 1237 bp, Homo sapiens
cagaggataatgataggagtaccttatttgtttatctcacaaggtgaggaaaccaaatacattgtatgggatgttttcctacacaaccagtaatatctgtgatttttttttttttagtggtggaacacataattgtatattcatacacctgtgagctatgtgatttttttttcaaaatggtgaatatttctcttgtaaaatcaagcctacacttggcgtgagtgtaggatatgctgttaatataagctaaattaatatcaaggtttcatccctacttttctttgattaataaccccagttccaggttgtaattttggtggactcataattgaatagcataaaattattcataaagttatttgaggtaatctcagttgattaactgaagaaagcttgtttgcttgatgtctgatatttatgttacttttgtgtgcacatgtgtacacgtggtgtatattaaaaacttcaggctctctgcactgtggatgaatttgatccaaccaagctagactgtgagtttcttgaggagtaattgtcgggaaagtagataaagtataagctttagaatcatatatttagattcaaatatctggtatcgaatcctggctctgaatttactggctgtgtgaccatgggtaaattacttaaattccttaactctccctgttttccattcctaaatgtgtatgatgaattatttgcagagccatttggaggactagtggtatggaatgcaaactatttatgtctatttactaaaacataaacagagtaaatcaccaagtacagacaggctccaaggaatggtttgcttacttgttcactcttttttgtctttctgattctatcctctgtcactctaggtcttcagtttctttactctccatggtggtgcctggctgctgcgactctaggggtcctttgcctgggattagtagtgaccattatggtgctgggcatgcaatgtaagtgctaaaatacggaactgatgtttattggggcaggggtgttggaaatgaggttaataaatatggtttataagtttctttcataacaactacaaacagccttgatatagattcattttaggcaaaatgtttttaagagtgaccatgaaaataaaggggtatattgttcatcttccaatggatagagccatgaaataaaaattacaattggtaggcatttttttgtttgtttgttttgttttgttttgtttcttttgttttcataactt

SEQ ID NO: 43882 - DNA, 666 bp, Homo sapiens
atttttagtttgttgaagttcgtgactgcttcactctctcattcttagcttgaatttggaaatgacttttgatgacctaaagatccagactgtgaaggaccagcctgatgagaagtcaaatggaaaaaaagctaaaggtcttcagtttctttactctccatggtggtgcctggctgctgcgactctaggggtcctttgcctgggattagtagtgaccattatggtgctgggcatgcaattatcccaggtgtctgacctcctaacacaagagcaagcaaacctaactcaccagaaaaagaaactggagggacagatctcagcccggcaacaagcagaagaagcttcacaggagtcagaaaacgaactcaaggaaatgatagaaacccttgctcggaagctgaatgagaaatccaaagagcaaatggaacttcaccaccagaatctgaatctccaagaaacactgaagagagtagcaaattgttcagctccttgtccgcaagactggatctggcatggagaaaactgttacctattttcctcgggctcatttaactgggaaaagagccaagagaagtgcttgtctttggatttctcattcagcttccgagcaagcgcatctatcatttacttgagctcgcttgctgactcctgtgaagcttcttcatg

SEQ ID NO: 43883 - DNA, 2472 bp, Homo sapiens
atttttagtttgttgaagttcgtgactgcttcactctctcattcttagcttgaatttggaaatgacttttgatgacctaaagatccagactgtgaaggaccagcctgatgagaagtcaaatggaaaaaaagctaaaggtcttcagtttctttactctccatggtggtgcctggctgctgcgactctaggggtcctttgcctgggattagtagtgaccattatggtgctgggcatgcaattatcccaggtgtctgacctcctaacacaagagcaagcaaacctaactcaccagaaaaagaaactggagggacagatctcagcccggcaacaagcagaagaagcttcacaggagtcagaaaacgaactcaaggaaatgatagaaacccttgctcggaagctgaatgagaaatccaaagagcaaatggaacttcaccaccagaatctgaatctccaagaaacactgaagagagtagcaaattgttcagctccttgtccgcaagactggatctggcatggagaaaactgttacctattttcctcgggctcatttaactgggaaaagagccaagagaagtgcttgtctttggatgccaagttgctgaaaattaatagcacagctgatctggacttcatccagcaagcaatttcctattccagttttccattctggatggggctgtctcggaggaaccccagctacccatggctctgggaggacggttctcctttgatgccccacttatttagagtccgaggcgctgtctcccagacatacccttcaggtacctgtgcatatatacaacgaggagctgtttatgcggaaaactgcattttagctgccttcagtatatgtcagaagaaggcaaacctaagagcacagtgaatttgaaggctctggaagaaaagaaaaaagtctttgagttttattctggaatttaagctattctttgtcacttgggtgccaaacatgagagcccagaaaactgtcatttagctggctgcagaactcctttgcagaaactggggttccaggtgcctggcacctttatgtcaacatttttgattctagctacctgtattatttcacctagcttgtcccaagcttccctgccagcctgaagtccattttcccctttttattttaaaatttgactcctcttcaagcttgaaaaccctctgaactcagtcttctttacctcattatcaccttcccctcacactcctaaaattgcatgaaagacagaacatggagaacttgctcaagtgcaggcagagagcaaaaaggggaaatatgtctgggaaaaagtgcacgtgaagaaacaaagaaggacagaggccattccgaaatcaagaaactcatgttcttaactttaaaaaaggtatcaatccttggtttttaaactgtggtccatctccagactctaccacttacggacagacagacagacagacacacacacacacacacacacacacattttgggacaagtggggagcccaagaaagtaattagtaagtgagtggtcttttctgtaagctaatccacaacctgttaccacttcctgaatcagttattatttcttcatttttttttctaccagaggacagattaatagatttaacccttcacaacagttcttgttagaatcatgggatgtgtggcccagaggtaagaatagaatttctttccctaaagaacataccttttgtagatgaactcttctcaactctgttttgctatgctataattccgaaacatacaagacaaaaaaaatgaagacactcaatctagaacaaactaagccaggtatgcaaatatcgctgaatagaaacagatggaattagaaatatatcttctatttttaggcttctatttcctttccacccactcttcacaggctattctactttaaaggaagcctttttattttgctgcacacaatctagcaggaatctttttttttttttaagagctgtgtcatccttatgtaggcaagagatgtttgcttttgttaaaagctttattgagatataattaacataaaataaactgaacatatttaaagtgtactatttgataagttttcacaccttgtggagaacatgcatactacaattaagagagtgaacatatccatcatccctcaaagtgtcacaatgctcctcctgatgactcctccccagaaaaccaccaatcggctttcattttgcattttgtagttttatgtgaatggaatcatatagtatgtcttttttttttgtctggcttctttcactttgcataattattttgagattcatatgtctccatcttgatgctcgtatgaattcattcttttaaatgttgaatattcccttgtatggatataccacaattcatttacccatttacttgttgatgacatttgggttgttttagttttgggatattacaaataaagctgctgtgaacatttgtgtacaaaaaagtat

SEQ ID NO: 43884 - DNA, 764 bp, Homo sapiens
atttttagtttgttgaagttcgtgactgcttcactctctcattcttagcttgaatttggaaatgacttttgatgacctaaagatccagactgtgaaggaccagcctgatgagaagtcaaatggaaaaaaagctaaaggtcttcagtttctttactctccatggtggtgcctggctgctgcgactctaggggtcctttgcctgggattagtagtgaccattatggtgctgggcatgcaattatcccaggtgtctgacctcctaacacaagagcaagcaaacctaactcaccagaaaaagaaactggagggacagatctcagcccggcaacaagcagaagaagcttcacaggagtcagaaaacgaactcaaggaaatgatagaaacccttgctcggaagctgaatgagaaatccaaagagcaaatggaacttcaccaccagaatctgaatctccaagaaacactgaagagagtagcaaattgttcagctccttgtccgcaagactggatctggcatggagaaaactgttacctattttcctcgggctcatttaactgggaaaagagccaagagaagtgcttgtctttggatgccaagttgctgaaaattaatagcacagctgatctggacttcatccagcaagcaatttcctattccagttttccattctggatggggctgtctcggaggaaccccagctacccatggctctgggaggacggttctcctttgatgccccacttgtaagtttcccattctttttgat

SEQ ID NO: 43885 - DNA, 2356 bp, Homo sapiens
atttttagtttgttgaagttcgtgactgcttcactctctcattcttagcttgaatttggaaatgacttttgatgacctaaagatccagactgtgaaggaccagcctgatgagaagtcaaatggaaaaaaagctaaaggtcttcagtttctttactctccatggtggtgcctggctgctgcgactctaggggtcctttgcctgggattagtagtgaccattatggtgctgggcatgcaattatcccaggtgtctgacctcctaacacaagagcaagcaaacctaactcaccagaaaaagaaactggagggacagatctcagcccggcaacaagcagaagaagcttcacaggagtcagaaaacgaactcaaggaaatgatagaaacccttgctcggaagctgaatgagaaatccaaagagcaaatggaacttcaccaccagaatctgaatctccaagaaacactgaagagagtagcaaattgttcagctccttgtccgcaagactggatctggcatggagaaaactgttacctattttcctcgggctcatttaactgggaaaagagccaagagaagtgcttgtctttggatgccaagttgctgaaaattaatagcacagctgatctgatttagagtccgaggcgctgtctcccagacatacccttcaggtacctgtgcatatatacaacgaggagctgtttatgcggaaaactgcattttagctgccttcagtatatgtcagaagaaggcaaacctaagagcacagtgaatttgaaggctctggaagaaaagaaaaaagtctttgagttttattctggaatttaagctattctttgtcacttgggtgccaaacatgagagcccagaaaactgtcatttagctggctgcagaactcctttgcagaaactggggttccaggtgcctggcacctttatgtcaacatttttgattctagctacctgtattatttcacctagcttgtcccaagcttccctgccagcctgaagtccattttcccctttttattttaaaatttgactcctcttcaagcttgaaaaccctctgaactcagtcttctttacctcattatcaccttcccctcacactcctaaaattgcatgaaagacagaacatggagaacttgctcaagtgcaggcagagagcaaaaaggggaaatatgtctgggaaaaagtgcacgtgaagaaacaaagaaggacagaggccattccgaaatcaagaaactcatgttcttaactttaaaaaaggtatcaatccttggtttttaaactgtggtccatctccagactctaccacttacggacagacagacagacagacacacacacacacacacacacacacattttgggacaagtggggagcccaagaaagtaattagtaagtgagtggtcttttctgtaagctaatccacaacctgttaccacttcctgaatcagttattatttcttcatttttttttctaccagaggacagattaatagatttaacccttcacaacagttcttgttagaatcatgggatgtgtggcccagaggtaagaatagaatttctttccctaaagaacataccttttgtagatgaactcttctcaactctgttttgctatgctataattccgaaacatacaagacaaaaaaaatgaagacactcaatctagaacaaactaagccaggtatgcaaatatcgctgaatagaaacagatggaattagaaatatatcttctatttttaggcttctatttcctttccacccactcttcacaggctattctactttaaaggaagcctttttattttgctgcacacaatctagcaggaatctttttttttttttaagagctgtgtcatccttatgtaggcaagagatgtttgcttttgttaaaagctttattgagatataattaacataaaataaactgaacatatttaaagtgtactatttgataagttttcacaccttgtggagaacatgcatactacaattaagagagtgaacatatccatcatccctcaaagtgtcacaatgctcctcctgatgactcctccccagaaaaccaccaatcggctttcattttgcattttgtagttttatgtgaatggaatcatatagtatgtcttttttttttgtctggcttctttcactttgcataattattttgagattcatatgtctccatcttgatgctcgtatgaattcattcttttaaatgttgaatattcccttgtatggatataccacaattcatttacccatttacttgttgatgacatttgggttgttttagttttgggatattacaaataaagctgctgtgaacatttgtgtacaaaaaagtat

SEQ ID NO: 43886 - DNA, 2437 bp, Homo sapiens
tatcagtatcagtaataaaagtattataataaagtatcagtaataaaagtattataataaaaagtattattaggacaggtaaactcatccatctactgtgagctgctggcttggagaacgacttttgaggagccagtttcctgaggagaaatgcttttataaagcactcattgctttgtaaaaggagacaaaactgatcctaaatgaccactccagggttgctgattttgtttctggctcatgtctgcctagtaaaccaccagcaagctgctgaaccaggctggaaacaacattgttgcaactgggagggacatagagtactgtgaaagcagcgttccaacacatcttcacttttacacagggataggcagagacttccaacatagaggttcttaaacttcgaggggttacaatccccttgcaaatatttttatagctatggaccctctcctcagatctacagccaacattttcagtgcaccttaggaggtcattttagtccacgcctctgaaaaagctgcactccaacggctgaagagcaagccatacggccgagaatggggctccctttgccttcatgaaagctacttcccccaacactaagactcagctgtacgtttgcttagctcagtcacatttacattcttctgggtgaactgtaccttttgagtacctgccttcattttctagaatcagacctaacaaggtcagtagaagcctgggcagcagcgggcctggaaagacgaggcagccagcatgaactgctgttctctccctgaccacaaggcgtcgtcttcctccagggtcaagtaattgttcttgttccgcctcacaggaatgtggggaggaaggacgttaacactataaaatgctgcgtcctaccttaaacttgtactgtgagaaagctggaaacttccacctgtacagtgggtctggtttgcatgtttagtttcatttgtgggaactgcttgtccaagagtgagctcaggtcagggcagtttgtgcctatgagaattagctcagctatcaggcaggtttttagacacctttttaaaatgtgctcgtgtttggtttgttttgcttactgtcagtcctgggtcaatcaaaggtttgtaagggtgagaatttttatgcactgctatatcgcaagtgcttaaaacagagactggcccagatgaggcattcttcaaatgtttgttgaaatgaatggacaaactcttaggataaatcctaatttgttggcaactgttatttgattttagaaggcaaactgattttattttagagaggggaaggggaggggaggctcattagcctcttggtagaaagaggactatttctgcaaatgaataggtttccaccttaagtagtgacagtccttaacttcttattatggagtgagtcttgaccgctttccaagttcaatagaagttcaagattgcctctcagtgattagggaaattgaagcttttaaagctcctggtctcagtaattcctcagaataaacctctttaaaagggatattgatggaaatgtacaattaccagtaattgaggttttatctgaggggatggagatgatgaaatggttccttcttggaagttgttggcattttggctttatttttcacaaataaagtgaaaccatttaaaacgattgacaacgattatatagtgccatgtggaatacaatagatattaatttgtggttggtttttctgcctgctttaaatgaaatgtattatgtttctgggttccttttttagctgtaaaaatacttcgtcactaaagcatgaaatttaatcagcagttgttcttcaagttcctgaaagctataaaagtttctcatgacttgagtggttttttccctgcccaccagaggagaaagcccttgtagaattctgcagtgttacaagtgttccctacaaaaactgaaaccatcagctcctctttaacaagttggctttttaaaagcacgtaattacaatttaatggtattctgtaaagtggtgctctaggcataatttaaattctttttaatgactatatttcttcaaaactttgaaagaaaaatgtgttctttttgctgcatcctttgtaagaagactgccaacagaggaaaaaggactttacaaattaagaccatcttggtttcatttccacaaagatgagaacaaatcatggtgttaggaaaggatccttagaagaacacaagaatttgaaagcccttggtggttatcactactatatttcatatttccacagaagtgacttagccaagctctgcattttgagcctgctgactttcatttaaaaggaatgaaaggctgaaaatccaggctgctgtgtctgtagataaaggtcaaaccatgtttgagttcttcactgttgtgtccacctaaataaaactgagtaagtaatgaaaaaaagtcttaata

SEQ ID NO: 43887 - DNA, 1232 bp, Homo sapiens
gcaatgctaggtataatagggaccaacctgtggagatgcccggtattccagcagctcaatccagtctgattttattttagagaggggaaggggaggggaggctcattagcctcttggtagaaagaggactatttctgcaaatgaataggtttccaccttaagtagtgacagtccttaacttcttattatggagtgagtcttgaccgctttccaagttcaatagaagttcaagattgcctctcagtgattagggaaattgaagcttttaaagctcctggtctcagtaattcctcagaataaacctctttaaaagggatattgatggaaatgtacaattaccagtaattgaggttttatctgaggggatggagatgatgaaatggttccttcttggaagttgttggcattttggctttatttttcacaaataaagtgaaaccatttaaaacgattgacaacgattatatagtgccatgtggaatacaatagatattaatttgtggttggtttttctgcctgctttaaatgaaatgtattatgtttctgggttccttttttagctgtaaaaatacttcgtcactaaagcatgaaatttaatcagcagttgttcttcaagttcctgaaagctataaaagtttctcatgacttgagtggttttttccctgcccaccagaggagaaagcccttgtagaattctgcagtgttacaagtgttccctacaaaaactgaaaccatcagctcctctttaacaagttggctttttaaaagcacgtaattacaatttaatggtattctgtaaagtggtgctctaggcataatttaaattctttttaatgactatatttcttcaaaactttgaaagaaaaatgtgttctttttgctgcatcctttgtaagaagactgccaacagaggaaaaaggactttacaaattaagaccatcttggtttcatttccacaaagatgagaacaaatcatggtgttaggaaaggatccttagaagaacacaagaatttgaaagcccttggtggttatcactactatatttcatatttccacagaagtgacttagccaagctctgcattttgagcctgctgactttcatttaaaaggaatgaaaggctgaaaatccaggctgctgtgtctgtagataaaggtcaaaccatgtttgagttcttcactgttgtgtccacctaaataaaactgagtaagtaatgaaaaaaagtcttaata

SEQ ID NO: 43888 - DNA, 381 bp, Homo sapiens
tcaccttaatatgtttttaatacatgtgatatttttgtaggtctagaattgtgaaatcaattctcttaaacatcttattatagaagtgtctgctgctatcctttgagcactaaccccaccacctgtaatgcatcatgccaatataagtgatagaattgctttgctaaattcttaagggcttatgtcagggaaaaactttgaaattagctgggtacagtggctcatgcctataatctcagtgctttgggaggccaaggtgggagaatcacttggctgggagaccagcctgagcaattcagcaagaccccttctctacaaaaactgcaaaacttagccaggtttggtggcacacgcctgtagtcatagctactgggaagactg

SEQ ID NO: 43889 - DNA, 793 bp, Homo sapiens
tgtgtctctcctgcagcctccattctgggtgcctccacccccttgccgtcgtcatggtaactgatgagcagcatgtgaccgaaagctctctgcccccccaaccccataccccctccccatcttgtgatcaccctcattacctcttctgggccccctgtggacctgcgttgacccagcatgggctacaatgggggagttgggtaatcgctcccggtaggttcctccccaacccccgaggcggggtcaggtggagcgtgggcgccagagcagcccctctgccttgggtgtcttggagatgacttggcgccccccggagccccgtcatggctgtggctgcgtccacaacactgcatcagcagagtcctggggaagccatttaggaatctgaagccctggatttctgctttgtcccttcaggggttcctgagcctgttaaaaaaaaaaaaaaatctaggaagaggccctggaaggaaaaaggggagggagatagcctattttacaaggtctgaaatgatgtgtcttatccttctggcttaaaccaagctgggcttaaaacatcttttaaaaaaaatctgtattctatttttttctctctgtttatcgctctccttctgcctctgttaatctttgtttctgtgtagttgcatcctgtttctgtctgaaaacccttgtctttctgaatccatctttcagtctctcacattctgtctttcccctcctccttcaccttccctccgtccctctcccttgcgcacttgccgggtaccagctgagtgcatccttttcccaaacc

SEQ ID NO: 43890 - DNA, 322 bp, Homo sapiens
aaccatcattagtcccaaaaattcacattgtagactgtgaattttgatcaatgaaatgaaaattcttagaagaaaattataaaaatgaataatattcaagaaatgaatacttttttcccagaacactacttttatactggtaaaagagggcattgaactaaaatgagtggagcctaatagagaagctatgctacctactctgcttgtagtgaatgtctgcatttcagtagcttaacaaaatcaaagttacatcttactcatatcaaagtacgatatggttatttctgatcagtaaggggaacggggactggcattgctataa

SEQ ID NO: 43891 - DNA, 525 bp, Homo sapiens
cacgaggggaactcatacatttctgggggcttcgaacatcagtcagtgaaggaccctgcaagactgaaaaaaagtcactacagttatctcagcctactgccttgaaaaagtttctattccagagcagggaaggaagagcccaggcagagcttgggagattgtggagtgaggagaccaagctgagagtgtggagagacccaaatgtcaagaatttccaaggcggagttctggagaggagagagctgcggagagaagagtctgaagataacgggtgattcccctggatgatttcgcagagcactgtgtgtgaggaaactcacccaggctgaggaatgacccaccacgaaggatcagagggagtggacccgggaactcacacaggcctgggaatgtctgttcctgccagccagctggaaagccttataattcaaggggttttgggtacagtacaaaaaaggcgcttgcctcagtcctggaggataattagccctagactaagtgcttctcttacctcacctgtcagat

SEQ ID NO: 43892 - DNA, 494 bp, Homo sapiens
gcttcttatccttgagtctgttgggggccctggagtctgagccagcttctctgtgttggaaacacctggacagggctgggctcaggtggattagagggggtgtgtatatctgtgagtagtttctggaatccttctttcccctgaatgagttatgtgcacttatctgtcccacaaaggataaagggacacatgggttaggggaggttttggaggcagttcccctcccaccccccagcccaccaaatgcttaggtatagactagtcactaaggtggaaggaatgtaggaatctcaggctctcagagtcagacctcagaaggctcccaggcaatgatccttgaggtgcagaaacccccttctcagccctgccccacatccttcatgagcattcctcaaactctgcctgaatgtctccagagcccgagaactcaccgcttctttggtggccccttccagctggggacagttctgaaataaagctcttccttctcagca

SEQ ID NO: 43893 - DNA, 388 bp, Homo sapiens
gtgtttgcaaggaagacttggccaaggaacaaaaggactgcccagcaaccaccagaggcgaggggagccgcacagaccaggttctcactcgcagcctccaaaataagccaacaccttgatttcagacctctggcctccagaaccgtgagagagtacatttccatggctgaagccaccaagtacatggtcattcgttatggtgatcctagagaacaatccaacccaccgtgagccagacagagacaaacaggaaccagtttctaccctcaagcggcgtccctgaaacggcaggttcacggacaagggctgttgtgagagtaaatgagatcatggctgtggaggcagacagccggggcaagagaggggcttttatgactactactggggt

SEQ ID NO: 43894 - DNA, 308 bp, Homo sapiens
gtgatgtatattctaaaataccccagaagtagaaataaagagttagtgaaatggtataataattaaatttaactgtaccaggtgcttctgaccctaaaggacctattctagggcccctaccctactattctgattcacattgcatcaacttctacctccacctccacaataagtgttctctaaagttgcaggttgagaatatagtaggtgcccaggacaaaagcccttttcactgtggaggactccaggccactttgcataaaatcagaaagggaacatggcttttcaaactgagagaaacccagagt

SEQ ID NO: 43895 - DNA, 432 bp, Homo sapiens
atatcaactgtggggccctggaggaaggcacgctggtggctgcaaactgcagcactccaagaccctgggtctgtgccaaggggacccagtgatctgggctctgcctggtcctcagcctgccaggcagatgcagcaccccctacaggggaggccagttgagagcttgggcagcctcttcctggacccagttatccaggtcttcatgctctgctcaagggggccacatgagcgagcctaggagctggacttcaacccaggaagatgcatccgagggaaaggagattttctatggcctcaggcctgagtgccaatattagtctccagcttctgtggatgatcggtttgatgacattgggatggttgtttagcatttctgtgccttggtttcattaaaatgacaatttccccctagaggaaaaagacagggttaac

SEQ ID NO: 43896 - DNA, 375 bp, Homo sapiens
atttagatattttctcccaacctaagaaaaacacacataatgtctacagagtaaaagagaaaaccagtatgagttgacatgactttattcctagcattttttttcttcaaaaattgtggtaatttacctacacattagatcactctaccttggctacttccaatttgtattatagctgtggaatgaattcagtagccctggaagtctagtcaaggtggttgaatataataaaatgtatgctgttcatcatagtttttcttaatactacagttactttgtttccaagtttgaattttttgccagatttggccaacataaaatctagtttcataagcaaaaatgtcagaaaaattccctttcccttaattagtagca

SEQ ID NO: 43897 - DNA, 480 bp, Homo sapiens
caggctgaagtatttaagattcctaaaagtttcaataaaaaagagtgtgtgtctgtgtaaagatggagaggagagagcatgcaaatgtggcaaaatatcaacatctggggagcctagataaaggcgctcactgaactctttaaactgttctagaagggtaactttttcaaaacagtatcttaggattaaaaaaaaaattcagagttccaacttcatgatgcaaggcactgtcttaagattaactggacatttctagcccctccccaattcagagacaaaaccacagaggaaaaccattacaattttttagaaaacctataatgtataaacaataaaaagatgcccatattaaaggattactatcaaacagtattatgactctctaaggctttattctgacaggctaaggcaaaaagctgaggggtttatggctttgttttaaaccacgttcataagaagaaggctgagagcgaacgtttt

SEQ ID NO: 43898 - DNA, 597 bp, Homo sapiens
ggcacgagcaaaccccagcattacacaatatacccacgtaacaaacctacacatataccctttaatcgataaagaaagttgaaattattttttaaaaaagaagaaattaccaggccaaaaaaaaaaaaatctatatactgctgatgatactcactattaacgtattacatcagattttttgcctcagatgctcctaggaacttgtacttaaatctgggatatctatcctttgactaggtgcctcattagatttcatgcagtttcaaattttagatttcaaattataattctgatttgatggatggatcccaggttgtcctttttgctttatgtttttatgtaaagaggcaacagttcagcaataatttatatttattttgaatgtaatttatttttatgtatcaactttgccttttcaatacttttttttttttaagagacagggtctcactgtgttgctcaggctagactcaaactcctaggctcaagccatcctgccacctcagcctcccaagtagctgggacttgggtcccagttacacaggtgtacgctactgctcctggcagcttctgaatattttgcttaagcagatgtta

SEQ ID NO: 43899 - DNA, 320 bp, Homo sapiens
tactgctgactgatttaagcatgcttaatgtgtttattttttaattgttttcatctttaggtagtcttgagagtcttttaaaaatttacagtaaatacagatgtatcttgaagctctcctcatcagtgagaagtccaacacaaatttaatttttaataaatgacatttgagttattttttcaaaacttgtagtatcagatcacctggcaaaaaatttattattcagaattttctttaatatataagtttgttcttttgcaaatgaatgatactaaaaaaagttaaagttcttcagagtttattcattaagcattttaact

SEQ ID NO: 43900 - DNA, 445 bp, Homo sapiens
tatctagctttcatctttcagagtacctagcataggacttggcaccaagtagcccatagtaaacagttattcaaccataatgtatgattttcttttctacttttcactggtatgtttttgtttaaaaagggtaaaccaccagggatggaaatgtccttgctatgttatccttcttctctaattagcaaccacccttcacaatctgccacattacatttaaaaaggattttcaaattagacatttatgcctgggcattaaccagggactgatgaatcagtgccatcagcagaacactgccctgactggcagacatggcaccattgtcaagacttgtaatttactcctggcttttcaaatagtcagtgtgtaactccaggcaaggtttaattatctcctgttaaaatgggaataatatgacccacccccactttgcttcccatgggt

SEQ ID NO: 43901 - DNA, 403 bp, Homo sapiens
ttagtttaaatgcaagacagtataagggtctgataaatttgaggatcagtatactgaatgcattcttagtgttggcttttctaaattatgtgctagttatcccacattatgttcattcacagtagcatttttccagtaatactgctttcaagacaaagtaatagtttgctagaatgttattgctttttgtttaacccttaatgtttttaataagatgttaagtaccctcaggtttgcacttgaacagcctattattaataagcaagatgtgctacgctttgcaaaaatcaacataattctactgtttgtactcagtcatctgatgcttctagtaaccaagcaaaagaaaacatacttaattaaatcagtcttatttgcaagcactagttttaagtattaagag

SEQ ID NO: 43902 - DNA, 376 bp, Homo sapiens
tttagtactgtgggccaatggacaaccttcaatcatcttttctacactgaccctcagacattctatctgctctcacggactcctttatttaccatgaataaagttccaaaatctacatattcatcccaagtctctttccagttccccttcttacattgcctatttgccatttctcccttcaataccctatacttcactcaaattcaacataccaaaaataaaaggccaggcacggtggctcacacctgtaatcccaggactttgggaggctgaggcaggtggatcacctgaggtcaggagtctgaccagcctgaccaatatggtgaaaccccgtctctacctaaaatacaaaaattagccaggcgtggtggcatgt

SEQ ID NO: 43903 - DNA, 180 bp, Homo sapiens
agcagagggcacagctcctgctccctgcccctgggattttcccagccccccccacgccagccccagtggcacagctcccatacaccatgctgtgcaggtagctcaggtgggcaaagggcagaaccctgaggggaaaatcctcactgcctctcacctgagtggcatctgaaatgttgtggg

SEQ ID NO: 43904 - DNA, 651 bp, Homo sapiens
actgcataatttccctttgttcccttcaacctcaacagatacacagctacacacaaaatctccaagactaccttccttccttctctatctaccagattcttattttcctttgtaactctcttctagaatcaccttcctccaaaaggattttttttatccaggtatctatctttctcaacacaactttactcactgccacaccacttcagcatttcttcttttctagatatttggcaattgtgtatttgtcatttgggatcaaatttgattcctgtttcatcacaacattgcctaaacagcaatgcttctgattctacatttgaaaattaaagcttatacacaaagtttaagattgtctctttttttttgtttgttttcttttcttttttgtttttgttaagactgtctcttgtaaaaaatgtttgcacagttgtcatatgtttgcatgacaagctgatcatggttccttacaaagtatacccaaggtatttgctctcaaccttttctcaccacccagtgcacacacacagaaattcactaacatgggtgctcaataattgaaaggaaccaaaagctgttggtggaacgtaagtgtccctccctcttctcttcccaccacctcaggcacaacaacgattagcagcttctgtg

SEQ ID NO: 43905 - DNA, 1237 bp, Homo sapiens
actgcataatttccctttgttcccttcaacctcaacagatacacagctacacacaaaatctccaagactaccttccttccttctctatctaccagattcttattttcctttgtaactctcttctagaatcaccttcctccaaaaggattttttttatccaggtatctatctttctcaacacaactttactcactgccacaccacttcagcatttcttcttttctagatatttggcaattgtgtatttgtcatttgggatcaaatttgattcctgtttcatcacaacattgcctaaacagcaatgcttctgattctacatttgaaaattaaagcttatacacaaagtttaagattgtctctttttttttgtttgttttcttttcttttttgtttttgttaagactgtctcttgtaaaaaatgtttgcacagttgtcatatgtttgcatgacaagctgatcatggttccttacaaagtatacccaaggtatttgctctcaaccttttctcaccacccagtgcacacacacagaaattcactaacatgggtgctcaataattgttattgacaagaattccaaacagttggtcaaatgactttttacttacaacatggagccataagtcataagataatttaatttatgaagaatcaatatgaaataaagacttaaagctcaatcttgttacctgtttggtgaacaactctggaaagtcaggataaaggaaagccaagtcgacagctgttttatctaagcagtaagaatatgcagatgggaccctcttctgttctcctaccatgtttgttccaggattccaatttgaaatctgtatgtgccccttgacacctcaatgctttgtcaagcacctcatttctctggctttagttttatagacaaagaaaccaaatacatggtgatggagcagcttatcacagtatgtttttagaaacaccaatgctaaaattaccagtccccaagtgtcaggtgaaattactataagaattaagtgagaattactttgatctaaagtattaatgaaaatggtagtgtcagtcatgattctggataattactcaaatagacaattttaaaaattgggacaacacattaatatgagaatatactgttataaagagaaaataggccgggtagggtggctcactcatgtaatcctagcattttgggaggctgaggtgggcggattgcttgagtccaggagtttgagaccagcctgggc

SEQ ID NO: 43906 - DNA, 401 bp, Homo sapiens
gacctggtctttttcatctctgtattaatgaactatgtatctatgtatgatacatacatgcatactatcatctgtgtatgaactgtgagcaagtgtgatataagaattggttgtgaggccgggcgcggtggctcacacctgttatcccagcagtttgggaggctgaggcaggaggatcacttgagcccaggagtttgagacaagcctgggcaacatggtgaaaccctgtgtctacaaaaaaatacaaaaattagtcaggcgtggtggtgcgcacctgaagtcccagctactctggaggctgaggcaggaggattgcttgagcccaggaagtggaggctgcagtgagccaagattgtgccactgcactccaggctaatcaacagagcaagacccagcgtcca

SEQ ID NO: 43907 - DNA, 349 bp, Homo sapiens
tttttgagctatacttcagctcaaaaagaggagctttttgatgtgatttgtcaagaatgtagattgttttcttgtgtgaattcttccctgtataatcctgatcattctattttagtggtaagagcccgagaaggagtatggatacctgtaaggctttcccgtccttggaaagcctctccttctgtgcatattattactgaaattcttcaaaagattttgaggcactcttggcgttaaattgctgctttaattttagtcattatgggatgattgctgtcacagctactgccacggcagctgggagttgctttgcattccacagtacaaacagcagactatgtaaataatt

SEQ ID NO: 43908 - DNA, 301 bp, Homo sapiens
atcctcaaattatattctcgcatgtatcagagattaaaataaatgtataatgtttattataaatatagactaaaagaattacagtattttaactttgaagtactattgcattcatgaatgattacgcacttagtttataggctcttagcctgaatagatgttcagtaaacaaggaacttttgaaaaattacatcatattatcagttacatttaataattaatttctgacattaatttgattcctcaaaagtgttgatgatcctctcttattgagtatgtagttgatgcccatcattttcaa

SEQ ID NO: 43909 - DNA, 343 bp, Homo sapiens
tgggagagtgtgctagggggaggagctgcaagaagggatgctccctaagctgatgccggggctcacccctgtgaactggctgtgctgcagtcagcagggcagctcctctgtgccaggtgctccacaggcatcatctctgacatcttcagtgcccttgcaggaagcccctccatatggctgtttctcagttgagaacacgaatcctttagtggttagaactgaaggcaggctgggcatggtggctcatgcctgtaatcccagcactttggaggccaagtacctgaggtcaggagtttgagaccagcctggccaacatggcaaaaccccatctctactaaaaata

SEQ ID NO: 43910 - DNA, 730 bp, Homo sapiens
ttcttttccctgggtcctgggagctgaggcaggaggagaagtggggggatgggagtggagagggagggcgggaaatcccagtgtggggagagggtcgatcagaccggcttggctccctgggcacctctgtcagagccccgcccagggctgcgtggccgcccatataagtggctctgggctgagacggagaagtcagtgcccgtgtctccacacgtctgcctccatcactgccatcgcgatcctgcagctatgtcctaccctgtgaccagtcagccccagtgcgccaccaccagctgctaccagacccagctcagtgactggcacacaggtctcacggactgctgcaacgacatgcctgtctgtctgtgcggcacttttgctcctctgtgccttgcctgccgcatctccgacgactttggcgagtgctgctgcgcgccctacctgcccggaggcctgcactccatccgcaccggcatgcgggagcgctaccacatccagggctccgtcgggcacgactgggcggccctcaccttttgtctgccctgcgccctctgccagatggcgcgggaactgaagatccgagagtaaggaagttccctgtcttccccgtccttttccaccagtctcgcctctggccttctctggccactcctgggagggactgcctcaccacccctgtcccgctgccagaaatacacccacaataaaaacctgaaaaccaaaaaaaaaa

SEQ ID NO: 43911 - DNA, 339 bp, Homo sapiens
atgattatataattgttaaatcacttaggagaattgtaaaaataaaatgtacaacaaacatgtagcagctacattgctaacaaaacgtgtatttccataaataagtgtacctttaacacttttcaaagaacattatctccgaaaatctcgttttattttcagtaaaatagctactgaagtgactccatttccttgaggtaaccacaaggaaaacaatgcatagaatcaaggcaattacacagacaattcaggcatttactcaaaaattcattttttaataataggtaactttggtcgtgtaaatacagtctgtcccaggtgtggtctccctattacagt

SEQ ID NO: 43912 - DNA, 540 bp, Homo sapiens
ttttttgaggctgaaaggggcacccagaatggtctttaaaccatgactgggggccttttcagaatgtgacgccaggttatcgctctctggctgggactctgtagtgcactttgtgggaccacacggagacagattcgaagtaggatggatggattctctaggtccttgagcatgttccagttaggcaagaggccagaggagatgcatagcttactctgagcatcttgacggtggacctcatggaatgtctttcaagcttcccatcttcatgttttaaaaaatccggttatctaaggaacgaagtttcagacccaccagaactgtagaagggcatcggatcctggtcagcagggtctcactccagttcttcggggtctgagactctctggaagagccaagaatgtgggctggggagtggagggaacagatgcggggcaccagtggatacctgaagaccccagcctgtgcctcctcaccagccaggaaagccagagatttttaacaaaaagttagaactttgtgtcaagcccttcaagcaaa

SEQ ID NO: 43913 - DNA, 427 bp, Homo sapiens
ttgcattccttccttggcttcctcactagactgaattcctgagagtggagaggatgtgtcttgtttccactcccagcactgtccggtccaaccagcgagaagtgattgctggttttgggagactccttgctctccttccttcttcgcccgggtcttgggtgctgaccttatgaaagggcagcctggggtttttcttggcatcaccagcacatagctgggttatgcacacagcacgttgcccagttcctgggcttggagggagtgtgctcatgtttgatggttacaacaatggatgggaacccatagccagtggcttcgatgcctctgtcctgatgggaagctgagaaggaattgacggtacccttctttcttttgggtcactaaccgtcctgcagcttcagcgtttctttgtgctggagcaagtgca

SEQ ID NO: 43914 - DNA, 419 bp, Homo sapiens
gtctgtgcctgggaaggggtgtgcgcatgggaagggtctgcgcctgggaaggggtgtgggctgccgtgcttggccctgtttgtcagtgctcctcccagatgtctgatgctactgcatccagccccaccagtaggcacacgctctgtgttcccgggtccccgtccccagctctcagggatgcactgcggtctggtccagcctcctttgggcactcacctgtgggacccctgaattcctctccatccattactgcccagccagccaggcctcctacaggtgtctccccttaaaagaagtttccagtcaggtttggtagctcatgcttgtaatcccaggattttgggaaaccaaggtgggaggatcacttgaggtcaagagtttgagaccagcgtgggcaacatagtgaaactgtctctaca

SEQ ID NO: 43915 - DNA, 609 bp, Homo sapiens
gcgtcgacgaggcctctaggagacaggctagggtgggaagcgttaagacagggtaggtgccatcaggagcctccaaacctgccccagagccaccagtctgcctctgcgggcctctctctgacgcccttccaatctgtgccctttctgcagctgtcttccctccattgtcataaatacaatcatgcagccaagtgagtccagactcagccagctctttctcatccatacccagggctctgcaatctgctttcttctccttctccctttgtagcccataattgtgatgatctgccccacacaccaaagtccactgtctcagaacctcaccccagaccctctgggggcccttgccttaacagtcagcttctcactgaccaccctcagctgaggctgaggttccctgacacatagcagttctctgctctggtggtgccctagaatcacttgaaaagattggacaaaacactgaggcccggctgggcgcggtggctcacgcctgtaatcccactactcgggaggctgaggcaggagaatggcgtgaacccgggaggtggagcttgcagtgaactgagatcacgcccctgcactccagcctgggcgacagagcga

SEQ ID NO: 43916 - DNA, 586 bp, Homo sapiens
cagtgagcatctgagctttgaacctcaaagaccaaaatgccctgcccattttcctgcttatcagctgaggaatctttacccacattgacacatgggcttgttctgacccaagtgcatgcaggcttccagagcagattcagaggcctaacttagtcctttagctttcctcccagcacagaactcccaaggttatctgcaagtaggccttgcctagagagactgagttttcaagttgtcagttttcccaaattgtcctcaagcatcttcctctggaatcaccttactgtttagtaaacattcagaggacttgctacacatctgggcagtctgcattgtaattcatatgtgtttacacatttgtgtcttcatctgctaaagcacctttgaaccatattgtaattcataatatctgaagcaattattatgaattgtagtaattcataatattgaagcgattcataatatctgaagcaatccccagatacgggttaggcatggccctgctctgagcaggatggcaaaagtggcagtccgtgacgcagcccttgttaccccaggctattactaaatggtggtggtggtttta

SEQ ID NO: 43917 - DNA, 392 bp, Homo sapiens
aaaaatgtcccatgaacaaataccaagtcatctgaggcttgtccacatgatttaccagcattttttcacacgacaaagatgtgaaggaaaactggggaaatgtgtcagccactattggcatgaaccagagatatttacaggggagggtgagggactatagtccagagtctcctcagattcttaaaacagcaaggattatgcaaagataaaaagcaaaagtaaacactaaaactgtgaatgaagcaagaacacaaagaggggaaatccttctatggaaacaagctttccttcagaggagaaaaacaagactctgctaaaaaaaatctgtcagcctggagtaatagatggaggctggtgtctgcaccgtgcctccctagtccacgtttctctgc

SEQ ID NO: 43918 - DNA, 473 bp, Homo sapiens
gactccgtctcaaaaaaaaaaaaaaagagaaaaaaatatatatatatcctggagaatatgaatgtattaaattatcacatgcaccctgaaaagatatgtatatatcctggagagttttgcgttaaagatctccctttaaaaaaaaatttttttttttttacagctagtggtattccattgtgtatgtttcccataacaaatgttaatgacctgcagtgagatccctattggtggaaatttgagttgtttttactacttttatattacaaacaatgctgcaataaatattattaggctagtgcccctctgtacatattcaagcacttctagaagataagttcctggaagcagcattaatgagttagcggtggctacatatgccgtggtgatagctgctgtccagttgcccctccatgggcagaaacctgtgggagggtcagaccagactctttaagtcattcttgaggacaagt

SEQ ID NO: 43919 - DNA, 528 bp, Homo sapiens
actgttcctcccatagcctcagcctcctcactgtttctcccatagcctcagcctcctgtttctttgcggacttcagtgccttcctcctcctcctcctctcctccttagagctgcagcctcctcctcttccctgtcctgtgcacccactgactcaggttcatgagatcctgtgggaggctctgctgcaggctctctagaggaccccatgacacctctgccatccagcgaactcttctggataaatggctcctggatgcctcagggttaacccttgtacactctgcacacagagctgccttcatggtctcactgcctcttagagatgccattgttactctcagctcatcatgttcccaaccaaaggcagagatggaaatagacgtgcttgagtggccgggctcatggttgtagatcttcaggcccttccctgcaatatcctgcccgtgcccactgcagccccatcagctggacacacagacacccttgatcagagtctggacaccagagtgcttccttctctcctggagc

SEQ ID NO: 43920 - DNA, 409 bp, Homo sapiens
gcctactactactactactactaaattcgcggccggtcgacgctgaggcaggagaattgcttgaacccagggggcagaggttgcagtgagctgagatcacgccattgcactccagcctgggcaacagagcaagacgccgtctcagcctcccgagtagttaggactacaggcgtgtgccaccacgcctgactagtttttgtatttttagtagagatgaagtttcactgtgttgcccaggctggtctcgaactcctgacctcaggtggtccacctacctcagcctcccaaagtgctgggattacaggcgtgagccaactgtgcctggcctgtactttcataagaactagaaaggtgacagtatatcaacaatacatgggtgcaaacatgcacacaacttaggaggatgaga

SEQ ID NO: 43921 - DNA, 355 bp, Homo sapiens
aaggggcaaacaagttctgtgcctattttataaggatattattcccatatatgagggttctgcctttatgatctaatgattcccaaaaggccccaccacccaatatcatcatttttggagttactatttcaaaataagcattttggggggatgcaacattcagaccatagcagctgtacaattggcaaaaggattgcctgtttttaaatctctgaatttgattttttttcccaaatacctttactagaaagaaaatttaaacattttacatttttactttacatggagaaaattcatgtcttgctctgttgtaagtttcatattattctctgtttaaagttcccaatcagaacat

SEQ ID NO: 43922 - DNA, 525 bp, Homo sapiens
  misc_feature (2)..(5): n is a, c, g, or t
  misc_feature (7)..(7): n is a, c, g, or t
  misc_feature (9)..(10): n is a, c, g, or t
cnnnncnanntttttttgtggagttaaacaaacttgccaggaatgtgatatttcagatcacttaatcaaggaaaagccgaacctatcttcagtcagaggagattgttgctgagttggtttatagttttctgatcccagaggtgcaaaaatactttgtcaaagaaaaagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaagcttcattctc

SEQ ID NO: 43923 - DNA, 459 bp, Homo sapiens
tgagctcataaactcatcatcaatcatgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagtccttggtccaatagaatggaatcttaagtctcaatcaaaaggaatcatggaaggagggttgagatgagagggaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaagcttcattctc

SEQ ID NO: 43924 - DNA, 1874 bp, Homo sapiens
aatttgattaaactccaatattatctttaataaaaaacttgacatttcccttcatatctgagaagacacactttaccttgttgataaaattgaaagaaaaaaaacccattctccatggtcactaacagaaacgtcttgctaaatcctcttgcttatttgagggctgtggtccatcagtgactgaccagacaatcgactttctcgtgcctcagttttcctcataagaacttgggttggagccaattgagaggtaatattcccagtaaaaattaaatgcattctgaaagtgaattgactgccaagagttttgagtaatccagcacttcttctaataatcaccactcataatggaatttgtgtccttaaagttatgttattcttttcaaggtgtcactggttgaaaaccatttggccggactggaaggaagggcactagcagacatgtttgacttcctgtccaaagagctggtgagactgcaggaggagaggaggatccatgcctttgtcatgctggctgagcgccagcggcgggtacgagaggctgaagagagtggtcggcgccaggtggaaaaacagcgcctgcgggaggaggacgagatatttaaggaggtggctaaagttcaccatagtactataagctcctacctagaagacataatactgaataccgaagcaaatactgcagaagaacaagccagggcagaaatagagaagatggctgagaaaatcaatgacattgcttatgaaatggaaagccgccgaacctatcttcagtcagaggagattgttgctgagttggtttatagttttctgatcccagaggtgcaaaaatactttgtcaaagaaaaagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaagcttcattctcttcagtgtcttctagatgccctacttaaagagaacattttcttatgtctcatttcaatattttgttaactatgaggatgtgctggtttgttgaatcaaacaaaaggaaatgttgtggaatatttttccaagtagttttggttcactattcacaggacattggcattatctactaaggctgaaaatgtgcatattccatgactcaggattttatctcctagatatatattcaacagaaatgcatgagtatgtgcaccaacaggcatgacaaaaatatttatagtagtggtgttcacaatagtcccaaactggaaacccaagtgtccatctccatcggaacagaaaactatactttggtctgcttctacagtggcacatcaacccacctttgagctttagatctaagaagtgtgttcatgcaacagccatagagatggtgctattaaaaggcaatctgcccatcctgtgtattgacaagcatcaggattccaggaggattcttcctgattcaaagactgtcaaataggaaaaaagaaaacagtaaatgaacaaaaacatcaacatggggtccaagtaatgaatttatagaggaaaatgtatgctactctgaaaacaaagcttatgttagagaatatcttactgtaagaaacaaggaaaattgcagaaac

SEQ ID NO: 43925 - DNA, 4519 bp, Homo sapiens
gacttgtttctaaatcacaattcccaaattattaatttctatggagaaatatgtgttaccatgttatctagactagctggtcagggtatttgcctccccagagacaagtctacttgggaaatcaagtgtatccaaaggctgcttgttaatttaatggcaaatcagttgattttaaagggtggtacagtatagtcaatcatgaatattcttcatcactttaaagatatacctgataaacagatacttataatagcagggcaatattttgttgaactttgtaaaaataacagttccatcatcagcaaacttacaaacttaaggggtgaattctgaagatagctgattttttttttaaccgtgttcaccaattctgagatatcatgtggtttgcatctttctagtgcaccaaatatgggagatggtataaatgtattgcttctttcacttgcaaattggcatagtgcgtatatacaaggtctttcccttgaagaattttttgggttacccaggctcaaaaggagttttgttcgtaggagagaagaaagtgtgttcagggtgtagtacttgaaaacatgctagactttctttatgaattccacttctgtaagctgacttggaatactcagaaaagaaaaacatcttgacaactgttgctggtagaagtggtagagtaacagggccacatgcacaacagagcatgagctgctgcagagtcagacaatatttaaacttttaaatttgttttccaattaagagattacattactttgccattattctcagcctaggggtagatatgttctatctgttatgctacttgattgtttattttgcagatccattgtttattgtgtcaagtgagaaagaccatacacaggcaaatatccaagctaccctgattcgcagcagactggtatgtctaattcatcagccaaggctacctgatgaacctgaaccatctagtttgcctgactgcattgatcagattgactaatcaccaaatcttcactggattttaggttccacagaaattaccttgccaagattactggagggcaaagcatcttaatacgtgtggctcattgtgaggattaagtcaccaataatgaacagagaacccataagctaatttatttcaatgggataaatttaataatatatgcccatgttaaaagaattcaagtagtataaaagcatatacagtgtgaagtaaattctagccctatcccctaccccctccacataaacagccattgtcatcagtttcttgggcatgtatttaaagatattttacgcatacagcaataacccctcttcttatgctgtatacattgttttgtatgtttttaaaaagagtttacaatgtaattaaaatgctttagaaaagctgatggtataattttgtcctttgcctcccttctctaacattagagaaaagttcccaggtttaaaaccatgttcagtaacctgatccattatccaagatactctctatattggagcaagtcagatcctgtcccaccatttatcagtcgggaatggaagggacataaggagaaacacagagaagccctccggcagctcaccacaactgacgcttcttttcagatgcctaaagaagtttatgaagatcctgaagttactggaaagaatcgctataaatactttgaaaggccttttctcccattttttcagcagatgccattcaatgttgtttatgccgtatccaaatggagtcttgctccatcactcaggctggagtgcagtggcgtgatctcggctcgctgcaacctccacctccagggttcaagtgattctccttcctcagcctcccaagtagctgggattacagggcagaaccatacacttttcctcctacttctactaagcacctatccatcccttcaaagtctactgtgggcactcagactgattatcgggatgctgacgttcaaacagatccatactctccagaatatgtagtatgtcaggactcaatccctgagctcttgaccctggctacgcttacttggggtcggggtctcccagcaggacaagctgaggtggagatgatagaaagagcccgcgagaagcgtgcttgggaagcctctctccccgctctgagtgacacctcccagtttgagaagaggaggaaaatgatgaatgaaatggagaggaaggagtgggccttcagagagcaggagattgaaaaactgcaggagattcgcctggaagttctaaaagagctgttgaggaagcgtgaagagaatcagaatgaagtgaatatgaagcacttgaatgcccggtggtctaaactgcaggagggaaaagaggcaaaaatggcaaaaattcagcgcacgcatgtatcaacaatcagaaaacttgtaggaaagagaaagaatatagaagggaagttggagagaagaaatatcatcaaggattattctgattatgcatcacaggtctatggacctctgtctcgtcttgggtgtttcccagacaacaactcagaggactttgtagtaaaaaactactatctcaacacctatgaaggattagtggaacttgagtcatgtctcccagattttgtgacacaaccccaaatcagagctccaaaacctaaagtcattaccaccaaagctggttttctgaagagggcagcaaggttggactatgagttggcagaggttcataaggcactgttggataagaagaataaagttcttgaagtaaagaaaccccctcgcttccttcaaagaaacccaatacctcaacctcggcttccaactccaaccttggaaatgacgtccaatgaagaagaagaaatggaaatggctgtgatctaccttcaaaagttactccggggcagagtcgttcagaacatgatgtttgaagggaaagaaaagcgactggagttgatccaggagttgcgcacctgccacgcactacaagaagatgaaaagctggtgaaaaaagccgagaagcaagtgaccctggccttacagcggcagaggaacttgcatgagcacaaggtgtcactggttgaaaaccatttggccggactggaaggaagggcactagcagacatgtttgacttcctgtccaaagagctggtgagactgcaggaggagaggaggatccatgcctttgtcatgctggctgagcgccagcggcgggtacgagaggctgaagagagtggtcggcgccaggtggaaaaacagcgcctgcgggaggaggacgagatatttaaggaggtggctaaagttcaccatagtactataagctcctacctagaagacataatactgaataccgaagcaaatactgcagaagaacaagccagggcagaaatagagaagatggctgagaaaatcaatgacattgcttatgaaatggaaagccgccgaacctatcttcagtcagaggagattgttgctgagttggtttatagttttctgatcccagaggtgcaaaaatactttgtcaaagaaaaagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaagcttcattctcttcagtgtcttctagatgccctacttaaagagaacattttcttatgtctcatttcaatattttgttaactatgaggatgtgctggtttgttgaatcaaacaaaaggaaatgttgtggaatatttttccaagtagttttggttcactattcacaggacattggcattatctactaaggctgaaaatgtgcatattccatgactcaggattttatctcctagatatatattcaacagaaatgcatgagtatgtgcaccaacaggcatgacaaaaatatttatagtagtggtgttcacaatagtcccaaactggaaacccaagtgtccatctccatcggaacagaaaactatactttggtctgcttctacagtggcacatcaacccacctttgagctttagatctaagaagtgtgttcatgcaacagccatagagatggtgctattaaaaggcaatctgcccatcctgtgtattgacaagcatcaggattccaggaggattcttcctgattcaaagactgtcaaataggaaaaaagaaaacagtaaatgaacaaaaacatcaacatggggtccaagtaatgaatttatagaggaaaatgtatgctactctgaaaacaaagcttatgttagagaatatcttactgtaagaaacaaggaaaattgcagaaac

SEQ ID NO: 43926 - DNA, 2948 bp, Homo sapiens
gacttgtttctaaatcacaattcccaaattattaatttctatggagaaatatgtgttaccatgttatctagactagctggtcagggtatttgcctccccagagacaagtctacttgggaaatcaagtgtatccaaaggctgcttgttaatttaatggcaaatcagttgattttaaagggtggtacagtatagtcaatcatgaatattcttcatcactttaaagatatacctgataaacagatacttataatagcagggcaatattttgttgaactttgtaaaaataacagttccatcatcagcaaacttacaaacttaaggggtgaattctgaagatagctgattttttttttaaccgtgttcaccaattctgagatatcatgtggtttgcatctttctagtgcaccaaatatgggagatggtataaatgtattgcttctttcacttgcaaattggcatagtgcgtatatacaaggtctttcccttgaagaattttttgggttacccaggctcaaaaggagttttgttcgtaggagagaagaaagtgtgttcagggtgtagtacttgaaaacatgctagactttctttatgaattccacttctgtaagctgacttggaatactcagaaaagaaaaacatcttgacaactgttgctggtagaagtggtagagtaacagggccacatgcacaacagagcatgagctgctgcagagtcagacaatatttaaacttttaaatttgttttccaattaagagattacattactttgccattattctcagcctaggggtagatatgttctatctgttatgctacttgattgtttattttgcagatccattgtttattgtgtcaagtgagaaagaccatacacaggcaaatatccaagctaccctgattcgcagcagactggtatgtctaattcatcagccaaggctacctgatgaacctgaaccatctagtttgcctgactgcattgatcagattgactaatcaccaaatcttcactggattttaggttccacagaaattaccttgccaagattactggagggcaaagcatcttaatacgtgtggctcattgtgaggattaagtcaccaataatgaacagagaacccataagctaatttatttcaatgggataaatttaataatatatgcccatgttaaaagaattcaagtagtataaaagcatatacagtgtgaagtaaattctagccctatcccctaccccctccacataaacagccattgtcatcagtttcttgggcatgtatttaaagatattttacgcatacagcaataacccctcttcttatgctgtatacattgttttgtatgtttttaaaaagagtttacaatgtaattaaaatgctttagaaaagctgatggtataattttgtcctttgcctcccttctctaacattagagaaaagttcccaggtttaaaaccatgttcagtaacctgatccattatccaagatactctctatattggagcaagtcagatcctgtcccaccatttatcagtcgggaatggaagggacataaggagaaacacagagaagccctccggcagctcaccacaactgacgcttcttttcagatgcctaaagaagtttatgaagatcctgaagttactggaaagaatcgctataaatactttgaaaggccttttctcccattttttcagcagatgccattcaatgttgtttatgccgtatccaaatggagtcttgctccatcactcaggctggagtgcagtggcgtgatctcggctcgctgcaacctccacctccagggttcaagtgattctccttcctcagcctcccaagtagctgggattacagggcagaaccatacacttttcctcctacttctactaagcacctatccatcccttcaaagtctactgtgggcactcagactgattatcgggatgctgacgttcaaacagatccatactctccagaatatgtagtatgtcaggactcaatccctgagctcttgaccctggctacgcttacttggggtcggggtctcccagcaggacaagctgaggtggagatgatagaaagagcccgcgagaagcgtgcttgggaagcctctctccccgctctgagtgacacctcccagtttgagaagaggaggaaaatgatgaatgaaatggagaggaaggagtgggccttcagagagcaggagattgaaaaactgcaggagattcgcctggaagttctaaaagagctgttgaggaagcgtgaagagaatcagaatgaagtgaatatgaagcacttgaatgcccggtggtctaaactgcaggagggaaaagaggcaaaaatggcaaaaattcagcgcacgcatgtatcaacaatcagaaaacttgtaggaaagagaaagaatatagaagggaagttggagagaagaaatatcatcaaggattattctgattatgcatcacaggtctatggacctctgtctcgtcttgggtgtttcccagacaacaactcagaggactttgtagtaaaaaactactatctcaacacctatgaaggattagtggaacttgagtcatgtctcccagattttgtgacacaaccccaaatcagagctccaaaacctaaagtcattaccaccaaagctggttttctgaagagggcagcaaggttggactatgagttggcagaggttcataaggcactgttggataagaagaataaagttcttgaagtaaagaaaccccctcgcttccttcaaagaaacccaatacctcaacctcggcttccaactccaaccttggaaatgacgtccaatgaagaagaagaaatggaaatggctgtgatctaccttcaaaagttactccggggcagagtcgttcagaacatggtgtgtaggtccaaccgctggccctgcatttctcttttgagaataaattttttagaatgcata

SEQ ID NO: 43927 - DNA, 410 bp, Homo sapiens
cagatttttttaagtgctagaatttggaaactgacacactgtgaagtaagaaacatctggatccataaggcttataaatagcagagctgggatatgtgtggggctgtctgagttcaaagctagggctcagacacactgtatcacaggaattttttgcatgtattgatctgataatgtttctaaaagatgacataatcataaacatttgttttgctcttttttacagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaa

SEQ ID NO: 43928 - DNA, 3131 bp, Homo sapiens
gacttgtttctaaatcacaattcccaaattattaatttctatggagaaatatgtgttaccatgttatctagactagctggtcagggtatttgcctccccagagacaagtctacttgggaaatcaagtgtatccaaaggctgcttgttaatttaatggcaaatcagttgattttaaagggtggtacagtatagtcaatcatgaatattcttcatcactttaaagatatacctgataaacagatacttataatagcagggcaatattttgttgaactttgtaaaaataacagttccatcatcagcaaacttacaaacttaaggggtgaattctgaagatagctgattttttttttaaccgtgttcaccaattctgagatatcatgtggtttgcatctttctagtgcaccaaatatgggagatggtataaatgtattgcttctttcacttgcaaattggcatagtgcgtatatacaaggtctttcccttgaagaattttttgggttacccaggctcaaaaggagttttgttcgtaggagagaagaaagtgtgttcagggtgtagtacttgaaaacatgctagactttctttatgaattccacttctgtaagctgacttggaatactcagaaaagaaaaacatcttgacaactgttgctggtagaagtggtagagtaacagggccacatgcacaacagagcatgagctgctgcagagtcagacaatatttaaacttttaaatttgttttccaattaagagattacattactttgccattattctcagcctaggggtagatatgttctatctgttatgctacttgattgtttattttgcagatccattgtttattgtgtcaagtgagaaagaccatacacaggcaaatatccaagctaccctgattcgcagcagactggtatgtctaattcatcagccaaggctacctgatgaacctgaaccatctagtttgcctgactgcattgatcagattgactaatcaccaaatcttcactggattttaggttccacagaaattaccttgccaagattactggagggcaaagcatcttaatacgtgtggctcattgtgaggattaagtcaccaataatgaacagagaacccataagctaatttatttcaatgggataaatttaataatatatgcccatgttaaaagaattcaagtagtataaaagcatatacagtgtgaagtaaattctagccctatcccctaccccctccacataaacagccattgtcatcagtttcttgggcatgtatttaaagatattttacgcatacagcaataacccctcttcttatgctgtatacattgttttgtatgtttttaaaaagagtttacaatgtaattaaaatgctttagaaaagctgatggtataattttgtcctttgcctcccttctctaacattagagaaaagttcccaggtttaaaaccatgttcagtaacctgatccattatccaagatactctctatattggagcaagtcagatcctgtcccaccatttatcagtcgggaatggaagggacataaggagaaacacagagaagccctccggcagctcaccacaactgacgcttcttttcagatgcctaaagaagtttatgaagatcctgaagttactggaaagaatcgctataaatactttgaaaggccttttctcccattttttcagcagatgccattcaatgttgtttatgccgtatccaaatggagtcttgctccatcactcaggctggagtgcagtggcgtgatctcggctcgctgcaacctccacctccagggttcaagtgattctccttcctcagcctcccaagtagctgggattacagggcagaaccatacacttttcctcctacttctactaagcacctatccatcccttcaaagtctactgtgggcactcagactgattatcgggatgctgacgttcaaacagatccatactctccagaatatgtagtatgtcaggactcaatccctgagctcttgaccctggctacgcttacttggggtcggggtctcccagcaggacaagctgaggtggagatgatagaaagagcccgcgagaagcgtgcttgggaagcctctctccccgctctgagtgacacctcccagtttgagaagaggaggaaaatgatgaatgaaatggagaggaaggagtgggccttcagagagcaggagattgaaaaactgcaggagattcgcctggaagttctaaaagagctgttgaggaagcgtgaagagaatcagaatgaagtgaatatgaagcacttgaatgcccggtggtctaaactgcaggagggaaaagaggcaaaaatggcaaaaattcagcgcacgcatgtatcaacaatcagaaaacttgtaggaaagagaaagaatatagaagggaagttggagagaagaaatatcatcaaggattattctgattatgcatcacaggtctatggacctctgtctcgtcttgggtgtttcccagacaacaactcagaggactttgtagtaaaaaactactatctcaacacctatgaaggattagtggaacttgagtcatgtctcccagattttgtgacacaaccccaaatcagagctccaaaacctaaagtcattaccaccaaagctggttttctgaagagggcagcaaggttggactatgagttggcagaggttcataaggcactgttggataagaagaataaagttcttgaagtaaagaaaccccctcgcttccttcaaagaaacccaatacctcaacctcggcttccaactccaaccttggaaatgacgtccaatgaagaagaagaaatggaaatggctgtgatctaccttcaaaagttactccggggcagagtcgttcagaacatgatgtttgaagggaaagaaaagcgactggagttgatccaggagttgcgcacctgccacgcactacaagaagatgaaaagctggtgaaaaaagccgagaagcaagtgaccctggccttacagcggcagaggaacttgcatgagcacaaggttttcctttttttgttttcttgttactttcttgttaaattttctcccttgattttatcatcacacagcaccattataataaaaattaatgaaatgatg

SEQ ID NO: 43929 - DNA, 1749 bp, Homo sapiens
aatttgattaaactccaatattatctttaataaaaaacttgacatttcccttcatatctgagaagacacactttaccttgttgataaaattgaaagaaaaaaaacccattctccatggtcactaacagaaacgtcttgctaaatcctcttgcttatttgagggctgtggtccatcagtgactgaccagacaatcgactttctcgtgcctcagttttcctcataagaacttgggttggagccaattgagaggtaatattcccagtaaaaattaaatgcattctgaaagtgaattgactgccaagagttttgagtaatccagcacttcttctaataatcaccactcataatggaatttgtgtccttaaagttatgttattcttttcaaggtgtcactggttgaaaaccatttggccggactggaaggaagggcactagcagacatgtttgacttcctgtccaaagagctggtgagactgcaggaggagaggaggatccatgcctttgtcatgctggctgagcgccagcggcgggtacgagaggctgaagagagtggtcggcgccaggtggaaaaacagcgcctgcgggaggaggacgagatatttaaggaggtggctaaagttcaccatagtactataagctcctacctagaagacataatactgaataccgaagcaaatactgcagaagaacaagccagggcagaaatagagaagatggctgagaaaatcaatgacattgcttatgaaatggaaagccgccgaacctatcttcagtcagaggagattgttgctgagttggtttatagttttctgatcccagaggtgcaaaaatactttgtcaaagaaaaagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaagcttcattctcttcagtgtcttctagatgccctacttaaagagaacattttcttatgtctcatttcaatattttgttaactatgaggatgtgctggtttgttgaatcaaacaaaaggaaatgttgtggaatatttttccaagtagttttggttcactattcacaggacattggcattatctactaaggctgaaaatgtgcatattccatgactcaggattttatctcctagatatatattcaacagaaatgcatgagtatgtgcaccaacaggcatgacaaaaatatttatagtagtggtgttcacaatagtcccaaaatggtgctattaaaaggcaatctgcccatcctgtgtattgacaagcatcaggattccaggaggattcttcctgattcaaagactgtcaaataggaaaaaagaaaacagtaaatgaacaaaaacatcaacatggggtccaagtaatgaatttatagaggaaaatgtatgctactctgaaaacaaagcttatgttagagaatatcttactgtaagaaacaaggaaaattgcagaaac

SEQ ID NO: 43930 - DNA, 1067 bp, Homo sapiens
  misc_feature (2)..(5): n is a, c, g, or t
  misc_feature (7)..(7): n is a, c, g, or t
  misc_feature (9)..(10): n is a, c, g, or t
cnnnncnanntttttttgtggagttaaacaaacttgccaggaatgtgatatttcagatcacttaatcaaggaaaagccgaacctatcttcagtcagaggagattgttgctgagttggtttatagttttctgatcccagaggtgcaaaaatactttgtcaaagaaaaagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaagcttcattctcttcagtgtcttctagatgccctacttaaagagaacattttcttatgtctcatttcaatattttgttaactatgaggatgtgctggtttgttgaatcaaacaaaaggaaatgttgtggaatatttttccaagtagttttggttcactattcacaggacattggcattatctactaaggctgaaaatgtgcatattccatgactcaggattttatctcctagatatatattcaacagaaatgcatgagtatgtgcaccaacaggcatgacaaaaatatttatagtagtggtgttcacaatagtcccaaaatggtgctattaaaaggcaatctgcccatcctgtgtattgacaagcatcaggattccaggaggattcttcctgattcaaagactgtcaaataggaaaaaagaaaacagtaaatgaacaaaaacatcaacatggggtccaagtaatgaatttatagaggaaaatgtatgctactctgaaaacaaagcttatgttagagaatatcttactgtaagaaacaaggaaaattgcagaaac

SEQ ID NO: 43931 - DNA, 469 bp, Homo sapiens
  misc_feature (1)..(1): n is a, c, g, or t
  misc_feature (3)..(3): n is a, c, g, or t
  misc_feature (6)..(6): n is a, c, g, or t
  misc_feature (8)..(8): n is a, c, g, or t
ngnacnanggctcaaagagaagtataagactaggtctttatatttgtaagttacttacactctagatatcaaacgaaatgtaactcacatgaagtgcttcaatgttgaatagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaagcttcattctc

SEQ ID NO: 43932 - DNA, 503 bp, Homo sapiens
aaaaaggaaaagagattgggaaacatgacgatctcagatggggcttgagtctcagagaagcagtacgtttgggtcccagcaggcagcaaagactaacaggaggagacccccagacaggtggaaacagcgcagggtctgagatcagaccaaatccgcaaagcctccagaggtagatttggccctcactcttccccacatcatagttaggtgatagcccctcacaatgtccccacctcccccaggtcccagttacagagcaggagcctgtggccagcataacgcaggactggaggggcgctaagatccaggacactatggcaggcctggcgccgggaatccctgtggtctggacagtgagggcggtgaaaaggatctggacacctccctccccttggcccactttgatttcacccctgccagggttcgtgagctgattccatgcactttctgcctgagtgggagcagcacactgaatgactgtcccatcctccctctcccccaca

SEQ ID NO: 43933 - DNA, 358 bp, Homo sapiens
aggtctccctcatctctacaggtttaacaactctgattcttggaattgtaatggcaagggcaatttcacagcctggatctccctgtgttgcccaggccagtcttgaactcaaagcaatccttctgcctcggcctcccaaagtgcagggatttcaggcgtgaaccatcatgcccagcctcaatattgtattttattctttgatttctttttttctgtattttattatttgaatttaaaaattaatttggggtaaattgatgtttatatgatattgagtcttcccatttgtgtgtatggatatggtatatttctccatttatttgtgtctttcaataaaagtttaacatgacgttaaaat

SEQ ID NO: 43934 - DNA, 423 bp, Homo sapiens
ctggggtacggggacagttctttggtgcagtgatcagcatgtccttaacagactgttcccgaggtaatgcctactgcgatctgctcacctgtgatctgtccacatgccgtctgcctgcgctgggttctgtgcgtgcacgcaagtctctctggtccagaagccagagctgggatggaattcaaggaaccacaaaagtctccctctcactgtcaattttgaagaatgaataaggggtaggcaggcaaaggcaaaaaactcagggtgagggcataaatagaagcagaggtatcgaggcaggaaacagcacagccaggtcacagcagttcagcacccactgggacaagcgcaagacaagaagtatggaaggaacacaggcaggcgagaaaggtagggccaggttcgagaaggattcctgcgtcctgt

SEQ ID NO: 43935 - DNA, 467 bp, Homo sapiens
aattgataagggacttgtcatcaaaactcttgtaatagagagtcttcctctattctctggaaactcaaaattaggacaaagttgtgtcattctttcattttctgaatacattctcttaaaactggggaaactgggccgggtgcggtggctcacacctgtaatcccagcactttgggaagccgaggcgggcagatcacgaggtcaagagatcgagaccatcctggctaacatggtgaaaccccgtctctactaaattacaaaaaaaattagccgggcgtggtggcgggcgcctgtagtcccagttcctcaggaggctgaggcaggagaatggcgtgaacccgggaggcggagcttgcagtgagccgagatagtgccactgcacttcagcctgggcaagagcgaaactccgtctcaaaaacaaacaaacaaacaaaaaactggggaaactgaaaggggcaaattgtcct

SEQ ID NO: 43936 - DNA, 775 bp, Homo sapiens
tgataaagaagtccgcagaggagcacatctcccaaaatgaaatcttactttctctcgtgagaaccaaggcaggaagactgtggtgaggggctctttccttttcacactcatgcttcaggacgacccactgtgtttggggctctctgtgctcataccttgtgtggtgtgaaccagtgaccctgtgtctgttaggattggtggttgggtggcatcaggctgaagaataggtgagcgggatcgtgctgttcagcaggaaaactcaaccacaggaaaagaccacttccagaacgtgggtctgctctggatgcaaataaatacattgattttaacataagttttgtttggagaacagtttaagtttttagaggaaaatattacttttatcatctctgtgtagaaataaaggcaagagagaaatataaggaagtagacactccctattttcatactgttaggatgcagaatgtaatgccattttgaaagtacataggaggtcatttaaacaaaaaattattgaacaaatactagtaatgattttacaagttgttgttttgttttgttttaggtgagaaaccttttgaatgtaacatttgtgggaaacatttctctcaggtgggaatactcttatttattgttaataattggaaacctgcaacacagtgtttttttattggaaataagacatacttttgtacttgtgagagaagcctctaatgatgtctgtaacttaaagacttcagaataaattaggataaatcgttttcaagaaaacaga

SEQ ID NO: 43937 - DNA, 341 bp, Homo sapiens
aaagccacaagcatgaatgggattaccaagaaattagatatagactatagatagaaaaggaaagaagttctaggattgagcccagaaaattcctatgtaaagatatcaggaaaaataaacctaggcatttctttttcttttcagctgagcaactcagagccaaagcaatttttcgactaactctccttaagagggttaccagaaaatttttgtatttatgattggaaaagtagttaactgtatataccatgaaactatggaatcttgagactaaaatagaccttaacctaaaggataataaattcaacttgttggtttttcaacagcaaatactctgaact

SEQ ID NO: 43938 - DNA, 133 bp, Homo sapiens
ccgctttccattcatgccacctggggatactcatgcctatcttggagggttgtgggaagggttctaagagcatatgcgtgtgacatttcttgtggacagtaggccctcataaatggggcgctcctccacctct

SEQ ID NO: 43939 - DNA, 361 bp, Homo sapiens
agcatcctagcaagatacctgacacatagtaggcacccaggaaatgacctttattataatcgtcctgctagtatatgttactttttgcccactcattcagcaaacatttatggacacctctcacgtgctgggcattgctctggggatggttgttggcctcgttgctctctgtatcccaggagagataccagctcagagtgcttcaactataacgtctaatgtttcagaatcaattttgaggtgtggtgaggtgttttttttttttttttattttactaattttccagatggtttctctctattgaaagtttatctagaaaggggtcatctcacagcttttattttctcctcaacttgcttt

SEQ ID NO: 43940 - DNA, 326 bp, Homo sapiens
ctgctttggttcagatcttggctgtagcactcagccaaccctggaaaataaacctctgcctgttctctcatctataaaatggggacaagcactaatgtcataggattgttatggtagagttacatgagtttcatgcatatcacagttaaacagctcctgatgcatggcaagtgcccaataaatgttagctattgtcatgttagaggaaatagattttgtggcctgggacatgtaatgctgccttagcagaaattcagctggttcatttaagctctaaatttatgagctttttattgattaaacccatcactgtagatcctcttaga

SEQ ID NO: 43941 - DNA, 336 bp, Homo sapiens
tagtcccagctactcgggaggctgaggcaggagaatggcatgaacctgggaggtggagcttgcagtgagctgagatcgtgccactgcactccagcctgggcgacagagagagactccgtctcaaaaataaaaaaaaaaaaaaaaaaaaaggacaataggagaaaaatgtgtctatggactgggtactatgtgaaaacaagttaacaacctcatacaccaagtcctggcctcaagtgatcgatctgcccatcttggcttcccaaagtgctgggattacaggcataagccaccatgctcagcccaaccttagccatctgaacctcattcccatccccc

SEQ ID NO: 43942 - DNA, 360 bp, Homo sapiens
ggaataacgcacataaaatgaccagcgtagtatctggcacatgataaaaattctttgtcatcattagtgactatcatttttatctatgcacatttttatctatgctcaactgggtataaacatgcctgcatatagactatccctacgttttgtcactattgaactcagctgcctagttactgcctaataagcatctctgtttcacctcttccactgtaggcattcagtgtgttttgctgctgactcaaacaatggtacaccaacagaaaacacccatataaaaatgtcattgcaatgatatgacatctgaggaggattttaaaatgcagaagcatcttgttcttatccaattgggcaatg

SEQ ID NO: 43943 - DNA, 418 bp, Homo sapiens
taccctgaagagtaatcacctgtttacgtgtttgcctctgaggagactctctaagtccctcatggtgatataccttttgctggctaatagcattgattctggttaataatgattgataaatatatgtaaaaaatgaataaatttttaagaccaaaaatttgccataattaagaactctgagaatctcggtctgctgggcacaggcaactagggaacagtgggttgcagtccaggtacatatatggtgcaatgggattgcaggaagaaacaattaaaatttgtgctgggagtctaggaaggcatggaggatgtgacatttgaacttagatgtggaggtaggcaacaggtcttgacacccatttggatcccacaatcaggcctaactaatgaatttatacactatctccactgaaggcca

SEQ ID NO: 43944 - DNA, 281 bp, Homo sapiens
gctgggattacaggcgcttgccaccacacctggctaattttttgtaattttagtagagatggggtttcgccatgttggtcaggctggtctcgaattccagaccacaggtgatctgcccgcctcggcctcccaaagtgctgggattacaggcgtgagccactgcacctggccccaaatttatatcttaacatcatggcagggcatggagaagaaaggccagtgggctgctcctatccactgactgggggttggccaactgcctggagattctgacgtcgacg

SEQ ID NO: 43945 - DNA, 616 bp, Homo sapiens
  misc_feature (443)..(443): n is a, c, g, or t
  misc_feature (470)..(470): n is a, c, g, or t
gcatttttttagagccaaggtttcaccatgttggcccacctcagcctcccaaggtgctgggattacaggcgtgagccacgcgcgcccggcccatttatgtgtaatcttaattcaacacttattgagcgcctactgtatgtttggcataaaatggtggtccctaatttcaaaagatttggagtctagagggcagaaattgaagaggttggtgctctgcagtctgagtccgcccacagactgaataaatatgggaaaaaaatcttccccacggcggaggagttctcagtcccacgcgcccagagtcgcacccactcgagccacccgcctgttgccgtcgccacgccctccagccgcagccccagcgcgcattcctacgggtcgccgggtctgtcgccagcgatcgaatgaagtcggctgatcccccacgtgtggctgctccagtngacacccaggggaggcctcggtccttnacccctagagcaaccaatgggctggccttaaattcttcagcgggggcgttctttttctttcctcccaagcaggcggccgttgggtcggccgaaggcagcagcgactactacggctcttcctctccaatgggatcccctgtctgccc

SEQ ID NO: 43946 - DNA, 620 bp, Homo sapiens
gcatttttttagagccaaggtttcaccatgttggcccacctcagcctcccaaggtgctgggattacaggcgtgagccacgcgcgcccggcccatttatgtgtaatcttaattcaacacttattgagcgcctactgtatgtttggcataaaatggtggtccctaatttcaaaagatttggagtctagagggcagaaattgaagaggttggtgctctgcagtctgagtccgcccacagactgaataaataagctctgcgtcggcgcccctcacctttctttcatggccagacttttctctggcggttccacagctgtcctgacagtggaattcagacggggtgaccaagcccctagcccacctaccagcgaaatccagcatcagttccagggcagccggacccgcgcccggggacgactgacccttagcccaaggctgcgggggcgtcggagtcctgaagcgcaggcgaggcagggccagcgggacagggagactcaaggccccaggggatctgggcgtttgaagactcaggtcagactctgaggcgcccgtctaaagagaccggttgtcttttccctaattcaggaggccaggctgtcccttggggcgtcgtacctcgtgc

SEQ ID NO: 43947 - DNA, 574 bp, Homo sapiens
gcatttttttagagccaaggtttcaccatgttggcccacctcagcctcccaaggtgctgggattacaggcgtgagccacgcgcgcccggcccatttatgtgtaatcttaattcaacacttattgagcgcctactgtatgtttggcataaaatggtggtccctaatttcaaaagatttggagtctagagggcagaaattgaagaggttggtgctctgcagtctgagtccgcccacagactgaataaatactctggcggttccacagctgtcctgacagtggaattcagacggggtgaccaagcccctagcccacctaccagcgaaatccagcatcagttccagggcagccggacccgcgcccggggacgactgacccttagcccaaggctgcgggggcgtcggagtcctgaagcgcaggcgaggcagggccagcgggacagggagactcaaggccccaggggatctgggcgtttgaagactcaggtcagactctgaggcgcccgtctaaagagaccggttgtcttttccctaattcaggaggccaggctgtcccttggggcgtcgtacctcgtgc

SEQ ID NO: 43948 - DNA, 650 bp, Homo sapiens
ctgaagacactttctctatatttccctgataacttctttacctctattctgatgtcaattgctttagggattcgggctgggcctgagatcttcctgacccaagggacaccaaagaccctacagaaccatcccaacatattgcaaagcttcaaggagagtagggactcaaattagtatagccctgttggatatatgtgcacaaatcaccattctacttggttctgggggttgggggaaggggtgctgagggatggaggacaatagcatgtgaggaaatacaaaagagaccctactgggaggtgcactagaaagaagggcaagaagccaagaggaaaaaaaaaaagccaaccctcccctcccctcccatcccctcctctttccttcccttcttttcctcccacctcagccacccaaatgactaggacaacaggcacacaccatcatgcctggataattttttagtgttttgtaaagacagaggagtctcactatgtcacccaggctggtctagaactcctggccttaagcagtcctcccacctctgcctctccaagtactgatattacaggcatgagccactgcaccggggaggcctacagtcgttctttatagtttaccctcttttttcctgcattctataaatactcaaa

SEQ ID NO: 43949 - DNA, 511 bp, Homo sapiens
ctgttccacctcagatcattaggcattagttagattctcataaggagcgtgcaacctagatccctcgcacgcacagttcacaataaggtttgcgctcctatgagaatctaatgctgctgccgatctgacaggaggcggagctcaaacagcaatgcgtggctggtccatcgctcactgttgtgtggcccagttcctaacaggccatggacccgtactagtctacagacatgggggttggggactcctggtttaatgggtatagagtttcagttttgcaaaatgaaaagagttctggagattggctgcacaacaatgtgaatgtacttaacaatactgaactgtacacttaaaaatagttaagatggggctggatatgatggctcaggcctgtaattccagtgctttgggaggctgaggcgggggcattgcttgaacccaagagttggaagttaagtgaggtatgattacgccacgcacaccagcctgggcaacagagcaagaccatgtcata

SEQ ID NO: 43950 - DNA, 3016 bp, Homo sapiens
  misc_feature (1413)..(1413): n is a, c, g, or t
aagcactgtacgctcgattacggatcggcggcgacggcgggcgggcggggactcggcgcgggcgccctcccggccagcggcggcagcccctcctccccggcgccctcaggaccccccagagacccccggcggcggcagcctgccttgctctgccaggaaccatgagtgaggcccgcagggacagcacgagcagcctgcagcgcaagaagccaccctggctaaagctggacattccctctgcggtgcccctgacggcagaagagcccagcttcctgcagcccctgaggcgacaggctttcctgaggagtgtgagtatgccagccgagacagcccacatctcttcaccccaccatgagctccggcggccggtgctgcaacgccagacgtccatcacacagaccatccgcagggggaccgccgactggtttggagtgagcaaggacagtgacagcacccagaaatggcagcgcaagagcatccgtcactgcagccagcgctacgggaagctgaagccccaggtcctccgggagctggacctgcccagccaggacaacgtgtcgctgaccagcaccgagacgccacccccactctacgtggggccatgccagctgggcatgcagaagatcatagaccccctggcccgtggccgtgccttccgtgtggcagatgacactgcggaaggcctgagtgccccacacactcccgtcacgccgggtgctgcctccctctgctccttctccagctcccgctcaggtttccaccggctcccgcggcggcgcaagcgagagtcggtggccaagatgagcttccgggcggccgcagcgctgatgaaaggccgctccgttagggatggcacctttcgccgggcacagcgtcgaagcttcactccagctagctttctggaggaggacacaactgatttccccgatgagctggacacatccttctttgcccgggaaggtatcctccatgaagagctgtccacatacccggatgaagttttcgagtccccatcggaggcagcgctaaaggactgggagaaggcaccggagcaggcggacctcaccggcggggccctggaccgcagcgagcttgagcgcagccacctgatgctgcccttggagcgaggctggcggaagcagaaggagggcgccgcagccccgcagcccaaggtgcggctccgacaggaggtggtgagcaccgcggggccgcgacggggccagcgtatcgcggtgccggtgcgcaagctcttcgcccgggagaagcggccgtatgggctgggcatggtgggacggctcaccaaccgcacctaccgcaagcgcatcgacagcttcgtcaagcgccagatcgaggacatggacgaccacaggcccttcttcacctactggcttaccttcgtgcactcgctcgtcnccatcctagccgtgtgcatctatggcatcgcgcccgtgggcttctcgcagcatgagacggtggactcggtgctgcggaaccgcggggtctacgagaacgtcaagtacgtgcagcaggagaacttctggatcgggcccagctcggaggccctcatccacctgggcgccaagttttcgccctgcatgcgccaggacccgcaggtgcacagcttcattcgctcggcgcgcgagcgcgagaagcactccgcctgctgcgtgcgcaacgacaggtcgggctgcgtgcagacctcggaggaggagtgctcgtccacgctggcagtgtgggtgaagtggcccatccatcccagcgccccagagcttgcgggccacaagagacagtttggctctgtctgccaccaggatcccagggtgtgtgatgagccctcctccgaagaccctcatgagtggccagaagacatcaccaagtggccgatctgcaccaaaaacagcgctgggaaccacaccaaccatccccacatggactgtgtcatcacaggacggccctgctgcattggcaccaagggcaggtgtgagatcacctcccgggagtactgtgacttcatgaggggctacttccatgaggaggccacgctctgctctcaggtgcactgcatggatgatgtgtgtgggctcctgccttttctcaaccccgaggtgcctgaccagttctaccgcctgtggctatccctcttcctgcacgccgggatcttgcactgcctggtgtccatctgcttccagatgactgtcctgcgggacctggagaagctggcaggctggcaccgcatagccatcatctacctgctgagtggtgtcaccggcaacctggccagtgccatcttcctgccataccgagcagaggtgggtcctgctggctcccagttcggcatcctggcctgcctcttcgtggagctcttccagagctggcagatcctggcgcggccctggcgtgccttcttcaagctgctggctgtggtgctcttcctcttcacctttgggctgctgccgtggattgacaactttgcccacatctcggggttcatcagtggcctcttcctctccttcgccttcttgccctacatcagctttggcaagttcgacctgtaccggaaacgctgccagatcatcatctttcaggtggtcttcctgggcctcctggctggcctggtggtcctcttctacgtctatcctgtccgctgtgagtggtgtgagttcctcacctgcatccccttcactgacaagttctgtgagaagtacgaactggacgctcagctccactgagctggctgcgggctccagcggccgtgtgctccagcaggccagagccagacacgacctccctgagcctcacaggcttacaggagtcacctgctccatgtggggactggcctgtttcctgaacacagacctctttcttgtgccttgttcacttctgttgaacccctcgtactgccgggcatttattatactacttcctgtcataaccttctaacttgtttcttgacgaccacctcatgtggccaataaatggactgggagcgttttagctgccattaacttgaacaggg

SEQ ID NO: 43951 - DNA, 3139 bp, Homo sapiens
  misc_feature (1536)..(1536): n is a, c, g, or t
aagcactgtacgctcgattacggatcggcggcgacggcgggcgggcggggactcggcgcgggcgccctcccggccagcggcggcagcccctcctccccggcgccctcaggaccccccagagacccccggcggcggcagcctgccttgctctgccaggaaccatgagtgaggcccgcagggacagcacgagcagcctgcagcgcaagaagccaccctggctaaagctggacattccctctgcggtgcccctgacggcagaagagcccagcttcctgcagcccctgaggcgacaggctttcctgaggagtgtgagtatgccagccgagacagcccacatctcttcaccccaccatgagctccggcggccggtgctgcaacgccagacgtccatcacacagaccatccgcagaccctggtccctggagtgactacaggcctggggcagggcatgctgccccggaggagggcctttgaagtcccctgcctgggaggggcgatctggccgccccttgctgagtccctgccatgccagggggaccgccgactggtttggagtgagcaaggacagtgacagcacccagaaatggcagcgcaagagcatccgtcactgcagccagcgctacgggaagctgaagccccaggtcctccgggagctggacctgcccagccaggacaacgtgtcgctgaccagcaccgagacgccacccccactctacgtggggccatgccagctgggcatgcagaagatcatagaccccctggcccgtggccgtgccttccgtgtggcagatgacactgcggaaggcctgagtgccccacacactcccgtcacgccgggtgctgcctccctctgctccttctccagctcccgctcaggtttccaccggctcccgcggcggcgcaagcgagagtcggtggccaagatgagcttccgggcggccgcagcgctgatgaaaggccgctccgttagggatggcacctttcgccgggcacagcgtcgaagcttcactccagctagctttctggaggaggacacaactgatttccccgatgagctggacacatccttctttgcccgggaaggtatcctccatgaagagctgtccacatacccggatgaagttttcgagtccccatcggaggcagcgctaaaggactgggagaaggcaccggagcaggcggacctcaccggcggggccctggaccgcagcgagcttgagcgcagccacctgatgctgcccttggagcgaggctggcggaagcagaaggagggcgccgcagccccgcagcccaaggtgcggctccgacaggaggtggtgagcaccgcggggccgcgacggggccagcgtatcgcggtgccggtgcgcaagctcttcgcccgggagaagcggccgtatgggctgggcatggtgggacggctcaccaaccgcacctaccgcaagcgcatcgacagcttcgtcaagcgccagatcgaggacatggacgaccacaggcccttcttcacctactggcttaccttcgtgcactcgctcgtcnccatcctagccgtgtgcatctatggcatcgcgcccgtgggcttctcgcagcatgagacggtggactcggtgctgcggaaccgcggggtctacgagaacgtcaagtacgtgcagcaggagaacttctggatcgggcccagctcggaggccctcatccacctgggcgccaagttttcgccctgcatgcgccaggacccgcaggtgcacagcttcattcgctcggcgcgcgagcgcgagaagcactccgcctgctgcgtgcgcaacgacaggtcgggctgcgtgcagacctcggaggaggagtgctcgtccacgctggcagtgtgggtgaagtggcccatccatcccagcgccccagagcttgcgggccacaagagacagtttggctctgtctgccaccaggatcccagggtgtgtgatgagccctcctccgaagaccctcatgagtggccagaagacatcaccaagtggccgatctgcaccaaaaacagcgctgggaaccacaccaaccatccccacatggactgtgtcatcacaggacggccctgctgcattggcaccaagggcaggtgtgagatcacctcccgggagtactgtgacttcatgaggggctacttccatgaggaggccacgctctgctctcaggtgcactgcatggatgatgtgtgtgggctcctgccttttctcaaccccgaggtgcctgaccagttctaccgcctgtggctatccctcttcctgcacgccgggatcttgcactgcctggtgtccatctgcttccagatgactgtcctgcgggacctggagaagctggcaggctggcaccgcatagccatcatctacctgctgagtggtgtcaccggcaacctggccagtgccatcttcctgccataccgagcagaggtgggtcctgctggctcccagttcggcatcctggcctgcctcttcgtggagctcttccagagctggcagatcctggcgcggccctggcgtgccttcttcaagctgctggctgtggtgctcttcctcttcacctttgggctgctgccgtggattgacaactttgcccacatctcggggttcatcagtggcctcttcctctccttcgccttcttgccctacatcagctttggcaagttcgacctgtaccggaaacgctgccagatcatcatctttcaggtggtcttcctgggcctcctggctggcctggtggtcctcttctacgtctatcctgtccgctgtgagtggtgtgagttcctcacctgcatccccttcactgacaagttctgtgagaagtacgaactggacgctcagctccactgagctggctgcgggctccagcggccgtgtgctccagcaggccagagccagacacgacctccctgagcctcacaggcttacaggagtcacctgctccatgtggggactggcctgtttcctgaacacagacctctttcttgtgccttgttcacttctgttgaacccctcgtactgccgggcatttattatactacttcctgtcataaccttctaacttgtttcttgacgaccacctcatgtggccaataaatggactgggagcgttttagctgccattaacttgaacaggg

SEQ ID NO: 43952 - DNA, 3528 bp, Homo sapiens
  misc_feature (1536)..(1536): n is a, c, g, or t
aagcactgtacgctcgattacggatcggcggcgacggcgggcgggcggggactcggcgcgggcgccctcccggccagcggcggcagcccctcctccccggcgccctcaggaccccccagagacccccggcggcggcagcctgccttgctctgccaggaaccatgagtgaggcccgcagggacagcacgagcagcctgcagcgcaagaagccaccctggctaaagctggacattccctctgcggtgcccctgacggcagaagagcccagcttcctgcagcccctgaggcgacaggctttcctgaggagtgtgagtatgccagccgagacagcccacatctcttcaccccaccatgagctccggcggccggtgctgcaacgccagacgtccatcacacagaccatccgcagaccctggtccctggagtgactacaggcctggggcagggcatgctgccccggaggagggcctttgaagtcccctgcctgggaggggcgatctggccgccccttgctgagtccctgccatgccagggggaccgccgactggtttggagtgagcaaggacagtgacagcacccagaaatggcagcgcaagagcatccgtcactgcagccagcgctacgggaagctgaagccccaggtcctccgggagctggacctgcccagccaggacaacgtgtcgctgaccagcaccgagacgccacccccactctacgtggggccatgccagctgggcatgcagaagatcatagaccccctggcccgtggccgtgccttccgtgtggcagatgacactgcggaaggcctgagtgccccacacactcccgtcacgccgggtgctgcctccctctgctccttctccagctcccgctcaggtttccaccggctcccgcggcggcgcaagcgagagtcggtggccaagatgagcttccgggcggccgcagcgctgatgaaaggccgctccgttagggatggcacctttcgccgggcacagcgtcgaagcttcactccagctagctttctggaggaggacacaactgatttccccgatgagctggacacatccttctttgcccgggaaggtatcctccatgaagagctgtccacatacccggatgaagttttcgagtccccatcggaggcagcgctaaaggactgggagaaggcaccggagcaggcggacctcaccggcggggccctggaccgcagcgagcttgagcgcagccacctgatgctgcccttggagcgaggctggcggaagcagaaggagggcgccgcagccccgcagcccaaggtgcggctccgacaggaggtggtgagcaccgcggggccgcgacggggccagcgtatcgcggtgccggtgcgcaagctcttcgcccgggagaagcggccgtatgggctgggcatggtgggacggctcaccaaccgcacctaccgcaagcgcatcgacagcttcgtcaagcgccagatcgaggacatggacgaccacaggcccttcttcacctactggcttaccttcgtgcactcgctcgtcnccatcctagccgtgtgcatctatggcatcgcgcccgtgggcttctcgcagcatgagacggtggactcggtgctgcggaaccgcggggtctacgagaacgtcaagtacgtgcagcaggagaacttctggatcgggcccagctcggaggccctcatccacctgggcgccaagttttcgccctgcatgcgccaggacccgcaggtgcacagcttcattcgctcggcgcgcgagcgcgagaagcactccgcctgctgcgtgcgcaacgacaggtcgggctgcgtgcagacctcggaggaggagtgctcgtccacgctggcagtgtgggtgaagtggcccatccatcccagcgccccagagcttgcgggccacaagagacagtttggctctgtctgccaccaggatcccagggtgtgtgatgagccctcctccgaagaccctcatgagtggccagaagacatcaccaagtggccggtgagctgcagtgggggggttgttagggagccctccgtgtcatgtgggggagaatgccacaccccacccactggtgataccagagattcccatcatgggaccacctcacgttttcagaggctgtgcacctgccctttgtacagcctgtccatcaaccagcgcctgcccctctgagcaagtagatcaagagaactagatggagacttgaaaggtcaagtgacattattccagtttgatagagactcagtgtggtggcctgcttgaagtcaaggaagccacaccgttttctgctttatgagcccacccatctttgcctctacccccaaacgtggtgtggggccaaaggttgggggaggccctgactcagctcgtcctcatttgtgacccagatctgcaccaaaaacagcgctgggaaccacaccaaccatccccacatggactgtgtcatcacaggacggccctgctgcattggcaccaagggcaggtgtgagatcacctcccgggagtactgtgacttcatgaggggctacttccatgaggaggccacgctctgctctcaggtgcactgcatggatgatgtgtgtgggctcctgccttttctcaaccccgaggtgcctgaccagttctaccgcctgtggctatccctcttcctgcacgccgggatcttgcactgcctggtgtccatctgcttccagatgactgtcctgcgggacctggagaagctggcaggctggcaccgcatagccatcatctacctgctgagtggtgtcaccggcaacctggccagtgccatcttcctgccataccgagcagaggtgggtcctgctggctcccagttcggcatcctggcctgcctcttcgtggagctcttccagagctggcagatcctggcgcggccctggcgtgccttcttcaagctgctggctgtggtgctcttcctcttcacctttgggctgctgccgtggattgacaactttgcccacatctcggggttcatcagtggcctcttcctctccttcgccttcttgccctacatcagctttggcaagttcgacctgtaccggaaacgctgccagatcatcatctttcaggtggtcttcctgggcctcctggctggcctggtggtcctcttctacgtctatcctgtccgctgtgagtggtgtgagttcctcacctgcatccccttcactgacaagttctgtgagaagtacgaactggacgctcagctccactgagctggctgcgggctccagcggccgtgtgctccagcaggccagagccagacacgacctccctgagcctcacaggcttacaggagtcacctgctccatgtggggactggcctgtttcctgaacacagacctctttcttgtgccttgttcacttctgttgaacccctcgtactgccgggcatttattatactacttcctgtcataaccttctaacttgtttcttgacgaccacctcatgtggccaataaatggactgggagcgttttagctgccattaacttgaacaggg

SEQ ID NO: 43953 - DNA, 1196 bp, Homo sapiens
cccgccttgaaatttccgccgacaccgttccctttttgtatcccctagggctttcacatgaacaccccaaaaaagagcagttccagggaatgatcatcggggaataggaaattccagtcacttgaaaatagtttggtaacaaacacgggggttggttatcaacttacacccggccttaaagagatatgctcatgcataaacgctctgaacaggtgatttggctctgcttctcaggtgcactgcatggatgatgtgtgtgggctcctgccttttctcaaccccgaggtgcctgaccagttctaccgcctgtggctatccctcttcctgcacgccgggatcttgcactgcctggtgtccatctgcttccagatgactgtcctgcgggacctggagaagctggcaggctggcaccgcatagccatcatctacctgctgagtggtgtcaccggcaacctggccagtgccatcttcctgccataccgagcagaggtgggtcctgctggctcccagttcggcatcctggcctgcctcttcgtggagctcttccagagctggcagatcctggcgcggccctggcgtgccttcttcaagctgctggctgtggtgctcttcctcttcacctttgggctgctgccgtggattgacaactttgcccacatctcggggttcatcagtggcctcttcctctccttcgccttcttgccctacatcagctttggcaagttcgacctgtaccggaaacgctgccagatcatcatctttcaggtggtcttcctgggcctcctggctggcctggtggtcctcttctacgtctatcctgtccgctgtgagtggtgtgagttcctcacctgcatccccttcactgacaagttctgtgagaagtacgaactggacgctcagctccactgagctggctgcgggctccagcggccgtgtgctccagcaggccagagccagacacgacctccctgagcctcacaggcttacaggagtcacctgctccatgtggggactggcctgtttcctgaacacagacctctttcttgtgccttgttcacttctgttgaacccctcgtactgccgggcatttattatactacttcctgtcataaccttctaacttgtttcttgacgaccacctcatgtggccaataaatggactgggagcgttttagctgccattaacttgaacaggg

SEQ ID NO: 43954 - DNA, 3124 bp, Homo sapiens
  misc_feature (1521)..(1521): n is a, c, g, or t
aagcactgtacgctcgattacggatcggcggcgacggcgggcgggcggggactcggcgcgggcgccctcccggccagcggcggcagcccctcctccccggcgccctcaggaccccccagagacccccggcggcggcagcctgccttgctctgccaggaaccatgagtgaggcccgcagggacagcacgagcagcctgcagcgcaagaagccaccctggctaaagctggacattccctctgcggtgcccctgacggcagaagagcccagcttcctgcagcccctgaggcgacaggctttcctgaggagtgtgagtatgccagccgagacagcccacatctcttcaccccaccatgagctccggcggccggtgctgcaacgccagacgtccatcacacagaccatccgcagcagccgacaagtacgcttcgggcgtgtccacactctgcccctcttgggtccccgggctgcccgcagggctttcccacagcgccagtctctctcttggtccctgctcagggggaccgccgactggtttggagtgagcaaggacagtgacagcacccagaaatggcagcgcaagagcatccgtcactgcagccagcgctacgggaagctgaagccccaggtcctccgggagctggacctgcccagccaggacaacgtgtcgctgaccagcaccgagacgccacccccactctacgtggggccatgccagctgggcatgcagaagatcatagaccccctggcccgtggccgtgccttccgtgtggcagatgacactgcggaaggcctgagtgccccacacactcccgtcacgccgggtgctgcctccctctgctccttctccagctcccgctcaggtttccaccggctcccgcggcggcgcaagcgagagtcggtggccaagatgagcttccgggcggccgcagcgctgatgaaaggccgctccgttagggatggcacctttcgccgggcacagcgtcgaagcttcactccagctagctttctggaggaggacacaactgatttccccgatgagctggacacatccttctttgcccgggaaggtatcctccatgaagagctgtccacatacccggatgaagttttcgagtccccatcggaggcagcgctaaaggactgggagaaggcaccggagcaggcggacctcaccggcggggccctggaccgcagcgagcttgagcgcagccacctgatgctgcccttggagcgaggctggcggaagcagaaggagggcgccgcagccccgcagcccaaggtgcggctccgacaggaggtggtgagcaccgcggggccgcgacggggccagcgtatcgcggtgccggtgcgcaagctcttcgcccgggagaagcggccgtatgggctgggcatggtgggacggctcaccaaccgcacctaccgcaagcgcatcgacagcttcgtcaagcgccagatcgaggacatggacgaccacaggcccttcttcacctactggcttaccttcgtgcactcgctcgtcnccatcctagccgtgtgcatctatggcatcgcgcccgtgggcttctcgcagcatgagacggtggactcggtgctgcggaaccgcggggtctacgagaacgtcaagtacgtgcagcaggagaacttctggatcgggcccagctcggaggccctcatccacctgggcgccaagttttcgccctgcatgcgccaggacccgcaggtgcacagcttcattcgctcggcgcgcgagcgcgagaagcactccgcctgctgcgtgcgcaacgacaggtcgggctgcgtgcagacctcggaggaggagtgctcgtccacgctggcagtgtgggtgaagtggcccatccatcccagcgccccagagcttgcgggccacaagagacagtttggctctgtctgccaccaggatcccagggtgtgtgatgagccctcctccgaagaccctcatgagtggccagaagacatcaccaagtggccgatctgcaccaaaaacagcgctgggaaccacaccaaccatccccacatggactgtgtcatcacaggacggccctgctgcattggcaccaagggcaggtgtgagatcacctcccgggagtactgtgacttcatgaggggctacttccatgaggaggccacgctctgctctcaggtgcactgcatggatgatgtgtgtgggctcctgccttttctcaaccccgaggtgcctgaccagttctaccgcctgtggctatccctcttcctgcacgccgggatcttgcactgcctggtgtccatctgcttccagatgactgtcctgcgggacctggagaagctggcaggctggcaccgcatagccatcatctacctgctgagtggtgtcaccggcaacctggccagtgccatcttcctgccataccgagcagaggtgggtcctgctggctcccagttcggcatcctggcctgcctcttcgtggagctcttccagagctggcagatcctggcgcggccctggcgtgccttcttcaagctgctggctgtggtgctcttcctcttcacctttgggctgctgccgtggattgacaactttgcccacatctcggggttcatcagtggcctcttcctctccttcgccttcttgccctacatcagctttggcaagttcgacctgtaccggaaacgctgccagatcatcatctttcaggtggtcttcctgggcctcctggctggcctggtggtcctcttctacgtctatcctgtccgctgtgagtggtgtgagttcctcacctgcatccccttcactgacaagttctgtgagaagtacgaactggacgctcagctccactgagctggctgcgggctccagcggccgtgtgctccagcaggccagagccagacacgacctccctgagcctcacaggcttacaggagtcacctgctccatgtggggactggcctgtttcctgaacacagacctctttcttgtgccttgttcacttctgttgaacccctcgtactgccgggcatttattatactacttcctgtcataaccttctaacttgtttcttgacgaccacctcatgtggccaataaatggactgggagcgttttagctgccattaacttgaacaggg

SEQ ID NO: 43955 - DNA, 3649 bp, Homo sapiens
  misc_feature (1536)..(1536): n is a, c, g, or t
aagcactgtacgctcgattacggatcggcggcgacggcgggcgggcggggactcggcgcgggcgccctcccggccagcggcggcagcccctcctccccggcgccctcaggaccccccagagacccccggcggcggcagcctgccttgctctgccaggaaccatgagtgaggcccgcagggacagcacgagcagcctgcagcgcaagaagccaccctggctaaagctggacattccctctgcggtgcccctgacggcagaagagcccagcttcctgcagcccctgaggcgacaggctttcctgaggagtgtgagtatgccagccgagacagcccacatctcttcaccccaccatgagctccggcggccggtgctgcaacgccagacgtccatcacacagaccatccgcagaccctggtccctggagtgactacaggcctggggcagggcatgctgccccggaggagggcctttgaagtcccctgcctgggaggggcgatctggccgccccttgctgagtccctgccatgccagggggaccgccgactggtttggagtgagcaaggacagtgacagcacccagaaatggcagcgcaagagcatccgtcactgcagccagcgctacgggaagctgaagccccaggtcctccgggagctggacctgcccagccaggacaacgtgtcgctgaccagcaccgagacgccacccccactctacgtggggccatgccagctgggcatgcagaagatcatagaccccctggcccgtggccgtgccttccgtgtggcagatgacactgcggaaggcctgagtgccccacacactcccgtcacgccgggtgctgcctccctctgctccttctccagctcccgctcaggtttccaccggctcccgcggcggcgcaagcgagagtcggtggccaagatgagcttccgggcggccgcagcgctgatgaaaggccgctccgttagggatggcacctttcgccgggcacagcgtcgaagcttcactccagctagctttctggaggaggacacaactgatttccccgatgagctggacacatccttctttgcccgggaaggtatcctccatgaagagctgtccacatacccggatgaagttttcgagtccccatcggaggcagcgctaaaggactgggagaaggcaccggagcaggcggacctcaccggcggggccctggaccgcagcgagcttgagcgcagccacctgatgctgcccttggagcgaggctggcggaagcagaaggagggcgccgcagccccgcagcccaaggtgcggctccgacaggaggtggtgagcaccgcggggccgcgacggggccagcgtatcgcggtgccggtgcgcaagctcttcgcccgggagaagcggccgtatgggctgggcatggtgggacggctcaccaaccgcacctaccgcaagcgcatcgacagcttcgtcaagcgccagatcgaggacatggacgaccacaggcccttcttcacctactggcttaccttcgtgcactcgctcgtcnccatcctagccgtgtgcatctatggcatcgcgcccgtgggcttctcgcagcatgagacggtggactcggtgctgcggaaccgcggggtctacgagaacgtcaagtacgtgcagcaggagaacttctggatcgggcccagctcggaggccctcatccacctgggcgccaagttttcgccctgcatgcgccaggacccgcaggtgcacagcttcattcgctcggcgcgcgagcgcgagaagcactccgcctgctgcgtgcgcaacgacaggtcgggctgcgtgcagacctcggaggaggagtgctcgtccacgctggcagtgtgggtgaagtggcccatccatcccagcgccccagagcttgcgggccacaagagacagtttggctctgtctgccaccaggatcccagggtgtgtgatgagccctcctccgaagaccctcatgagtggccagaagacatcaccaagtggccggtgagctgcagtgggggggttgttagggagccctccgtgtcatgtgggggagaatgccacaccccacccactggtgataccagagattcccatcatgggaccacctcacgttttcagaggctgtgcacctgccctttgtacagcctgtccatcaaccagcgcctgcccctctgagcaagtagatcaagagaactagatggagacttgaaaggtcaagtgacattattccagtttgatagagactcagtgtggtggcctgcttgaagtcaaggaagccacaccgttttctgctttatgagcccacccatctttgcctctacccccaaacgtggtgtggggccaaaggttgggggaggccctgactcagctcgtcctcatttgtgacccagatctgcaccaaaaacagcgctgggaaccacaccaaccatccccacatggactgtgtcatcacaggacggccctgctgcattggcaccaagggcaggtgtgagatcacctcccgggagtactgtgacttcatgaggggctacttccatgaggaggccacgctctgctctcaggtgcactgcatggatgatgtgtgtgggctcctgccttttctcaaccccgaggtgcctgaccagttctaccgcctgtggctatccctcttcctgcacgccgggcaagtgacactgtgggccgggtcgggggtctcagggccctcaggattggctggctgggggtggcagaaaggtcacttccctgctgaatgtctcccgacccccgcctgctactgactacaggatcttgcactgcctggtgtccatctgcttccagatgactgtcctgcgggacctggagaagctggcaggctggcaccgcatagccatcatctacctgctgagtggtgtcaccggcaacctggccagtgccatcttcctgccataccgagcagaggtgggtcctgctggctcccagttcggcatcctggcctgcctcttcgtggagctcttccagagctggcagatcctggcgcggccctggcgtgccttcttcaagctgctggctgtggtgctcttcctcttcacctttgggctgctgccgtggattgacaactttgcccacatctcggggttcatcagtggcctcttcctctccttcgccttcttgccctacatcagctttggcaagttcgacctgtaccggaaacgctgccagatcatcatctttcaggtggtcttcctgggcctcctggctggcctggtggtcctcttctacgtctatcctgtccgctgtgagtggtgtgagttcctcacctgcatccccttcactgacaagttctgtgagaagtacgaactggacgctcagctccactgagctggctgcgggctccagcggccgtgtgctccagcaggccagagccagacacgacctccctgagcctcacaggcttacaggagtcacctgctccatgtggggactggcctgtttcctgaacacagacctctttcttgtgccttgttcacttctgttgaacccctcgtactgccgggcatttattatactacttcctgtcataaccttctaacttgtttcttgacgaccacctcatgtggccaataaatggactgggagcgttttagctgccattaacttgaacaggg

SEQ ID NO: 43956 - DNA, 718 bp, Homo sapiens
aagcactgtacgctcgattacggatcggcggcgacggcgggcgggcggggactcggcgcgggcgccctcccggccagcggcggcagcccctcctccccggcgccctcaggaccccccagagacccccggcggcggcagcctgccttgctctgccaggaaccatgagtgaggcccgcagggacagcacgagcagcctgcagcgcaagaagccaccctggctaaagctggacattccctctgcggtgcccctgacggcagaagagcccagcttcctgcaggtaggccctggcctgcagggactgtgggtgccccctgtccagtaccctcaccatgaccctgttgcccagcccctgaggcgacaggctttcctgaggagtgtgagtatgccagccgagacagcccacatctcttcaccccaccatgagctccggcggccggtgctgcaacgccagacgtccatcacacagaccatccgcaggtaccaacaccgcccagctgctccatggggtgggagctgggggctggtggggcagaggcaggtacacagaggatggaaatgagaacaagggccctcttgtttcagcttcctcctccatctcggtccccaccatccccttgccctcctcctgttctggatactgaccgctctcaccccactaccctgctccactcccttctcttcagcactcactctctccttctctgtctccaccgcccg

SEQ ID NO: 43957 - DNA, 1429 bp, Homo sapiens
acgtgacttccgtcgcatttcggggcggtaccaagatggactcctcgcgggcccggcagcagctccggcggcgattcctcctcctgccggacgccgaggcccagctggaccgcgagggtgacgccgggccggaaacctccacagctgttgagaaaaaggagaaacctcttccaagacttaatatccattctggattctggattttggcatccattgttgtgacctattatgttgacttctttaaaacccttaaagaaaacttccacactagcagctggtttctctgtggcagtgccttgttgcttgtcagtttatcaattgcattttactgcatagtctacctggaatggtattgtggaattggagaatatgatgtcaagtatccagccttgatacccattaccactgcctcctttattgcagcaggaatttgcttcaacattgctttatggcatgtgtggtcgtttttcactccattgttgttgtttacccagtttatgggggttgtcatgtttatcacactccttggatgatttccgaagagacagggtcttctatgttgcccaggctgtctttgaactcctgggatcaagtgatcctcctgcctcagccttcgaagtagttgggactacaggcccacgccaccgtgcctggctggacatgtaaatttgaagtgaatggttaaacatccagctagctgaaagcatggcagaccctaacagaaaagctacagtgtgtttttgcagctatgaagtgaatggtttcctggggaaaattgtgactttgtataactgttgttgaaaccagaataaattatatttcacttgcatatgcataaattattaaaattttcagaagtcagtgatacagaagtactattttgcaatgttaatctgtttgagtctttggagaaagtggtttcattgtaggtacatagtgcactgttaatattttaaacaagtagttcactcttccatttaagggatagcagttccttgtataaaatgactggatgtgtataaaggaattatgttgtcatgtgcctttaaccagctttagtaattactataatctcatatttatgatagttttgttaggtgacaggaccaaatgaaaatattttatgttttctcatcactttagattttatcattatgtacattactgggtttttagcatttcctaatgtgaagttttaatcacttttaagtatacatttttttctgtatcatttaaataaaatatttttataactttaaaaaaaaaaaaaaaacaagaagaaaaacaaaaaaaacacaaaaaaatcgacgacgccaaaaaaaaaatggggcgcgccaacgatcacccgtggggcgccaaaagggggcgattaaaaaaaaaacgggggaccaaaaagcggccgagcgcaggtgcactctcgccacccgct

SEQ ID NO: 43958 - DNA, 1762 bp, Homo sapiens
acgtgacttccgtcgcatttcggggcggtaccaagatggactcctcgcgggcccggcagcagctccggcggcgattcctcctcctgccggacgccgaggcccagctggaccgcgagggtgacgccgggccgggtgaggcgcgcaccaagccgccccgaggttctcagaggcgaggcgtcggaaaacggccggcctccggcagccctggcccagtctggaaggactgagtttcggctttgcaagtcgaatatttaatgtcagggaagatccttagaatcgcggagtgctgtgcatcgtcatttcagctgcgcttcagaattctctggagagctgatttgacacctatttggaaatagcgattaaaattaaaaatacccaccagttttaagtcttaaggatttaccagaaacatgcgtgtaccgcagtgtacaatgatgtgcgcagtgtttcacttcaggattgcttgtaatagcgaattactagaaatatctgccttgcccgtcagcagaaagctgtttaagtaaatttgggtatatgtatacctgacacatcaggtcgactcgtatgtaccaatggggatgattttcaaagggaagtgtggaacactatggtatgccgccatttgggtacaaaacagaaacctccacagctgttgagaaaaaggagaaacctcttccaagacttaatatccattctggattctggattttggcatccattgttgtgacctattatgttgacttctttaaaacccttaaagaaaacttccacactagcagctggtttctctgtggcagtgccttgttgcttgtcagtttatcaattgcattttactgcatagtctacctggaatggtattgtggaattggagaatatgatgtcaagtatccagccttgatacccattaccactgcctcctttattgcagcaggaatttgcttcaacattgctttatggcatgtgtggtcgtttttcactccattgttgttgtttacccagtttatgggggttgtcatgtttatcacactccttggatgatttccgaagagacagggtcttctatgttgcccaggctgtctttgaactcctgggatcaagtgatcctcctgcctcagccttcgaagtagttgggactacaggcccacgccaccgtgcctggctggacatgtaaatttgaagtgaatggttaaacatccagctagctgaaagcatggcagaccctaacagaaaagctacagtgtgtttttgcagctatgaagtgaatggtttcctggggaaaattgtgactttgtataactgttgttgaaaccagaataaattatatttcacttgcatatgcataaattattaaaattttcagaagtcagtgatacagaagtactattttgcaatgttaatctgtttgagtctttggagaaagtggtttcattgtaggtacatagtgcactgttaatattttaaacaagtagttcactcttccatttaagggatagcagttccttgtataaaatgactggatgtgtataaaggaattatgttgtcatgtgcctttaaccagctttagtaattactataatctcatatttatgatagttttgttaggtgacaggaccaaatgaaaatattttatgttttctcatcactttagattttatcattatgtacattactgggtttttagcatttcctaatgtgaagttttaatcacttttaagtatacatttttttctgtatcatttaaataaaatatttttataacttt

SEQ ID NO: 43959 - DNA, 2076 bp, Homo sapiens
acgtgacttccgtcgcatttcggggcggtaccaagatggactcctcgcgggcccggcagcagctccggcggcgattcctcctcctgccggacgccgaggcccagctggaccgcgagggtgacgccgggccggaaacctccacagctgttgagaaaaaggagaaacctcttccaagacttaatatccattctggattctggattttggcatccattgttgtgacctattatgttgacttctttaaaacccttaaagaaaacttccacactagcagctggtttctctgtggcagtgccttgttgcttgtcagtttatcaattgcattttactgcatagtctacctggaatggtattgtggaattggagaatatgatgtcaagtatccagccttgatacccattaccactgcctcctttattgcagcaggaatttgcttcaacattgctttatggcatgtgtggtcgtttttcactccattgttgttgtttacccagtttatgggggttgtcatgtttatcacactccttggatgatttccgaagatcaccccatcctgagatctgctgccttacacagtggaggctgttttctgagtgtcggataactctgttattaaataagtgtatattgagaatactcactccagatgcttaggggcatggtgagaaggacaaagatagtgcctcctgtcaggtcacttacatcagaacttgcaggaaacctgctttatacagcagttgacaggtgtggaaactgaagctcatggaaataaaagttaatacgctaaattttcaaggagttaatgaaaactgacatttctgctaaaaacagcatgttctccctgtgggattttaaaggaaggtcagtggtaactgtgtaaagaagaaatggacatactctcattgttagcagtctgaaaatagttgctagcacctccatgcccacgccaatgtctccagcctccttcaggcaccttgctgtgtcttgggaccactgggacccctcacaggaggcccttcattcctgtacacctgtggtgccacaagcggctttgggcccggaggaatcctacacatctcagaacacttcctcacctgaccctgtcacccatctccccttctcgtgttctcagccccttctttgactcttgaattttgagtttttacagatgtttgggagctcttactctgacatgaagttataattggtaatggagactcagacaatgttgtagattacagagtgaactatgctttttagtgttaaatgcaatagcttgagatacaatgttttacttggtacataaatgctggttttctttcagatttaaggacatacacttttttttttttttttttaagagacagggtcttctatgttgcccaggctgtctttgaactcctgggatcaagtgatcctcctgcctcagccttcgaagtagttgggactacaggcccacgccaccgtgcctggctggacatgtaaatttgaagtgaatggttaaacatccagctagctgaaagcatggcagaccctaacagaaaagctacagtgtgtttttgcagctatgaagtgaatggtttcctggggaaaattgtgactttgtataactgttgttgaaaccagaataaattatatttcacttgcatatgcataaattattaaaattttcagaagtcagtgatacagaagtactattttgcaatgttaatctgtttgagtctttggagaaagtggtttcattgtaggtacatagtgcactgttaatattttaaacaagtagttcactcttccatttaagggatagcagttccttgtataaaatgactggatgtgtataaaggaattatgttgtcatgtgcctttaaccagctttagtaattactataatctcatatttatgatagttttgttaggtgacaggaccaaatgaaaatattttatgttttctcatcactttagattttatcattatgtacattactgggtttttagcatttcctaatgtgaagttttaatcacttttaagtatacatttttttctgtatcatttaaataaaatatttttataacttt

SEQ ID NO: 43960 - DNA, 1611 bp, Homo sapiens
cttcctcataaaaatgtgttggatgacacaatcagctttcgtttggtgttatttatagaatttctgcctccctacagatcaccccatcctgagatctgctgccttacacagtggaggctgttttctgagtgtcggataactctgttattaaataagtgtatattgagaatactcactccagatgcttaggggcatggtgagaaggacaaagatagtgcctcctgtcaggtcacttacatcagaacttgcaggaaacctgctttatacagcagttgacaggtgtggaaactgaagctcatggaaataaaagttaatacgctaaattttcaaggagttaatgaaaactgacatttctgctaaaaacagcatgttctccctgtgggattttaaaggaaggtcagtggtaactgtgtaaagaagaaatggacatactctcattgttagcagtctgaaaatagttgctagcacctccatgcccacgccaatgtctccagcctccttcaggcaccttgctgtgtcttgggaccactgggacccctcacaggaggcccttcattcctgtacacctgtggtgccacaagcggctttgggcccggaggaatcctacacatctcagaacacttcctcacctgaccctgtcacccatctccccttctcgtgttctcagccccttctttgactcttgaattttgagtttttacagatgtttgggagctcttactctgacatgaagttataattggtaatggagactcagacaatgttgtagattacagagtgaactatgctttttagtgttaaatgcaatagcttgagatacaatgttttacttggtacataaatgctggttttctttcagatttaaggacatacacttttttttttttttttttaagagacagggtcttctatgttgcccaggctgtctttgaactcctgggatcaagtgatcctcctgcctcagccttcgaagtagttgggactacaggcccacgccaccgtgcctggctggacatgtaaatttgaagtgaatggttaaacatccagctagctgaaagcatggcagaccctaacagaaaagctacagtgtgtttttgcagctatgaagtgaatggtttcctggggaaaattgtgactttgtataactgttgttgaaaccagaataaattatatttcacttgcatatgcataaattattaaaattttcagaagtcagtgatacagaagtactattttgcaatgttaatctgtttgagtctttggagaaagtggtttcattgtaggtacatagtgcactgttaatattttaaacaagtagttcactcttccatttaagggatagcagttccttgtataaaatgactggatgtgtataaaggaattatgttgtcatgtgcctttaaccagctttagtaattactataatctcatatttatgatagttttgttaggtgacaggaccaaatgaaaatattttatgttttctcatcactttagattttatcattatgtacattactgggtttttagcatttcctaatgtgaagttttaatcacttttaagtatacatttttttctgtatcatttaaataaaatatttttataacttt

SEQ ID NO: 43961 - DNA, 1215 bp, Homo sapiens
acgtgacttccgtcgcatttcggggcggtaccaagatggactcctcgcgggcccggcagcagctccggcggcgattcctcctcctgccggaaacctccacagctgttgagaaaaaggagaaacctcttccaagacttaatatccattctggattctggattttggcatccattgttgtgacctattatgttgacttctttaaaacccttaaagaaaacttccacactagcagctggtttctctgtggcagtgccttgttgcttgtcagtttatcaattgcattttactgcatagtctacctggaatggtattgtggaattggagaatatgatgtcaagtatccagccttgatacccattaccactgcctcctttattgcagcaggaatttgcttcaacattgctttatggcatgtgtggtcgtttttcactccattgttgttgtttacccagtttatgggggttgtcatgtttatcacactccttggatgatttccgaagagacagggtcttctatgttgcccaggctgtctttgaactcctgggatcaagtgatcctcctgcctcagccttcgaagtagttgggactacaggcccacgccaccgtgcctggctggacatgtaaatttgaagtgaatggttaaacatccagctagctgaaagcatggcagaccctaacagaaaagctacagtgtgtttttgcagctatgaagtgaatggtttcctggggaaaattgtgactttgtataactgttgttgaaaccagaataaattatatttcacttgcatatgcataaattattaaaattttcagaagtcagtgatacagaagtactattttgcaatgttaatctgtttgagtctttggagaaagtggtttcattgtaggtacatagtgcactgttaatattttaaacaagtagttcactcttccatttaagggatagcagttccttgtataaaatgactggatgtgtataaaggaattatgttgtcatgtgcctttaaccagctttagtaattactataatctcatatttatgatagttttgttaggtgacaggaccaaatgaaaatattttatgttttctcatcactttagattttatcattatgtacattactgggtttttagcatttcctaatgtgaagttttaatcacttttaagtatacatttttttctgtatcatttaaataaaatatttttataacttt

SEQ ID NO: 43962 - DNA, 859 bp, Homo sapiens
acgtgacttccgtcgcatttcggggcggtaccaagatggactcctcgcgggcccggcagcagctccggcggcgattcctcctcctgccggacgccgaggcccagctggaccgcgagggtgacgccgggccggaaacctccacagctgttgagaaaaaggagaaacctcttccaagacttaatatccattctggattctggattttggcatccattgttgtgacctattatgttgacttctttaaaacccttaaagaaaacttccacactagcagctggtttctctgtggcagtgccttgttgcttgtcagtttatcaattgcattttactgcatagtctacctggaatggtattgtggaattggagaatatgatgtcaagtatccagccttgatacccattaccactgcctcctttattgcagcaggaatttgcttcaacattgctttatggcatgtgtggtcgtttttcactccattgttgttgtttacccagtttatgggggttgtcatgtttatcacactccttggatgatttccgaaggtaagatatctggagtggtttttctaaaaatgaactcgtttgaaaaatgtcttttatgacaattttcagtggatggagctgtaacagactatttgtgaattattttcagtcatgtttacaccagagttgtccacactagaattatccattcattgaactctgagatagactcctttttgttttgagacagcttctcactctgttgtccaggctggagtacggtggcatgatcacagctcactgcagccttgaccacttgggggctcaagcaatcctcccacctcagtttcccaagtagctggtattataagcatgtg

SEQ ID NO: 43963 - DNA, 1257 bp, Homo sapiens
acgtgacttccgtcgcatttcggggcggtaccaagatggactcctcgcgggcccggcagcagctccggcggcgattcctcctcctgccggacgccgaggcccagctggaccgcgagggtgacgccgggccggaaacctccacagctgttgagaaaaaggagaaacctcttccaagacttaatatccattctggattctggattttggcatccattgttgtgacctattatgttgacttctttaaaacccttaaagaaaacttccacactagcagctggtttctctgtggcagtgccttgttgcttgtcagtttatcaattgcattttactgcatagtctacctggaatggtattgtggaattggagaatatgatgtcaagtatccagccttgatacccattaccactgcctcctttattgcagcaggaatttgcttcaacattgctttatggcatgtgtggtcgtttttcactccattgttgttgtttacccagtttatgggggttgtcatgtttatcacactccttggatgatttccgaagagacagggtcttctatgttgcccaggctgtctttgaactcctgggatcaagtgatcctcctgcctcagccttcgaagtagttgggactacaggcccacgccaccgtgcctggctggacatgtaaatttgaagtgaatggttaaacatccagctagctgaaagcatggcagaccctaacagaaaagctacagtgtgtttttgcagctatgaagtgaatggtttcctggggaaaattgtgactttgtataactgttgttgaaaccagaataaattatatttcacttgcatatgcataaattattaaaattttcagaagtcagtgatacagaagtactattttgcaatgttaatctgtttgagtctttggagaaagtggtttcattgtaggtacatagtgcactgttaatattttaaacaagtagttcactcttccatttaagggatagcagttccttgtataaaatgactggatgtgtataaaggaattatgttgtcatgtgcctttaaccagctttagtaattactataatctcatatttatgatagttttgttaggtgacaggaccaaatgaaaatattttatgttttctcatcactttagattttatcattatgtacattactgggtttttagcatttcctaatgtgaagttttaatcacttttaagtatacatttttttctgtatcatttaaataaaatatttttataacttt

SEQ ID NO: 43964 - DNA, 7991 bp, Homo sapiens
tgccctctcccgatgtcagttaccaggctttgctaataaaacgtctctcccggctcttccagagagccagccgcagagtctctgccgtctccccgtgcgctcaagcacaagcccccaactaaaagccttgtctggaaaatctgcttggtgccataacagattatctggtgagccaggtaggagcacaaggagtaatttccctccctgcaggggaggcttgtgagcctgcgagccggagggaggccccactgattcagcgctgccaccgcgactggcgagttttcctctagtctcgcgactggacactggtcagtagaacctggacctgctgtaaggctgaagaagaaaaagaaaccatccaagctggcactcggttttggggagttctcttcactgctcacgccggccctcttgtgtgacctgtactgttgtgctgtgtggggctgggagccaactctcttttcgtcgcctgacacctgtgcttgcaccctgcccctggtcctttaataagacaagcagacacaggggctacagtcatgggcaatgccccaggcatcttccaagactcacacctgggatgtatcatttctaaatggaaggaatccaaatcagatggtttaaagaaaaagaaactccagcctgggaaacataggaagactccacctctacaaaaaacaggaaaaatgagccgggtgtgggggtgccttcctggggtctcagctactcagaaggctaaagtgaggatcgcttaagtccaggaggttgaggctgcagtgagttgtggtaataccatagcactccaacctgggcaatggagtgagaccctgcctcaaaatcaaattttttttttaattaaaaaaaaagaaactgattttcctctgtaatacaacctgccctagtacacattagatcaagaaaaatggccatgggcagaagtggatctcctagttttaacactatcttaccgcccgacctattctgtgaatggacagagaaatggggagagatacctagctacaagcttttatgaagttatgctaggacccagagctactggattcttgtcaggtgtgtgtggcccctatttccaggttcctcctgaaggaacctgaagaagctgacctccacagcctcaggccccgagcactccctccctaccctaagcaggcctcctggggaggggagcccctgtgctgtccccaacagcgctccaatcggactccaaacaggcaccctcttttgcttccccactggcccagggctgttttcccctcagagaaatggatggaaacgggggagtgacaaggatccaagttcctttttttggtggtggatctaggactatgtaaaaaacactttggtagattttcagaggatcctggtaagtttagagatgaatttgttaaactaaatcttgccttttcattgacgtggcaggatgttatggtcactttgcagtactgatgaaaagcaacacatatttggaaaggctaaggaatatgccaatagccaggtggtcactaaagaccaatatgcagtcatctgtttagggggagatgcggtcccaggcatagtctccacgtgagtgagactatggagaaaacctagaaaaagctagaatgagccactttgtcacctgcctgactgaaggaagaaggaaatgtatagtaaaacctgtacactatgacagggtcaagaaaattacccagagaaagaaggagatcccagtagtcttcctcaatcgagtccctgaggcccttgggaaatgcacccatgcagacccagaggcagcagaggggaagcatcgcgtgccatgcattttatccttcagtcagctccggacattagaaggaaattacagaaaatttggaggccagaccccagaccctgctgttgactttggcagaggcggcttttaaggttttcaataacggacaggacacagatggcaggtaagaagaggagactgaccaagacagcacagcttctggctgccctaattcatccaccatctcagggtgaccctaggattctcaggagaccaactaatcgaagacagccaaccttggatggagccaatgtgcctactgcaggatggagggtgtcactggaagagaggctgccctgacctccttaaaacaggacagccggcaggcaaccctggccagccgccactcctcaccaagctttcagatgagattgatacacaccgcctgacagcaccctggctctgactgcagcacactccatcgtcatcacaccacggagcctcaggtcacccttgatgtggcaggtaggaaaacagttcctcgtggacagcagagctgcctgctcggtcctgacccagcctatttgcctcctctccaattgcaattgcagggtaatgggaatagacaggtgtcctaaggtaagaaaatttactttccctcttgcttgtgaggccatgtctaggcttttttctcctcatttctgtatgccccccggaatgtcctactccattgctgggtagagacttattaagcaaaatgggagccaccatctccctggaagaggacagactgcaggtagaggcagagccagaacagggaatccacctgctagcactcttaaatggacaggaacttgagacccaaaacatacccaaagaaagcaaggatcacatcaccccttccctatcggacacttcagtcctaggacaggctaataaagttccgccagtaaagacagacctgaagcctgggatgggctatccatggaggaaatcatacctcctaaaacctgtggcactgaatggggttcagccattactccacaaattcctatagcaagggctaaaccctgccagtccccaggcaacacctcggtcctccctgttaaaaagcctaatggagaatatcagtttgtgtaggacttgaagggggttaatgaggcagtcattcccatccacccaacactggtcccaagcttgtctgtgctcagatacctggagatgctcagtttttcactctactacacttcaaggatgctttcttttgtgtagccctctccacccagaatccctgtatctttttgctttgaatggagaaatctctgatacccagaaagccacatagtacacatggactgtgcttccccagggcttctgggaaggcccccacctttttgggaatgcagggagctaagcctacagaatgggacttttattacaatatgtggatgacttgttcattgtcagccaaacatggcaggattcagattttaatatcattaaaaccttgaatttcctggctgagcggtgatacaaggtcagccccatccaaggcccagatttctttacagaagttccgatatctggggttcattctgaccccaggagcccgaacactagttgtggactggaaaaagcaatcacttcattgctggtcccacaaacaaaaaggcagccccagggtttcttgggaatggtgggcttctgtagtatttggattccaaattatggcctgacggctaaacccctatgtgagacccaaaagggggaagaaagagagcccttgtactgggagaagaaatgtcaacaatcttttgaacctctaaaaactgagctgggtcaagcccttgtccttggactccctgagaaaaaccacttaccttgtatgtttgtgagagactaggaatagctttgggagtcttaactcaaaggttaggacctgttcagaagccagtggctcatttttcgaaacagacaaatccagttgcacagaagcggcctggctgctggagggcagtggcagccactgccctgctgtttagtgaagcatctaagctgacacagggacaatatacagaagctatgactccccaccaggttcagactgggttagaagtcaagggacaccattggctcactgcagggaggctgaccaactaccaagctctcttattagacaccctggatattactttaagggtatgtcagactttgaacacagcaacctcactcccaaccacagatgatgaggactcacagcatcaatgcacagggcccacaaaacagactccagcaggcctagcttgtgagataagcctcttgagaatgcaaagacggaatgatatcctgatggcagtagctttgtggagggagacccaaaaggcaggacatgcagtagtaagcctgaaggagactacagaaactaaagcccttcctccccaaaatggcacaaaaagcagcactagaggccttaacagagcctcacaactgggagaaagggagggagtaaatttatacaccaactcaaagtataggtttctcctgctgtgtgcccatgcagccatatggaaggaaaagggaatgttaacagttaaaaattccccaggcaaacgtaaggatccaatccaacttctcctggaagcggcacaacttccctgccaggtggcagtcattcactgcaaaggccaccagagggactggtccctcatcagccaaggaaatagggccacaaaacaggcaacctggttataggaatccagcaatgtgttggccttaatgacagaccctaccaaccttcctaatcacctacaatactcacaacaagagcaagaggaagctaaggggcaggggtaccaggaaaacagtgctggatggttcacagatggtgacaagttttattccaggaactgaccagttgaaagttactaagcatctccatgatgccactcattaatggagagatgttttatggaattctgtccataaaatattcaccagaaagaaactaagaaaaagtgtaaaacaagtaacctttgtcagtgaattgtgttcccgaaataatccccacacccatccaattcccccttcttgacttaaactggttcaacacaggggaacttatctgggagaagactggcaggttgttttaacccaaatgactccaaatctagggtacaaatatctcctggtgtttgtggatacttttactggacgggtcaagggtttccctacctgtacagaaaaagcagtagaagtctgtaaaccttcactaaaggaagtaatttctcaatttggactccccaagtcccctcagagtggtaacaggctctccttcatgggtaagattactcagagcctctccacaaccttaggaatagattatgaactggcaccccaatcatcagggaaagttaagatgaaccatacacttgagacgactctagccaaactctttcaggagatgcacgagtcctgggttaagatgctcccagtcttctcagggtccgcagggccccttcgtgcagcctaagacttagttcttctcagatgatctaccagaggcctttcctcaccactgacctcctgttaggtgaagaattacataaaaaattacagtatcgatttaggacagattcaaaaggtgacttcagaatatggaaacaaaatcctgccagtccccactaaggatgggaaaacccctttacaagttaatccaggggaccaagtcctcctaaaggcttgaagggcaggctccccggaggaccaccccttgcttaaatgggagggcccttactgggtgatcctgaccactccaactgcagccaactcacaaggaatcactagctgggtacacctctcccgatcagaaatgctttctcctaaatgtttccagactcgcccagatggcccattttactcctgaaaacctgtggaagacctcaaattcaggagagccaattcatcatcggagaagtaatgtggttagagatcttgagtccaatacttttccttgtattactaattggtttactattattctgttgctttgctcagcctcctccctcaggtaaagacttcgtttgtccctgctgggtataaagatgctactctttactttgttcctactcctccccatcagggcacagggtaggctaggcctactaaaatgagaaacaaactctcttgacaacctttccggcattatagcttcaggtaataatttgtccaactgctgggtgtgctaccatcatccccaggctcagaggggctgcctcttgcactccctaaaagctcaactaccaacttcacaaaagaggtatggaaacctaaaataacctctgcacctcttatggtggacctaagtgtctccctttcctttgaatgtataaacctcattgggctgctaaatgctttggtcaccaaaaagggtggaaaaaagagaagttggactgcctactttgaaatcccaccgggttttctcttagcagtaaagaaaaaccctaatcaaacttgggctcaggaaggctatcttttcccccatgccaaaacagtcatacctctctccacagcttagctgctcacctgaactcctctcgccttgtgtaagtttgtgcacccatggggtattctgttcctttgtggacacccagactgccatctgatcaacagctacccttcagccaatttcacctttctgttacttgcactagcgtgcccttgtgtggataatgtacaacgcaataaggaatgcatgttaggtactttaagtcccagtagaataccagttcataatatcacacatgtggtgaaatctaaaaaggcaatagggctaattttggcaggagttggaatagccccttgggatggctttgcatactgtcagacagctttgagaaactttcaaacccttgaaacactggcaactagtacaggcagagccataaaaggacatcaagcctccctgcactccctagccaatgctgtcttggataacagatttgccctggaatatcttctggctgaacaagggcgggtatgcacagtaataaaccacatctgttgttcttacattaacagttcaggattggctaaactgcaagttcaaaagatttaccaagaccaggcacaatggttcatgcctgtaatcccagcactttgggaggccaaggtgggtggatcgtttgagcctaagagtttgagaccagcctgggcaacatggctaaaccccatctctacaaaattacaaaaaaagaaaaaaaaattaggtggccttggtggcatgtgcctttattcccagctactcaggaggctgaggtgggaggattgcctgagcccagaaggttgaggctgcagtaagccatgatggcaccactgcactcctacctggatgacagagtgagaccctgtctccaaaagaaaataaaagtaaagattcaccaagaggctacctggctacataatcgtaatgactctactgctcaaaccatctggggctccatcagtggatacctacaaagtatgacatggtttttacctttcttcggaccctaagtggtcatttaattgctattacttttggcgtattgtgtttttaaccttttggtaaagtttgtgtctttcaggtttcaatagctccaagtcaagctaatgatggcccaagaattccaacccataacatcccaggagcaccccagtccctacaggtctttaggacagccagtgagagatttccccaccccctaaagttaggcagggacgacatccctgttcagcaggaagtcgcttcagaagatgagatcttcagccctttctccttaagaatagagggtgaaatctctcagggggaaatagagatagaacagaaatggaatggggttgcttcttcataatacttaaccatgccttctacttaaagttctaggaactggccttaggaaatctaactatgaaaccaaggttatggagtatcccacctcaggaaggaacactgaacaactgattgacagtcttcttgccgccagccagaccaccaagtggcccattaaccaagagaaccagcgcaaccagatacgctgacccgcatctcctacctctcatgtgctttgcccagcccagcctgcataccttactcatgatgtcaattcccaagtttcgctaataaaaacatctctgcaagcctcttcagggagccaacaagacagtcaaaaaaaaatataattaataa

SEQ ID NO: 43965 - DNA, 3302 bp, Homo sapiens
cgaagacgtggatcagggaagacggtcattaatggagagatgttttatggaattctgtccataaaatattcaccagaaagaaactaagaaaaagtgtaaaacaagtaacctttgtcagtgaattgtgttcccgaaataatccccacacccatccaattcccccttcttgacttaaactggttcaacacaggggaacttatctgggagaagactggcaggttgttttaacccaaatgactccaaatctagggtacaaatatctcctggtgtttgtggatacttttactggacgggtcaagggtttccctacctgtacagaaaaagcagtagaagtctgtaaaccttcactaaaggaagtaatttctcaatttggactccccaagtcccctcagagtggtaacaggctctccttcatgggtaagattactcagagcctctccacaaccttaggaatagattatgaactggcaccccaatcatcagggaaagttaagatgaaccatacacttgagacgactctagccaaactctttcaggagatgcacgagtcctgggttaagatgctcccagtcttctcagggtccgcagggccccttcgtgcagcctaagacttagttcttctcagatgatctaccagaggcctttcctcaccactgacctcctgttaggtgaagaattacataaaaaattacagtatcgatttaggacagattcaaaaggtgacttcagaatatggaaacaaaatcctgccagtccccactaaggatgggaaaacccctttacaagttaatccaggggaccaagtcctcctaaaggcttgaagggcaggctccccggaggaccaccccttgcttaaatgggagggcccttactgggtgatcctgaccactccaactgcagccaactcacaaggaatcactagctgggtacacctctcccgatcagaaatgctttctcctaaatgtttccagactcgcccagatggcccattttactcctgaaaacctgtggaagacctcaaattcaggagagccaattcatcatcggagaagtaatgtggttagagatcttgagtccaatacttttccttgtattactaattggtttactattattctgttgctttgctcagcctcctccctcaggtaaagacttcgtttgtccctgctgggtataaagatgctactctttactttgttcctactcctccccatcagggcacagggtaggctaggcctactaaaatgagaaacaaactctcttgacaacctttccggcattatagcttcaggtaataatttgtccaactgctgggtgtgctaccatcatccccaggctcagaggggctgcctcttgcactccctaaaagctcaactaccaacttcacaaaagaggtatggaaacctaaaataacctctgcacctcttatggtggacctaagtgtctccctttcctttgaatgtataaacctcattgggctgctaaatgctttggtcaccaaaaagggtggaaaaaagagaagttggactgcctactttgaaatcccaccgggttttctcttagcagtaaagaaaaaccctaatcaaacttgggctcaggaaggctatcttttcccccatgccaaaacagtcatacctctctccacagcttagctgctcacctgaactcctctcgccttgtgtaagtttgtgcacccatggggtattctgttcctttgtggacacccagactgccatctgatcaacagctacccttcagccaatttcacctttctgttacttgcactagcgtgcccttgtgtggataatgtacaacgcaataaggaatgcatgttaggtactttaagtcccagtagaataccagttcataatatcacacatgtggtgaaatctaaaaaggcaatagggctaattttggcaggagttggaatagccccttgggatggctttgcatactgtcagacagctttgagaaactttcaaacccttgaaacactggcaactagtacaggcagagccataaaaggacatcaagcctccctgcactccctagccaatgctgtcttggataacagatttgccctggaatatcttctggctgaacaagggcgggtatgcacagtaataaaccacatctgttgttcttacattaacagttcaggattggctaaactgcaagttcaaaagatttaccaagaccaggcacaatggttcatgcctgtaatcccagcactttgggaggccaaggtgggtggatcgtttgagcctaagagtttgagaccagcctgggcaacatggctaaaccccatctctacaaaattacaaaaaaagaaaaaaaaattaggtggccttggtggcatgtgcctttattcccagctactcaggaggctgaggtgggaggattgcctgagcccagaaggttgaggctgcagtaagccatgatggcaccactgcactcctacctggatgacagagtgagaccctgtctccaaaagaaaataaaagtaaagattcaccaagaggctacctggctacataatcgtaatgactctactgctcaaaccatctggggctccatcagtggatacctacaaagtatgacatggtttttacctttcttcggaccctaagtggtcatttaattgctattacttttggcgtattgtgtttttaaccttttggtaaagtttgtgtctttcaggtttcaatagctccaagtcaagctaatgatggcccaagaattccaacccataacatcccaggagcaccccagtccctacaggtctttaggacagccagtgagagatttccccaccccctaaagttaggcagggacgacatccctgttcagcaggaagtcgcttcagaagatgagatcttcagccctttctccttaagaatagagggtgaaatctctcagggggaaatagagatagaacagaaatggaatggggttgcttcttcataatacttaaccatgccttctacttaaagttctaggaactggccttaggaaatctaactatgaaaccaaggttatggagtatcccacctcaggaaggaacactgaacaactgattgacagtcttcttgccgccagccagaccaccaagtggcccattaaccaagagaaccagcgcaaccagatacgctgacccgcatctcctacctctcatgtgctttgcccagcccagcctgcataccttactcatgatgtcaattcccaagtttcgctaataaaaacatctctgcaagcctcttcagggagccaacaagacagtcaaaaaaaaatataattaataa

SEQ ID NO: 43966 - DNA, 2602 bp, Homo sapiens
tgccctctcccgatgtcagttaccaggctttgctaataaaacgtctctcccggctcttccagagagccagccgcagagtctctgccgtctccccgtgcgctcaagcacaagcccccaactaaaagccttgtctggaaaatctgcttggtgccataacagattatctggtgagccaggtaggagcacaaggagtaatttccctccctgcaggggaggcttgtgagcctgcgagccggagggaggccccactgattcagcgctgccaccgcgactggcgagttttcctctagtctcgcgactggacactggtcagtagaacctggacctgctgtaaggctgaagaagaaaaagaaaccatccaagctggcactcggttttggggagttctcttcactgctcacgccggccctcttgtgtgacctgtactgttgtgctgtgtggggctgggagccaactctcttttcgtcgcctgacacctgtgcttgcaccctgcccctggtcctttaataagacaagcagacacaggggctacagtcatgggcaatgccccaggcatcttccaagactcacacctgggatgtatcatttctaaatggaaggaatccaaatcagatggtttaaagaaaaagaaactccagcctgggaaacataggaagactccacctctacaaaaaacaggaaaaatgagccgggtgtgggggtgccttcctggggtctcagctactcagaaggctaaagtgaggatcgcttaagtccaggaggttgaggctgcagtgagttgtggtaataccatagcactccaacctgggcaatggagtgagaccctgcctcaaaatcaaattttttttttaattaaaaaaaaagaaactgattttcctctgtaatacaacctgccctagtacacattagatcaagaaaaatggccatgggcagaagtggatctcctagttttaacactatcttaccgcccgacctattctgtgaatggacagagaaatggggagagatacctagctacaagcttttatgaagttatgctaggacccagagctactggattcttgtcaggtgtgtgtggcccctatttccaggttcctcctgaaggaacctgaagaagctgacctccacagcctcaggccccgagcactccctccctaccctaagcaggcctcctggggaggggagcccctgtgctgtccccaacagcgctccaatcggactccaaacaggcaccctcttttgcttccccactggcccagggctgttttcccctcagagaaatggatggaaacgggggagtgacaaggatccaagttcctttttttggtggtggatctaggactatgtaaaaaacactttggtagattttcagaggatcctggtaagtttagagatgaatttgttaaactaaatcttgccttttcattgacgtggcaggatgttatggtcactttgcagtactgatgaaaagcaacacatatttggaaaggctaaggaatatgccaatagccaggtggtcactaaagaccaatatgcagtcatctgtttagggggagatgcggtcccaggcatagtctccacgtgagtgagactatggagaaaacctagaaaaagctagaatgagccactttgtcacctgcctgactgaaggaagaaggaaatgtatagtaaaacctgtacactatgacagggtcaagaaaattacccagagaaagaaggagatcccagtagtcttcctcaatcgagtccctgaggcccttgggaaatgcacccatgcagacccagaggcagcagaggggaagcatcgcgtgccatgcattttatccttcagtcagctccggacattagaaggaaattacagaaaatttggaggccagaccccagaccctgctgttgactttggcagaggcggcttttaaggttttcaataacggacaggacacagatggcaggtaagaagaggagactgaccaagacagcacagcttctggctgccctaattcatccaccatctcagggtgaccctaggattctcaggagaccaactaatcgaagacagccaaccttggatggagccaatgtgcctactgcaggatggagggtgtcactggaagagaggctgccctgacctccttaaaacaggacagccggcaggcaaccctggccagccgccactcctcaccaagctttcagatgagattgatacacaccgcctgacagcaccctggctctgactgcagcacactccatcgtcatcacaccacggagcctcaggtcacccttgatgtggcagttctaggaactggccttaggaaatctaactatgaaaccaaggttatggagtatcccacctcaggaaggaacactgaacaactgattgacagtcttcttgccgccagccagaccaccaagtggcccattaaccaagagaaccagcgcaaccagatacgctgacccgcatctcctacctctcatgtgctttgcccagcccagcctgcataccttactcatgatgtcaattcccaagtttcgctaataaaaacatctctgcaagcctcttcagggagccaacaagacagtcaaaaaaaaatataattaataa

SEQ ID NO: 43967 - DNA, 603 bp, Homo sapiens
tgtggcgatctagagctccccctcggcaggttgactaggagaccaactaatcgaagacagccaaccttggatggagccaatgtgcctactgcaggatggagggtgtcactggaagagaggctgccctgacctccttaaaacaggacagccggcaggcaaccctggccagccgccactcctcaccaagctttcagatgagattgatacacaccgcctgacagcaccctggctctgactgcagcacactccatcgtcatcacaccacggagcctcaggtcacccttgatgtggcagttctaggaactggccttaggaaatctaactatgaaaccaaggttatggagtatcccacctcaggaaggaacactgaacaactgattgacagtcttcttgccgccagccagaccaccaagtggcccattaaccaagagaaccagcgcaaccagatacgctgacccgcatctcctacctctcatgtgctttgcccagcccagcctgcataccttactcatgatgtcaattcccaagtttcgctaataaaaacatctctgcaagcctcttcagggagccaacaagacagtcaaaaaaaaatataattaataa

SEQ ID NO: 43968 - DNA, 7440 bp, Homo sapiens
ggtacccacaggcaggttgtactgggatgtatcatttctaaatggaaggaatccaaatcagatggtttaaagaaaaagaaactccagcctgggaaacataggaagactccacctctacaaaaaacaggaaaaatgagccgggtgtgggggtgccttcctggggtctcagctactcagaaggctaaagtgaggatcgcttaagtccaggaggttgaggctgcagtgagttgtggtaataccatagcactccaacctgggcaatggagtgagaccctgcctcaaaatcaaattttttttttaattaaaaaaaaagaaactgattttcctctgtaatacaacctgccctagtacacattagatcaagaaaaatggccatgggcagaagtggatctcctagttttaacactatcttaccgcccgacctattctgtgaatggacagagaaatggggagagatacctagctacaagcttttatgaagttatgctaggacccagagctactggattcttgtcaggtgtgtgtggcccctatttccaggttcctcctgaaggaacctgaagaagctgacctccacagcctcaggccccgagcactccctccctaccctaagcaggcctcctggggaggggagcccctgtgctgtccccaacagcgctccaatcggactccaaacaggcaccctcttttgcttccccactggcccagggctgttttcccctcagagaaatggatggaaacgggggagtgacaaggatccaagttcctttttttggtggtggatctaggactatgtaaaaaacactttggtagattttcagaggatcctggtaagtttagagatgaatttgttaaactaaatcttgccttttcattgacgtggcaggatgttatggtcactttgcagtactgatgaaaagcaacacatatttggaaaggctaaggaatatgccaatagccaggtggtcactaaagaccaatatgcagtcatctgtttagggggagatgcggtcccaggcatagtctccacgtgagtgagactatggagaaaacctagaaaaagctagaatgagccactttgtcacctgcctgactgaaggaagaaggaaatgtatagtaaaacctgtacactatgacagggtcaagaaaattacccagagaaagaaggagatcccagtagtcttcctcaatcgagtccctgaggcccttgggaaatgcacccatgcagacccagaggcagcagaggggaagcatcgcgtgccatgcattttatccttcagtcagctccggacattagaaggaaattacagaaaatttggaggccagaccccagaccctgctgttgactttggcagaggcggcttttaaggttttcaataacggacaggacacagatggcaggtaagaagaggagactgaccaagacagcacagcttctggctgccctaattcatccaccatctcagggtgaccctaggattctcaggagaccaactaatcgaagacagccaaccttggatggagccaatgtgcctactgcaggatggagggtgtcactggaagagaggctgccctgacctccttaaaacaggacagccggcaggcaaccctggccagccgccactcctcaccaagctttcagatgagattgatacacaccgcctgacagcaccctggctctgactgcagcacactccatcgtcatcacaccacggagcctcaggtcacccttgatgtggcaggtaggaaaacagttcctcgtggacagcagagctgcctgctcggtcctgacccagcctatttgcctcctctccaattgcaattgcagggtaatgggaatagacaggtgtcctaaggtaagaaaatttactttccctcttgcttgtgaggccatgtctaggcttttttctcctcatttctgtatgccccccggaatgtcctactccattgctgggtagagacttattaagcaaaatgggagccaccatctccctggaagaggacagactgcaggtagaggcagagccagaacagggaatccacctgctagcactcttaaatggacaggaacttgagacccaaaacatacccaaagaaagcaaggatcacatcaccccttccctatcggacacttcagtcctaggacaggctaataaagttccgccagtaaagacagacctgaagcctgggatgggctatccatggaggaaatcatacctcctaaaacctgtggcactgaatggggttcagccattactccacaaattcctatagcaagggctaaaccctgccagtccccaggcaacacctcggtcctccctgttaaaaagcctaatggagaatatcagtttgtgtaggacttgaagggggttaatgaggcagtcattcccatccacccaacactggtcccaagcttgtctgtgctcagatacctggagatgctcagtttttcactctactacacttcaaggatgctttcttttgtgtagccctctccacccagaatccctgtatctttttgctttgaatggagaaatctctgatacccagaaagccacatagtacacatggactgtgcttccccagggcttctgggaaggcccccacctttttgggaatgcagggagctaagcctacagaatgggacttttattacaatatgtggatgacttgttcattgtcagccaaacatggcaggattcagattttaatatcattaaaaccttgaatttcctggctgagcggtgatacaaggtcagccccatccaaggcccagatttctttacagaagttccgatatctggggttcattctgaccccaggagcccgaacactagttgtggactggaaaaagcaatcacttcattgctggtcccacaaacaaaaaggcagccccagggtttcttgggaatggtgggcttctgtagtatttggattccaaattatggcctgacggctaaacccctatgtgagacccaaaagggggaagaaagagagcccttgtactgggagaagaaatgtcaacaatcttttgaacctctaaaaactgagctgggtcaagcccttgtccttggactccctgagaaaaaccacttaccttgtatgtttgtgagagactaggaatagctttgggagtcttaactcaaaggttaggacctgttcagaagccagtggctcatttttcgaaacagacaaatccagttgcacagaagcggcctggctgctggagggcagtggcagccactgccctgctgtttagtgaagcatctaagctgacacagggacaatatacagaagctatgactccccaccaggttcagactgggttagaagtcaagggacaccattggctcactgcagggaggctgaccaactaccaagctctcttattagacaccctggatattactttaagggtatgtcagactttgaacacagcaacctcactcccaaccacagatgatgaggactcacagcatcaatgcacagggcccacaaaacagactccagcaggcctagcttgtgagataagcctcttgagaatgcaaagacggaatgatatcctgatggcagtagctttgtggagggagacccaaaaggcaggacatgcagtagtaagcctgaaggagactacagaaactaaagcccttcctccccaaaatggcacaaaaagcagcactagaggccttaacagagcctcacaactgggagaaagggagggagtaaatttatacaccaactcaaagtataggtttctcctgctgtgtgcccatgcagccatatggaaggaaaagggaatgttaacagttaaaaattccccaggcaaacgtaaggatccaatccaacttctcctggaagcggcacaacttccctgccaggtggcagtcattcactgcaaaggccaccagagggactggtccctcatcagccaaggaaatagggccacaaaacaggcaacctggttataggaatccagcaatgtgttggccttaatgacagaccctaccaaccttcctaatcacctacaatactcacaacaagagcaagaggaagctaaggggcaggggtaccaggaaaacagtgctggatggttcacagatggtgacaagttttattccaggaactgaccagttgaaagttactaagcatctccatgatgccactcattaatggagagatgttttatggaattctgtccataaaatattcaccagaaagaaactaagaaaaagtgtaaaacaagtaacctttgtcagtgaattgtgttcccgaaataatccccacacccatccaattcccccttcttgacttaaactggttcaacacaggggaacttatctgggagaagactggcaggttgttttaacccaaatgactccaaatctagggtacaaatatctcctggtgtttgtggatacttttactggacgggtcaagggtttccctacctgtacagaaaaagcagtagaagtctgtaaaccttcactaaaggaagtaatttctcaatttggactccccaagtcccctcagagtggtaacaggctctccttcatgggtaagattactcagagcctctccacaaccttaggaatagattatgaactggcaccccaatcatcagggaaagttaagatgaaccatacacttgagacgactctagccaaactctttcaggagatgcacgagtcctgggttaagatgctcccagtcttctcagggtccgcagggccccttcgtgcagcctaagacttagttcttctcagatgatctaccagaggcctttcctcaccactgacctcctgttaggtgaagaattacataaaaaattacagtatcgatttaggacagattcaaaaggtgacttcagaatatggaaacaaaatcctgccagtccccactaaggatgggaaaacccctttacaagttaatccaggggaccaagtcctcctaaaggcttgaagggcaggctccccggaggaccaccccttgcttaaatgggagggcccttactgggtgatcctgaccactccaactgcagccaactcacaaggaatcactagctgggtacacctctcccgatcagaaatgctttctcctaaatgtttccagactcgcccagatggcccattttactcctgaaaacctgtggaagacctcaaattcaggagagccaattcatcatcggagaagtaatgtggttagagatcttgagtccaatacttttccttgtattactaattggtttactattattctgttgctttgctcagcctcctccctcaggtaaagacttcgtttgtccctgctgggtataaagatgctactctttactttgttcctactcctccccatcagggcacagggtaggctaggcctactaaaatgagaaacaaactctcttgacaacctttccggcattatagcttcaggtaataatttgtccaactgctgggtgtgctaccatcatccccaggctcagaggggctgcctcttgcactccctaaaagctcaactaccaacttcacaaaagaggtatggaaacctaaaataacctctgcacctcttatggtggacctaagtgtctccctttcctttgaatgtataaacctcattgggctgctaaatgctttggtcaccaaaaagggtggaaaaaagagaagttggactgcctactttgaaatcccaccgggttttctcttagcagtaaagaaaaaccctaatcaaacttgggctcaggaaggctatcttttcccccatgccaaaacagtcatacctctctccacagcttagctgctcacctgaactcctctcgccttgtgtaagtttgtgcacccatggggtattctgttcctttgtggacacccagactgccatctgatcaacagctacccttcagccaatttcacctttctgttacttgcactagcgtgcccttgtgtggataatgtacaacgcaataaggaatgcatgttaggtactttaagtcccagtagaataccagttcataatatcacacatgtggtgaaatctaaaaaggcaatagggctaattttggcaggagttggaatagccccttgggatggctttgcatactgtcagacagctttgagaaactttcaaacccttgaaacactggcaactagtacaggcagagccataaaaggacatcaagcctccctgcactccctagccaatgctgtcttggataacagatttgccctggaatatcttctggctgaacaagggcgggtatgcacagtaataaaccacatctgttgttcttacattaacagttcaggattggctaaactgcaagttcaaaagatttaccaagaccaggcacaatggttcatgcctgtaatcccagcactttgggaggccaaggtgggtggatcgtttgagcctaagagtttgagaccagcctgggcaacatggctaaaccccatctctacaaaattacaaaaaaagaaaaaaaaattaggtggccttggtggcatgtgcctttattcccagctactcaggaggctgaggtgggaggattgcctgagcccagaaggttgaggctgcagtaagccatgatggcaccactgcactcctacctggatgacagagtgagaccctgtctccaaaagaaaataaaagtaaagattcaccaagaggctacctggctacataatcgtaatgactctactgctcaaaccatctggggctccatcagtggatacctacaaagtatgacatggtttttacctttcttcggaccctaagtggtcatttaattgctattacttttggcgtattgtgtttttaaccttttggtaaagtttgtgtctttcaggtttcaatagctccaagtcaagctaatgatggcccaagaattccaacccataacatcccaggagcaccccagtccctacaggtctttaggacagccagtgagagatttccccaccccctaaagttaggcagggacgacatccctgttcagcaggaagtcgcttcagaagatgagatcttcagccctttctccttaagaatagagggtgaaatctctcagggggaaatagagatagaacagaaatggaatggggttgcttcttcataatacttaaccatgccttctacttaaagttctaggaactggccttaggaaatctaactatgaaaccaaggttatggagtatcccacctcaggaaggaacactgaacaactgattgacagtcttcttgccgccagccagaccaccaagtggcccattaaccaagagaaccagcgcaaccagatacgctgacccgcatctcctacctctcatgtgctttgcccagcccagcctgcataccttactcatgatgtcaattcccaagtttcgctaataaaaacatctctgcaagcctcttcagggagccaacaagacagtcaaaaaaaaatataattaataa

SEQ ID NO: 43969 - DNA, 5715 bp, Homo sapiens
tgccctctcccgatgtcagttaccaggctttgctaataaaacgtctctcccggctcttccagagagccagccgcagagtctctgccgtctccccgtgcgctcaagcacaagcccccaactaaaagccttgtctggaaaatctgcttggtgccataacagattatctggtgagccaggtaggagcacaaggagtaatttccctccctgcaggggaggcttgtgagcctgcgagccggagggaggccccactgattcagcgctgccaccgcgactggcgagttttcctctagtctcgcgactggacactggtcagtagaacctggacctgctgtaaggctgaagaagaaaaagaaaccatccaagctggcactcggttttggggagttctcttcactgctcacgccggccctcttgtgtgacctgtactgttgtgctgtgtggggctgggagccaactctcttttcgtcgcctgacacctgtgcttgcaccctgcccctggtcctttaataagacaagcagacacaggggctacagtcatgggcaatgccccaggcatcttccaagactcacacctgggatgtatcatttctaaatggaaggaatccaaatcagatggtttaaagaaaaagaaactccagcctgggaaacataggaagactccacctctacaaaaaacaggaaaaatgagccgggtgtgggggtgccttcctggggtctcagctactcagaaggctaaagtgaggatcgcttaagtccaggaggttgaggctgcagtgagttgtggtaataccatagcactccaacctgggcaatggagtgagaccctgcctcaaaatcaaattttttttttaattaaaaaaaaagaaactgattttcctctgtaatacaacctgccctagtacacattagatcaagaaaaatggccatgggcagaagtggatctcctagttttaacactatcttaccgcccgacctattctgtgaatggacagagaaatggggagagatacctagctacaagcttttatgaagttatgctaggacccagagctactggattcttgtcaggtgtgtgtggcccctatttccaggttcctcctgaaggaacctgaagaagctgacctccacagcctcaggccccgagcactccctccctaccctaagcaggcctcctggggaggggagcccctgtgctgtccccaacagcgctccaatcggactccaaacaggcaccctcttttgcttccccactggcccagggctgttttcccctcagagaaatggatggaaacgggggagtgacaaggatccaagttcctttttttggtggtggatctaggactatgtaaaaaacactttggtagattttcagaggatcctggtaagtttagagatgaatttgttaaactaaatcttgccttttcattgacgtggcaggatgttatggtcactttgcagtactgatgaaaagcaacacatatttggaaaggctaaggaatatgccaatagccaggtggtcactaaagaccaatatgcagtcatctgtttagggggagatgcggtcccaggcatagtctccacgtgagtgagactatggagaaaacctagaaaaagctagaatgagccactttgtcacctgcctgactgaaggaagaaggaaatgtatagtaaaacctgtacactatgacagggtcaagaaaattacccagagaaagaaggagatcccagtagtcttcctcaatcgagtccctgaggcccttgggaaatgcacccatgcagacccagaggcagcagaggggaagcatcgcgtgccatgcattttatccttcagtcagctccggacattagaaggaaattacagaaaatttggaggccagaccccagaccctgctgttgactttggcagaggcggcttttaaggttttcaataacggacaggacacagatggcaggtaagaagaggagactgaccaagacagcacagcttctggctgccctaattcatccaccatctcagggtgaccctaggattctcaggagaccaactaatcgaagacagccaaccttggatggagccaatgtgcctactgcaggatggagggtgtcactggaagagaggctgccctgacctccttaaaacaggacagccggcaggcaaccctggccagccgccactcctcaccaagctttcagatgagattgatacacaccgcctgacagcaccctggctctgactgcagcacactccatcgtcatcacaccacggagcctcaggtcacccttgatgtggcaggtaggaaaacagttcctcgtggacagcagagctgcctgctcggtcctgacccagcctatttgcctcctctccaattgcaattgcagggtaatgggaatagacaggtgtcctaaggtaagaaaatttactttccctcttgcttgtgaggccatgtctaggcttttttctcctcatttctgtatgccccccggaatgtcctactccattgctgggtagagacttattaagcaaaatgggagccaccatctccctggaagaggacagactgcaggtagaggcagagccagaacagggaatccacctgctagcactcttaaatggacaggaacttgagacccaaaacatacccaaagaaagcaaggatcacatcaccccttccctatcggacacttcagtcctaggacaggctaataaagttccgccagtaaagacagacctgaagcctgggatgggctatccatggaggaaatcatacctcctaaaacctgtggcactgaatggggttcagccattactccacaaattcctatagcaagggctaaaccctgccagtccccaggcaacacctcggtcctccctgttaaaaagcctaatggagaatatcagtttgtgtaggacttgaagggggttaatgaggcagtcattcccatccacccaacactggtcccaagcttgtctgtgctcagatacctggagatgctcagtttttcactctactacacttcaaggatgctttcttttgtgtagccctctccacccagaatccctgtatctttttgctttgaatggagaaatctctgatacccagaaagccacatagtacacatggactgtgcttccccagggcttctgggaaggcccccacctttttgggaatgcagggagctaagcctacagaatgggacttttattacaatatgtggatgacttgttcattgtcagccaaacatggcaggattcagattttaatatcattaaaaccttgaatttcctggctgagcggtgatacaaggtcagccccatccaaggcccagatttctttacagaagttccgatatctggggttcattctgaccccaggagcccgaacactagttgtggactggaaaaagcaatcacttcattgctggtcccacaaacaaaaaggcagccccagggtttcttgggaatggtgggcttctgtagtatttggattccaaattatggcctgacggctaaacccctatgtgagacccaaaagggggaagaaagagagcccttgtactgggagaagaaatgtcaacaatcttttgaacctctaaaaactgagctgggtcaagcccttgtccttggactccctgagaaaaaccacttaccttgtatgtttgtgagagactaggaatagctttgggagtcttaactcaaaggttaggacctgttcagaagccagtggctcatttttcgaaacagacaaatccagttgcacagaagcggcctggctgctggagggcagtggcagccactgccctgctgtttagtgaagcatctaagctgacacagggacaatatacagaagctatgactccccaccaggttcagactgggttagaagtcaagggacaccattggctcactgcagggaggctgaccaactaccaagctctcttattagacaccctggatattactttaagggtatgtcagactttgaacacagcaacctcactcccaaccacagatgatgaggactcacagcatcaatgcacagggcccacaaaacagactccagcaggcctagcttgtgagataagcctcttgagaatgcaaagacggaatgatatcctgatggcagtagctttgtggagggagacccaaaaggcaggacatgcagtagtaagcctgaaggagactacagaaactaaagcccttcctccccaaaatggcacaaaaagcagcactagaggccttaacagagcctcacaactgggagaaagggagggagtaaatttatacaccaactcaaagtataggtttctcctgctgtgtgcccatgcagccatatggaaggaaaagggaatgttaacagttaaaaattccccaggcaaacgtaaggatccaatccaacttctcctggaagcggcacaacttccctgccaggtggcagtcattcactgcaaaggccaccagagggactggtccctcatcagccaaggaaatagggccacaaaacaggcaacctggttataggaatccagcaatgtgttggccttaatgacagaccctaccaaccttcctaatcacctacaatactcacaacaagagcaagaggaagctaaggggcaggggtaccaggaaaacagtgctggatggttcacagatggtgacaagttttattccaggaactgaccagttgaaagttactaagcatctccatgatgccactcattaatggagagatgttttatggaattctgtccataaaatattcaccagaaagaaactaagaaaaagtgtaaaacaagtaacctttgtcagtgaattgtgttcccgaaataatccccacacccatccaattcccccttcttgacttaaactggttcaacacaggggaacttatctgggagaagactggcaggttgttttaacccaaatgactccaaatctagggtacaaatatctcctggtgtttgtggatacttttactggacgggtcaagggtttccctacctgtacagaaaaagcagtagaagtctgtaaaccttcactaaaggaagtaatttctcaatttggactccccaagtcccctcagagtggtaacaggctctccttcatgggtaagattactcagagcctctccacaaccttaggaatagattatgaactggcaccccaatcatcagggaaagttaagatgaaccatacacttgagacgactctagccaaactctttcaggagatgcacgagtcctgggttaagatgctcccagtcttctcagggtccgcagggccccttcgtgcagcctaagacttagttcttctcagatgatctaccagaggcctttcctcaccactgacctcctgttaggtgaagaattacataaaaaattacagtatcgatttaggacagattcaaaaggtgacttcagaatatggaaacaaaatcctgccagtccccactaaggatgggaaaacccctttacaagttaatccaggggaccaagtcctcctaaaggcttgaagggcaggctccccggaggaccaccccttgcttaaatgggagggcccttactgggtgatcctgaccactccaactgcagccaactcacaaggaatcactagctgggtacacctctcccgatcagaaatgctttctcctaaatgtttccagactcgcccagagccaggcctaagttcagagccaggcctaagttcagagcaggggg

SEQ ID NO: 43970 - DNA, 1507 bp, Homo sapiens
cacgggacgagaggatgctgacagtgcctcacagccgcacaggacgcgaggatgctgacagtgcctcacagccgcacaggacgcgaggatgctgacagtgcctcacagccgcacaggacgcgaggatgctgacagtgcctcacagccacacaggacgcaaggatgctgacggtgcctcacagctgatgagctgctgctccgagcttctggagtgcccgtgttcccctgaccaccttccctgccacacctccccacaatccaataaccagagttaactcccagcaagcagggccttctaacctaggctacaacattgacttctacctacatttcctgatgctctttaggagaatgtgatcccacacactaaatatatggttgttttgccaccttttaatttgtgcctttaagaaaagatcatttggttagttggttacaaagaggggtttccaattatattttgataatgccccacaagttatgaaggtaacttctactgaatatatatatttaaattttgcatttttctactgagcaccaacgatttattggaattgatttcaattaggaatttagggatatataagaaccaattacagttgtccatacttatctttgatgtgggacaattaagaagttacaaaaaatgggtgttggtgatattttatcatggttatttagcttaaaatacacgtgtaaaggcaggtgtcttccatttttctcctttgccttttagctgctgttttcctgcctctgacatgttggctgctcagaaactgctctctgggcagtgattggggaacagggtattcaagttcactaaaggctcaattttccattgatagaatatcagtgtccacagaattaagactgcaagcacagcaaagacacccatattgaatgttcccttaaattgcttttatttggagacaattctgaacatgaagtgttatagagggcccaggaaactaagttgagcccacctgaccctgtgatgaatcttggaacttccgtctcttgaatacattcttagtagtagcttcttggcattttcaaaaaaggaaaaaaaaaatatggcatagacagcttattactgtgattctttgagttttctcaggtgagttttttgataaaatatttgtgaagtggcctcatggtttcatttgatgattcactcttatcctttccttatcttgaataaaatcccattcattttctttttaaaacttcagcttctgtaaaggtttccagatcctgatgtggatgttaatgttcatgtgcaggaaaacaatgaaggcatagcacctctagaaacttcagaaggcagtggtacctgctgtgtcccaacagtatgctgattctcttctctgcagcattgtgggtgtacatacactaaaggacagaagctcctcatatgcctgggcacgtgcctccataaagctgctgtggggaaaggaagccactgacaataaagacaacttaagctgatgaaaatcagcacacagct

SEQ ID NO: 43971 - DNA, 360 bp, Homo sapiens
cctctcttagcttattggtcccagataattctcccaagtgcttggcttttggtttctgttttcactcttggcttaaataacaaaggttaactctaagctgcattggtgttcctcaaaaccattatgcctttgagttttagggtggactccccacttcaggtttgttctctaaagcaagctggacaaggtgggagctcccctcccctcatggttagcatgctgcttcctttggcgtaagtgcttgtgttggttggcgcattaggattggctttggctgacacctctgccaaaaccccaagttctgccaggcctgtgggaacggagggcagataaaggtaggaggcataagcttcctgctag

SEQ ID NO: 43972 - DNA, 4315 bp, Homo sapiens
  misc_feature (3824)..(3824): n is a, c, g, or t
cccttaataagatttgccacgtacactcgagccatcgcgagtgtccttgagccgcgggtgacggtggctctcgctgctcgcgccccctcctcccgcggggggagcctgatgccacgttccctatgaattatttatcgccggcctaaaaataccccgaacttcacagcccgagtgaccctccggtggacatgggtggggccctggggccggccctgttgctcacctcgctcttcggtgcctgggcagggctgggtccggggcagggcgagcagggcatgacggtggccgtggtgtttagcagctcagggccgccccaggcccagttccgtgcccgcctcaccccccagagcttcctggacctacccctggagatccagccgctcacagttggggtcaacaccaccaaccccagcagcctcctcacccagatctgcggcctcctgggtgctgcccacgtccacggcattgtctttgaggacaacgtggacaccgaggcggtggcccagatccttgacttcatctcctcccagacccatgtgcccatcctcagcatcagcggaggctctgctgtggtcctcacccccaaggagccgggctccgccttcctgcagctgggcgtgtccctggagcagcagctgcaggtgctgttcaaggtgctggaagagtacgactggagcgccttcgccgtcatcaccagcctgcacccgggccacgcgctcttcctggagggcgtgcgcgccgtcgccgacgccagccacgtgagttggcggctgctggacgtggtcacgctggagctgggcccgggagggccgcgcgcgcgcacgcagcgcctgctgcgccagctcgacgcgcccgtgtttgtggcctactgctcgcgcgaggaggccgaggtgctcttcgccgaggcggcgcaggccggtctggtggggcccggccacgtgtggctggtgcccaacctggcgctgggcagcaccgatgcgccccccgccaccttccccgtgggcctcatcagcgtcgtcaccgagagctggcgcctcagcctgcgccagaaggtgcgcgacggcgtggccattctggccctgggcgcccacagctactggcgccagcatggaaccctgccagccccggccggggactgccgtgttcaccctgggcccgtcagccctgcccgggaggccttctacaggcacctactgaatgtcacctgggagggccgagacttctccttcagccctggtgggtacctggtccagcccaccatggtggtgatcgccctcaaccggcaccgcctctgggagatggtggggcgctgggagcatggcgtcctatacatgaagtaccccgtgtggcctcgctacagtgcctctctgcagcctgtggtggacagtcggcacctgacggtggccacgctggaagagcggccctttgtcatcgtggagagccctgaccctggcacaggaggctgtgtccccaacaccgtgccctgccgcaggcagagcaaccacaccttcagcagcggggacgtggccccctacaccaagctctgctgtaagggattctgcatcgacatcctcaagaagctggccagagtggtcaaattctcctacgacctgtacctggtgaccaacggcaagcatggcaagcgggtgcgcggcgtatggaacggcatgattggggaggtgtactacaagcgggcagacatggccatcggctccctcaccatcaatgaggaacgctccgagatcgtagacttctctgtaccctttgtggagacgggcatcagtgtgatggtggctcgcagcaatggcaccgtctccccctcggccttcttggagccatatagccctgcagtgtgggtgatgatgtttgtcatgtgcctcactgtggtggccatcaccgtcttcatgttcgagtacttcagccctgtcagctacaaccagaacctcaccagaggcaagaagtccgggggcccagctttcactatcggcaagtccgtgtggctgctgtgggcgctggtcttcaacaactcagtgcccatcgagaacccgcggggcaccaccagcaagatcatggttctggtctgggccttctttgctgtcatcttcctcgccagctacacggccaacctggccgccttcatgatccaagagcaatacatcgacactgtgtcgggcctcagtgacaagaagtttcagcggcctcaagatcagtacccacctttccgcttcggcacggtgcccaacggcagcacggagcggaacatccgcagtaactaccgtgacatgcacacccacatggtcaagttcaaccagcgctcggtggaggacgcgctcaccagcctcaagatggggaagctggatgccttcatctatgatgctgctgtcctcaactacatggcaggcaaggacgagggctgcaagctggtcaccattgggtctggcaaggtctttgctaccactggctacggcatcgccatgcagaaggactcccactggaagcgggccatagacctggcgctcttgcagttcctgggggacggagagacacagaaactggagacagtgtggctctcagggatctgccagaatgagaagaacgaggtgatgagcagcaagctggacatcgacaacatggcaggcgtcttctacatgctgctggtggccatggggctggccctgctggtcttcgcctgggagcacctggtctactggaagctgcgccactcggtgcccaactcatcccagctggacttcctgctggctttcagcaggggcatctacagctgcttcagcggggtgcagagcctcgccagcccaccgcggcaggccagcccggacctcacggccagctcggcccaggccagcgtgctcaagatgctgcaggcagcccgcgacatggtgaccacggcgggcgtaagcagctccctggaccgcgccactcgcaccatcgagaattggggtggcggccgccgtgcgcccccaccgtccccctgcccgaccccgcggtctggccccagcccatgcctgcccacccccgacccgcccccagagccgagccccacgggctggggaccgccagacgggggtcgcgcggcgcttgtgcgcagggctccgcagcccccgggccgccccccgacgccggggccgcccctgtccgacgtctcccgagtgtcgcgccgcccagcctgggaggcgcggtggccggtgcggaccgggcactgcgggaggcacctctcggcctccgagcggcccctgtcgcccgcgcgctgtcactacagctcctttcctcgagccgaccgatccggccgccccttcctcccgctcttcccggagcccccggagctggaggacctgccgctgctcggtccggagcagctggcccggcgggaggccctgctgcacgcggcctgggcccggggctcgcgcccgcgtcacgcttccctgcccagctccgtggccgaggccttcgctcggcccagctcgctgcccgctgggtgcaccggccccgcctgcgcccgccccgacggccactcggcctgcaggcgcttggcgcaggcgcagtcgatgtgcttgccgatctaccgggaggcctgccaggagggcgagcaggcaggggcccccgcctggcagcacagacagcacgtctgcctgcacgcccacgcccacctgccattttgctggggggctgtctgtcctcaccttccaccctgtgccagccacggctcctggctctccggggcctgggggcctctggggcacaggggcaggactctggggctgggcacaggctacagagacagtgggggactggacgagatcagcagngtagcccgtgggacgcaaggcttcccgggaccctgcacctggagacggatctccagtctggagtcagaagtgtgagttatcagccactcaggctccgagccagctggattctctgcctgccactgtcagggttaagcggcaggcaggattgggcttttctggcttctaccatgaaatcctggccatgggaccccagtgacagatgatgtcttccatggtcatcagtgacctcagtagcctcaaatcatggtgagggctgggcttttgctgtcctcttctcacgcagagttctgccaggagggtgtgctgtgggggtcagactcctgaggctctcccttccctggggctagccagttactggtcatggctgctgtgggcatggaggctggaacttgtggttgaggcagggccatcccgatccttgctctacctggctagagtttcttctcatcagagcactgggacattaaaccaaccttttacaacacact

SEQ ID NO: 43973 - DNA, 911 bp, Homo sapiens
agcgggcgagtcccgcttcttccccttccagctctgccccatctcctttgccccagcctagctctctccttcctgcgacctgggagaatcggagtgggcttccagagtagtggcatcttgcagatgctggcccgtgcccggctcccgggcttccagagcgcaaagggaagggtaggcagagagggcactgggcgagcaagacctggcgctgggccctggctgcgcaccagccgcctgcgccggtctctgtgggcttcgcccaggatccccgacggcggggaggggaagccccgagtctcctgtttcctgcctacgcgggcagggcggggacacgcggagcaaaggcacccggcaacctgaacccccaggtgcgtcccgcgaccctgcaaggagctgctgggaccctccggtggacatgggtggggccctggggccggccctgttgctcacctcgctcttcggtgcctgggcagggctgggtccggggcagggcgagcagggcatgacggtggccgtggtgtttagcagctcagggccgccccaggcccagttccgtgcccgcctcaccccccagagcttcctggacctacccctggagatccagccgctcacagttggggtcaacaccaccaaccccagcagcctcctcacccagatctgcggcctcctgggtgctgcccacgtccacggcattgtctttgaggacaacgtggacaccgaggcggtggcccagatccttgacttcatctcctcccagacccatgtgcccatcctcagcatcagcggaggctctgctgtggtcctcacccccaaggagcgtccaaactcatgtcccctcgtgcctcaggcctggaaccaggctggggtcgggggtgctttggttctgggaagctgggattagacgggatggg

SEQ ID NO: 43974 - DNA, 4542 bp, Homo sapiens
  misc_feature (4051)..(4051): n is a, c, g, or t
agcgggcgagtcccgcttcttccccttccagctctgccccatctcctttgccccagcctagctctctccttcctgcgacctgggagaatcggagtgggcttccagagtagtggcatcttgcagatgctggcccgtgcccggctcccgggcttccagagcgcaaagggaagggtaggcagagagggcactgggcgagcaagacctggcgctgggccctggctgcgcaccagccgcctgcgccggtctctgtgggcttcgcccaggatccccgacggcggggaggggaagccccgagtctcctgtttcctgcctacgcgggcagggcggggacacgcggagcaaaggcacccggcaacctgaacccccaggtgcgtcccgcgaccctgcaaggagctgctgggaccctccggtggacatgggtggggccctggggccggccctgttgctcacctcgctcttcggtgcctgggcagggctgggtccggggcagggcgagcagggcatgacggtggccgtggtgtttagcagctcagggccgccccaggcccagttccgtgcccgcctcaccccccagagcttcctggacctacccctggagatccagccgctcacagttggggtcaacaccaccaaccccagcagcctcctcacccagatctgcggcctcctgggtgctgcccacgtccacggcattgtctttgaggacaacgtggacaccgaggcggtggcccagatccttgacttcatctcctcccagacccatgtgcccatcctcagcatcagcggaggctctgctgtggtcctcacccccaaggagccgggctccgccttcctgcagctgggcgtgtccctggagcagcagctgcaggtgctgttcaaggtgctggaagagtacgactggagcgccttcgccgtcatcaccagcctgcacccgggccacgcgctcttcctggagggcgtgcgcgccgtcgccgacgccagccacgtgagttggcggctgctggacgtggtcacgctggagctgggcccgggagggccgcgcgcgcgcacgcagcgcctgctgcgccagctcgacgcgcccgtgtttgtggcctactgctcgcgcgaggaggccgaggtgctcttcgccgaggcggcgcaggccggtctggtggggcccggccacgtgtggctggtgcccaacctggcgctgggcagcaccgatgcgccccccgccaccttccccgtgggcctcatcagcgtcgtcaccgagagctggcgcctcagcctgcgccagaaggtgcgcgacggcgtggccattctggccctgggcgcccacagctactggcgccagcatggaaccctgccagccccggccggggactgccgtgttcaccctgggcccgtcagccctgcccgggaggccttctacaggcacctactgaatgtcacctgggagggccgagacttctccttcagccctggtgggtacctggtccagcccaccatggtggtgatcgccctcaaccggcaccgcctctgggagatggtggggcgctgggagcatggcgtcctatacatgaagtaccccgtgtggcctcgctacagtgcctctctgcagcctgtggtggacagtcggcacctgacggtggccacgctggaagagcggccctttgtcatcgtggagagccctgaccctggcacaggaggctgtgtccccaacaccgtgccctgccgcaggcagagcaaccacaccttcagcagcggggacgtggccccctacaccaagctctgctgtaagggattctgcatcgacatcctcaagaagctggccagagtggtcaaattctcctacgacctgtacctggtgaccaacggcaagcatggcaagcgggtgcgcggcgtatggaacggcatgattggggaggtgtactacaagcgggcagacatggccatcggctccctcaccatcaatgaggaacgctccgagatcgtagacttctctgtaccctttgtggagacgggcatcagtgtgatggtggctcgcagcaatggcaccgtctccccctcggccttcttggagccatatagccctgcagtgtgggtgatgatgtttgtcatgtgcctcactgtggtggccatcaccgtcttcatgttcgagtacttcagccctgtcagctacaaccagaacctcaccagaggcaagaagtccgggggcccagctttcactatcggcaagtccgtgtggctgctgtgggcgctggtcttcaacaactcagtgcccatcgagaacccgcggggcaccaccagcaagatcatggttctggtctgggccttctttgctgtcatcttcctcgccagctacacggccaacctggccgccttcatgatccaagagcaatacatcgacactgtgtcgggcctcagtgacaagaagtttcagcggcctcaagatcagtacccacctttccgcttcggcacggtgcccaacggcagcacggagcggaacatccgcagtaactaccgtgacatgcacacccacatggtcaagttcaaccagcgctcggtggaggacgcgctcaccagcctcaagatggggaagctggatgccttcatctatgatgctgctgtcctcaactacatggcaggcaaggacgagggctgcaagctggtcaccattgggtctggcaaggtctttgctaccactggctacggcatcgccatgcagaaggactcccactggaagcgggccatagacctggcgctcttgcagttcctgggggacggagagacacagaaactggagacagtgtggctctcagggatctgccagaatgagaagaacgaggtgatgagcagcaagctggacatcgacaacatggcaggcgtcttctacatgctgctggtggccatggggctggccctgctggtcttcgcctgggagcacctggtctactggaagctgcgccactcggtgcccaactcatcccagctggacttcctgctggctttcagcaggggcatctacagctgcttcagcggggtgcagagcctcgccagcccaccgcggcaggccagcccggacctcacggccagctcggcccaggccagcgtgctcaagatgctgcaggcagcccgcgacatggtgaccacggcgggcgtaagcagctccctggaccgcgccactcgcaccatcgagaattggggtggcggccgccgtgcgcccccaccgtccccctgcccgaccccgcggtctggccccagcccatgcctgcccacccccgacccgcccccagagccgagccccacgggctggggaccgccagacgggggtcgcgcggcgcttgtgcgcagggctccgcagcccccgggccgccccccgacgccggggccgcccctgtccgacgtctcccgagtgtcgcgccgcccagcctgggaggcgcggtggccggtgcggaccgggcactgcgggaggcacctctcggcctccgagcggcccctgtcgcccgcgcgctgtcactacagctcctttcctcgagccgaccgatccggccgccccttcctcccgctcttcccggagcccccggagctggaggacctgccgctgctcggtccggagcagctggcccggcgggaggccctgctgcacgcggcctgggcccggggctcgcgcccgcgtcacgcttccctgcccagctccgtggccgaggccttcgctcggcccagctcgctgcccgctgggtgcaccggccccgcctgcgcccgccccgacggccactcggcctgcaggcgcttggcgcaggcgcagtcgatgtgcttgccgatctaccgggaggcctgccaggagggcgagcaggcaggggcccccgcctggcagcacagacagcacgtctgcctgcacgcccacgcccacctgccattttgctggggggctgtctgtcctcaccttccaccctgtgccagccacggctcctggctctccggggcctgggggcctctggggcacaggggcaggactctggggctgggcacaggctacagagacagtgggggactggacgagatcagcagngtagcccgtgggacgcaaggcttcccgggaccctgcacctggagacggatctccagtctggagtcagaagtgtgagttatcagccactcaggctccgagccagctggattctctgcctgccactgtcagggttaagcggcaggcaggattgggcttttctggcttctaccatgaaatcctggccatgggaccccagtgacagatgatgtcttccatggtcatcagtgacctcagtagcctcaaatcatggtgagggctgggcttttgctgtcctcttctcacgcagagttctgccaggagggtgtgctgtgggggtcagactcctgaggctctcccttccctggggctagccagttactggtcatggctgctgtgggcatggaggctggaacttgtggttgaggcagggccatcccgatccttgctctacctggctagagtttcttctcatcagagcactgggacattaaaccaaccttttacaacacact

SEQ ID NO: 43975 - DNA, 2668 bp, Homo sapiens
  misc_feature (2177)..(2177): n is a, c, g, or t
cttagaggaccctcgaagatggcggttggggagtgtactacaagcgggcagacatggccatcggctccctcaccatcaatgaggaacgctccgagatcgtagacttctctgtaccctttgtggagacgggcatcagtgtgatggtggctcgcagcaatggcaccgtctccccctcggccttcttggagccatatagccctgcagtgtgggtgatgatgtttgtcatgtgcctcactgtggtggccatcaccgtcttcatgttcgagtacttcagccctgtcagctacaaccagaacctcaccagaggcaagaagtccgggggcccagctttcactatcggcaagtccgtgtggctgctgtgggcgctggtcttcaacaactcagtgcccatcgagaacccgcggggcaccaccagcaagatcatggttctggtctgggccttctttgctgtcatcttcctcgccagctacacggccaacctggccgccttcatgatccaagagcaatacatcgacactgtgtcgggcctcagtgacaagaagtttcagcggcctcaagatcagtacccacctttccgcttcggcacggtgcccaacggcagcacggagcggaacatccgcagtaactaccgtgacatgcacacccacatggtcaagttcaaccagcgctcggtggaggacgcgctcaccagcctcaagatggggaagctggatgccttcatctatgatgctgctgtcctcaactacatggcaggcaaggacgagggctgcaagctggtcaccattgggtctggcaaggtctttgctaccactggctacggcatcgccatgcagaaggactcccactggaagcgggccatagacctggcgctcttgcagttcctgggggacggagagacacagaaactggagacagtgtggctctcagggatctgccagaatgagaagaacgaggtgatgagcagcaagctggacatcgacaacatggcaggcgtcttctacatgctgctggtggccatggggctggccctgctggtcttcgcctgggagcacctggtctactggaagctgcgccactcggtgcccaactcatcccagctggacttcctgctggctttcagcaggggcatctacagctgcttcagcggggtgcagagcctcgccagcccaccgcggcaggccagcccggacctcacggccagctcggcccaggccagcgtgctcaagatgctgcaggcagcccgcgacatggtgaccacggcgggcgtaagcagctccctggaccgcgccactcgcaccatcgagaattggggtggcggccgccgtgcgcccccaccgtccccctgcccgaccccgcggtctggccccagcccatgcctgcccacccccgacccgcccccagagccgagccccacgggctggggaccgccagacgggggtcgcgcggcgcttgtgcgcagggctccgcagcccccgggccgccccccgacgccggggccgcccctgtccgacgtctcccgagtgtcgcgccgcccagcctgggaggcgcggtggccggtgcggaccgggcactgcgggaggcacctctcggcctccgagcggcccctgtcgcccgcgcgctgtcactacagctcctttcctcgagccgaccgatccggccgccccttcctcccgctcttcccggagcccccggagctggaggacctgccgctgctcggtccggagcagctggcccggcgggaggccctgctgcacgcggcctgggcccggggctcgcgcccgcgtcacgcttccctgcccagctccgtggccgaggccttcgctcggcccagctcgctgcccgctgggtgcaccggccccgcctgcgcccgccccgacggccactcggcctgcaggcgcttggcgcaggcgcagtcgatgtgcttgccgatctaccgggaggcctgccaggagggcgagcaggcaggggcccccgcctggcagcacagacagcacgtctgcctgcacgcccacgcccacctgccattttgctggggggctgtctgtcctcaccttccaccctgtgccagccacggctcctggctctccggggcctgggggcctctggggcacaggggcaggactctggggctgggcacaggctacagagacagtgggggactggacgagatcagcagngtagcccgtgggacgcaaggcttcccgggaccctgcacctggagacggatctccagtctggagtcagaagtgtgagttatcagccactcaggctccgagccagctggattctctgcctgccactgtcagggttaagcggcaggcaggattgggcttttctggcttctaccatgaaatcctggccatgggaccccagtgacagatgatgtcttccatggtcatcagtgacctcagtagcctcaaatcatggtgagggctgggcttttgctgtcctcttctcacgcagagttctgccaggagggtgtgctgtgggggtcagactcctgaggctctcccttccctggggctagccagttactggtcatggctgctgtgggcatggaggctggaacttgtggttgaggcagggccatcccgatccttgctctacctggctagagtttcttctcatcagagcactgggacattaaaccaaccttttacaacacact

SEQ ID NO: 43976 - DNA, 1883 bp, Homo sapiens
  misc_feature (1392)..(1392): n is a, c, g, or t
ctaaaaaaaaaaaaaaaagccaacgtcctgagaagtggcatggctcaccagggtggcagggttgaagagggtcagagtcccccccacaggtgtgcccaggttggaaccttcatgtgccaggtgctagctagagtgattaggagaatgagtcaacctgggcgctcagaccactcattcatctgcaaagcacagtgcctggcgcatgggagatgcttcacagttagctacttcctgagacttatagaagactgatgatgccttgggaccaggcagggacaatcgtggcgggtccctcagcggagggcgctgcttacggcctgtcgtctccctactgcccagggcatctacagctgcttcagcggggtgcagagcctcgccagcccaccgcggcaggccagcccggacctcacggccagctcggcccaggccagcgtgctcaagatgctgcaggcagcccgcgacatggtgaccacggcgggcgtaagcagctccctggaccgcgccactcgcaccatcgagaattggggtggcggccgccgtgcgcccccaccgtccccctgcccgaccccgcggtctggccccagcccatgcctgcccacccccgacccgcccccagagccgagccccacgggctggggaccgccagacgggggtcgcgcggcgcttgtgcgcagggctccgcagcccccgggccgccccccgacgccggggccgcccctgtccgacgtctcccgagtgtcgcgccgcccagcctgggaggcgcggtggccggtgcggaccgggcactgcgggaggcacctctcggcctccgagcggcccctgtcgcccgcgcgctgtcactacagctcctttcctcgagccgaccgatccggccgccccttcctcccgctcttcccggagcccccggagctggaggacctgccgctgctcggtccggagcagctggcccggcgggaggccctgctgcacgcggcctgggcccggggctcgcgcccgcgtcacgcttccctgcccagctccgtggccgaggccttcgctcggcccagctcgctgcccgctgggtgcaccggccccgcctgcgcccgccccgacggccactcggcctgcaggcgcttggcgcaggcgcagtcgatgtgcttgccgatctaccgggaggcctgccaggagggcgagcaggcaggggcccccgcctggcagcacagacagcacgtctgcctgcacgcccacgcccacctgccattttgctggggggctgtctgtcctcaccttccaccctgtgccagccacggctcctggctctccggggcctgggggcctctggggcacaggggcaggactctggggctgggcacaggctacagagacagtgggggactggacgagatcagcagngtagcccgtgggacgcaaggcttcccgggaccctgcacctggagacggatctccagtctggagtcagaagtgtgagttatcagccactcaggctccgagccagctggattctctgcctgccactgtcagggttaagcggcaggcaggattgggcttttctggcttctaccatgaaatcctggccatgggaccccagtgacagatgatgtcttccatggtcatcagtgacctcagtagcctcaaatcatggtgagggctgggcttttgctgtcctcttctcacgcagagttctgccaggagggtgtgctgtgggggtcagactcctgaggctctcccttccctggggctagccagttactggtcatggctgctgtgggcatggaggctggaacttgtggttgaggcagggccatcccgatccttgctctacctggctagagtttcttctcatcagagcactgggacattaaaccaaccttttacaacacact

SEQ ID NO: 43977 - DNA, 620 bp, Homo sapiens
catttggaaaacacaggagtggcctggacagcctttaagaccttctgctctgactatgcaagtccacactggggctgggctctggggtgggtttggggctttggtgcctggaaggctggaggaagggttgtgactggctgctgccctccgcctgcagtttcagcggcctcaagatcagtacccacctttccgcttcggcacggtgcccaacggcagcacggagcggaacatccgcagtaactaccgtgacatgcacacccacatggtcaagttcaaccagcgctcggtggaggacgcgctcaccagcctcaagatggggtgggtccccagccctgcacccgctgtcttcatccgtgtgtctccccagtgaccagccttagctctcaatgtggggacagtgggactgggctgtcctgcaggactcctgtggggtggagggaagaggtcttggggcagagtggagcttgaggcaaaaatggaaggccaccatgtgtctcagaacacagctgtggtgccaatcaaagttcagcctcagcctgaggtggtggttgggaccttctctgagtcttaggagcacggagagggtgggcagaaagggtggtgtgtcttctgggaacaga

SEQ ID NO: 43978 - DNA, 345 bp, Homo sapiens
tcctgcaggactcctgtggggtggagggaagaggtcttggggcagagtggagcttgaggcaaaaatggaaggccaccatgtgtctcagaacacagctgtggtgccaatcaaagttcagcctcagcctgaggtggtggttgggaccttctctgagtcttaggagcacggagagggtgggcagaaagggtggtgtgtcttctgggaacagacagtcccctggccactctgcagaggagggtgggaggggtcctcaccccatccaggacccaagagaaccagacaagtctctgcccattggtccctcccgggggtgcccagcaggctcatgtggtttagacccctgtc

SEQ ID NO: 43979 - DNA, 3806 bp, Homo sapiens
  misc_feature (3315)..(3315): n is a, c, g, or t
cgaggctctgggacagacaccgcgagggaggcggcctggcgcgggctctcgtcgcgggcgcagcgccccttcccctcggagccgggctccgccttcctgcagctgggcgtgtccctggagcagcagctgcaggtgctgttcaaggtgctggaagagtacgactggagcgccttcgccgtcatcaccagcctgcacccgggccacgcgctcttcctggagggcgtgcgcgccgtcgccgacgccagccacgtgagttggcggctgctggacgtggtcacgctggagctgggcccgggagggccgcgcgcgcgcacgcagcgcctgctgcgccagctcgacgcgcccgtgtttgtggcctactgctcgcgcgaggaggccgaggtgctcttcgccgaggcggcgcaggccggtctggtggggcccggccacgtgtggctggtgcccaacctggcgctgggcagcaccgatgcgccccccgccaccttccccgtgggcctcatcagcgtcgtcaccgagagctggcgcctcagcctgcgccagaaggtgcgcgacggcgtggccattctggccctgggcgcccacagctactggcgccagcatggaaccctgccagccccggccggggactgccgtgttcaccctgggcccgtcagccctgcccgggaggccttctacaggcacctactgaatgtcacctgggagggccgagacttctccttcagccctggtgggtacctggtccagcccaccatggtggtgatcgccctcaaccggcaccgcctctgggagatggtggggcgctgggagcatggcgtcctatacatgaagtaccccgtgtggcctcgctacagtgcctctctgcagcctgtggtggacagtcggcacctgacggtggccacgctggaagagcggccctttgtcatcgtggagagccctgaccctggcacaggaggctgtgtccccaacaccgtgccctgccgcaggcagagcaaccacaccttcagcagcggggacgtggccccctacaccaagctctgctgtaagggattctgcatcgacatcctcaagaagctggccagagtggtcaaattctcctacgacctgtacctggtgaccaacggcaagcatggcaagcgggtgcgcggcgtatggaacggcatgattggggaggtgtactacaagcgggcagacatggccatcggctccctcaccatcaatgaggaacgctccgagatcgtagacttctctgtaccctttgtggagacgggcatcagtgtgatggtggctcgcagcaatggcaccgtctccccctcggccttcttggagccatatagccctgcagtgtgggtgatgatgtttgtcatgtgcctcactgtggtggccatcaccgtcttcatgttcgagtacttcagccctgtcagctacaaccagaacctcaccagaggcaagaagtccgggggcccagctttcactatcggcaagtccgtgtggctgctgtgggcgctggtcttcaacaactcagtgcccatcgagaacccgcggggcaccaccagcaagatcatggttctggtctgggccttctttgctgtcatcttcctcgccagctacacggccaacctggccgccttcatgatccaagagcaatacatcgacactgtgtcgggcctcagtgacaagaagtttcagcggcctcaagatcagtacccacctttccgcttcggcacggtgcccaacggcagcacggagcggaacatccgcagtaactaccgtgacatgcacacccacatggtcaagttcaaccagcgctcggtggaggacgcgctcaccagcctcaagatggggaagctggatgccttcatctatgatgctgctgtcctcaactacatggcaggcaaggacgagggctgcaagctggtcaccattgggtctggcaaggtctttgctaccactggctacggcatcgccatgcagaaggactcccactggaagcgggccatagacctggcgctcttgcagttcctgggggacggagagacacagaaactggagacagtgtggctctcagggatctgccagaatgagaagaacgaggtgatgagcagcaagctggacatcgacaacatggcaggcgtcttctacatgctgctggtggccatggggctggccctgctggtcttcgcctgggagcacctggtctactggaagctgcgccactcggtgcccaactcatcccagctggacttcctgctggctttcagcaggggcatctacagctgcttcagcggggtgcagagcctcgccagcccaccgcggcaggccagcccggacctcacggccagctcggcccaggccagcgtgctcaagatgctgcaggcagcccgcgacatggtgaccacggcgggcgtaagcagctccctggaccgcgccactcgcaccatcgagaattggggtggcggccgccgtgcgcccccaccgtccccctgcccgaccccgcggtctggccccagcccatgcctgcccacccccgacccgcccccagagccgagccccacgggctggggaccgccagacgggggtcgcgcggcgcttgtgcgcagggctccgcagcccccgggccgccccccgacgccggggccgcccctgtccgacgtctcccgagtgtcgcgccgcccagcctgggaggcgcggtggccggtgcggaccgggcactgcgggaggcacctctcggcctccgagcggcccctgtcgcccgcgcgctgtcactacagctcctttcctcgagccgaccgatccggccgccccttcctcccgctcttcccggagcccccggagctggaggacctgccgctgctcggtccggagcagctggcccggcgggaggccctgctgcacgcggcctgggcccggggctcgcgcccgcgtcacgcttccctgcccagctccgtggccgaggccttcgctcggcccagctcgctgcccgctgggtgcaccggccccgcctgcgcccgccccgacggccactcggcctgcaggcgcttggcgcaggcgcagtcgatgtgcttgccgatctaccgggaggcctgccaggagggcgagcaggcaggggcccccgcctggcagcacagacagcacgtctgcctgcacgcccacgcccacctgccattttgctggggggctgtctgtcctcaccttccaccctgtgccagccacggctcctggctctccggggcctgggggcctctggggcacaggggcaggactctggggctgggcacaggctacagagacagtgggggactggacgagatcagcagngtagcccgtgggacgcaaggcttcccgggaccctgcacctggagacggatctccagtctggagtcagaagtgtgagttatcagccactcaggctccgagccagctggattctctgcctgccactgtcagggttaagcggcaggcaggattgggcttttctggcttctaccatgaaatcctggccatgggaccccagtgacagatgatgtcttccatggtcatcagtgacctcagtagcctcaaatcatggtgagggctgggcttttgctgtcctcttctcacgcagagttctgccaggagggtgtgctgtgggggtcagactcctgaggctctcccttccctggggctagccagttactggtcatggctgctgtgggcatggaggctggaacttgtggttgaggcagggccatcccgatccttgctctacctggctagagtttcttctcatcagagcactgggacattaaaccaaccttttacaacacact

SEQ ID NO: 43980 - DNA, 3187 bp, Homo sapiens
  misc_feature (2696)..(2696): n is a, c, g, or t
cccttaataagatttgccacgtacactcgagccatcgcgagtgtccttgagccgcgggtgacggtggctctcgctgctcgcgccccctcctcccgcggggggagcctgatgccacgttccctatgaattatttatcgccggcctaaaaataccccgaacttcacagcccgagtgtggggcgctgggagcatggcgtcctatacatgaagtaccccgtgtggcctcgctacagtgcctctctgcagcctgtggtggacagtcggcacctgacggtggccacgctggaagagcggccctttgtcatcgtggagagccctgaccctggcacaggaggctgtgtccccaacaccgtgccctgccgcaggcagagcaaccacaccttcagcagcggggacgtggccccctacaccaagctctgctgtaagggattctgcatcgacatcctcaagaagctggccagagtggtcaaattctcctacgacctgtacctggtgaccaacggcaagcatggcaagcgggtgcgcggcgtatggaacggcatgattggggaggtgtactacaagcgggcagacatggccatcggctccctcaccatcaatgaggaacgctccgagatcgtagacttctctgtaccctttgtggagacgggcatcagtgtgatggtggctcgcagcaatggcaccgtctccccctcggccttcttggagccatatagccctgcagtgtgggtgatgatgtttgtcatgtgcctcactgtggtggccatcaccgtcttcatgttcgagtacttcagccctgtcagctacaaccagaacctcaccagaggcaagaagtccgggggcccagctttcactatcggcaagtccgtgtggctgctgtgggcgctggtcttcaacaactcagtgcccatcgagaacccgcggggcaccaccagcaagatcatggttctggtctgggccttctttgctgtcatcttcctcgccagctacacggccaacctggccgccttcatgatccaagagcaatacatcgacactgtgtcgggcctcagtgacaagaagtttcagcggcctcaagatcagtacccacctttccgcttcggcacggtgcccaacggcagcacggagcggaacatccgcagtaactaccgtgacatgcacacccacatggtcaagttcaaccagcgctcggtggaggacgcgctcaccagcctcaagatggggaagctggatgccttcatctatgatgctgctgtcctcaactacatggcaggcaaggacgagggctgcaagctggtcaccattgggtctggcaaggtctttgctaccactggctacggcatcgccatgcagaaggactcccactggaagcgggccatagacctggcgctcttgcagttcctgggggacggagagacacagaaactggagacagtgtggctctcagggatctgccagaatgagaagaacgaggtgatgagcagcaagctggacatcgacaacatggcaggcgtcttctacatgctgctggtggccatggggctggccctgctggtcttcgcctgggagcacctggtctactggaagctgcgccactcggtgcccaactcatcccagctggacttcctgctggctttcagcaggggcatctacagctgcttcagcggggtgcagagcctcgccagcccaccgcggcaggccagcccggacctcacggccagctcggcccaggccagcgtgctcaagatgctgcaggcagcccgcgacatggtgaccacggcgggcgtaagcagctccctggaccgcgccactcgcaccatcgagaattggggtggcggccgccgtgcgcccccaccgtccccctgcccgaccccgcggtctggccccagcccatgcctgcccacccccgacccgcccccagagccgagccccacgggctggggaccgccagacgggggtcgcgcggcgcttgtgcgcagggctccgcagcccccgggccgccccccgacgccggggccgcccctgtccgacgtctcccgagtgtcgcgccgcccagcctgggaggcgcggtggccggtgcggaccgggcactgcgggaggcacctctcggcctccgagcggcccctgtcgcccgcgcgctgtcactacagctcctttcctcgagccgaccgatccggccgccccttcctcccgctcttcccggagcccccggagctggaggacctgccgctgctcggtccggagcagctggcccggcgggaggccctgctgcacgcggcctgggcccggggctcgcgcccgcgtcacgcttccctgcccagctccgtggccgaggccttcgctcggcccagctcgctgcccgctgggtgcaccggccccgcctgcgcccgccccgacggccactcggcctgcaggcgcttggcgcaggcgcagtcgatgtgcttgccgatctaccgggaggcctgccaggagggcgagcaggcaggggcccccgcctggcagcacagacagcacgtctgcctgcacgcccacgcccacctgccattttgctggggggctgtctgtcctcaccttccaccctgtgccagccacggctcctggctctccggggcctgggggcctctggggcacaggggcaggactctggggctgggcacaggctacagagacagtgggggactggacgagatcagcagngtagcccgtgggacgcaaggcttcccgggaccctgcacctggagacggatctccagtctggagtcagaagtgtgagttatcagccactcaggctccgagccagctggattctctgcctgccactgtcagggttaagcggcaggcaggattgggcttttctggcttctaccatgaaatcctggccatgggaccccagtgacagatgatgtcttccatggtcatcagtgacctcagtagcctcaaatcatggtgagggctgggcttttgctgtcctcttctcacgcagagttctgccaggagggtgtgctgtgggggtcagactcctgaggctctcccttccctggggctagccagttactggtcatggctgctgtgggcatggaggctggaacttgtggttgaggcagggccatcccgatccttgctctacctggctagagtttcttctcatcagagcactgggacattaaaccaaccttttacaacacact

SEQ ID NO: 43981 - DNA, 491 bp, Homo sapiens
tgtcacatgcagactgtggttttgaaacttccaagcccttaaaagaaaccagagctgaagaaatggcttatttcaggtctggagccggaaaaatacaagatgagcacagaacatatcagacagccagaaacctctgagagagttcaggaatgatgtcaaaaggatccaggagccagcttgtaggggctctcactgtccaaagaggacagaatttaacatcccaaatatgtttaaattcattagttcaccaataccaacatcaaatccctaactggtcgcctctggaggctgataggaaaatgattcatcattgtgaaaactgatgaatttaaaaaaagaatcaggcatttatcttcagttttctccatgaactataacaccagagagtggataagaagaggtttatctttaatagttcatctactacataaagaagcaataactcagccagaacatcacactttttttttttttttttgagacggagtctc

SEQ ID NO: 43982 - DNA, 984 bp, Homo sapiens
tttaaacaagaccaatcagtgaaatattgaatgtcaatactttttgttagaaatgccctctgaaaatgttagaaaatgtaaaactttacctgtgacaaggaataaattcatgattagaagaattatactgtttttcttgtgcaaataatacttaaggcagatgttcagtctcacagtgatgttggaaagcatattttatgcagtctaaacactatttctgtattagatatttaaatgcatgaggataaattctaattgctttttgtttaaaacagaaacatagaagaagcattagccccagtttgtataaaatgtctgctgcaactgaattcatgatagttcatgaaaactgaaaatcattccaattttgtaaaactgctgctactggttttatcaataaagttttagcagatggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaactcaaggggcaacccaatgcccattataacaaaaagaaaaaacttttaaaagccctggcgggacccaattaaaccttactggcgggaaaaccccttttttccccctgttttaatacctggcaggccttgcaaatatcgccctttccacaatttgccaacgtgacggaccaatgcctttttccaaacggttatataccctaaaggcccactggaaaaattctttccaaaaaatgtcaggttaaaaaaccgggtaaaccgaattgtgaaacacccctctttttttcacaatattgccccaaaaatttgtgataacctcgtgtgactctttcggaaccaacggggccaacttgttaaaaacttcgtcctactacggaacaagtggcccacaattggggaaccatggctttccccttttacgggcaaaatacccctttataaggacttttggcccccttcgtgacgcg

SEQ ID NO: 43983 - DNA, 391 bp, Homo sapiens
gttgaccaggctggtctcgaactcctgatcttgtgattcactcacctcagcttcctaaagtgctgggattgttttaaaggtttaagcaagttttaaaacgttaattgtaaagaaaattctgtgtgtaaacatattagctaaagttaaaaaggtatcatccagtttttctgggacatccttgtctttcttgttcatgatttttaagggaaaatatgaggtctttaaaaataaatattacattagccaggcatggtggtgtgcacctgtaatcccagttatttgggaggctgaggcaggggaattgcttgaacccaggagacggaggttgcagtgagctgagattgtgccattgcgctccagcctggatgacagaacgagagactgtctcaaa

SEQ ID NO: 43984 - DNA, 139 bp, Homo sapiens
cactctgataaagcaagacatgcagtctgttagcattcagccatgaaaataataacttgtaagaccagcttgtaaggctatgccatccaagtttcactaaatgtgtttatcaaattctctggaataatgattaagctca

SEQ ID NO: 43985 - DNA, 416 bp, Homo sapiens
cagtagatgagctgcccaagttgctgactcacagaattgggtgctaaataaaatggttgtagtttcaagccatgaagttttgggatgaactgttatgcagcaaaaagctaactgatatgatagatattgccagttttccaaagtggctgtgccaatctaccttctcagcagcactgtgtgctagagcccattactctgcctgttctccaatacctagtattgtcagggttttttttttgtttgtttgagacagtctctgtcacccaggctggagtgcagtggcatgatcttggctcactgcaacctctgcctcccaggtttaagtgattctcctgcttcagcctcctgagtagctaggattacaggtgtccgccaccatgcctggctaatttttatatttttagtagagacagggt

SEQ ID NO: 43986 - DNA, 344 bp, Homo sapiens
ggctggacagaatcattctgctttggagggcaacctaacagcattagcagggaaagtagtggtagaatttgtttctttttttaggacagttctgccccacatttttaaccattgttcttggaagtttagcatcaacatgaactacataatattcattgtcagttttgtagtttgcaactgacaaccctgagtagtacagtgacaaataccaaaagcatagccaaagaacttctgtgccatggcacgcctgtaatcccagcattttgggaggctgaggtgggtggaatgcttgagctcaggagtttgagaccaagctgggcaacatggcaaaatcccatctctac

SEQ ID NO: 43987 - DNA, 595 bp, Homo sapiens
aacctggatcacagaggacaggtaaactatttataatgcttaaccatggtaccggtagtcattggatcagatctcttggactgagtataccactataatactgcttctatggaaaaaaaatatatatataaaggattcaatagccatcattttcatccagaatattttcaagaaacataagccagtttgctcatttgattttatcaatggttctttaagttgatccacaaacccatgagggtcctggagaacctttcagggcttgacaaagtcaaaattattttagtaatagtactcagacattatttgcctttttggctacgttgacatttgcactgatggtacaaaatcaatggtggattgacatcctagtataaattaaggcagtagatccaagtagtatgaacaatcactgttctattcactgccatcttctgtttttctttttaaaaaagctagtttgaaatactgtcctcaatgacatagtaaatttaatatttactatatcctcaatgtaatatttacatttacatgagtaattacaatattatatgacaatattaatacacattaaatttactatttaatattagtt

SEQ ID NO: 43988 - DNA, 3473 bp, Homo sapiens
atgtattgaaagggtatgtataggtgcaaatgataaaaaagaagagtttgatgtttccggaaatggaaggattgaaggccatataggtgtgcaattacaagagcattcctatcttgagaagggcatgctggcgtctgaggaactgtcacagtctggtggtagcaccaaagatgatgaattagcttcaaccactactccaaagagagggagacctaaaggtaacatctcacggacgtgttcacactgtggccttttggcctctagtattacaaacttgactgttcacattagacgaaaacacagtcaccagtatagttatttatgcaaagtgtgtaagtattacactgtaactaagggagatatggaacgtcattgtgccaccaagaaacataaaggacgggtagaaatagaagcaagtggaaaacacagttcagatatcattgttggccctgaagggggtagccttgaagctggtaaaaagaatgctggctcagcagtgaccatgtcagatgaacatgctaacaaaccagctgagtcacccacctccgttttagagaagccagatcgtggaaactcaattgaagctgaagttgaaaatgtatttcattctctagatggagaagttaacagccatcttcttgatgaaaaggagcaaatatcttcagagccagaggacttcgcccagccgggggatgtgtactcccagagagatgttacaggcacaggtgagaataagtgtttgcactgtgagtttagtgctcactcctctgcttctctagagctgcatgtaaaacggaaacatacaaaagagtttgagttttattgcatggcatgcgattactacgcggtgactcgtcgcgagatgaccaggcatgcagcaacagagaagcacaaaatgaaaaggcagtcttatctcaactctgctaatgtagaagctggttctgcagacatgtccaaaaacatcattatgcctgaagaagagcatcaacaaaattctgaggaatttcaaataatttcaggtcaaccatctgatactcttaaatctagaaatgctgcagattgctctattttaaatgagaatactaatttagatatgtctaaagtgctctgcgctgctgactctgtagaagttgagactgaagaagaatctaatttcaatgaagaccattccttttgtgagactttccaacaggctcctgtcaaggataaagttaggaaacctgaggagatgatgtcacttactatgtcctcaaactatggctccccaagcagatttcaaaatgaaaattcaggaagctctgccttaaattgtgagacagcaaagaaaaaccatgagatatcgaatgatgcaggtgagctgcgtgtccattgtgagggtgaaggaggaaacgcaggagacggtggaggtgttgtcccccacagacacctgtgccctgtgacgctcgatggggagcgctcggctgaaagccctgtgctcgttgtgacaagaataaccagagaacagggaaatctggagagcgggggtcagaacagagttgcacgtgggcatggtttggaagacttgaaaggtgtccaagaagatcccgttctggggaataaggaaattctgatgaattcacaacatgaaacagaatttattttggaggaggatggcccagcttctgatagcacagttgaaagtagtgatgtctatgaaactataattagtattgatgataaagggcaggccatgtacagttttggtcgatttgactcctccataataagaataaagaaccctgaagatggtgagttgatagaccagtctgaagagggcttgatagcaacgggagtgagaattagtgagctgcccttgaaagactgtgctcaaggtgtgaaaaagaagaaatctgagggcagttccattggtgagtctacacgaattcgctgtgatgattgtggcttcttagcagatggactgagtggactgaatgttcacatagccatgaagcatcctacaaaagagaagcacttccattgtttactctgtggaaagtcgttctataccgaaagcaaccttcaccagcatctggctagtgccggccacatgagaaatgagcaggccagtgtggaggagcttccggagggaggggccacctttaaatgtgtcaagtgcacagagccctttgattctgaacagaatttatttctacatattaaaggacagcatgaggaattgctgcgggaggtgaataagtatatagtggaagacactgagcaaatcaaccgcgagagggaggaaaaccagggaaacgtctgcaagtattgtgggaagatgtgtcgaagcagcaactcgatggccttcctggcacacattcgcactcacacaggatcaaaaccattcaagtgcaagatatgccattttgcaacagctcagcttggagatgccagaaaccatgtgaaaaggcaccttgggatgagggaatacaagtgtcatgtctgtggggttgcttttgtaatgaagaagcacttaaatactcatctactaggcaagcatggagttggcaccccaaaagaaaggaaatttacatgccacttatgtgatagaagtttcacagagaagtgggccctgaacaaccacatgaaactccacacgggagaaaagccgtttaaatgtacctggcccacgtgccattactcattcctcacagcctccgcaatgaaagaccactacaggacgcacacaggcgagaagtcgtttctgtgtgacctctgcggctttgccggcgggacccgccacgccctcaccaagcatcgcagacagcacacaggagaaaaacctttcaagtgcgatgagtgtaactttgcctccacaactcagtcccatttgactcggcataaacgtgtccacactggagaaaagccctacagatgcccctggtgtgactacaggtcaaactgtgctgaaaatatccgcaaacacattctgcatactggcaaacatgaaggagtcaagatgtacaactgtcccaagtgtgactacgggaccaacgtcccggtggagttccggaaccatttgaaggaacagcatcctgacatcgaaaacccggacctcgcttacctgcatgctggtaagggacagaaactgtgaaaacttgtttctaacaggatttcatgtgatcacagcagttataatgctatttgtacattaccatgatttattgtaatggagtagagtatgtgatagtatctgcttcaagacctatagaaaagtacattccagtttgatcccactcaactatgaaaacaggacttttcaactgtattttatcaaaaaaggaaatctgacagagtaattatttgatgactgtaaagttaataatagtaaatatttaaagcatagttgacctgaaatgagagtagttgttaaatcttcatatgttgactaattgctaaaattttaattttttttcttaaaaaatgcttgtgatttg

SEQ ID NO: 43989 - DNA, 3626 bp, Homo sapiens
atgtattgaaagggtatgtataggtgcaaatgataaaaaagaagagtttgatgtttccggaaatggaaggattgaaggccatataggtgtgcaattacaagagcattcctatcttgagaagggcatgctggcgtctgaggaactgtcacagtctggtggtagcaccaaagatgatgaattagcttcaaccactactccaaagagagggagacctaaaggtaacatctcacggacgtgttcacactgtggccttttggcctctagtattacaaacttgactgttcacattagacgaaaacacagtcaccagtatagttatttatgcaaagtgtgtaagtattacactgtaactaagggagatatggaacgtcattgtgccaccaagaaacataaaggacgggtagaaatagaagcaagtggaaaacacagttcagatatcattgttggccctgaagggggtagccttgaagctggtaaaaagaatgctggctcagcagtgaccatgtcagatgaacatgctaacaaaccagctgagtcacccacctccgttttagagaagccagatcgtggaaactcaattgaagctgaagttgaaaatgtatttcattctctagatggagaagttaacagccatcttcttgatgaaaaggagcaaatatcttcagagccagaggacttcgcccagccgggggatgtgtactcccagagagatgttacaggcacaggtgagaataagtgtttgcactgtgagtttagtgctcactcctctgcttctctagagctgcatgtaaaacggaaacatacaaaagagtttgagttttattgcatggcatgcgattactacgcggtgactcgtcgcgagatgaccaggcatgcagcaacagagaagcacaaaatgaaaaggcagtcttatctcaactctgctaatgtagaagctggttctgcagacatgtccaaaaacatcattatgcctgaagaagagcatcaacaaaattctgaggaatttcaaataatttcaggtcaaccatctgatactcttaaatctagaaatgctgcagattgctctattttaaatgagaatactaatttagatatgtctaaagtgctctgcgctgctgactctgtagaagttgagactgaagaagaatctaatttcaatgaagaccattccttttgtgagactttccaacaggctcctgtcaaggataaagttaggaaacctgaggagatgatgtcacttactatgtcctcaaactatggctccccaagcagatttcaaaatgaaaattcaggaagctctgccttaaattgtgagacagcaaagaaaaaccatgagatatcgaatgatgcaggtgagctgcgtgtccattgtgagggtgaaggaggaaacgcaggagacggtggaggtgttgtcccccacagacacctgtgccctgtgacgctcgatggggagcgctcggctgaaagccctgtgctcgttgtgacaagaataaccagagaacagggaaatctggagagcgggggtcagaacagagttgcacgtgggcatggtttggaagacttgaaaggtgtccaagaagatcccgttctggggaataaggaaattctgatgaattcacaacatgaaacagaatttattttggaggaggatggcccagcttctgatagcacagttgaaagtagtgatgtctatgaaactataattagtattgatgataaagggcaggccatgtacagttttggtcgatttgactcctccataataagaataaagaaccctgaagatggtgagttgatagaccagtctgaagagggcttgatagcaacgggagtgagaattagtgagctgcccttgaaagactgtgctcaaggtgtgaaaaagaagaaatctgagggcagttccattggtgagtctacacgaattcgctgtgatgattgtggcttcttagcagatggactgagtggactgaatgttcacatagccatgaagcatcctacaaaagagaagcacttccattgtttactctgtggaaagtcgttctataccgaaagcaaccttcaccagcatctggctagtgccggccacatgagaaatgagcaggccagtgtggaggagcttccggagggaggggccacctttaaatgtgtcaagtgcacagagccctttgattctgaacagaatttatttctacatattaaaggacagcatgaggaattgctgcgggaggtgaataagtatatagtggaagacactgagcaaatcaaccgcgagagggaggaaaaccagggaaacgtctgcaagtattgtgggaagatgtgtcgaagcagcaactcgatggccttcctggcacacattcgcactcacacaggatcaaaaccattcaagtgcaagatatgccattttgcaacagctcagcttggagatgccagaaaccatgtgaaaaggcaccttgggatgagggaatacaagtgtcatgtctgtggggttgcttttgtaatgaagaagcacttaaatactcatctactaggcaagcatggagttggcaccccaaaagaaaggaaatttacatgccacttatgtgatagaagtttcacagagaagtgggccctgaacaaccacatgaaactccacacgggagaaaagccgtttaaatgtacctggcccacgtgccattactcattcctcacagcctccgcaatgaaagaccactacaggacgcacacaggcgagaagtcgtttctgtgtgacctctgcggctttgccggcgggacccgccacgccctcaccaagcatcgcagacagcacacaggagaaaaacctttcaagtgcgatgagtgtaactttgcctccacaactcagtcccatttgactcggcataaacgtgtccacactggagaaaagccctacagatgcccctggtgtgactacagtgcctatgattgggtctgaaaggctggccttgctcccagacgtttagaaaagcagctagatgtgcacaggtttcctgcgggtgacagagaggccagcgcagcgcctgctgttcaggagcgtctcagaggcacacgagagcctgttggctgctcgcgcagagagcgcatgtggacacctggacagccgcgtgacttggaagcatgggagtttatcctctcaagggtggtggatgagaccaagaatgcgtcagtgttcatccacttctgtgctaacttacaagtttctttctcttatgaggcactgtgctgttttagaatcactttttatcgcataataaacatgaacagaaatataactgagaaatggagagaaaaattcaatgtgcatcaatttgtcctaagaactagtttcaaagaatttagatttatgaaaagcaaaaagtaatgagtaaatgatctaatggaaattatcccattcaataaatagctaccagttataataaaggaaaataaaattcataagatttagagcaaggtgatccagaaactctccaactaaaatttcctcttgctgaaaatgtccaaaggattgtattttgtgattacctcagattgctgtaaactctttttatctgaataaaatgagtacgcgccaagctctttcctccctttccccccacggtgacacacgagcg

SEQ ID NO: 43990 - DNA, 5647 bp, Homo sapiens
atgtattgaaagggtatgtataggtgcaaatgataaaaaagaagagtttgatgtttccggaaatggaaggattgaaggccatataggtgtgcaattacaagagcattcctatcttgagaagggcatgctggcgtctgaggaactgtcacagtctggtggtagcaccaaagatgatgaattagcttcaaccactactccaaagagagggagacctaaaggtaacatctcacggacgtgttcacactgtggccttttggcctctagtattacaaacttgactgttcacattagacgaaaacacagtcaccagtatagttatttatgcaaagtgtgtaagtattacactgtaactaagggagatatggaacgtcattgtgccaccaagaaacataaaggacgggtagaaatagaagcaagtggaaaacacagttcagatatcattgttggccctgaagggggtagccttgaagctggtaaaaagaatgctggctcagcagtgaccatgtcagatgaacatgctaacaaaccagctgagtcacccacctccgttttagagaagccagatcgtggaaactcaattgaagctgaagttgaaaatgtatttcattctctagatggagaagttaacagccatcttcttgatgaaaaggagcaaatatcttcagagccagaggacttcgcccagccgggggatgtgtactcccagagagatgttacaggcacaggtgagaataagtgtttgcactgtgagtttagtgctcactcctctgcttctctagagctgcatgtaaaacggaaacatacaaaagagtttgagttttattgcatggcatgcgattactacgcggtgactcgtcgcgagatgaccaggcatgcagcaacagagaagcacaaaatgaaaaggcagtcttatctcaactctgctaatgtagaagctggttctgcagacatgtccaaaaacatcattatgcctgaagaagagcatcaacaaaattctgaggaatttcaaataatttcaggtcaaccatctgatactcttaaatctagaaatgctgcagattgctctattttaaatgagaatactaatttagatatgtctaaagtgctctgcgctgctgactctgtagaagttgagactgaagaagaatctaatttcaatgaagaccattccttttgtgagactttccaacaggctcctgtcaaggataaagttaggaaacctgaggagatgatgtcacttactatgtcctcaaactatggctccccaagcagatttcaaaatgaaaattcaggaagctctgccttaaattgtgagacagcaaagaaaaaccatgagatatcgaatgatgcaggtgagctgcgtgtccattgtgagggtgaaggaggaaacgcaggagacggtggaggtgttgtcccccacagacacctgtgccctgtgacgctcgatggggagcgctcggctgaaagccctgtgctcgttgtgacaagaataaccagagaacagggaaatctggagagcgggggtcagaacagagttgcacgtgggcatggtttggaagacttgaaaggtgtccaagaagatcccgttctggggaataaggaaattctgatgaattcacaacatgaaacagaatttattttggaggaggatggcccagcttctgatagcacagttgaaagtagtgatgtctatgaaactataattagtattgatgataaagggcaggccatgtacagttttggtcgatttgactcctccataataagaataaagaaccctgaagatggtgagttgatagaccagtctgaagagggcttgatagcaacgggagtgagaattagtgagctgcccttgaaagactgtgctcaaggtgtgaaaaagaagaaatctgagggcagttccattggtgagtctacacgaattcgctgtgatgattgtggcttcttagcagatggactgagtggactgaatgttcacatagccatgaagcatcctacaaaagagaagcacttccattgtttactctgtggaaagtcgttctataccgaaagcaaccttcaccagcatctggctagtgccggccacatgagaaatgagcaggccagtgtggaggagcttccggagggaggggccacctttaaatgtgtcaagtgcacagagccctttgattctgaacagaatttatttctacatattaaaggacagcatgaggaattgctgcgggaggtgaataagtatatagtggaagacactgagcaaatcaaccgcgagagggaggaaaaccagggaaacgtctgcaagtattgtgggaagatgtgtcgaagcagcaactcgatggccttcctggcacacattcgcactcacacaggatcaaaaccattcaagtgcaagatatgccattttgcaacagctcagcttggagatgccagaaaccatgtgaaaaggcaccttgggatgagggaatacaagtgtcatgtctgtggggttgcttttgtaatgaagaagcacttaaatactcatctactaggcaagcatggagttggcaccccaaaagaaaggaaatttacatgccacttatgtgatagaagtttcacagagaagtgggccctgaacaaccacatgaaactccacacgggagaaaagccgtttaaatgtacctggcccacgtgccattactcattcctcacagcctccgcaatgaaagaccactacaggacgcacacaggcgagaagtcgtttctgtgtgacctctgcggctttgccggcgggacccgccacgccctcaccaagcatcgcagacagcacacaggagaaaaacctttcaagtgcgatgagtgtaactttgcctccacaactcagtcccatttgactcggcataaacgtgtccacactggagaaaagccctacagatgcccctggtgtgactacaggtcaaactgtgctgaaaatatccgcaaacacattctgcatactggcaaacatgaaggagtcaagatgtacaactgtcccaagtgtgactacgggaccaacgtcccggtggagttccggaaccatttgaaggaacagcatcctgacatcgaaaacccggacctcgcttacctgcatgctggcattgtttccaagtcgtacgagtgccgtctaaagggacaaggagccaccttcgtggagacagacagccccttcaccgcggcggccttggcagaagagcccctcgtcaaggagaagcccctcagaagcagcaggaggccagcgccgccccctgagcaggtgcagcaggtcatcatcttccagggctacgacggggagtttgccctggacccctcggtggaggagacggccgccgccacgctgcagacgctggccatggccggccaggtggcccgggtggtgcatatcacggaggatggccaggtcatcgccacgagtcagagcggggcacatgtaggcagcgtggtgcccggacccatcctccccgagcagctggctgatggagccacccaggtggtcgtcgtggggggctccatggaaggccacggcatggatgagtccctcagtccaggtggcgctgtgatacaacaggtgaccaagcaggagattttaaacctctcggaggctggagtcgctccccccgaggcatcctcagccctggatgcattgctctgtgcggtcactgaattaggggaggtggagggcagggctgggctcgaggagcaaggcaggcccggcgccaaagacgtgctgatccagctgcccgggcaggaggtctcccatgtggctgccgaccccgaggcccccgagatccagatgttcccacaggcccaggagagcccggccgccgtggaggtgctcacccaggtggtccatccctcagcagccatggcctctcaggagcgggcacaggtggccttcaagaagatggtccagggcgtcctccagtttgctgtgtgtgacacggccgcggccggccagttggtcaaggacggtgtcacccaggtggtggtgagcgaagagggtgccgtccacatggtcgccggggagggtgcccagatcatcatgcaggaggcgcagggcgagcacatggatctggtggagtccgacggggagatctcgcagatcatcgtgacagaggagctggtccaggccatggtgcaggagtccagtggcggcttctccgagggcaccacgcactacatcctgacagagctgcccccaggggtgcaggacgagccgggcctgtactcccacaccgtgctggagactgcggactcgcaggaactcctgcaggccggggccacgctaggcacagaggccggggccccaagcagggcagagcagctggccagcgtggtcatctacacccaggagggctcctcggccgcggcggcaattcagagccaaagagaaagcagcgaactccaggaagcatgagacgcgcggcacctttactcagcacagggcaggtgtgggaaggtccagcttcggtgggggaccgtgttccctgagcttcatctgaaaccttcaaaaccatgaggacaaggctcccgtgagctctgagcatgccctcccagcgagagtcacactggccaccagccaggcgcccacagagggtaccgtgggctgggcctcggggagcaggctgccaagtgcaggggagggccgggcgcaggccacacagggagctccggtccactgggggcccttcgatcagtggcctcccgcttcgtcctggccgctgtgctgaagagaagccaagtgttgttggtgtttttctctcccaagtgttttcccatttcagttatcagaaggtcatggccgtggggaaagtggtgaagatacccctcgtggcttggggtgcacctgcttgtgcagtcagcatgtagctgcctttccatttcattctctactgggctaaaaattgcagctacaagtgttaccatcttgaagcagtccacttccattcaattttttttttttaattttagaataacagtgtccccataccaaaggaagcctgctagctcatttcatgtataaatttcccatcttcaaacagtttaggtgtatttgttgctctggtcacattctgcataaaagaaatcctcttaagcctatggttaagaaaagccttgaagtttatattcagttaaaatatatgtcggtggagatagccagtgcttctaattttgacttagtttcatacagtaaagcctaaatgtgaaacgcacacgctggaagatattgttcctatcaatattttgctttttataacaagggtttgttcatattgatgccatttttgcaggatttcttcgtgatttctgtccatatgaaaatgctgacattaaacattaacacatggagaccgtgccctgtggccctgccgtggctgccagcatggtctgtgtttccttgtggattcacctgtggccctgctgtggccaccagcatggtctgtgtcctcgtggattcactgcagctgtcggatgcgagtttctgtcataatcatttgtttcctgatacaattgttcttattcttttccaaaactgtaaaataatctcctccctcaaatgcaaaggttgtttttgttctgtttctgttttctttgaaataaaattataacgttaaaagatcaaaatggcatgtta

SEQ ID NO: 43991 - DNA, 3222 bp, Homo sapiens
atgtattgaaagggtatgtataggtgcaaatgataaaaaagaagagtttgatgtttccggaaatggaaggattgaaggccatataggtgtgcaattacaagagcattcctatcttgagaagggcatgctggcgtctgaggaactgtcacagtctggtggtagcaccaaagatgatgaattagcttcaaccactactccaaagagagggagacctaaaggtaacatctcacggacgtgttcacactgtggccttttggcctctagtattacaaacttgactgttcacattagacgaaaacacagtcaccagtatagttatttatgcaaagtgtgtaagtattacactgtaactaagggagatatggaacgtcattgtgccaccaagaaacataaaggacgggtagaaatagaagcaagtggaaaacacagttcagatatcattgttggccctgaagggggtagccttgaagctggtaaaaagaatgctggctcagcagtgaccatgtcagatgaacatgctaacaaaccagctgagtcacccacctccgttttagagaagccagatcgtggaaactcaattgaagctgaagttgaaaatgtatttcattctctagatggagaagttaacagccatcttcttgatgaaaaggagcaaatatcttcagagccagaggacttcgcccagccgggggatgtgtactcccagagagatgttacaggcacaggtgagaataagtgtttgcactgtgagtttagtgctcactcctctgcttctctagagctgcatgtaaaacggaaacatacaaaagagtttgagttttattgcatggcatgcgattactacgcggtgactcgtcgcgagatgaccaggcatgcagcaacagagaagcacaaaatgaaaaggcagtcttatctcaactctgctaatgtagaagctggttctgcagacatgtccaaaaacatcattatgcctgaagaagagcatcaacaaaattctgaggaatttcaaataatttcaggtcaaccatctgatactcttaaatctagaaatgctgcagattgctctattttaaatgagaatactaatttagatatgtctaaagtgctctgcgctgctgactctgtagaagttgagactgaagaagaatctaatttcaatgaagaccattccttttgtgagactttccaacaggctcctgtcaaggataaagttaggaaacctgaggagatgatgtcacttactatgtcctcaaactatggctccccaagcagatttcaaaatgaaaattcaggaagctctgccttaaattgtgagacagcaaagaaaaaccatgagatatcgaatgatgcaggtgagctgcgtgtccattgtgagggtgaaggaggaaacgcaggagacggtggaggtgttgtcccccacagacacctgtgccctgtgacgctcgatggggagcgctcggctgaaagccctgtgctcgttgtgacaagaataaccagagaacagggaaatctggagagcgggggtcagaacagagttgcacgtgggcatggtttggaagacttgaaaggtgtccaagaagatcccgttctggggaataaggaaattctgatgaattcacaacatgaaacagaatttattttggaggaggatggcccagcttctgatagcacagttgaaagtagtgatgtctatgaaactataattagtattgatgataaagggcaggccatgtacagttttggtcgatttgactcctccataataagaataaagaaccctgaagatggtgagttgatagaccagtctgaagagggcttgatagcaacgggagtgagaattagtgagctgcccttgaaagactgtgctcaaggtgtgaaaaagaagaaatctgagggcagttccattggtgagtctacacgaattcgctgtgatgattgtggcttcttagcagatggactgagtggactgaatgttcacatagccatgaagcatcctacaaaagagaagcacttccattgtttactctgtggaaagtcgttctataccgaaagcaaccttcaccagcatctggctagtgccggccacatgagaaatgagcaggccagtgtggaggagcttccggagggaggggccacctttaaatgtgtcaagtgcacagagccctttgattctgaacagaatttatttctacatattaaaggacagcatgaggaattgctgcgggaggtgaataagtatatagtggaagacactgagcaaatcaaccgcgagagggaggaaaaccagggaaacgtctgcaagtattgtgggaagatgtgtcgaagcagcaactcgatggccttcctggcacacattcgcactcacacaggatcaaaaccattcaagtgcaagatatgccattttgcaacagctcagcttggagatgccagaaaccatgtgaaaaggcaccttgggatgagggaatacaagtgtcatgtctgtggggttgcttttgtaatgaagaagcacttaaatactcatctactaggcaagcatggagttggcaccccaaaagaaagagtaaaggttgcatatcgaaagatcgggacgttgccaggaatacagaacaacaggaacgcgtcgagtgcctctgaagcccaaagtctttgtgagcacttttcataactgatgggacctgcagtgggaggattggctgaggacttattttggttgaagttagacatatttcattgtctttttttttttccttttatctgtgtacttctttgcatacttgaattcatttgtgtgatgtaaatcatcacacaaatgtaggctagtctagtgattttctggaaggaactgttattttaaaaattgagtactcagttttataaaattgtcatcatcaatgagttaaaaaaaaaaaaacccttaatgattcagggtttatttaaagctgactgtccaatcaaagtttttgtaagcatgccatgtgacaaatgcctggcatattcagtaaggaacatattaattattctaattaacacatgacttcagagaagtctttcgttaatcagcacatggatcttggttatttgtacccttttgggaaaatttcacactcagatgcaaaaataccaggctaaatacattgctttgtttgtatgtggagaggatattcatcacaatggtactatacatctaagaaaacagaaagtaattaaaatgctgattactat

SEQ ID NO: 43992 - DNA, 4305 bp, Homo sapiens
atgtattgaaagggtatgtataggtgcaaatgataaaaaagaagagtttgatgtttccggaaatggaaggattgaaggccatataggtgtgcaattacaagagcattcctatcttgagaagggcatgctggcgtctgaggaactgtcacagtctggtggtagcaccaaagatgatgaattagcttcaaccactactccaaagagagggagacctaaaggtaacatctcacggacgtgttcacactgtggccttttggcctctagtattacaaacttgactgttcacattagacgaaaacacagtcaccagtatagttatttatgcaaagtgtgtaagtattacactgtaactaagggagatatggaacgtcattgtgccaccaagaaacataaaggacgggtagaaatagaagcaagtggaaaacacagttcagatatcattgttggccctgaagggggtagccttgaagctggtaaaaagaatgctggctcagcagtgaccatgtcagatgaacatgctaacaaaccagctgagtcacccacctccgttttagagaagccagatcgtggaaactcaattgaagctgaagttgaaaatgtatttcattctctagatggagaagttaacagccatcttcttgatgaaaaggagcaaatatcttcagagccagaggacttcgcccagccgggggatgtgtactcccagagagatgttacaggcacaggtgagaataagtgtttgcactgtgagtttagtgctcactcctctgcttctctagagctgcatgtaaaacggaaacatacaaaagagtttgagttttattgcatggcatgcgattactacgcggtgactcgtcgcgagatgaccaggcatgcagcaacagagaagcacaaaatgaaaaggcagtcttatctcaactctgctaatgtagaagctggttctgcagacatgtccaaaaacatcattatgcctgaagaagagcatcaacaaaattctgaggaatttcaaataatttcaggtcaaccatctgatactcttaaatctagaaatgctgcagattgctctattttaaatgagaatactaatttagatatgtctaaagtgctctgcgctgctgactctgtagaagttgagactgaagaagaatctaatttcaatgaagaccattccttttgtgagactttccaacaggctcctgtcaaggataaagttaggaaacctgaggagatgatgtcacttactatgtcctcaaactatggctccccaagcagatttcaaaatgaaaattcaggaagctctgccttaaattgtgagacagcaaagaaaaaccatgagatatcgaatgatgcaggtgagctgcgtgtccattgtgagggtgaaggaggaaacgcaggagacggtggaggtgttgtcccccacagacacctgtgccctgtgacgctcgatggggagcgctcggctgaaagccctgtgctcgttgtgacaagaataaccagagaacagggaaatctggagagcgggggtcagaacagagttgcacgtgggcatggtttggaagacttgaaaggtgtccaagaagatcccgttctggggaataaggaaattctgatgaattcacaacatgaaacagaatttattttggaggaggatggcccagcttctgatagcacagttgaaagtagtgatgtctatgaaactataattagtattgatgataaagggcaggccatgtacagttttggtcgatttgactcctccataataagaataaagaaccctgaagatggtgagttgatagaccagtctgaagagggcttgatagcaacgggagtgagaattagtgagctgcccttgaaagactgtgctcaaggtgtgaaaaagaagaaatctgagggcagttccattggtgagtctacacgaattcgctgtgatgattgtggcttcttagcagatggactgagtggactgaatgttcacatagccatgaagcatcctacaaaagagaagcacttccattgtttactctgtggaaagtcgttctataccgaaagcaaccttcaccagcatctggctagtgccggccacatgagaaatgagcaggccagtgtggaggagcttccggagggaggggccacctttaaatgtgtcaagtgcacagagccctttgattctgaacagaatttatttctacatattaaaggacagcatgaggaattgctgcgggaggtgaataagtatatagtggaagacactgagcaaatcaaccgcgagagggaggaaaaccagggaaacgtctgcaagtattgtgggaagatgtgtcgaagcagcaactcgatggccttcctggcacacattcgcactcacacaggatcaaaaccattcaagtgcaagatatgccattttgcaacagctcagcttggagatgccagaaaccatgtgaaaaggcaccttgggatgagggaatacaagtgtcatgtctgtggggttgcttttgtaatgaagaagcacttaaatactcatctactaggcaagcatggagttggcaccccaaaagaaaggaaatttacatgccacttatgtgatagaagtttcacagagaagtgggccctgaacaaccacatgaaactccacacgggagaaaagccgtttaaatgtacctggcccacgtgccattactcattcctcacagcctccgcaatgaaagaccactacaggacgcacacaggcgagaagtcgtttctgtgtgacctctgcggctttgccggcgggacccgccacgccctcaccaagcatcgcagacagcacacaggagaaaaacctttcaagtgcgatgagtgtaactttgcctccacaactcagtcccatttgactcggcataaacgtgtccacactggagaaaagccctacagatgcccctggtgtgactacaggtcaaactgtgctgaaaatatccgcaaacacattctgcatactggcaaacatgaaggagtcaagatgtacaactgtcccaagtgtgactacgggaccaacgtcccggtggagttccggaaccatttgaaggaacagcatcctgacatcgaaaacccggacctcgcttacctgcatgctggcattgtttccaagtcgtacgagtgccgtctaaagggacaaggagccaccttcgtggagacagacagccccttcaccgcggcggccttggcagaagagcccctcgtcaaggagaagcccctcagaagcagcaggaggccagcgccgccccctgagcaggtgcagcaggtcatcatcttccagggctacgacggggagtttgccctggacccctcggtggaggagacggccgccgccacgctgcagacgctggccatggccggccaggtggcccgggtggtgcatatcacggaggatggccaggtcatcgccacgagtcagagcggggcacatgtaggcagcgtggtgcccggacccatcctccccgagcagctggctgatggagccacccaggtggtcgtcgtggggggctccatggaaggccacggcatggatgagtccctcagtccaggtggcgctgtgatacaacaggtgaccaagcaggagattttaaacctctcggaggctggagtcgctccccccgaggcatcctcagccctggatgcattgctctgtgcggtcactgaattaggggaggtggagggcagggctgggctcgaggagcaaggcaggcccggcgccaaagacgtgctgatccagctgcccgggcaggaggtctcccatgtggctgccgaccccgaggcccccgagatccagatgttcccacaggcccaggagagcccggccgccgtggaggtgctcacccaggtggtccatccctcagcagccatggcctctcaggagcgggcacaggtggccttcaagaagatggtccagggcgtcctccagtttgctgtgtgtgacacggccgcggccggccagttggtcaaggacggtgtcacccaggtggtggtgagcgaagagggtgccgtccacatggtcgccggggagggtgcccagatcatcatgcaggaggcgcagggcgagcacatggatctggtggagtccgacggggagatctcgcagatcatcgtggattcactgcagctgtcggatgcgagtttctgtcataatcatttgtttcctgatacaattgttcttattcttttccaaaactgtaaaataatctcctccctcaaatgcaaaggttgtttttgttctgtttctgttttctttgaaataaaattataacgttaaaagatcaaaatggcatgtta

SEQ ID NO: 43993 - DNA, 2270 bp, Homo sapiens
caacatccataaatatactcccgcttataaagatcataaacatctagcctctgccttcagaagttacaagatgatcaattcaacctccacacagcctccagatgaatcctgctctcagaacctcctgatcactcagcagatcattcctgtgctgtactgtatggtcttcattgcaggaatcctactcaatggagtgtcaggatggatattcttttacgtgcccagctctaagagtttcatcatctatctcaagaacattgttattgctgactttgtgatgagcctgacttttcctttcaagatccttggtgactcaggccttggtccctggcagctgaacgtgtttgtgtgcagggtctctgccgtgctcttctacgtcaacatgtacgtcagcattgtgttctttgggctcatcagctttgacagatattataaaattgtaaagcctctttggacttctttcatccagtcagtgagttacagcaaacttctgtcagtgatagtatggatgctcatgctcctccttgctgttccaaatattattctcaccaaccagagtgttagggaggttacacaaataaaatgtatagaactgaaaagtgaactgggacggaagtggcacaaagcatcaaactacatcttcgtggccatcttctggattgtgtttcttttgttaatcgttttctatactgctatcacaaagaaaatctttaagtcccaccttaagtcaagtcggaattccacttcggtcaaaaagaaatctagccgcaacatattcagcatcgtgtttgtgttttttgtctgttttgtaccttaccatattgccagaatcccctacacaaagagtcagaccgaagctcattacagctgccagtcaaaagaaatcttgcggtatatgaaagaattcactctgctactatctgctgcaaatgtatgcttggaccctattatttatttctttctatgccagccgtttagggaaatcttatgtaagaaattgcacattccattaaaagctcagaatgacctagacatttccagaatcaaaagaggaaatacaacacttgaaagcacagatactttgtgagttcctaccctcttccaaagaaagaccacgtgtgcatgttgtcatcttcaattacataacagaaatcaataagatatgtgccctcatcataaatatcatctctagcactgccatccaatttagttcaataaaattcaaatataagtttccatgcttttttgtaacatcaaagaaaacatacccatcagtaatttctctaatactgacctttctattctctattaataaaaaattaatacatacaattattcaattctattatattaaaataagttaaagtttataaccactagtctggtcagttaatgtagaaatttaaatagtaaataaaacacaacataatcaaagacaactcactcaggcatcttctttctctaaataccagaatctagtatgtaattgttttcaacactgtccttaaagactaacttgaaagcaggcacagtttgatgaagggctagagagctgtttgcaataaaaagtcaggtttttttcctgatttgaagaagcaggaaaagctgacacccagacaatcacttaagaaaccccttattgatgtatttcatggcactgcaaaggaagaggaatattaattgtatacttagcaagaaaattttttttttctgatagcactttgaggatattagatacatgctaaatatgttttctacaaagacttacgtcatttaatgagcctggggttctggtgttagaatatttttaagtaggctttactgagagaaactaaatattggcatacgttatcagcaacttcccctgttcaatagtatgggaaaaataagatgactgggaaaaagacacacccacaccgtagaacatatattaatctactggcgaatgggaaaggagaccattttcttagaaagcaaataaacttgatttttttaaatctaaaatttacattaatgagtgcaaaataacacataaaatgaaaattcacacatcacatttttctggaaaacagacggattttacttctggagacatggcatacggttactgacttatgagctaccaaaactaaattctttctctgctattaactggctagaagacattcatctatttttcaaatgttctttcaaaacatttttataagtaatgtttgtatctatttcatgctttactgtctatatactaataaagaaatgttttaatactg

SEQ ID NO: 43994 - DNA, 806 bp, Homo sapiens
gggatgtggggaaaagtaggaggagaaataagaaagcaggactgtttttgcattactggaggaaaggaactagctcagaagtcagcctaacacccacagagattaaaacgtctcttccttcctctttgtttccacgtcccagtcttcaataaattctatctgacaacagcagcagagggacccactatcttgtggtttctgtcaagttcctgattttcatccgtagttgaagatgagcaagaactctgtaacagtgttaccttggagcctacaatgagaggtatttcaaaatgagtgaagcatgactctcacagatgaaggcctagacgcaggtaagaaaacagcttttccatgaaatgacttgcatgtatgtgaatggtgcatgggaacagaaaagatttctgagctgggcagcaacaaagctgaggaacactgaaccattgccactcacatttttctcagtaggttactttttgtttgacaactataattggtatattaatatatttccccatgctaatatggggatccaatactgaaatattatcatttatgatttaggatttccaatcgtggctgtcaaaatatatctgtgatgaagagatatcaaggaaaatgtttaaaaggtattcatccaggacaaacatttcaaaagctcgtaaatgtgtattaaaattgcttctcaaaactacaaaatcgattagcataatacttaggtcagtatgtctttgtttgcaattgcatatgtgtacagatatatagttgcatttacttgtacatacacttatataggtaaaagtttttat

SEQ ID NO: 43995 - DNA, 2664 bp, Homo sapiens
gggatgtggggaaaagtaggaggagaaataagaaagcaggactgtttttgcattactggaggaaaggaactagctcagaagtcagcctaacacccacagagattaaaacgtctcttccttcctctttgtttccacgtcccagtcttcaataaattctatctgacaacagcagcagagggacccactatcttgtggtttctgtcaagttcctgattttcatccgtagttgaagatgagcaagaactctgtaacagtgttaccttggagcctacaatgagaggtatttcaaaatgagtgaagcatgactctcacagatgaaggcctagacgcaggatctttaatgaaaaaacacttgggccacttcaagacgacaaacgctcactgggcaaaacaccttcactgaaaagagacctcatattatgcaaaaaaaatcttaaaaggcctctgccttcagaagttacaagatgatcaattcaacctccacacagcctccagatgaatcctgctctcagaacctcctgatcactcagcagatcattcctgtgctgtactgtatggtcttcattgcaggaatcctactcaatggagtgtcaggatggatattcttttacgtgcccagctctaagagtttcatcatctatctcaagaacattgttattgctgactttgtgatgagcctgacttttcctttcaagatccttggtgactcaggccttggtccctggcagctgaacgtgtttgtgtgcagggtctctgccgtgctcttctacgtcaacatgtacgtcagcattgtgttctttgggctcatcagctttgacagatattataaaattgtaaagcctctttggacttctttcatccagtcagtgagttacagcaaacttctgtcagtgatagtatggatgctcatgctcctccttgctgttccaaatattattctcaccaaccagagtgttagggaggttacacaaataaaatgtatagaactgaaaagtgaactgggacggaagtggcacaaagcatcaaactacatcttcgtggccatcttctggattgtgtttcttttgttaatcgttttctatactgctatcacaaagaaaatctttaagtcccaccttaagtcaagtcggaattccacttcggtcaaaaagaaatctagccgcaacatattcagcatcgtgtttgtgttttttgtctgttttgtaccttaccatattgccagaatcccctacacaaagagtcagaccgaagctcattacagctgccagtcaaaagaaatcttgcggtatatgaaagaattcactctgctactatctgctgcaaatgtatgcttggaccctattatttatttctttctatgccagccgtttagggaaatcttatgtaagaaattgcacattccattaaaagctcagaatgacctagacatttccagaatcaaaagaggaaatacaacacttgaaagcacagatactttgtgagttcctaccctcttccaaagaaagaccacgtgtgcatgttgtcatcttcaattacataacagaaatcaataagatatgtgccctcatcataaatatcatctctagcactgccatccaatttagttcaataaaattcaaatataagtttccatgcttttttgtaacatcaaagaaaacatacccatcagtaatttctctaatactgacctttctattctctattaataaaaaattaatacatacaattattcaattctattatattaaaataagttaaagtttataaccactagtctggtcagttaatgtagaaatttaaatagtaaataaaacacaacataatcaaagacaactcactcaggcatcttctttctctaaataccagaatctagtatgtaattgttttcaacactgtccttaaagactaacttgaaagcaggcacagtttgatgaagggctagagagctgtttgcaataaaaagtcaggtttttttcctgatttgaagaagcaggaaaagctgacacccagacaatcacttaagaaaccccttattgatgtatttcatggcactgcaaaggaagaggaatattaattgtatacttagcaagaaaattttttttttctgatagcactttgaggatattagatacatgctaaatatgttttctacaaagacttacgtcatttaatgagcctggggttctggtgttagaatatttttaagtaggctttactgagagaaactaaatattggcatacgttatcagcaacttcccctgttcaatagtatgggaaaaataagatgactgggaaaaagacacacccacaccgtagaacatatattaatctactggcgaatgggaaaggagaccattttcttagaaagcaaataaacttgatttttttaaatctaaaatttacattaatgagtgcaaaataacacataaaatgaaaattcacacatcacatttttctggaaaacagacggattttacttctggagacatggcatacggttactgacttatgagctaccaaaactaaattctttctctgctattaactggctagaagacattcatctatttttcaaatgttctttcaaaacatttttataagtaatgtttgtatctatttcatgctttactgtctatatactaataaagaaatgttttaatactg

SEQ ID NO: 43996 - DNA, 1041 bp, Homo sapiens
ctcccctccccccactcctctcagtgggggcccctccagtccctgagaattggtactacgaaaaggtgaactcctgggcagaatcttgcctagagcttgcggagtccagccaggcccctgctgaagggccccagaccaccggccacttctcccccgtccatctgaccagctgggcccctgcgcccacctggcctccacgttccctctcctctcacccacacccctggccatggctaactactatgaagtgctgggcgtgcaggccagcgcttccccggaggacatcaagaaagcctaccgcaagctggcccttcgttggcaccccgacaagaaccctgacaataaggaggaggcggagaagaagttcaagctggtgtctgaggcctatgaggttctgtctgactccaagaaacgctccctgtatgaccgtgctggctgtgacagctggcgggctggtggcggggccagcacgccctaccacagccccttcgacaccggctacaccttccgtaaccctgaggacatcttccgggagttttttggtggcctggaccctttctcctttgagttctgggacagcccattcaatagtgaccgtggtggccggggccatggcctgaggggggccttctcggcaggctttggagaatttccggccttcatggaggccttctcatccttcaacatgctgggctgcagcgggggcagccacaccaccttctcatccacctccttcgggggctccagttctggcagctcggggttcaagtcggtgatgtcatccaccgagatgatcaatggccacaaggtcaccaccaagcgcatcgtggagaacgggcaggagcgcgtggaggtggaggaagacgggcagctcaagtcggtgactgtgaacggcaaggagcagctcaaatggatggacagcaagtaggcgctggccaccccgccctgccttcccaccaccaccaccgtgcatggggcagcaaacacgtggggccgcagacatagcctgatggttaataaatgtgccaagtgagttcatgg

SEQ ID NO: 43997 - DNA, 461 bp, Homo sapiens
  misc_feature (1)..(1): n is a, c, g, or t
nccttgcggcaacgactctacgttattttccaccgctacagggatgtgttcccccaaggtttacctgatgagtacgcctttgtcacaaccttccggttcaggaaaacctctcggaaggaagactggtatatctggcaggtcatcgaccagtacagcatcccacagctttcagttcccatgaaggtaggacagctctccaccagcacacagtccggtgaggaaagagaaatctgaaattcaaagccatcaacaccatctgttggtttgagataaaagcaacactactatttgttctctgccaaatccaaatccccttgttctcaagtcatagacaaaccgtttctttctcctctcctagtaaaatgaactggatgaagatattactcacttttcagctgggagatactgactaaactttcactgggggctaaaataaaataaaagcatgctcaagcaaaaga

SEQ ID NO: 43998 - DNA, 1356 bp, Homo sapiens
ggtgtctttctccacacaggccatgctgctgtagaccctaacagcgtctcttcctggccaagagaagcctgtccccaagaacaggagagccatggccggcctccgagggaacgctgtggctggcctcctctggatgctgctgctgtggagtgggggcggcggctgccaggctcagcgggcaggttgcaaaagtgtccactacgatctggtcttcctcctggacacctcctccagcgtgggcaaggaggactttgagaaggtccggcagtgggtggccaacctggtggacaccttcgaggtgggccccgaccgcacccgtgtgggggtcgtgcgctacagcgaccggcccaccacggccttcgagttgggactctttggctcgcaggaggaggtcaaggcggctgcccggcgtctcgcctaccacgggggcaacaccaacacgggagacgcgctccgctacatcacggcccgcagcttctccccacacgccggcggccgccccagggaccgcgcctacaagcaggtggccatcctgctcaccgacggccgcagccaggacctggtgctggacgccgcggcggcagcccaccgcgctggcatccgcatctttgccgtgggcgtgggcgaggcactcaaggaggagctggaggagatcgcctcagagcccaagtccgcccacgtcttccacgtgtccgacttcaatgccatcgacaagatccggggcaagctgcggcgccgtctttgtgaaaatgtgctctgtcctagcgttcgtgtagaaggagatcgctttaagcacaccaatggaggaaccaaggaaatcacaggttttgacctgatggatttgttcagtgtgaaggaaatcttggggaagagagagaatggagctcagagttcctatgtacggatgggatccttccctgtggtgcaaagtactgaggatgtgttcccccaaggtttacctgatgagtacgcctttgtcacaaccttccggttcaggaaaacctctcggaaggaagactggtatatctggcaggtcatcgaccagtacagcatcccacagctttcagttcccatgaaggtaggacagctctccaccagcacacagtccggtgaggaaagagaaatctgaaattcaaagccatcaacaccatctgttggtttgagataaaagcaacactactatttgttctctgccaaatccaaatccccttgttctcaagtcatagacaaaccgtttctttctcctctcctagtaaaatgaactggatgaagatattactcacttttcagctgggagatactgactaaactttcactgggggctaaaataaaataaaagcatgctcaagcaaaaga

SEQ ID NO: 43999 - DNA, 1198 bp, Homo sapiens
ggtgtctttctccacacaggccatgctgctgtagaccctaacagcgtctcttcctggccaagagaagcctgtccccaagaacaggagagccatggccggcctccgagggaacgctgtggctggcctcctctggatgctgctgctgtggagtgggggcggcggctgccaggctcagcgggcaggttgcaaaagtgtccactacgatctggtcttcctcctggacacctcctccagcgtgggcaaggaggactttgagaaggtccggcagtgggtggccaacctggtggacaccttcgaggtgggccccgaccgcacccgtgtgggggtcgtgcgctacagcgaccggcccaccacggccttcgagttgggactctttggctcgcaggaggaggtcaaggcggctgcccggcgtctcgcctaccacgggggcaacaccaacacgggagacgcgctccgctacatcacggcccgcagcttctccccacacgccggcggccgccccagggaccgcgcctacaagcaggtggccatcctgctcaccgacggccgcagccaggacctggtgctggacgccgcggcggcagcccaccgcgctggcatccgcatctttgccgtgggcgtgggcgaggcactcaaggaggagctggaggagatcgcctcagagcccaagtccgcccacgtcttccacgtgtccgacttcaatgccatcgacaagatccggggcaagctgcggcgccgtctttgtgaaaatgtgctctgtcctagcgttcgtgtagaaggagatcgctttaagcacaccaatggaggaaccaaggaaatcacaggttttgacctgatggatttgttcagtgtgaaggaaatcttggggaagagagagaatggagctcagagttcctatgtacggatgggatccttccctgtggtgcaaagtactgaggatgtgttcccccaaggtttacctgatgagtacgcctttgtcacaaccttccggttcaggaaaacctctcggaaggaagactggtatatctggcaggtcatcgaccagtacagcatcccacaggtctccatccggctggatggtgaaaacaaggcagtcgagtacaacgctgtgggtgccatgaaagatgctgtcagggtggtcttccgaggttctcgggtcaatgacctctttgaccgggactggcacaagatggccctg

SEQ ID NO: 44000 - DNA, 465 bp, Homo sapiens
ggccctcggtgtccccgctgctactctggcacttggcttgcagcacggtatttttctagagagtttaatggttttgttttccctgcccagcctttgtggttgcccatcaatacctggtgcgagtggcatggagactccagccctgccatcttcctggagtcagagccttccctttccagggagctgagggtctttgttccaggctgccacgtggggactctgctattccaaagaggaggaggaagaaggctgataatatgcattttgcctttcactgccttttgggcaacagtcttggaatgaaaacactaaaaacagatgtaaaaactgagggtgggagatatacctaatgctagatgacacattagtgggtgcagcacaccagcatggcacatgtatacatatgtaactaacctgcacaatgtgcacatgtaccctaaaacttagagtataataaaaaaaaaa

SEQ ID NO: 44001 - DNA, 904 bp, Homo sapiens
  misc_feature (816)..(816): n is a, c, g, or t
gattcccgccctgcttttcgcccgccgttccgtggcgggaactgaggcgactgtggggacatcagtgatcgtaagtctcctgggcccgttattctcagattaggtgacggagctaagacttcgagaccatctcgtcctttttgtatcgcggaaacctgaggaacgagccggcggcggtgacctgcacgagaagccaggctaactgggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaatatcgcccaaaatgtgtggatgaagttgctttccaggaagaagtggttgcagtgctgaaaaaatctttagaaggagcagatcttcctaatctcttgttttacggaccacctggaactggaaaaacatccactattttggcagcagctagagaactctttgggcctgaacttttccgattaagagttcttgagttaaatgcatctgatgaacgtggaatacaagtagttcgagagaaagtgaaaaattttgctcaattaactgtgtcaggaagtcgctcagatgggaagccgtgtccgccttttaagatggtgattctggatgaagcagattctatgacctcagctgctcagggaggtttaagacgtaccatgggaaagggtcgaaaacacccgatctggcttatctgtactatgtcagtcgataattgaccctgactttaatgtcaaatcggttcagccctgagataaatnacaggggttaaatgcgaagaagcaaaggaggagaatttgtagggagagaaaaatttgctcgtcatggagggagaggacgggtgcagtt

SEQ ID NO: 44002 - DNA, 930 bp, Homo sapiens
  misc_feature (675)..(675): n is a, c, g, or t
gattcccgccctgcttttcgcccgccgttccgtggcgggaactgaggcgactgtggggacatcagtgatcggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaatatcgcccaaaatgtgtggatgaagttgctttccaggaagaagtggttgcagtgctgaaaaaatctttagaaggagcagatcttcctaatctcttgttttacggaccacctggaactggaaaaacatccactattttggcagcagctagagaactctttgggcctgaacttttccgattaagagttcttgagttaaatgcatctgatgaacgtggaatacaagtagttcgagagaaagtgaaaaattttgctcaattaactgtgtcaggaagtcgctcagatgggaagccgtgtccgccttttaagatggtgattctggatgaagcagattctatgacctcagctgctcaggcagctttaagacgtaccatggagaaggagtcgaaaaccacccgattctgtcttatctgtaactatgtcagtcgaataattgaacccctgacctctagatgttcaaaattccgnttcaagcctctgtcagataaaattccacagcagggattactagacattgccaagaaggaaaatgtcaaaattagtgatgagggaatagcttatctggttaaagtgtcagaaggagacttaagaaaagccattacatttcttcaaagcgctactccgattaaccagggtgggaaggggatccacgggagaaaggggattacagacattgcggggttatatacaggtgggagaaattgatggggtaattggtgcctg

SEQ ID NO: 44003 - DNA, 1016 bp, Homo sapiens
  misc_feature (761)..(761): n is a, c, g, or t
tcctttattatgtaacatctttgcacaaggctaagtgtattttcgggctgtactttctcataatggttccccaccaccacccccgctttcctatggtgctgattcgcaataaaagtttcaataaaagctttttttttctgtcttgcacctgaccagggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaatatcgcccaaaatgtgtggatgaagttgctttccaggaagaagtggttgcagtgctgaaaaaatctttagaaggagcagatcttcctaatctcttgttttacggaccacctggaactggaaaaacatccactattttggcagcagctagagaactctttgggcctgaacttttccgattaagagttcttgagttaaatgcatctgatgaacgtggaatacaagtagttcgagagaaagtgaaaaattttgctcaattaactgtgtcaggaagtcgctcagatgggaagccgtgtccgccttttaagatggtgattctggatgaagcagattctatgacctcagctgctcaggcagctttaagacgtaccatggagaaggagtcgaaaaccacccgattctgtcttatctgtaactatgtcagtcgaataattgaacccctgacctctagatgttcaaaattccgnttcaagcctctgtcagataaaattccacagcagggattactagacattgccaagaaggaaaatgtcaaaattagtgatgagggaatagcttatctggttaaagtgtcagaaggagacttaagaaaagccattacatttcttcaaagcgctactccgattaaccagggtgggaaggggatccacgggagaaaggggattacagacattgcggggttatatacaggtgggagaaattgatggggtaattggtgcctg

SEQ ID NO: 44004 - DNA, 783 bp, Homo sapiens
  misc_feature (675)..(675): n is a, c, g, or t
gattcccgccctgcttttcgcccgccgttccgtggcgggaactgaggcgactgtggggacatcagtgatcggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaatatcgcccaaaatgtgtggatgaagttgctttccaggaagaagtggttgcagtgctgaaaaaatctttagaaggagcagatcttcctaatctcttgttttacggaccacctggaactggaaaaacatccactattttggcagcagctagagaactctttgggcctgaacttttccgattaagagttcttgagttaaatgcatctgatgaacgtggaatacaagtagttcgagagaaagtgaaaaattttgctcaattaactgtgtcaggaagtcgctcagatgggaagccgtgtccgccttttaagatggtgattctggatgaagcagattctatgacctcagctgctcaggcagctttaagacgtaccatggagaaggagtcgaaaaccacccgattctgtcttatctgtaactatgtcagtcgaataattgaacccctgacctctagatgttcaaaattccgnttcaagcctctgtcagataaaattccacagcagggattactagacattgccacgccggccactgtccacttagcgagagggatcgtcctgtaagggtccggggctcag

SEQ ID NO: 44005 - DNA, 1128 bp, Homo sapiens
  misc_feature (873)..(873): n is a, c, g, or t
gattcccgccctgcttttcgcccgccgttccgtggcgggaactgaggcgactgtggggacatcagtgatcgtaagtctcctgggcccgttattctcagattaggtgacggagctaagacttcgagaccatctcgtcctttttgtatcgcggaaacctgaggaacgagccggcggcggtgacctgcacgagaagccaggctaactggtaacctgctggaggaactgcaagcccgcttcgccttccccactcctgcccttgatgccccttggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaatatcgcccaaaatgtgtggatgaagttgctttccaggaagaagtggttgcagtgctgaaaaaatctttagaaggagcagatcttcctaatctcttgttttacggaccacctggaactggaaaaacatccactattttggcagcagctagagaactctttgggcctgaacttttccgattaagagttcttgagttaaatgcatctgatgaacgtggaatacaagtagttcgagagaaagtgaaaaattttgctcaattaactgtgtcaggaagtcgctcagatgggaagccgtgtccgccttttaagatggtgattctggatgaagcagattctatgacctcagctgctcaggcagctttaagacgtaccatggagaaggagtcgaaaaccacccgattctgtcttatctgtaactatgtcagtcgaataattgaacccctgacctctagatgttcaaaattccgnttcaagcctctgtcagataaaattccacagcagggattactagacattgccaagaaggaaaatgtcaaaattagtgatgagggaatagcttatctggttaaagtgtcagaaggagacttaagaaaagccattacatttcttcaaagcgctactccgattaaccagggtgggaaggggatccacgggagaaaggggattacagacattgcggggttatatacaggtgggagaaattgatggggtaattggtgcctg

SEQ ID NO: 44006 - DNA, 323 bp, Homo sapiens
gtaataataaaattagtgccagtcatggtggctcatgcctgtaatcctaacactttgggatgctgaggcctggagtttgagaccagcctgggcaacatagtgatacccctatctttacaaagattaaaaaatagaaatataaaaagttagccaggcatggtggcacttgtctgtaatcccacttacttgggaggctgaggtgggaggattgtttgagctcaggaggtcaaggctgcggtaagccataattgtattccacccagggtgataaagcatgacgggagatcctgtctcaaaacaaaacaaaaccaaaaaaaggcgag

SEQ ID NO: 44007 - DNA, 565 bp, Homo sapiens
taccttgagaaggttaaagggaagtccaagaagattaaagttttgctgttgctatctagagctcttgaaagcttctgccacttgtgatccaagaacaggaatgcatgttatttgtgtttgggagcaataacacatctatttgagtctatttcaactcgaactagaggaaaacagaatccccaataatttcagtttgtgccttttacagtttttcctcatttattttatttagcgagtttgtgttacacctactcagtgttgtaaaactgccatttcaggacaaatcattttgagttaagaggttctagacttttatggaaaataaagagcactggctgcccgagacaagttccaaagtgaaaatgtaaatgtctcttgatttctccatcgcctcccaggctggattaggccccttctgtgccaagtgataactgtttcttgcctgtctctaactgcatgtttgtactttatctgccaggacaatgtgatctcctcgagggcagggtctgtctttcagatttctatatccacagattagaggttctcataataaatacatttaatg

SEQ ID NO: 44008 - DNA, 330 bp, Homo sapiens
  misc_feature (281)..(281): n is a, c, g, or t
  misc_feature (283)..(283): n is a, c, g, or t
gaggaggatttcttcaatctatatcaccttttatacagaaagctttaagtttagattagcattttccaaaatgtgttttcaagaacatttgttcaaaggtcaaataaatggaaggtaatgcagccccaggttcccccacactctcaccttagtagtcgcatgagtaattctgaccagttcctgcagtaaagaaattatagtttaagctggacatggtggcacttgcctgtagtctcagctacttgggaggtggaggtgggaggatcccttgagccccacanangtttttgagtccagcctgggcaacatagcaagactctctgtctctaa

SEQ ID NO: 44009 - DNA, 382 bp, Homo sapiens
tacttcgtagtatgtctcctcccagaagtaattatagtctggacttttgtgtaatccttgctttacttttcttcagaattgaattatctatatttatattcctaagtaatttttattttacttcatttttttagggtgtttttttgttttgtttttgtttttgaggcagagtctcgctctgtcacccaggctggagtgcagtggtgctatcacgactcaagtgacctcctgggctcaagcgacctttccatctcagcctcctaagtagctggaactacaggtgtgtgccaccatgccaggctattttttgtagtttttgtagagatggggtttcaccctgttgcccaggcttgtctcaaactcctggactcaagcaatccaa

SEQ ID NO: 44010 - DNA, 800 bp, Homo sapiens
ttctcccttgggaccagcagaggttcagcacggccaggcagagggtgtgccagggtggctgtgcccgttgcctggtaagaagtggctctaggcccaaggagcccaagggctccatctgccatccccgccctggaagaatccacagcccccatgtctgcccatgctgagctgctgcccaagtgtttgggatggcacagctggggcatgggagcggggtctccaaccttgagggcgtagagaagtgggaggacaggagggcaggccctgggctgagagagtggcctggcgcagcctcttggcactgacagtgtggggctgtgccagtttcttggcccaggaggtagtacaggggccctcccaaagttcagccctggaggagccccctggctggaggctgctcagagccttcaggccccagctctgcctccttcctcagctggactacagttctaggctctaggctggggtggtggacaatgtggccttggtagctgggcctctggtgggagggccagaaggtggggggctgcagggccacctcagatgcccatcctccacgagcttctgcctttcctgaaaatccctgtggaaggaagaactgaggccaagtctcggggccctgagcctcgggttcctcacctgtgaaatgggctggcccagcaggtacatggagaaaagggggtctgggttggggtccaacgagggtcagaggaaggggcccaaggagaagaccaggggcctcctcaggctatgccaggcagcaaggcccaggacaccctggcttcccaccctcccccagg

SEQ ID NO: 44011 - DNA, 388 bp, Homo sapiens
agctccctgtgaataacccacctcttggcacgtacctgccctacctcaccctgttaagggagctgctaagagaacacaccgaccacagccttccaaagcccggaccactcagcccagacagtccggccataataaccccaggagatcaggtactagtaaaagacctccaggcaagaggtctctccccccagtggaaaggcccctatacggtaattcttacaacaccgacggcagctaaacttataggccttccctcctggtaccatatttcccatcttaagaaggcacctacacaacatcaggccacttggactgtcacctccctttccccaaccaaactgaaactctctccatcaaataccgcatgaattctccatgtgacaggctc

SEQ ID NO: 44012 - DNA, 482 bp, Homo sapiens
tgtttttgtttcctagagtcttgtacagggctgggaatgtttgggtactcaatgatgtgtttttttaattgcaggaatatatataatataaaaattatcatttttccattttcaagtgtatagttcagtgacattaagtacattcgcattgttctgcaaccattgtcaccatccatccacagaactttttcatcttgcaaagctgaagctctatgcttattaaacagtaactccctctccccctccccctccccctctccctctccctctccgtctccctccggtctccctctccctctccccacggtctccctctgatgccgagccgaagctggactgtactgctgccatctcggctcactgcaacctccctgcctgattctcctgcctcagcctgcctagtgcctgctattgcaggcgcgcgccgccacacctgactggttttcgtatttttttggtggagtcggggtttcgctgtgttg

SEQ ID NO: 44013 - DNA, 329 bp, Homo sapiens
catgaagaaaataaagtgttcaacaaaggaataaaaaccatgaaaaagaaccaaacaaattctagtgctaaagaacacagtgaatgaactgaaaacttcaagagtgctccaattggagactcaattgagcagaggaaagaatcagagagcccaaagacaagtcatttgagattacgcagtttgaggaacaaaaagataaaataatgtagacagcctataagaattgtgggacataatcaagccaactaacatatgcattatggaagttcttcaaaaatgaaggggagataaggatgttcccaggcaaacaaaggctgtgggagttcatc

SEQ ID NO: 44014 - DNA, 322 bp, Homo sapiens
ttacaggcatgagccaccgcacttggcctggcctcttcttaaaaactctcctcctctggcttcagggatggacacatttgtccctacaccctgaacacgtttccatcaagaattacatatttcttgtgtacatcttcacatcacattaaaaaaaaaaaccctatcaaagttttctttctcatttgatcggttgataaacacgtatacacagagaacatttccacccacacttcacaagagttactgtgcgggccacaggcagagaacacaaagtgccattgagatgagccccgtagttgtgcagtctcactcataaactgac

SEQ ID NO: 44015 - DNA, 290 bp, Homo sapiens
gctgatgctatctgtaaaaaataataataataataatatagtctattttacatatcaggaaagtgaacatgtttcaatatagccatatatattgagaaggaacttaccaccccttcttccaatcgaggcatttcatttgttggttgaagcagatgagaactgtacagattgaaaatgatttgtttttttttttttttagaaaaaaacgaaaaccaattggtgcaactctccttgtaaccaaaggccctttctgccttctgtggtcatgtaggacctggcccttccttcct

SEQ ID NO: 44016 - DNA, 459 bp, Homo sapiens
gacacattcaaaccatagcatttgatgtgctaattatatatattttaatatgctgggaattaaacacataattgttaacagaagaagaaaaccactcatgtaccatctaatatcatctggtatactcccagtggtatatgtgccaggctttgggaaacactattatttttcttgctttacagttgaggaaacggagagaaaataaggttaagcgacactccctgggtggattttagctagaatccaagcactctgacaccagagccaagcataaccactccagtcttgtagcgcttttctaagcggtcaaagtttgcataaaaaaagcagactgggccgggcacggtggctcacgcctgtaatccgagcactttgggagaccgagacggatggatcacgaggtcaggagatcgagaccatcctggctaacacggtgaaaccctgtctctactaaaaata

SEQ ID NO: 44017 - DNA, 481 bp, Homo sapiens
gctatcttaaccttaattttcaagaaagttctcagtttcttattttttaaaaaatcattccattcttcctcgttggtgcagtattgtcttttgttaatgacagttgtctttttgaaattttcttacattctgtgtattgtttctcagaactgcttctcccaatcatcctcttctttcctatcccacttctctttttaaagaaagaggtgggagggagggaggcagaggagagagtggaagggaggagggtaggggaagctagatttaagtatacgctttctgagtacctgccctccctcgtcttttcaggcatatagactgagctacaaaaaccaaaatgttaattcatttaataaatatctcttttagccctattatgtgctaggcatacttctgggcactggggttaaaatcgtgaatattacaggcgcaatcactgccctctaggtatggggtaaattgcagatgattgaagaaaaaa

SEQ ID NO: 44018 - DNA, 284 bp, Homo sapiens
gagatcgtgccactgcactccagagcctgggcgacagagcgagactccatctcacaagaaaaaaaaaaaaaaggtcatgaggaggtaaagtagtacaatggttgagagttaaaacactggcatcagatagcttggttcaaatccaggcttttcttgttcctagattttcggtcttgagtttacgtcaaattctctaagcctgtttcctcatctctaaaatggggtttatgaggttagattatttcctacaatggctgtgaggaataaacgagttagttcataca

SEQ ID NO: 44019 - DNA, 1083 bp, Homo sapiens
agctcagcttagagaacaggaagtgggagccacataccccgagctggcggcttgagcctgtggtatctaggctcacctcactgcggttggtggaggtgatggaggttgcagcttggccagcatggtagaaaggtggcagggtagactctagattctagagggcaacctctgtttgctcatgctggagcgtggcaggtgcacaatgtttccttgggaatcctcagcagggcacgtctggcttttaccacccagttgcttcgagccaggagatggaggagtcatctgttgcacgctggaggctggagcctgcagatggcatggttctgtggctcacctcgctgcagttggtggcagagacagagactgcagcttgaccagagtggtggagtgagtattgtcatctgcatgagcaaatctggttcatcacatctttgcaacaggaaaaggaagggaggatcatgtgtataatgttttaaggccaagattcacaacaagaacaaagtctttattaacttttgccttcaagaacctgcagtgttgagcccttttttatttctggttggagtgcagtggcatgatcttgactcacagcaacctccacctcccgggttcaagccattctcttccctcagcctcctcagtagctggattacagatatgtatctcaagagcactccacaacaaagattctgcctgcaatcctccacttcaaggtctgttccaggaaacctgtgtaacacagttatgcatagagtggtcttaggaagctgactctaacatgaaaatttagagttggatcttttgctgacatattgaatattcataagagcatatgatacatttgtctatcataaacatgtcatttcaaaaaaccctcaaagttgccttgtagaacataattttaaaactagtgtgtaggaatatttcatatcagttattcagtcttcttaatatctgaaccgaaattaatcttccattctgcttttatttataaataatgatttattgtcagattcaataatttatattttcatttattctaaggtaggaaataccagcataaaaataaattatttgaaacaa

SEQ ID NO: 44020 - DNA, 484 bp, Homo sapiens
  misc_feature (56)..(56): n is a, c, g, or t
ccccactccctaccctccccaaaaaaaaaagcaatctcgagtaatgcctgctcaanatatgtatctcaagagcactccacaacaaagattctgcctgcaatcctccacttcaaggtctgttccaggaaacctgtgtaacacagttatgcatagagtggtcttaggaagctgactctaacatgaaaatttagagttggatcttttgctgacatattgaatattcataagagcatatgatacatttgtctatcataaacatgtcatttcaaaaaaccctcaaagttgccttgtagaacataattttaaaactagtgtgtaggaatatttcatatcagttattcagtcttcttaatatctgaaccgaaattaatcttccattctgcttttatttataaataatgatttattgtcagattcaataatttatattttcatttattctaaggtaggaaataccagcataaaaataaattatttgaaacaa

SEQ ID NO: 44021 - DNA, 1103 bp, Homo sapiens
agctcagcttagagaacaggaagtgggagccacataccccgagctggcggcttgagcctgtggtatctaggctcacctcactgcggttggtggaggtgatggaggttgcagcttggccagcatggtagaaaggtggcagggtagactctagattctagagggcaacctctgtttgctcatgctggagcgtggcaggtgcacaatgtttccttgggaatcctcagcagggcacgtctggcttttaccacccagttgcttcgagccaggagatggaggagtcatctgttgcacgctggaggctggagcctgcagatggcatggttctgtggctcacctcgctgcagttggtggcagagacagagactgcagcttgaccagagtggtggagtgagtattgtcatctgcatgagcaaatctggttcatcacatctttgcaacaggaaaaggaagggaggatcatgtgtataatgttttaaggccaagattcacaacaagaacaaagtctttattaacttttgccttcaagaacctgcagtgttgagcccttttttatttctggttggagtgcagtggcatgatcttgactcacagcaacctccacctcccgggttcaagccattctcttccctcagcctcctcagtagctggattacaggtacctcccaccacacccagatatgtatctcaagagcactccacaacaaagattctgcctgcaatcctccacttcaaggtctgttccaggaaacctgtgtaacacagttatgcatagagtggtcttaggaagctgactctaacatgaaaatttagagttggatcttttgctgacatattgaatattcataagagcatatgatacatttgtctatcataaacatgtcatttcaaaaaaccctcaaagttgccttgtagaacataattttaaaactagtgtgtaggaatatttcatatcagttattcagtcttcttaatatctgaaccgaaattaatcttccattctgcttttatttataaataatgatttattgtcagattcaataatttatattttcatttattctaaggtaggaaataccagcataaaaataaattatttgaaacaa

SEQ ID NO: 44022 - DNA, 478 bp, Homo sapiens
agctctctgcatcacgagatgattattcaattttaggatgacaaggtggttagaaagattttccttagattgagctttgatcgaccttcctttgtctttcacccactggtctgagtccagccctctggagtctcattatacaagttaatccttaataccccttctagttctgcctagaggaggacacaagaaggagggaagcaagaatgaagccacattccaagccacccaagctttcttacatcactctgtctacacataagctgcaggttgtcacatttgacaaattgttttaaaatcttctcttttcctaattcctgccaactcttcctcaccctcacccacagaaacttctctaagaatgacccaggaaggggggagagtcatagaaccccacccctgaggacttttgcagtttaaatagcaatcttgagtagttttcaagtttttattttttataattcttcagaattccttt

SEQ ID NO: 44023 - DNA, 375 bp, Homo sapiens
cccatagtccccatccccaaccactacggggaggtattgggtggcagatctgaggaagctagattatcccgggcaggcacatgggtgtggggagcagagaagaaaatggaaggattctacttctgttcaccctaccctagagtacactctaccctcaccctctagaagccccagatcacagacacccaccctctgtctcaaatcccagctacgtagactttcactccagtttaaaactttaggatctgccaccaccaccagaaagaaaaatatcaatagaaacatacattttttctgcataatttagaagcgtctatgtgtcttctgtcttcctctcaactctacttccttgccaaagagaaatatagcagccct

SEQ ID NO: 44024 - DNA, 508 bp, Homo sapiens
  misc_feature (58)..(58): n is a, c, g, or t
  misc_feature (67)..(67): n is a, c, g, or t
  misc_feature (94)..(94): n is a, c, g, or t
  misc_feature (125)..(125): n is a, c, g, or t
  misc_feature (138)..(138): n is a, c, g, or t
ctaaagaccccctaaatgccccagcctaattaaagtaaccccccggtaaactgcaggnaattgccanggggccctccttcccaagtccccccanggatccacctgtcccccaagtattccccctngccagaagccccngcccctgaccttcagaagaaggaacttcaggcccaagaaggcctggtgaagttcctggaaaccccaaggaagcagagagctcctgcatgagcccttcccctagagagaaatcagtctctgtctctcttagactgaccccctcagtcacagcatggtgctgtgattttgccaagaggcaggggtgggtctgggggaagatggacggtgcttccaaaaggctaaattttagtctcaaaggtttctgattgcggacacataggtgatatctaacttgcttttgtttagccttgaatattttcaaatataatcttcaatatttctgttacaatattgtagcttgcttctgtttataaaaataatgcagcatttg

SEQ ID NO: 44025 - DNA, 219 bp, Homo sapiens
gggtgcccgagctcaggaggtaggaatgtgcctcccagccagacagtccaacgactgccaactaggggaggcctgtgctcctgggctggagggaggccggccgaggttgcagggtccaggcctggaccgggtgaggtgtgcagtcccggcccccttctttctcctgccctagggcaaagggtaggtcctcactgacccatggacagttccggggaagag

SEQ ID NO: 44026 - DNA, 644 bp, Homo sapiens
agtttgatagaaatatctataacacttggaaaattataaattatcgtacaaatataaagattgaaaaataaagattatgacattgcagaagaaacaatgctatttttgtgggtctttttaggtttaactcacttctttctacactccattctccaaaatgattgtgtccttatggcctggtattttctatcatatctagccatttgtatagaaagcaaaataaagatggtaagccaaatgacaaattaagtctatagataaataaagatatatcctattgcaatgcttttgtttttgaaatatcaagtccagcttcattttctggtttagttaaaatgctgtgggaagcttctctggactagaggacattgacctttggaaggcgttggctgctcctgaagaaagctcctggctgtttaaaggaatggggtggagtggaaatacacacagacaggaaacctcacaggtggggagaagagggccacgcccaaaagcaagtcagttcattcaccgatcagatctttaattctaagtaggtctccaaactcaattggccctctcagaaacatgtaggttactgaccttgtgtatcagatctgggttaatgtttatgtcatgcacaaagaaataactctgagtacttt

SEQ ID NO: 44027 - DNA, 410 bp, Homo sapiens
ttggggtctctttttaaatagtgttaacatatttttcatatgtgtagttttgtatgttttacaaccatatataaatcgagtcactcacaatgtatgtacaatatgttcttcagcaatttgcctctctcactcagtatcatgtatctggtctcatctatattgctctatgtatctttagttctttcatttttatttgacattccattgatgaatataccacaatttatatatctgttctgatgatgaacatttggggttttgttttgttttcctaaaaacagtgctgttactgaacattagtaggcagaagaaaaaacaaaacaccttgatctgtgtctcacactttatgcaaaaattgcccaaaatgaaaggactagtccctagaataagtacttgcaaaactcagcagt

SEQ ID NO: 44028 - DNA, 398 bp, Homo sapiens
ccttccaccatgattgtgaggtctccccagccatgtggaactgtaagtccattaaatctctttttcttcccagtcttgggtatgtctttatcagcagcgtgaaaaatgaactaatacaagatcataattagaattacagtaaaactaacttccttgaaaaattctcattaggtagcattcaaaaacatgtcagctcaataccattgacaacttatataatgggttcataagctggttcagaagtaaaggttatgcctgttttgccaagtcaaccccaggataactttgccactgctcgctttatacttcctgaaaatacattatctaagattgttgacttctcttttgaaaacactcaagagaaaatggtaagtattaaatggatgttattctgatgc

SEQ ID NO: 44029 - DNA, 350 bp, Homo sapiens
gagcccgagggaggcccctgagactgcaggtggggagggcagcttggctcagcctggctgtgtgtgggactggggacaagcaagtcacacctatgactcgggctctgctgttccccatctgtctggccgttgcgtctgtctccaaactcccgtttgcatctctccatctgcctccttcactttgtctctgtccgtctctgtctccatgtctgaccctttgggacacacttttaacaggcacggagacaccagccccggcccccaaccctgtgatctgtgccccccgtcccacagctctgagcgctttcaccagcttcaaaaggcacattaattactctaatgaggtcagg

SEQ ID NO: 44030 - DNA, 496 bp, Homo sapiens
atctgttatatagcatggtaaaaataaatttaaaataaacattttccataatactgtttttcatctcactcgttccatctcagtatttaattgcagaactaagtttttttttttttttaacatttaacaacgctcagcaagttgtgtaacttctagaatgggttgtgcctgctctgcaaaagagaaacagccagtgcctgaaaatagcaatcgcttcttccacaagggcttagtttctagccctagctctttagcaaattacctgtgaaaccctgacaaaaaaatctttctgagttacagggtcctctcttctgtaaagtggagataataatacctgctctgcctattgtaataagtctcgatggggaggtaatgaaaaatatgtataaggcaatattgaatgctgtttgtgaaaagttatacaaatactagttgataatattcttatatgatctctaagttcagaaagagagaaccatcaacttgttaaagagac

SEQ ID NO: 44031 - DNA, 461 bp, Homo sapiens
cctgggcatgagtatggggcttgggcaggtctagaaagacagctctgtaaaaatgcctaggtattgtggtgatagcggcgtggtatgtacgtgtgtgtgtgttttaacagtaaccgcaacaaaaccccactaaagagaaaacactcaagtttggaacggtgtgtaaaaccacgctcagcttggtaagttcccatggagtagaaggaacttgaggtcagccatccagtcatcattctccacttcatgaagcgcttgtgttctccctcccctctctcttctgccaacgcctgatctcctattctctaattctcctttccttttcctcatcccctttttgtttcccataacaacataaacagcagcagccgcttactgagggtctactatctgttctatattaatgcaatccttaaaataatctctcaaggtaagtaatattacacctgggaccaggttccttg

SEQ ID NO: 44032 - DNA, 408 bp, Homo sapiens
gattattcttaatacctactacagtgaaaatgctatgtaatagttgttatactctattgtttagggaataatgacaagaaaaaagtttgtacatgttcagtacagttgcaactatcgaaatttttttccaaatacttttgacctatagttagttggttgaatccatggatatggagagctgattgtattgagagaggatactgtttgtgggaatctttataatcccatcattcagagctcagacactagaggcagttaacactgggtttatggcttggcctctactaaggatgtgacttcaaatgcctctccaaatctcagtttcagcttttgtaaaatgtggaataatcatattatttacccagatgattttgtgaggattaaatgagataatgcctagaaaatgct

SEQ ID NO: 44033 - DNA, 440 bp, Homo sapiens
tccatctggagttaccccgtcggtcagcacgtactgctagctaacggatattgggaggtatccagtaagcaagtctgacaaaggaaagtggatgtttagaggggacgagggaagcatcagtaagtcatccccaataagacttcatcccatggtaagattttagaaatacaaggtgctcccagaagttcattgtaccagcccctgctttagttggggcatggggaggtggtgattagaaagatatccccaaagaaataccatttaacagatgccttgtgaatgaatgggtgtcagcccagtggagagaggtgtcagcccaacagagctctgggtggaaagcccagcaagggcagtggcccagcacatctttgtgctcatgaatttctaaatcatttcttttcccttgggaatactggtgctaagttgggtgcaaaagagga

SEQ ID NO: 44034 - DNA, 408 bp, Homo sapiens
tacgttttggaacagtgattcattaattaatgcatttaacaaatgtgtattgcttgccaactatgcgtcaggcactcttctatgcacattattgctataattgccatgatctctatcatcttcatcatacgtctatattagactgtgaatttctcaaaggcagagatggccaggcatggtggctcacacctgtaattccagcattttaggaggccaagacgagaggaccacctgccctgacctcccaaagtgctggaatcacaggcgtgagccactgtgcccagccctgagtgtttctacattatcattatcttcatggctttctgtaatttagtaatttctcttatttttgaagcattgttgggttccctgtggtcactagcaatgcagaccctggaacaactggtc

SEQ ID NO: 44035 - DNA, 333 bp, Homo sapiens
gatggagctcggagcagaaaaacttaaataatagcagtatgggtcaaataagtgggttccaagcttgacaccagaagacagatgtcattctgcaatagcaggagtagattttcctgttggccaaactggatggttgggttgtgatatggtcacagtgtttggacatgtgcaggtggctaccttagtttttccttgcatgttaattgtgtaacagaagtgctttgttcattgtaaagtagaggatctgttccatgctacaatatttttaatgcagttgcctgttgtggaacattttaagattatagaagaacaaaatacagtcaattgagcaat

SEQ ID NO: 44036 - DNA, 282 bp, Homo sapiens
actacagcaggtcatagttggttgatttgacatttcttctgaatactgtcatgcagtattttattatgaaagcaatttctaacccatgtttgattatttacagaagacattatcattactttagaagtttatacattgaagaatgcttatgaccaaaagaaaggttgaggatgaaagtttatgaaaatttatgatttaaatgtatttttttcctttaaaattatatttgtataaatggagatcatatcgtctaaaatataataaaattgaggctaatggtgt

SEQ ID NO: 44037 - DNA, 242 bp, Homo sapiens
ccttcaggataagaaatattaccagggataaggaaacgttctataattacaaagggctaaattcattgagaagacataaaaatcctaaatgtgtatatacacatagttacagaggctcaagatgcatgaagcaaaaatgaacagaactgaaaggggaaatagacaaatccacaattatagttggatatttcaacacttctcagaaactacattatatcaatgtagaaagaaaatcagtaaga

SEQ ID NO: 44038 - DNA, 485 bp, Homo sapiens
gtcattatctttagcttccttggataatagcgaacatcatttcaataaagagtacttaaaattttctacgctttgtttatggctaagaaaactcagtatgtctaatgttgtagttaagcgctgaagtttcttaaggaaatattttttaacgatggaaacaagataagaaataaagcatctacaagtttgtctaaaagttgtagtcttcagaatgttaaacttgactttttctggttaattttagggagatgacactttgcttgttcctattcatgcctatccagtcatgaactcactagactttccttcatttataaatctgtcaaatgttctacttggtgaaaggtgagttaccaaaatgtcaacaaaatgtataggatgtgaaaaactaagagatactcatacaaaaccttagacttttgtttttcctaatggaagttcatccttccacctgaaatagactggacttgtcattgtaaaaggca

SEQ ID NO: 44039 - DNA, 962 bp, Homo sapiens
atggcgacgctccgagcgggcgccggcgctggcgccggccgaatccggcccgggaaccacctccagggacatgacctttggctctaaaaagaagactccatttttcatgataaaatggcagtggtgaaaacccccagcagaggactaaagaatgctaaagaaccctttaataatgcatcaccccatctcttgaagaacctagtggaggagccgaaaaaaagaaaagaagtacctaatcacctcctagaatcaaaggtttatgcaaaacttgtgaataataaggtcatacaggcaagacctggcataatacattttggaggctatcaagtagaaaaacaacaccaacagattctgcatctggtcaatgtttccaatgaagacacacgtgttcatattttacccccgcaaaccaaatactttgagatcaattatgtaagaaaggaacaccacctggtccctggcttgtccctcacggtcaccgttacattttctccagatgagtggcgatactattatgactgcatccgtgttcactgtaagggagatgacactttgcttgttcctattcatgcctatccagtcatgaactcactagactttccttcatttataaatctgtcaaatgttctacttggtgaaagcaaaacttatgttattcctttgcagtgcagctgccctgtagattttgagttttatatcaccttgattcagtctcatcaagcctttgctattgagccaacatcaggaataattccggctaatgggaagatgactgtgactattaagtttacaccctttcagtatgggactgcacaaataaaaatgcagttatggatttcgcagttcaactctcaaccatacgaatgtgtcttcaccggaacatgctatcccaacatggccttaccattagaagagtttgaaaggttgaataccctttctaagaaagtaaacgttcctccaga

SEQ ID NO: 44040 - DNA, 473 bp, Homo sapiens
tgtacccagaaatctgaacgttcgacggtgatctccaaaaagcctcaggcgcatgtcaccacagtaagcaattaacatgtggtaggaacctgtgtggaccattgcttgaatgggcggccactgatccatcatgcgaagcctcatcttctctaccattcctttcatttctgtaccctttttttgtatccaaagtactgcctagaagaggatgagagatgaaagcctgactgtggaggtggatcattttccaaagtgtggggtagggaaggctgaatattcagatccctgttccctctggtgtgactaaggaaagactagacagcttgactttaggaatctcctagtacagcagctcccacttacccatggtttccctttctgtggtttcaactacctgtgtggtcaactgcagtccaaaaatatcaaaagaaaaattccagaaataaacaattcataagttttaaaaaaaaagc

SEQ ID NO: 44041 - DNA, 2014 bp, Homo sapiens
cggtcatatcccagattttaagttccttatcgaaagcagacaatagaacagggatttagcagctccccgagggctgacaccgtctgatgccaggctctccttgttggagggtccaactcataacgcttggtgtcatgtgagcctggaaggtcctgaaatttcttggattcccaaggaaagtcgtggctgcttagggccttagggtccaaagtggaggatttaaggagatgctgagcaatccccagagtctgctgagctttggtttccgagttcagggttttgtcactgactgtttcatcatcttattcttttgatgcactgggggtgtttgagagcaggcacttcaggaatgtggaggctgattcgatgtccccatgtgccatggggaccctggcaatgaccgctggcctgctctgtttcaggattcctactgcagcctctgttgggtgcttggagtgaccggtgtacctcaaggtttggaaggagacgccctttcattcttgtcctggctataggggcactgctgggcctctcgctcttgctgaatggccgggacattggcatcgccctggctgacgtgaccgggaaccacaagtggggcctgctgctgaccgtgtgcggtgtggtgctgatggactttagcgccgactcggcggacaaccccagccacgcctacatgatggacgtgtgcagccccgcagaccaggaccgaggcctgaacatccacgccctcctggcaggtctcggaggaggctttggatacgtggtcggcggaatccactgggataaaacgggcttcgggagggccctggggggacagctccgagtcatttacctcttcactgcggtcaccctgagcgtcaccaccgtcctgaccctggtcagcatccctgagaggccgctgcggccgccgagtgagaagcgggcagccatgaagagccccagcctcccgctgcccccgtccccacccgtcctgccagaggaaggccctggcgacagcctcccgtcgcacacggccaccaacttctccagccccatctcgccgcccagccccctcacgcccaagtacggcagcttcatcagcagggacagctccctgacgggcatcagcgagttcgcctcatcctttggcacggccaacatagacagcgtcctcattgactgcttcacgggcggccacgacagctacctggccatccctggcagcgtccccaggccgcccatcagcgtcagcttcccccgggcccccgacggcttctaccgccaggaccgtggacttctggagggcagagagggtgccctgacctccggctgtgacggggacattctgagggtgggctccttggacacctctaagccgaggtcatcagggattctgaagagacctcagaccttggccatcccggacgcagccggaggagggggtcccgaaaccagcaggagaaggaatgtgaccttcagtcagcaggtggccaatatcctgctcaacggcgtgaagtatgagagcgagctgacgggctccagcgagcgcgcggagcagcctctgtccgtggggcgcctctgctccaccatctgcaacatgcccaaggcgctacgcaccctctgcgtcaaccacttcctgggtgagctcccggccaagcctccccggtggctctcattcgaggggatgttgctcttctacacagattctggtctccctggtcctggggcccctgacctcggccgtgggcagtgccaacggggtgatgtacttctccagcctcgtgtccttcctgggctgcctgtactcctccctgtttgtcatttatgaaattcctcccagcgacgctgcagacgaggagcaccggcccctcctgctgaacgtctgacatcgcggagcctcgactccggacacgcgcctgcacctgggggtctggagcaggccgaccagtgaggaccaaagggccttgttggacagggggacaggctgcctactggaatgtaaatatgtgataaaataataaatgacagcggc

SEQ ID NO: 44042 - DNA, 1731 bp, Homo sapiens
ctgcttttcaacggctgcattctctttggcatcgagttcagctacgccatggagacggcgtacgtgaccccggtgctcctgcagatgggcctgcccgaccagctctacagcctggtgtggttcatcagccccatcctcggattcctactgcagcctctgttgggtgcttggagtgaccggtgtacctcaaggtttggaaggagacgccctttcattcttgtcctggctataggggcactgctgggcctctcgctcttgctgaatggccgggacattggcatcgccctggctgacgtgaccgggaaccacaagtggggcctgctgctgaccgtgtgcggtgtggtgctgatggactttagcgccgactcggcggacaaccccagccacgcctacatgatggacgtgtgcagccccgcagaccaggaccgaggcctgaacatccacgccctcctggcaggtctcggaggaggctttggatacgtggtcggcggaatccactgggataaaacgggcttcgggagggccctggggggacagctccgagtcatttacctcttcactgcggtcaccctgagcgtcaccaccgtcctgaccctggtcagcatccctgagaggccgctgcggccgccgagtgagaagcgggcagccatgaagagccccagcctcccgctgcccccgtccccacccgtcctgccagaggaaggccctggcgacagcctcccgtcgcacacggccaccaacttctccagccccatctcgccgcccagccccctcacgcccaagtacggcagcttcatcagcagggacagctccctgacgggcatcagcgagttcgcctcatcctttggcacggccaacatagacagcgtcctcattgactgcttcacgggcggccacgacagctacctggccatccctggcagcgtccccaggccgcccatcagcgtcagcttcccccgggcccccgacggcttctaccgccaggaccgtggacttctggagggcagagagggtgccctgacctccggctgtgacggggacattctgagggtgggctccttggacacctctaagccgaggtcatcagggattctgaagagacctcagaccttggccatcccggacgcagccggaggagggggtcccgaaaccagcaggagaaggaatgtgaccttcagtcagcaggtggccaatatcctgctcaacggcgtgaagtatgagagcgagctgacgggctccagcgagcgcgcggagcagcctctgtccgtggggcgcctctgctccaccatctgcaacatgcccaaggcgctacgcaccctctgcgtcaaccacttcctgggtgagctcccggccaagcctccccggtggctctcattcgaggggatgttgctcttctacacagattctggtctccctggtcctggggcccctgacctcggccgtgggcagtgccaacggggtgatgtacttctccagcctcgtgtccttcctgggctgcctgtactcctccctgtttgtcatttatgaaattcctcccagcgacgctgcagacgaggagcaccggcccctcctgctgaacgtctgacatcgcggagcctcgactccggacacgcgcctgcacctgggggtctggagcaggccgaccagtgaggaccaaagggccttgttggacagggggacaggctgcctactggaatgtaaatatgtgataaaataataaatgacagcggc

SEQ ID NO: 44043 - DNA, 383 bp, Homo sapiens
cacagcaacaggtggtagacaaccacggggcctgtgtgcattcctccgtttgcaaacccctggcccctggtattctgggatttacactacctcccccaggccctgactgacaagctaatcggtgtgctgggaagcgctgagctattgattccactgtaacagaacaccaccctgtcaatgaaactgcaatgaaatgcttcagcaacgaagaaagggaggcattcgactgttgagcaactggaagaaatttgcttgtaggtagtgcggcagaaatgaaaaagctctccggagcagggccttgaaaagccaggttattaaaaaagccacaaagctggagtctggctgagtggagaaaaacagttatggttcagttaggcgtatct

SEQ ID NO: 44044 - DNA, 960 bp, Homo sapiens
tgctcctgtgttgaatcaatatctagaatatgctcttgacagctctggagcaaaaagccaagtctctgacaaaagaatcagtactaattgggaaataaatcagagtttgctatagctaaaagggaaaaactcccacacatttatctgtcattttgattcgttctttcatcctatgtagtacattttcagggtctcaaagaagctcatctgtctatgaaggtgctcatggaagcatcttgttttacatatgatgaaaatggagagagcacttcttttgacaggaaacttcacttcttgttactgaaaaccgtcacaacagttcattatgtctggctttcagaggtttcctggagttaggagaacaatagacagttaaaatggcaatgtcaagagcattctggggttttataatgagtaccaagggaaattttttctctcgagtttgtaagaaaaaagtaggaggacctatttgggaagcctggggatatgtggaaatgaaaggcaatgctctatttttttaacggagtgttccttctaacctttgtaagctgaaaaaaatattataccatggtttccatgttcttgttattgagttgccagtgaagaagagaagtttctcttcagttgtccctctctgtaggttaaatcagcccctgaaaagacacatttgcagctttctgtatttttctttgattaaacatcagttagaattcttggatccagttttttaattcttgttgtatatgtacggtgcttctggggcttatgatttctaatttagcagcaggagttacttctcttttccctctacctccaaaaaaaaaagatgactcaagcattaggaatatgtttttgggcttattgtataattcaatgtgtatttggatttgcacaatttttaatcttgatttatgtagccctaatgtgatttctaatttttaataaagtttttgaggtact

SEQ ID NO: 44045 - DNA, 575 bp, Homo sapiens
ttacaaatgttaaatgctgtaaactctatacttttatagcatttttaagtttccaatctatgctacaatttcacttttatgtgtaccactttatgtagacatttacctgaatatttaacatattaaagacattcagagggtaccctgactcacacataacctttaagtaaagcatatctgcttattcatcctgtcgttgtctcctccaaagagaggcaacatttcagaaaataagtgggtttccatggtttctgtctctgagttacattcttagctttcaaacaatattgtggagtattttgccttgtgccctgattaataccttaggaggaaatgttcccaggggaagcctatattgaacgtctccttctgaatcactttgcttaaatagagtttcaatttgcctcccaaaagagccctgcgcttactgcgaccactgaaccatttactgcctgattgtaggcacaggtgcactgatttttcagtccaaatatccatgtgcacaaatttatacctggtttagaaatcttgtcctaacactttccttgctctcctctatccaatagcccacaccc

SEQ ID NO: 44046 - DNA, 228 bp, Homo sapiens
gttgaattgcagcagcaaaggaatgacttaaaggcagaatttatcattaaaagcagagtgtaaaatattggaaaattctcagcctggtcatgtaatagagaaggaaagagcatattcaggagaggaatccaagggtcaagctggagccacaggttgctaaagagtttagggtgacaaaaagggatctaggtactaatagtcaagacagtggggaaaaggccacaaagg

SEQ ID NO: 44047 - DNA, 532 bp, Homo sapiens
gcactcattgaaattcttattccttgatgagtcatgctttgcatgctgtttgaagtaagtacaacagacatgctcctagtgagaagtcagactcttacttagacttagcgaaagactctccctcctttcctgcctgccaattttgtgttgaaatattgactttggattgcaaatactatattgcggtgaacgaactttcaggcttattgtaaaacacagttcagaattttaggcacagaacggaaaggtcctgtggaggacctgctggccatgctttctgtgacagctattttttaacctaattttataagtgaaaaaacagaatgagagaatttaaattacctttttgatgccgtctacctggcaggtggttcgatctgctatttggacctgagttctgtatttaagtcctgtgttctttctgttaacactccggggactcctgactgccttttcagaactttatgtgttgcttcattgttgttagtaaagttaactgtatttctgtttaaagaactcttacaaaaaaaaa

SEQ ID NO: 44048 - DNA, 563 bp, Homo sapiens
accaactccaaatagactcatcatacaagccaaattttcggaaccaggatcttgtgttggatattaacaaagtgaagttactgcaggatgtacggaagcttttggtaagctatgatcatcgtttggattacttgtgctcaaaacacatgatcatggaaggagggaggacagtttactttggaatgaataccactgtaagtgatgaggattctcttccctgacaggtgtttgactgtttttttcaaaatataatgccagttctggccgggcatggcggctcatgcttgtaatcctagcactttggaagaccaaggcaggaggatcacttcaggccaggagttctagaccggcctgggcagcatagcaagaccccgtctctacagggggaaaaaaaaaaagttggccgatcatggtggcatgcgcctgtggtctcagctgcttggaaggctgaagcaataggatcacttgagcccgggagttcagggctgcagtgagctaagaccataccactgcactcccaacatgggcaacagagcaagaccttgtcccccaaaaaaaaaaaa

SEQ ID NO: 44049 - DNA, 290 bp, Homo sapiens
aaagaagaataaatgggacattacacaagatcaactgcaagaacaaaccagcaatcctgagaggaaccacagaccctctgaaagaagtggactgcttctgcaggacctgggagacaccccaaatactgttcaatgaagaatgtacagccatgtaggaactacaattgggggaaacaggaataatctaatggaaatagaccgagtcgcgatacctatcaagccccgtcagctcagcttcttcttggcctctctgtgcagcatttctttctcccaggtatggaataggaacc

SEQ ID NO: 44050 - DNA, 367 bp, Homo sapiens
aaagaagaataaatgggacattacacaagatcaactgcaagaacaaaccagcaatcctgagaggaaccacagaccctctgaaagaagtggactgcttctgcaggacctgggagacaccccaaatactctaaggaggagagaggcacaaggtatatctgcagaagtaaccatggatttaaaagtagctacagcatcaatttaaaggttcaatgaagaatgtacagccatgtaggaactacaattgggggaaacaggaataatctaatggaaatagaccgagtcgcgatacctatcaagccccgtcagctcagcttcttcttggcctctctgtgcagcatttctttctcccaggtatggaataggaacc

SEQ ID NO: 44051 - DNA, 410 bp, Homo sapiens
cagttgtataaaagaggaaaactgaggtttagaaagattcaatgacttgctcaaagtcaacagctaatgagagaggaactgagattcaaacccaggtcatctgactcttagttggtgcctctcttgagaatgaggataagagatgggatgaatgagagctggacaagtgatcaaggtattctgggtctaaactcttactccctttcattcattcatttattcactacttcaatgaatgcttattgagttcctataatgtgtcaggacctatgctaggcaccagacatacattagtgcctagatcagacaaggacactgccctcatgaaacttagagtcaaacagaaaacattacaatctgttatttcagatttgtttgggtgttcagaatagagtagaggttgtaggctg

SEQ ID NO: 44052 - DNA, 728 bp, Homo sapiens
ctaatttttgtatttttaggggacacagggtctcaccatgttggccaggctggtctcgaactgctggcctcaagtgatccacccgctttggcctcccagagtgctgggattacaggcgtgagccactgcacccagcctaattactttgaaaaatgggatcacaggccgggcgcggtggctaacgcttgaaatcccagcactttgggaggccgagatgggcggatcacctgaggtcaggaattcgagaccaacgtggccaacacggcaaaacctcgactccaccaaaaataaaaaaaattagccgggcctggcagcgcgtgcctgcagtcccagctactcagcaggctgaggttgggagatcacttgagcccagaaggtggaggttgcagtgagctgagaacccaccattgtactccagcctgcgtgtcagtgagattctgtctcaaaaaaaaaaagaaaagaaaaaaaatctaggctatgctccctagtatgggaaatctagtctagtcatttgacagaatcaggctttgcaggccatattgtctctgtcgtaactaccaactctgctggttaaaagggaagtagccacaaacaatatctgaatgatggattatggctgtgttccaatctttatttgcatagaccagcttttgattgcggccgaaatttggcttacttggccattcgcctttaggggggggattctcctggccggcgttacacgtcgg

SEQ ID NO: 44053 - DNA, 615 bp, Homo sapiens
  misc_feature (45)..(45): n is a, c, g, or t
gggttgggggtagagggtaggaaaagagggcaagatggatgactnaccaacttcgaggccagcctccgactgcctgttagggcagtagaacctaagagccggtccaaggcaacacaaaagacagtgaggctaggtctttcattgcagccaacgatcaagaaagcaactccatcaaatgacactgtctttttaaaaaaaatttttttttcgagactcggtctcaaaaaataataattaacaaaaaaaaaaaaatacaaaagttagttgcacatgttgccatatgctcgtggtcccagctactcagcaggctgaggttgggagatcacttgagcccagaaggtggaggttgcagtgagctgagaacccaccattgtactccagcctgcgtgtcagtgagattctgtctcaaaaaaaaaaagaaaagaaaaaaaatctaggctatgctccctagtatgggaaatctagtctagtcatttgacagaatcaggctttgcaggccatattgtctctgtcgtaactaccaactctgctggttaaaagggaagtagccacaaacaatatctgaatgatggattatggctgtgttccaataaaactttatttgcaaaaacagga

SEQ ID NO: 44054 - DNA, 652 bp, Homo sapiens
ctaatttttgtatttttaggggacacagggtctcaccatgttggccaggctggtctcgaactgctggcctcaagtgatccacccgctttggcctcccagagtgctgggattacaggcgtgagccactgcacccagcctaattactttgaaaaatgggatcacaggccgggcgcggtggctaacgcttgaaatcccagcactttgggaggccgagatgggcggatcacctgaggtcaggaattcgagaccaacgtggccaacacggcaaaacctcgactccaccaaaaataaaaaaaattagccgggcctggcagcgcgtgcctgcagtcccagctactcagcaggctgaggttgggagatcacttgagcccagaaggtggaggttgcagtgagctgagaacccaccattgtactccagcctgcgtgtcagtgagattctgtctcaaaaaaaaaaagaaaagaaaaaaaatctaggctatgctccctagtatgggaaatctagtctagtcatttgacagaatcaggctttgcaggccatattgtctctgtcgtaactaccaactctgctggttaaaagggaagtagccacaaacaatatctgaatgatggattatggctgtgttccaataaaactttatttgcaaaaacagga

SEQ ID NO: 44055 - DNA, 2454 bp, Homo sapiens
ctggcaccattctttaagaaagaagtacaagggaatattagatttttattgtgtggtttcacatcagtgtaattagaatataggaaatttgtttaaaataataggccttttcatttgacgagatttaaaaacacagattggctgtggtatctgggcataatttgatatagataatagtattttcctccatatcgaaaattgaggtaagttttataacctctttgatgcattttcctagtagagttaaaaatgttgaagtatagccaccaaaacattcatgttggttatccttttttttttccttaatgaaaatgtactactttggtggaaaaaagttaataatttcgttagttggtaggtgaataatgagtgatagagactgttctgacaccaattgtctgacaccaactgggtatcctgcaattcatttcaattctgacactaactacccagagttaacacaaactaccaggcacacaaagtgttcatccaccaggaagctccttgaactttgagtttgcagagttttattggccacatgattaacttccttctccagctcctctttaatctctgaacatctgggggtgtggctaaaagttccaaccctctaaccatatgcttggtctgtctggcatggccagctcgtcctttcaaactatgtgagggcctaccttgagtcacccccaagtataaactcagatatagtccaaaggggcttcttatgaataacaaagacacttccattaatcaggaaattccaagcctctctaagctctgtaccaggaacaggagacaaagactagatttattcttcattatatgacagatacatttttatattttgcctctggttttagtaaagtttttgttgtgaagaacacaaatgccagatcaaatgagggggctgtaattagcaaggctgcaagggattgtgagcagtaagggagatagggattttactggaaatccaccaaaggaactggtatgtagctatgcctctcagtaaggggaactagaaagctattaggaaatcaaggcatctggagaaactatgtgtgtgtgcccaccaacatgttcatgtttgcgctgcatttttgctttgtcatcctcttgcctcaggttgttttgctctcttgtttgactttctatgcccttctctaccctagggcttctacttagagtttctgcttccacaggactccttacagcttaagttctagtttatatgtggctatgcatattgaaaacttgggttctttttttggagacagggttgtacaggctgttgcacaggctgtattgcggtggtgtgatcatagctcactgcaaccttgaactcctgggttcaagtgatcctcctgcctcagcctcctaccaccccctgctaatttttgttattgttgttgttgttagagaatggggtctggctatgttgcccaggttggtcttgacctaagggcctcaagtgatcctcccacctcagcctcctaaagcactgtgaatttcaggcatgagcttgagttcttattaactgtcagcctgactggctctttcctagctaggctagtcagctcggctgaggagtcaagggaggacaggcttattactatggaaagcacttccaaaacattaaaatgtttctctttaaagagtgtttatcaatgctcaaacctgaaccagaaaaagaaaaaagaaaaaaaatggaaaagagtgcttaaaatattaaggatattaagcatgtcaatccttttcttattcctaataccaaaagaagaattcctaagataaaagattgataagtgtcatgacatgaaatttaattgagtttaacatatttaagtaaatatttgacttttgattttgtaagatcagccgggagaaaggacaagagagcaagacccaagttcaggcaagcttttattaaacccgccggctgctttatcacagacaaaggaggcagcagcagccagcttacagaatgaggggtttatattggggagggagtttgagggagttctttggtatggccgcatcccggggttgtttgctggtttattctgccacattatcaccttgtgacgtttatggtaccggagattgtaggtaaagtttgtttatgcttcccacgacctccctctgtgcggtccggatggtttgtaattggggtttgctttatagcagcgaggcctgataggtaaagtctgctggcttcactgtggcgcctagataagggcttagaaatgtaaaaaggcttggggcagcatggagaggagttgcagagtggggaggggcaggcagcaccaagaagcttcttgaggcagtttgtccctaacagatttattttcggaaaggaattctgaactctgagaccaaatcagtatatttgtgtatattttttcatatacttccaaagtcttttaattcttaattaacctgatatttaagtgaaaa

SEQ ID NO: 44056 - DNA, 778 bp, Homo sapiens
acctgccacttgactagggtgggcctcaggaccatccaatctgcccgctttggggactggtagcatcttcctggatcgctaaactgcagggaggggcttcccgtgtggatggttggatcagctcacagtcattcttcagggtggagagaggaggctgcagtcccagtgttccagctcaggaccaatgaggttgatttggtgcttgtctcctttctagaggaggcaaggctcttaggatacacccaaaggaccttatgttccggattaggttccgcaggctcctcagcagtgatcagtggtgtggccttctagggaagaccagtgggtaggtgtggaggaacagaatttaattcctcccaggcctttcagcaggccctttaccgttaagaaggaaaaacaaaactattcctttgtgccatggtgcagtagaagttagaagcctatttcatcctgagaggagcatgatgggaatatccctgaaagcagccagaggaagtcagcctttggcaggatgcatgaaccgactctggccccagcaagggcagggaaagtgtgctatgcggtgtgtgtgttcctgggctctgtgttggctacaggatctgcctagtcctctcttgggttgtaggaaacaccatgggatgattgtttttactaattgcagtggttgtgaccccacgattcctctcctcccatgagcacgctgtcttccggagacttctgtcacttctcaccattgctggttatcctccattttgcccagtaactccgctttcctctc

SEQ ID NO: 44057 - DNA, 1083 bp, Homo sapiens
gaggacctgcccttgagtctaggttctgccatccaggaactgtgggaccctagtctagttgcctaactgcctgtctaattcaaggtttcttcatctgtaatgagaatatcttgtgaacttgttatgagaattaaaggagataagtagttaaagctttttaaatagctgtcattatatagtaggttattgtatacatgatcactgattattatttttcagctttccattgtttatataaaaataagtatatgcatttttttcttcctattcccttatctctaagctgaaaagtaaaaggagcttatcatggtaaaactaagataaaaataaacagataggagagctgaattccatttcaagtcctcatgtatatgcttacaaagttccaaattaagcttgggactggttcttacatggcaggtaatccaaaccttttctatttactgaagattttcagctctcttacagaaatacacaggctaccattaaaattgtagggataaattttaaattgaatttgaaaataagagcagtaatccagggaggaaatggctaaggagaatgaaatagaagacacaaaaacaagcaatggcaaccagaagggaatcactaattatgggtatatatatttttccagttgtaaagctttgggttcaggggttcatcagatcctcttaagatagaatcagaattgtaattgtgcctgaagaatggtagtggagtttaaaaaaataaggacttaagacagtgttacctggtgtgtagaaaggacacagttttgaaagaaattgtttttgctttgcaaatttccccccccgcttggaaaactgtattcaaggccacctatatatggcaattaaggccctgactttgtagttatttcgtgtgtttttatttgattgaaactgatgaaagaaacaagatgcccgtactttttaaacagtatttttaaaataaaacattctgaggaaattgagggatcaggagagaggagcacagactaatagaagggctatgcaaaaactagacatgtaatgatacattcttgtttgattacttctcttcgtttctgtattgtgattt

SEQ ID NO: 44058 - DNA, 996 bp, Homo sapiens
ccaggcgtcgcgtctacgcgggggattacagtaacccggttgtcagtgatgagtcagagtgcgtggtgctgatgctgctgccatttcatcacctttgcgagcgcagcatccatccctccgctctcccggcgcctgggcctacccagcttcgggctcccaggccagcgatgcgctcgcggctgagctagatcctgccgagccgcgctctctgaggcgtcggcggggcgccccctcccgccgtccccggtccgggccaaggagacctgcagagccgcggccatggaggccatctggctgtaccagttccggctcattgtcatcggggattccacagtgggcaagtcctgcctgatccgccgcttcaccgagggtcgctttgcccaggtttctgaccccaccgtgggggtggattttttctcccgcttggtggagatcgagccaggaaaacgcatcaagctccagatctgggataccgcgggtcaagagaggttcagatccatcactcgcgcctactacaggaactcagtaggtggtcttctcttatttgacattaccaaccgcaggtccttccagaatgtccatgagtggttagaagagaccaaagtacacgttcagccctaccaaattgtatttgttctggtgggtcacaagtgtgacctggatacacagaggcaagtgactcgccacgaggccgagaaactggctgctgcatacggcatgaagtacattgaaacgtcagcccgagatgccattaatgtggagaaagccttcacagacctgacaagagacatatatgagctggttaaaaggggggagattacaatccaggagggctgggaaggggtgaagagtggatttgtaccaaatgtggttcactcttcagaagaggttgtcaaatcagagaggagatgtttgtgctagtcagttcttttatttccaaaacatgctctcctacttgaactgaaaagtaagagaaataaatagaatctttgtgta

SEQ ID NO: 44059 - DNA, 310 bp, Homo sapiens
gttctggggatcagaccgtgtacatctttggggccattattctgtctgccacagaggcgaggtgaatgcaaggtgaagtgggggtggaacagaaccaacgtggaatctgtgagcctcggggtttcgccctttccagtttccatgactcctcagaacaggacctggcacatgggtgctgtctaggtagatttcagccactgttaccactctgagctcatgccatctgttttgttggcattaaaatgttcttttaggaaaagatggtaaaagtaggtggtggttattgttgcttttaatgtatatatcttgc

SEQ ID NO: 44060 - DNA, 345 bp, Homo sapiens
gtaacccaaatgttcagaaccccagcactgtgctctttcttgtaggtcagattatgcacatcagagtaccatgtgatgaccatatattgatttctgaatagtcctcatctttctctttttgtcctttgctatgctagagttgaaagatctagggctcggcacggtggcttatgcctgcaatcccagcactttgggaagctgtggtgggcggatcgcttaagatcagtagtttgagactagcctggccaacatggtgaaatgccgtctttactaaaaatataaaaactagccaggcatagtggcatatgtctgtaatctcagagacttgggaggctgtggtgggag

SEQ ID NO: 44061 - DNA, 5127 bp, Homo sapiens
  misc_feature (1227)..(1227): n is a, c, g, or t
  misc_feature (1331)..(1331): n is a, c, g, or t
  misc_feature (1555)..(1555): n is a, c, g, or t
  misc_feature (3221)..(3221): n is a, c, g, or t
  misc_feature (3325)..(3325): n is a, c, g, or t
ccgcttggcagcttgattctcaacttccagtactccaaacactcagtcagaaaagtcagtcagctgctttcctgctggcatgttagtcttggccttggcagctgcaggggtgagatgtgctaatgatggggccaagctgagctttgggggtgaagccatcagctgttcccatctccctctggcggaggcaaaatgagaacagctgggaagcaaggccaacatccactcccagaagccgctcctctgccagcagaggtgtcaacagaattccagtcatgtgagccttccaggagtgtatagtgaattcattccatacttaaacattctagtatacaaagaagattgtacaatggagtaagccaacaatggagacactcatctgtttatttttgtaaccttcagaatgaatgctatgattccatatagattgatttctccactaatttatctacaggaaaatcagacgcctgatttgccactaaaatttggacatgtcagatttagtctattcaattcactaagctttacttccagtttcttagtagggagagtctgctccttggagcataatttattcagctgcaatagatggtactcttgaaacttttttctcacatactttagtctcttttctgtttcttgtctctgctctcctttaaaaaggtgattatcatccttctttctccctcagtgctgctgaagactaagccattggttatagaggctcagtgagaaagcaatttcaaaagagggaggcagaaagggctgggataggatatggtctgtaaagctaaatcaagacaactgttttcaagcacaaagctcctagtagaagcatctgcttctcttatggacttcagtgacataaaataatgagatttcttcagcttatctcccctgatgttacttccttatggatttagtgggtcaagagtgctgtgtgttctggcgttgtagttataaaattgacaggtggcttggatcatggccagaattctggacttggagtgagaagtggctctgagttctggcttggcctctttatggctgtgtgaccttgaggaacccactaaatctttctgaacttagtttatttgtcaacaatgagcaaggatgcagcctacctccctgggttgtggtgaattccaaatgagggagaggttggggaatgtgttttgtaatttaaggtcttctcttttgatggtacagggggcacatggtatcacngttcatatgttcattcagtgctgaggtttgtcctcatgccttgaacggcacaagttctcagcatccatgagccaccgtccccttctgctcatggtagatgggtntccaagttaatcccaaagcttgacagagggggtggcagagaattgggagaggaaggcagtttctattcgtttttctcctaccttaaatctcatgtttccatctttgttgtttatcagtctaccattaggggcatctctgttaaccaggactatttgagattgtgttaataatgtgaactctttcaaatatcatttacttatagcacacaaaatggtcaccagtntccttcttctctgctatatgggactcactgtgggctaggcataagggctgtagagaatgaatggtagcagatgcccaggccaggggcatgaattttcctagccttcagcttccactggctttttgagaaagagatgtgggagggaggataagcgtagaatggcaaggcaaataaaatttaacatgcctctcagggtattgggttggcatgaataagaattgctgcagaaataggaacctcacatttgtgggtgaagcagacacataagctcttgacttatatcttaattaccagttagagcaggtgattgcagcagtaaagcccgttaagcactctacatccttgtggctctaaacagtacacatttagaacatccagaatctgacagaaatgttccactctaagaccaaatattggtggtgttttcccaatttacagcaaaacgtaagtgaatggaaagatctctcccacactactaagattgttcatctgaatctttctgaaactaagttgcagctaccattatcttctgacttgcacagcagcaaatgaattttctaaaatgtttactcagttcagtgcatgatcagacaacacccaagggctcctggtgacaggtttatctgtgtacctggaaaacaatcacatttctgagtggtaattgctctttcttcataggatagaattgaggaattccataaagggattttgcctgtgtggtttctgtgctagcactggttcagtagcttctcatacattctcaccatgccctgggaggcaggcactatgaccactctttcttccagataggaaagccaaggctaggacattcagcttgtgcagttatacagctacaaggtgacgcagctgagattatgcacatgaattactgcacaaatagggaatatactagaaatgggacttacacgaataactaatagtgatgacaccggcatttaacaaaacattcagcagactctcgactaatccctttacatgaattatgtggttaaaatatccctatggcccttagaggtatgggccattattatttccattttacagatgaagaaactaaggcatagagaactcatgatttgccttagcccttgcatcttataagaggctgagccaggattgaactaggcagttgattttcagggcccacatgctaaaccactgggctgccaagggaggacctatgatgtccaggaactcttccatactccagaccctttgcagctatctcagcttgtgtttatcttgggacattgggatttgaggagagaacctaggaagacactgagatagaacaatacttgagtctttagctgtgtgaatcccaggaacttgtcctgtgggctctgacctgcaaggactggcaggaaaaacaggactggagacccatttgcagggcctggtatctctgacctttcattttcgcatcaaaggaacatgtggacttaccagctaaaatttattcttcctgaaggagaaacttactgtttaataattaagtatactatcttctgtttcctctcacaaataaaatgcaggactcaacctaataactgctacctatgatggctgtagaaaatacttgtaaacatgataaatgcacatgcatgagtgcatttgttatttattgctgtatgacaaattgccncaacttagtggcttactatcacacctgtgtacaatctcacagcttttgtgggttacgaatctaggcacaacttatctgggtcctctaattcagcttctttcacnggtttcagtcaagatgttagccaggactggatctcattcaaaggctcaactgggaaggatctgctttcaagctcacagaaacatggcagaattcagtcccttgagttgttgaactgaaggtttcagttcctagctggttcccattttcctaatcagtattctctccaatatagaagcttgcttcatcaaggcctgcagactgagaaggcaatataatctgcaaataagacagaatcacaagttgtataatccaatcatggtctgtgaatattgctatagtctactggttaaaaacaagtcactaagtctcttaacctagtgacttgcttaattctaaccctaccagggttacatatgagagtgaataccaggaggcgggggcactgggaaccatctcaacagtctagcacagtgagttaattagataatcagcattgtaaataccaggaatggctttgacaggtgaaagcgtctgttttcagaggtgtccactcactatgtacaggtcctggagctggcagcagcatctgattggtaaggtggctctgtttctgcatttttgttgcttagctgtttcatgtccttttactgcagtgtcttcattgcctttgcctgacagttcttttcccactctcactccaacacttggctgaactcctccttggcttagacttcacttcctcacaggcagccggttcttggtccttcccacccaaccccagtcaaggaaaggtccccctgctaaatgctctcaaaatgctatgtctctgtcagagcacttatcacattctaatcaactgtttgtcttctaggttagaatttaagctctgtggtgacagagaccacatccatcttattctctgttgggtcccccgtgcctagcacatcacagctgctcaataaatattggcatgatgagtaaatagtcccacttggtgtgctgctttttcatttcaacaaatgtgattcactaaagctctactcttaaattttttgtgtttgtacaacctttcatgtaaatgaattttcacatttggaaagtctttttgaaaaaaaataccatgtatccaaatatttgatatggaaaaggtagttagtatatattagtgatacgaaaggaacatcttaaaggaacatcttttggaaatactatgatgctgtaatggatgctaattttcatattgggtagaaaatgtgagctgatagtctaataaaaatcgcaagaggtctctattaattttagcttgttcttatctccctgagaaatgtacagatgcgaggatgggcatgaagaactctatgcatttgcttgggtttggatattctatagctagcatttagtgatctggtgatgataaacttaactatatgtttactttttttcctttttatttcctctaccctcattttaaacttttgaagtgattttagcctaaatgagtaaaaattcaattggggaatgaaatgactccttctaaaacagagctcaccttctgcaactacaaaggcaaaaaaaaacaacaacaacaacaaacttacatcaggctgatttgcaaatcacaagttttactttgttttatgctgctttcttacattgaacttggttattttatttacatccacaatggatagtttcagtggtttgatgaaaatcatttttatgtacaaaaattggaagacttaacatgaaaggttattattgataaactcatagtaattttaaaagtacattccttaaagttgtaccctatttgttgttacaatacatttttcttttggtggtttgacttcagtcctttgta

SEQ ID NO: 44062 - DNA, 320 bp, Homo sapiens
tcaggtaccggcacgagcgccacaagtccatctcaacagtctagcacagtgagttaattagataatcagcattgtaaataccaggaatggctttgacaggtgaaagcgtctgttttcagaggtgtccactcactatgtacaggtcctggagctggcagcagcatctgattggtaaggtggctctgtttctgcatttttgttgcttagctgtttcatgtctcaagttaatggtttacctttttagaaaactccaaatacactttcattgttatttgacttttgagttatgtaatgtctaagagtcttgtctctcgctcgtg

SEQ ID NO: 44063 - DNA, 228 bp, Homo sapiens
tagaatacattggaaagaaaaatctgaaagaagagatcaggttagtagcttttgtctaaatctcagtgtgagataattccccagattttgggcggtggcattggaaatggagaggaaccttttgaccttactccattaagaaagaattggtaaatttattgacaaagtagttatttaatataacatttatttctgatgaccaaagttcactgtatgttttatgtcttt

SEQ ID NO: 44064 - DNA, 1021 bp, Homo sapiens
caaccactaaatgactaaaaataaaagctgaagctatgataggaatgtcttattctaattttggtaatattcattatattttaagtagacagatgtaaataatgggcaaataatgcttttaattattttctttaacccgtcttagagccaagaagcttctttcaaggcagtggtacatggtggaggctatcagagtttctagaataattatctaggctgaaagtcatatctgggctttttggtgatctttctatgtgagcacgtacagctaatttgactaattctcttcaaatatttcttgaagatgtatgttacaacaaggcttaggttataatattagaataggccttctcttttgagtggagtaatatgattattctaataaagatcctttcttcactgaggctactgtttgggagttgaagtaactgggaaatttgaacctacccttctcctttcacattatatcaccagtataagagcagaattgtcagatattccgttaaatattggatacgaaatgttttttaattgataaataatttgtgtgtggcagtatttctgcattcttgtcctataaactaatatcagagttctttggttgctgtgacatgcctcctcagattaatagtgagatttcttcctgtaggtaaccctaatttcttttaaagcaatgatttatggtattatgatctaaatgccttttttttttaagagatgggatctcaccatgttgcccaggctgagctcaagctatcctcccacctcaccttggcttcccaaagtgctgggattacaggcatgagccaccatacccggccctcgatgcatttttaatgttacattagttgctaaaaaataaaacataaaaaagaggccgggcacagtggatcacgcctgtaatcccagctacctgagaggctgaggcagggaaattgcttgaacctgggaggcagaggttgtggtgagccgagatcacgctattgcactcccctgggcaacaagagcaaaacttcatttc

SEQ ID NO: 44065 - DNA, 768 bp, Homo sapiens
aattctcaagatcacatcatgtctgtctgcaaggctgtctgatcttggagagatggtttcatccctgggaaattaaacactatgtgctgagcccctggtaaagacaaataggacctcgtggggctgaatttggtctcgtggtctaagattgcctcacttggtcacagtaatggtaaatacaggtagccacgattccagctgtattgtgcgttcttgggagggttggttccatgggttgttatattgataggtacactggcctcctgcgtttgtggctttctagctctatcagtaaaaaaaagacaaaaatgagcatgacctcctaatggatgttcatttacaaatagtctatttgttttgtgtgttgtaaatcacttcaaaaggattgggttagaaagatgatgttgatgttcttctaatgctccagtgacccacttctgtactcccagaaaggggacgtccccttcctcatggaccctgcgctagatgcttgtgaagatctgcagggagacacgatgcggctggagttgacagacctagggaacaaattttcccagatgcccaaagaaaagagaaagcacagaccatttaggatacagatagtggtttagtactgtcaagatgtggtgtgagggaggagagagggtcaggaccttggatttgatcctgtagactggagccagagatgaattttcaccaggagaatgactcactcaggtttgagtgttcaattgctctggagacagaggttggaggaagcaggctaga

SEQ ID NO: 44066 - DNA, 432 bp, Homo sapiens
tacctcctggtatgcactcccttgtgtagtccccttctatgttgaatcagggcttgcctttgtgactgatagaatatggtagaaatgataaagtgtgacttccaaggctagttcataaaggcattgcagcttctgccttgctctttcttgctaacttgctctgggataagccagctgccatgtcatgaagacattcagtcagggttgtgcagacaccttcttggagaggaagcaaccagccagcaccaacttaccaacatgtgaatgaccttggaagatcttccagccccagtcatgccatcagatgactagagccctctcacagctgactgcaacctcattaaagacttaaagccagaacacccaacagagctgctcttgaattcctgattcatagacacttcgagagataataaattattgttgctttca

SEQ ID NO: 44067 - DNA, 356 bp, Homo sapiens
cttgtgagatggggtcttgctttgctgcccagacttgagtgcagtggcgcgatctcagctcactgcaacctctgcctcctgggttcaagcaattctcctgcctcagtttcccaagtcgctgggactacaggcacgcaccaccacgcccagctaatttttgtatttttagtagagacggggttttgccatattggccaggctggtctcaaactcttgacctcaggtgatccacccacctcagcctcccaaagtgctgggattacaggcgtgagccaccacgcccagcctagatttttctttgaagctttgaattattttgcaaatcaagataagaaactcaggagagttccagaatg

SEQ ID NO: 44068 - DNA, 208 bp, Homo sapiens
gtagagagagaaacaaaaatattttcttagaaatactgactaaaaactccccagatttgatgaaaatcattaatctgaaaattaggaatctcaatgaactccaagtagaatcattaccaaagactaccactcttagacacattatatatgtatatgtagtcacattatatatacacaccttatatatacacccacacacccacacaca

SEQ ID NO: 44069 - DNA, 482 bp, Homo sapiens
tttacctgcaggcttgtttggaataaaaaatgcctccaaattcctaggcaggacaaacttgccccaaagctttgttgttctacattatctctgtgattgtacaggaatctctcttccctcctagattatcagtgtcttggatataattggagctcaaatgcttagggaattgatttaatgttgcttaaaacgtatttgtaggccaggtgtggtggctcacgcctataatgccagcactttaagaggctggggcaggcagatcacttgaggccaggagttcgagaccagccctggcctcaagttggccaacatggcaaaaccccatctttactaataataacaaaaattagtcgggcgtggtggcacatgcctgtaatcctagctactcaagtggctgaacccaggaggtggaggttgcagtgacctgaagtcaccccatcgtactgcagcctgggtaacagagcaagattctgtctttttaa

SEQ ID NO: 44070 - DNA, 459 bp, Homo sapiens
tttgtgttccccacaaattcatatgttgcaattcttacctccagtgtgatggtattaagaggtgggacctttgggaggtgattagggcatgagggtgaagcaatcatgaaggggaagagtaccctctaagaattcctagagagcttatttgtctcttataccaagtgaagatgcagcaagaaggcaccatctgtgaaccgggaaaaaatccttcaccagacatcaaatctgctggagccttgatcttagatttcacagcctccagaactgcaagaaataaatttctgttgcttataagccacctggtttatggtagtttgttatagcaacccaagagtactaagacatgatataacctatactcattttctgctgttatttaacatcttacattagtatggtgtatttgttataattattgaactaatactgatacacaatcattaactaaagtctgtt

SEQ ID NO: 44071 - DNA, 941 bp, Homo sapiens
ggcaaaagaaagaaagaggcagggaaactgaggctcagtgactagacagacgttgcccagagtcatggtcatggaggaagcttgtgctagaatggtggagaggaaaccagagcccagctcctaatgcaaggctctttcattcctttagccaccctcgcccccgccaaaacaaacagacaaaaaactgtcattctcatatgaccacggactctgcgccccggccgcaggcggaggacagggaggagcgcacacgagaaagctcccacgcgcccgcgcctcgcctccgacgggaaggcgcctcttccgaccgtcctggatgcaaattaaatacttccctccgcagaagacttatctcggggtagggccgcagccggatttccaaatcgcgggtttgattttcgctgcgtcctctccgcgacgcgcgcagggagcgcgcccggccacctgcagcctctggctgcggccatctttccgcctggggccacctggcctgcgccctttgtgcccggcccgctccgtgactgttcttcttgccgctacttacagaactcagccgccttagcgtcttagagaagaggacggcatgcatgcggaccccgtccaccacacctggagagcagggagcccttagtccctggacacttaccagggccgccacccctggtccacgcacgtgatgacatctcaccaggggcagcacaccgcccgagtccgcgacactgataacacctcctgcgggcaggagggcgccacagccacccctggtcccctagattgtgtgaggctagcatttctgcccgcctcttggcgtggacagcacgctggaccgagatggaaccacagctttctcttcccaatccctggcctcaccgttttgtttcatacctcaccgtttgtttcaaacctcgtggtgttgaaatgattaaatgagattaaggggt

SEQ ID NO: 44072 - DNA, 203 bp, Homo sapiens
aagcaaggacgtaaaagccaggacaggctgcgctgagggtcactacactaacagacccagacgacacgatggaacgtgaatactgaagccaacaatcttctggaactctcttttccaaaactcatatgctgttttttctaattgggaaatcagggacagggaaacattcgcataattacccaccaacatgttcttcttaacag

SEQ ID NO: 44073 - DNA, 251 bp, Homo sapiens
tttcatttaacttcacaattcagctgcttgtgctgcactttttccccctcggtaaattgtgacagataaattatcgttttactacatttatttctgtgattacaattgttagtcatatctgtcaatacaatttcaaagcttttaaaaaatgctttaggggggaaaactgaattttaactgttaatcatttttttccctttatagcttattgggtcttaaataatatttttgtgaaggccttccaaattgtg

SEQ ID NO: 44074 - DNA, 381 bp, Homo sapiens
aagtcctctcctcatagcttggctctgtctgataatttaaaaaagatgttttccatctaataggtttatccaccctctaagatctttcatatgttcatcccttctggaaagtaagaagaaaaaggactagtcatcctgtctgatgacaaggagaaatggaggcagatgggtttagagggtcatataccatttaaacatagggcagtaattcttccattttgaaaacctgatgaaaatgcacacatacaaaattcttcatacggtttcagggtttcatggacttcctgacactcttccatggaaccctaggagttcaagaacctcaggcaaagaacacctgcccacatggatctggcagcccaagccctctaagcccccaga

SEQ ID NO: 44075 - DNA, 440 bp, Homo sapiens
gtactagatctgaaactgtgtggcggggccctgcaatttgcaacaaacctgattctgacacatgctagtttgaaaaccattgatctagatgttgtgggacatctataccttacatctttcctcacctctccaaagggtcatggccaacactcctataacaaaaagacgggttaagaccaggtatggtggcttatgcctgtagtcccagcactttgggaggattgcttgagcccaggagtttgagaccagcctgggcaacatggtgagaccttatctctacaaaactaaataaattagctgggagcggtggtgtgtgtgcctgttatcccagctactctctgaggactgaggttgcgaagatcatttgagcctgggaggtcaaggctgcagtgagctctggtggtgccacggaactccagcctggttgacagagcaagacc

SEQ ID NO: 44076 - DNA, 1710 bp, Homo sapiens
tgacacaatcacttataaaggatctaaagaacctttacctgaacaaggcagtgaatttcagcgatcaccttctgagcagtgctgccgagggtgatggggggctgtgcggcagcaggtccagctgggtgagtgactacagccagagtacctcagatactattgaaaaaatcaaaaggataaagaatttcaagaccaaaacttttcaagaaaagaaggagcagcttatacctgaaaacagactcctgctgaaggaagtcggacccacgggggaaggaagagtctctgtgattgaacagctgctggatgagggagcagaccccaactgctgtgatgaagacaatcgacccgtcataaccgtggctgttatgaataagcaccatgaagcgattccagttctcgtgcagagaggagcagacatcgaccagcagtgggggccgctcagaaatacagctcttcatgaagcaactctgcttggccttgcaggaagagagagcaccgccactttactgggatgcaatgcaagcatccaaaagaagaatgcaggaggccagacagcatacgacctggctctgaacactggagatgaccttgtcacctcactctttgctgccaagtttggccaagggcttgaggaccaactcgctcaaactaggagcctcagcctggatgactgttagccctgaggcctccacgggacttcatttaagaatacgtgcatggctggcacagtggcttacgcctgtaatcccagcactttgggaggctgaggctggcgtatcacctgaggtcgggagttcaagaccagcctgaccaacatggagaaaccccgtctctactaaaaatacaaaattagtcgggcgtagtggtgcatgcctgtaatcccagttactcgagaggctgaggcaggaaaatcgcttgaacccgggaggcagaggttacagtgagccaagatcgcgccatcgcactccagcctgggcaacaagagcaaaactccatctcaaaaaaaaaaaagaatatgtgcagctctggctattctttaatcatgtctttctgaaatgtgtatttgagattagaaattgaggttgagaggaactcaggagattttttttttaaatcatatgacagtataagccatcagtactaaatggacagctcccagtatactgtggactgtgataaactgaatgtatgttttttaatggtttattgctgcaggttttttgtgtatttgatttttagtttttaacttatttttcaataggtaataattgcacatggttcaaagctaaaaggtatgaagtattatgtagggatacgtccctcccattctgtcccacagccaccacctctctcctcagccagcaatgacatcagcgtcgacttgcctttcccggggttgtgcagagttagatatgcacatacatgtggtataagcacatgtacagaggagtacacatagcatataaacatgtctgtagcacatatatattctttcccctcttttaaaacaaatggtagcaaaccaaccacacactgttctgtatcttgctctgtttgcttgatacatcttgtaagtggctcctaattactatgtaaagattgaccttatttaaatttttttatgttgaaatcatcaatattcccatcattatggtgtgttctttgattgacaaatcagctctcaataaaccacttataagaatgtgtaat

SEQ ID NO: 44077 - DNA, 2706 bp, Homo sapiens
ttcaaagggagacagactttctcaagtgtgcccactgccttgccccccggccatcagatccctttgctcgcttctgtcaagaatgtggctctcctgtcccacccatatttggctgtcgtctcccacccccagaaggagctcagatgggcttgtgtgcagaatgcagaagcttggtacccatgaacactcccatctgcgtggtgtgtgaggcccctcttgctctacagctgcagccacaggcaagcctccacttgaaggagaaggtaatttgccgggcctgtggtacaggaaatcctgctcacctgagatactgtgtcacctgtgagggggccctgccttcatcacaagagtcgatgtgcagtggggataaagcccctcctccgcccactcagaaaggggggaccatttcctgctacagatgtggtcgctggaatctctgggaggcgtccttctgcggctggtgtggagccatgctcggcattcctgctggctgttctgtttgccctaaatgtggggccagcaatcacctgtctgcccgattctgtggctcctgtggtatttgtgtgaagtccctagtgaaacttagcttggacagaagcctggctctagctgctgaggaacctcgccctttttctgagccccgatgtgcctggcagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaagcttatctctgctactgtccacgaagatggttgtgaagttagcatcagactgaattatagtcaagtctcaaacaagaacctttacctgaacaaggcagtgaatttcagcgatcaccttctgagcagtgctgccgagggtgatggggggctgtgcggcagcaggtccagctgggtgagtgactacagccagagtacctcagatactattgaaaaaatcaaaaggataaagaatttcaagaccaaaacttttcaagaaaagaaggagcagcttatacctgaaaacagactcctgctgaaggaagtcggacccacgggggaaggaagagtctctgtgattgaacagctgctggatgagggagcagaccccaactgctgtgatgaagacaatcgacccgtcataaccgtggctgttatgaataagcaccatgaagcgattccagttctcgtgcagagaggagcagacatcgaccagcagtgggggccgctcagaaatacagctcttcatgaagcaactctgcttggccttgcaggaagagagagcaccgccactttactgggatgcaatgcaagcatccaaaagaagaatgcaggaggccagacagcatacgacctggctctgaacactggagatgaccttgtcacctcactctttgctgccaagtttggccaagggcttgaggaccaactcgctcaaactaggagcctcagcctggatgactgttagccctgaggcctccacgggacttcatttaagaatacgtgcatggctggcacagtggcttacgcctgtaatcccagcactttgggaggctgaggctggcgtatcacctgaggtcgggagttcaagaccagcctgaccaacatggagaaaccccgtctctactaaaaatacaaaattagtcgggcgtagtggtgcatgcctgtaatcccagttactcgagaggctgaggcaggaaaatcgcttgaacccgggaggcagaggttacagtgagccaagatcgcgccatcgcactccagcctgggcaacaagagcaaaactccatctcaaaaaaaaaaaagaatatgtgcagctctggctattctttaatcatgtctttctgaaatgtgtatttgagattagaaattgaggttgagaggaactcaggagattttttttttaaatcatatgacagtataagccatcagtactaaatggacagctcccagtatactgtggactgtgataaactgaatgtatgttttttaatggtttattgctgcaggttttttgtgtatttgatttttagtttttaacttatttttcaataggtaataattgcacatggttcaaagctaaaaggtatgaagtattatgtagggatacgtccctcccattctgtcccacagccaccacctctctcctcagccagcaatgacatcagcgtcgacttgcctttcccggggttgtgcagagttagatatgcacatacatgtggtataagcacatgtacagaggagtacacatagcatataaacatgtctgtagcacatatatattctttcccctcttttaaaacaaatggtagcaaaccaaccacacactgttctgtatcttgctctgtttgcttgatacatcttgtaagtggctcctaattactatgtaaagattgaccttatttaaatttttttatgttgaaatcatcaatattcccatcattatggtgtgttctttgattgacaaatcagctctcaataaaccacttataagaatgtgtaat

SEQ ID NO: 44078 - DNA, 2688 bp, Homo sapiens
ttcaaagggagacagactttctcaagtgtgcccactgccttgccccccggccatcagatccctttgctcgcttctgtcaagaatgtggctctcctgtcccacccatatttggctgtcgtctcccacccccagaaggagctcagatgggcttgtgtgcagaatgcagaagcttggtacccatgaacactcccatctgcgtggtgtgtgaggcccctcttgctctacagctgcagccacaggcaagcctccacttgaaggagaaggtaatttgccgggcctgtggtacaggaaatcctgctcacctgagatactgtgtcacctgtgagggggccctgccttcatcacaagagtcgatgtgcagtggggataaagcccctcctccgcccactcagaaaggggggaccatttcctgctacagatgtggtcgctggaatctctgggaggcgtccttctgcggctggtgtggagccatgctcggcattcctgctggctgttctgtttgccctaaatgtggggccagcaatcacctgtctgcccgattctgtggctcctgtggtatttgtgtgaagtccctagtgaaacttagcttggacagaagcctggctctagctgctgaggaacctcgccctttttctgagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaagcttatctctgctactgtccacgaagatggttgtgaagttagcatcagactgaattatagtcaagtctcaaacaagaacctttacctgaacaaggcagtgaatttcagcgatcaccttctgagcagtgctgccgagggtgatggggggctgtgcggcagcaggtccagctgggtgagtgactacagccagagtacctcagatactattgaaaaaatcaaaaggataaagaatttcaagaccaaaacttttcaagaaaagaaggagcagcttatacctgaaaacagactcctgctgaaggaagtcggacccacgggggaaggaagagtctctgtgattgaacagctgctggatgagggagcagaccccaactgctgtgatgaagacaatcgacccgtcataaccgtggctgttatgaataagcaccatgaagcgattccagttctcgtgcagagaggagcagacatcgaccagcagtgggggccgctcagaaatacagctcttcatgaagcaactctgcttggccttgcaggaagagagagcaccgccactttactgggatgcaatgcaagcatccaaaagaagaatgcaggaggccagacagcatacgacctggctctgaacactggagatgaccttgtcacctcactctttgctgccaagtttggccaagggcttgaggaccaactcgctcaaactaggagcctcagcctggatgactgttagccctgaggcctccacgggacttcatttaagaatacgtgcatggctggcacagtggcttacgcctgtaatcccagcactttgggaggctgaggctggcgtatcacctgaggtcgggagttcaagaccagcctgaccaacatggagaaaccccgtctctactaaaaatacaaaattagtcgggcgtagtggtgcatgcctgtaatcccagttactcgagaggctgaggcaggaaaatcgcttgaacccgggaggcagaggttacagtgagccaagatcgcgccatcgcactccagcctgggcaacaagagcaaaactccatctcaaaaaaaaaaaagaatatgtgcagctctggctattctttaatcatgtctttctgaaatgtgtatttgagattagaaattgaggttgagaggaactcaggagattttttttttaaatcatatgacagtataagccatcagtactaaatggacagctcccagtatactgtggactgtgataaactgaatgtatgttttttaatggtttattgctgcaggttttttgtgtatttgatttttagtttttaacttatttttcaataggtaataattgcacatggttcaaagctaaaaggtatgaagtattatgtagggatacgtccctcccattctgtcccacagccaccacctctctcctcagccagcaatgacatcagcgtcgacttgcctttcccggggttgtgcagagttagatatgcacatacatgtggtataagcacatgtacagaggagtacacatagcatataaacatgtctgtagcacatatatattctttcccctcttttaaaacaaatggtagcaaaccaaccacacactgttctgtatcttgctctgtttgcttgatacatcttgtaagtggctcctaattactatgtaaagattgaccttatttaaatttttttatgttgaaatcatcaatattcccatcattatggtgtgttctttgattgacaaatcagctctcaataaaccacttataagaatgtgtaat

SEQ ID NO: 44079 - DNA, 1134 bp, Homo sapiens
ttcaaagggagacagactttctcaagtgtgcccactgccttgccccccggccatcagatccctttgctcgcttctgtcaagaatgtggctctcctgtcccacccatatttggctgtcgtctcccacccccagaaggagctcagatgggcttgtgtgcagaatgcagaagcttggtacccatgaacactcccatctgcgtggtgtgtgaggcccctcttgctctacagctgcagccacaggcaagcctccacttgaaggagaaggtaatttgccgggcctgtggtacaggaaatcctgctcacctgagatactgtgtcacctgtgagggggccctgccttcatcacaagagtcgatgtgcagtggggataaagcccctcctccgcccactcagaaaggggggaccatttcctgctacagatgtggtcgctggaatctctgggaggcgtccttctgcggctggtgtggagccatgctcggcattcctgctggctgttctgtttgccctaaatgtggggccagcaatcacctgtctgcccgattctgtggctcctgtggtatttgtgtgaagtccctagtgaaacttagcttggacagaagcctggctctagctgctgaggaacctcgccctttttctgagccccgatgtgcctggcagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaaggtgggtgagatgaaatttccactccacaagtgtccacgggatcaggctgaaggaaccctccatggactttgcctgaaactgcatcttgcctggctcctttccctttcctgctctgctttctacactttcttactcttctgccttgtgagctctgctctaataaatcacttgcacatgaatattg

SEQ ID NO: 44080 - DNA, 714 bp, Homo sapiens
tccatctatccctggcccccagcccatgtggttttggcagcaataaggtgtgtggggtaatgactcctgaaattaaaatggtgtgtgtatgtgaaggaaaggcgggcaaagctgtggggagcggtggagtggaaggaacaaaggaggtcagtactgggaacgctgaaggtgggaggccatttcataacattacttgttgatgaaattgccatggataccttctttgcccatcagcaggcctagcgtcttggcagtcatggtgacaatgacgttgaaggtgggggctccaccgatgctcttcatacaaagatccgtggtcaattccccatcctgcagcagtgagtccaggaccacagtatatttctggccccccagtgtcagcccattcatgacaaagcttgaccagtctttgccaaccaggacaccaacctcagctggcgtgatgttgaggaaggttttccctgggacggtggcacagatggaaggtgggtccttgttgcccacaatggccgtgtcctaacaggtcccgtccgccacgaggctgtagatggaggtgtccacctggcctttgcgttgctgcaggggctcctctggtcgctgctgctggggccgcctgggctggcgggtgggggaggcggagagctcgatgcaggtgctgtcctcctcgccacgactctgctagctgtgcagtagccctcgctccgccacttaaaa

SEQ ID NO: 44081 - DNA, 414 bp, Homo sapiens
aagggctgggtcaagttcaagaagggaaaggggggcaacccggggaaaggaagggaaatgtactctcaatttcccatatatcttggattgttagagcaggaaggagcctctcattttacagctgagaaaacggcagccctgagaggttgatctatttggtcaacctctgctggtgaagtaaggcagagctgagattggttttgggtctcctggatctctgagatacactcatttccctgggactgtgtgtgtaggtgctcacagagccacagtatactgttgtgtaggttggtcactgcacaaggactcctcaccaaggggctgagtaggggctgaaatctagccatgtcttgtgcactagggcagagtggctgctacccagaggatgtgctcggaggcaccatctggaactgt

SEQ ID NO: 44082 - DNA, 1981 bp, Homo sapiens
aggaaggcaatcgacacagttattagcacatttcagaaaatgaacacccttgtgatagaattaccagctgtatgaaacaaattgtcccatgcaaattaccctataactaggaaagagacactataacccaaatgccataccccctttttcctttgaccatgcctggggtttcaatgccttggcacctgcaatctggaagtaaacagtctgcttgcttcttcaggcacgtgacagtgacaacacagtgactgcctctgaaaagagccctgaggcaaacactctctcctgctgaacaggaggcactgtaacccttacaaacagcttacagttacttgggctacttatttgatcatcataacaggcctacgaggtttttgccccattttacagaatagtaaactaagagccatgaaaatcacttgggccagggtcaaggactcgtgactcctagctcttttcactgcatcatactgctgtcagatgaataaatgattatgaatttgtttacttgggaagagatatgactataaataaatgttctctacatgttaggatatgttttccttattgattacaactcagctataatcctgagggaacatgggaaggaatcaaaggtaaagcccattcaggcattattgacaagagggctttaaacaagtgaataattgcacaactaaaaagacattagaactgtgtgggctataagtgttcttatcactgagacacagtggatttttattgaaaggaaccacgtacagcaatgcggagtgggatagggataaaatacccaccccaaaatgaccttggccacctgtctgccatatacgtacactgagttcctgtctacccaagagagtcagcccttaattctcaggtgaacaaacagctaactgcatcagcaaattggaatggctggcttgaagtttccattattttcttgaagagaggtgatgctttaaattactttttggattgtagccagttcagctaggcaaaagccatacttttcacaattaaaaaaaaaaactattctgactagagtcaggtttctcatatccatcgtgataggaaggcctaagaatggcaaatcgctttgagatataatattgaacttcagtatgaatgtgaccgaatctgaaactttgggaatttgctttagccagaataaagaaaccaaatcatgaaaattatggaagactattctgccacctgtgccccaagttggatgagcaaaccactttggatcagttcacagcattaactacaagtgaactgatcatcttctctatattcatttcacaagagctggcttaggtggggtaattaaattgccaccttcgtggttgtaaaagacaaacaaaacatggcaaatttcattaacacaaaatttcatcaactgctatactgaattatgtttagaagattctgaaagcaagattatccagtgggtaaatgagagtcgactggattctgtcagttcaaaaaaggaaagaaacaaaacttccctacaattttcttcactaaaatttattatatgtacagtattcccactcctggcattttctggcaggtttaaaaatattcagcataaatccagcagaggtggctgagcttaattgcttaaataagttctagaaaatttaaaaatcattttagtagaattcagtaccattgtcactgcaataagtgggttttagaaaataagtgtgaaaagaatcaggtgttaatataatactaaggataaagctttagaagctattttactacataggtaaagaaaagataaactaacttgtaacaaagaccacaactgcatgttggattagattgtctcatatttcagaataaaatgtactgtatacttttcctcactttgttgtgcactgtaatgaaatgtgaaaaatgctttatttagctgtatgtgaatgaaaatatgcttgtatttagtaaaatgattgattatgtgacaaaaaaaatc

SEQ ID NO: 44083 - DNA, 1010 bp, Homo sapiens
  misc_feature (969)..(970): n is a, c, g, or t
  misc_feature (992)..(992): n is a, c, g, or t
aggaaggcaatcgacacagttattagcacatttcagaaaatgaacacccttgtgatagaattaccagctgtatgaaacaaattgtcccatgcaaattaccctataactaggaaagagacactataacccaaatgccataccccctttttcctttgaccatgcctggggtttcaatgccttggcacctgcaatctggaagtaaacagtctgcttgcttcttcaggcacgtgacagtgacaacacagtgactgcctctgaaaagagccctgaggcaaacactctctcctgctgaacaggaggcactgtaacccttacaaacagcttacagttacttgggctacttatttgatcatcataacaggcctacgaggtttttgccccattttacagaatagtaaactaagagccatgaaaatcacttgggccagggtcaaggactcgtgactcctagctcttttcactgcatcatactgctgtcagatgaataaatgattatgaatttgtttacttgggaagagatatgactataaataaatgttctctacatgttaggatatgttttccttattgattacaactcagctataatcctgagggaacatgggaaggaatcaaaggtaaagcccattcaggcattattgacaagagggctttaaacaagtgaataattgcacaactaaaaagacattagaactgtgtgggctataagtgttcttatcactgagacacagtggatttttattgaaaggaaccacgtacagcaatgcggagtgggatagggataaaatacccaccccaaaatgaccttggccacctgtctgccatatacgtacactgagttcctgtctacccaagagagtcagcccttaattctcaggtgaacaaacagctaactgcatcagcaaattggaatggctggcttgaagtttccattattttcttgaagagaggtgatgctttaaattactnnaacctgcagcccgggggatccnctaggtctagatcggcca

SEQ ID NO: 44084 - DNA, 297 bp, Homo sapiens
tgaataggtaattcaaagtaaaaatggcaaataacatatcaaagatgataaagttactgatgctcaattaaatagaaataatgccaataaattattgctataaaaacctcaaatagaagagtcagcataacatggtggttaagagctggcactctgaattcaggtcaccttgattcaaatctctgagaaatcactaaataatggtgtgggttggacaaggtatttaaactttatttgcttcagctttctcaccaatgaaatggcaatgttggtcacagtattatctacctcaggggt

SEQ ID NO: 44085 - DNA, 446 bp, Homo sapiens
agacacttgaatatagaaaatgggcacaaaatgataaactctaatggtaggcatgtctatacaactatataacataagagtattataaatattacatatagattgtatattataatacataaaaatgtatatacatctttatatacattgaaatgtgttcatattggctgggtgtggtggctcacatctgtaatcccagcactttgggaggcctaggcgggcggatcacttgaggtcaggagttcaagaccagcctggccaacatggtgaaaccccgtctctactaaaaatacaaaaattagccgggtgtggtgacccatgcctctaatcccagctacgagggaggctgaggcaggagaatggcttgaacccaggaggtggaggttgcagtgagctgagatcgtgccactacactctagcctgggcgatagagcgagaccccctca

SEQ ID NO: 44086 - DNA, 674 bp, Homo sapiens
gggctgcaggattcggcacgaggaaacccagaggtacttttgaaaaactcctgacgagcatttaaaatagaaattgccaatctttttcaaagttgtttatgtttataatcaggggataaagcaccaattgtagaaaacctgaaaaataacagtgataaaaatgacagacttgtataacatgtatcactaacatacacgtttttatatacttttatttctgtgcattttacatttttaagaatagttttatattgtttatacaatcattactctaacatttttactaataaagaactttttacaccaaaataaaactaatagaaaaaaatggacaagtatgaatgatggttcttaggctaccagtggtctctaaacatgatatggaaaagttcagctctactgttagcccaagaagtgcattattattttggcattattattgataatgaaaggcattaccattttctcacataaaatttgcagatattgaaaaatattccttagctgtatgggagtggggttagttgtggtctttatgaaaagttgattttatgttaccaggaactttagcaactgtatactctttgacccagaaataatttagaaagttattttttggtattctgtggacactgatttgattaaataatttcaccagaattatttatggtggt

SEQ ID NO: 44087 - DNA, 386 bp, Homo sapiens
tggagacactcttgtctaaatgtcacttgcagtgtataagatgtttctttgtcccactttgatttattatccgtgacaacttatattagaaacccagaggtacttttgaaaaactcctgacgagcatttaaaatagaaattgccaatctttttcaaagttgtttatgtttataatcaggggataaagcaccaattgtagaaaacctgaaaaataacagtgataaaaatgacagacttgtataacatgtatcactaacatacacgtttttatatacttttatttctgtgcattttacatttttaagaatagttttatattgtttatacaatcattactctaacatttttactaataaagaactttttacaccaaaataaaactaata

SEQ ID NO: 44088 - DNA, 387 bp, Homo sapiens
ggtgcaatctaaaaattaatgagtatttcatctgtgataaaatctacgtcagacttaagaactgtgcggttaacaatgactcaaaaatacaggatctgccaggtgcagtggctcacacttgtaattccagcactttgggaggtagaggcaggcagatcacttgagtccagaagtttgagaccagcctagatgacatggtgaaaccctgcctctacaaaaaatacagaaattatccaggagtagtggcatgcacctggtgtcccagctacttgggaggctgaggtggaaggatcgtttgaacctgggaggtggaggttgcagtgagccgagatcatgccactgcactccagcctaggcgacagagcgagactctgtctcagaaaaaaa

SEQ ID NO: 44089 - DNA, 561 bp, Homo sapiens
  misc_feature (278)..(278): n is a, c, g, or t
tttttttttcctttagacagagtcttgctctgtctcccaggctggagtgcagtggaataatctcaggtcactgcaacctccgcctcccgggttgttcaagtgattctcctgcctcagcctcctgggtagctgggattacaggtgtccgccaccatgccaggctaattttgtatttttagtagagatggggtttcactatgttggccaggctgatctcgaactcctgacctcaggtgatcacctgcctcagcctcccaaagtgctgggattacaggcgngagccactgcgcctggccgatcttttgagtttctgttcattcattcatcttaacaccatagtgttagggcattctttattttaaacagattatagactggagctaagcttaaattagaagtcacagcatagcccagagataaatagatcaggtacccagataacaggcaaccaaaataaattcacatggttgagccattattttctctaatctcctcagatgaaaccatacttgagatactcagaacatactacactatactcaactggggacatcaagcaat

SEQ ID NO: 44090 - DNA, 848 bp, Homo sapiens
tccacactcctgcaatgcgccaaaaatcacacaggcatctctaccagtcaatcacacccaggcctgtttcaaaagctaacaggtcccgggtgctctcttggaaagtttgctttccaataggatgttcaatagcaagaagtctctggggcctagagacaaaaggacagcaacagattcatgtcatcatctatggactgcagacccctgctagtgcccgcctgcggccccccagtctgccggtgcaccagcctgtcgctcccgtggggcggggggttagtaccagccgcctgctggaaactagcttcctgcttaggcaggaggccaaggactgtgtccccagcacgagcacctggctacctcccccaggcaagagccacggatctctttggcatcatgcgccacctggcacctgcaggggaagctgtcatcagcccccagaacccttgtttctaagggggaaatgggcctactcttcggaaagaaaattccacagggaatatgcctggcaattttccctaggccttcttggttcccccactccactgcctctaacctctgccttatctacagcctgctgaagttcagcaccccttggaaggtgacccaatacctgtccccagaggccccagcgttgaggtggattaagcatatctcagcttggccaagttggcacaatcccaaagccccacactctcctaaattctactgtgagaccaagcacacaggctgggccggaagaaaagctggtgattgttaactctcgtccctgcaagggggggggggggggggccatgacccctggggcatctggtccattctagggcctggtcaagtggctagatctggag

SEQ ID NO: 44091 - DNA, 311 bp, Homo sapiens
gctttgtggcttgttaatctcacttaatgtatctttctacatcagcatgtatggatttacctcatcctttcaatacagtaatccattgaatgagtgtgacataattgatttagccattttcctggacacttgaggattttttttccccctcagtctttgaccattagcagcagtgtgctgtgtagaacattctcaaatatttatatctctgggcactcaaatgggaaggtttcaataaaaagggttttaaggtaatttcacaaactgtcctttctttgcatcatctcccgaaaggaaatactgcctatacc

SEQ ID NO: 44092 - DNA, 490 bp, Homo sapiens
cttaatgaaagaaagtaacgatttatgggataaaaatattccagtggtttgtatttgcttcatacttcaaaagtgttagtccatttattgtttaaagttatattgaaactgatattttcactgctgccaaagcagtacctgacagtagataggtatccacagtcttatgttccttagagttatagaactatgcctctgaaaggggttttaatactttaataaacctggcctaaactgttttatttctaagttgaagaaactgattgtcaagtactttgacttgtccaatctcatacaactaactatggtacatctagagttagatctcagtatcaggggtcccagttgtattctgcttcaccattccacaattttcgatattgattaaaacttttcacactaacttttggaactgtggttattattaatttagttggattcatgtccccttatttatctccttactcctccactgctggccttcataact

SEQ ID NO: 44093 - DNA, 513 bp, Homo sapiens
  misc_feature (20)..(20): n is a, c, g, or t
agctaacagccaccaggatntgaactagaactggggatacaaaggtgagaaactgtgtccttgagaagctcgccactcaggcatgtacaatgcctggtggctgttagctccttccccacttattagattaaacaggacaaatctctccccgtgcatatagcaaatactcctgggacaggaagttcatgaatcaactgtgtacgctgcttcttctttcccttaaccttcactgcattttgctttattaaaacattcctagaatgttcattcctattcaaggtatacataatcaatgacaataaaaactgttaccaattgtataggggtttacgttctgatttagactaaggaagacaaaatattaaaggacggagggagagacatcttacaattagaaggaagaacctggccagcagggaggttttttgttggagttgctgaaagcatacctcgtgtatacgcaggtactgctgggtacaagattaagtcgtttcagaaagaaaccatagtaca

SEQ ID NO: 44094 - DNA, 432 bp, Homo sapiens
accttaacctcccaaatagctgagattacaggcacctgccatcatgcctggctaatttttgtagagatggggttttgccatgttggccaggctggtctcgaactcctgacctcaggtgatcctcccaccttggcctcctgaagtgctgggattacaggcgtgagccaccacgcctggcccatagctcgcttttaaagccttccctcctttcttgcacctcaatgactttcctgccctgtacatttattttgaattaaatgagctggagggtagtagtgttggcggggagtggcccttgcaaatggaactaatgacctgcgtgctggggaaggttgttctgccccgccctgccttctctgctgcaaagcacctctgctgtctcatgatttcctgtggagttctcatcaacgcctctttaagactcaaatggac

SEQ ID NO: 44095 - DNA, 370 bp, Homo sapiens
gtgaattgctcctctcccaaaatgcatttgtatcatgtctttgcagcaagaagtgactatatctctgtgaatgctacatacattaccatattgtaatttaacaccaaaggcattagctgcaccaactttttatttattgtgatcttgaaaaacacatggtcttcacattttttgatgagggtcattaaaaaatatttatggaatatgcatgtcaatcccagatatattgaaatgagtaaaccttcatattatgctgttggctacataacagagcaatagctgggaactactttgccttgggactcttaaaacagggaaaggttttatatacttcattgtccaaagagttatctagataccaagtgatgtg

SEQ ID NO: 44096 - DNA, 414 bp, Homo sapiens
acaggcaatcatttctttgtctttgctgcaggggcatctttggaatcatgtcatccctggtcatcattggctggtgtagtctctcagcttccaagatcttcattgcagccttgcacatggaaggacagcagcttcttgttgcctacccttgtgccatactttatggactttttgccctcctaacaattttctaaagaatgtttgagatggcatttcaagactctgtttgctgtccagattattttggaaatatattaacattcaaatttggtgatatgatttctgttttattgcttttgagagagtaataagcagagagacaaagcagcacttaagggtggtgctctaatagcctgttggtttgaatgatgttttgcttttgagtttggtgcattaaaacatttcaaaatactt

SEQ ID NO: 44097 - DNA, 363 bp, Homo sapiens
gtgtagtatactgtccaaatcttattcctcagggtagagccgtacaataaatgagcctagttttcttccttcttctttaccacaccacttcccttgatcccactgccccatgttctcagaaatcttcagatgccagttttcccctccttcagcttcatcttcacctctcctctctgtgattatacatgtcatcctactaaatccttcctttcattccacctggccctctacccaatgattaccttcaccttttcatatttaccaaatttttccaaagaatactactcattgttcttacttgcatctcaattcctcctaagctgactgcaatcccatgttcttgaaacatctagctgtctttca

SEQ ID NO: 44098 - DNA, 288 bp, Homo sapiens
gctgaggcctcgggtgcagatgagatggtgtctcaggctggcttccccagaaagtaggctctgaaatggatattagcaagcagggaatttacgtagggagagaggatgcagggaatttatgcggggagagacaaaggaaaccaggctgccacgcagccagtgaaggcctcagctgaccccacaaggactccggagccagcagggtccttcggagacatcctcaactaaggcaacggggaagatctttgtgtctcagcactgggctgctgccaaggaaggggcccagcc

SEQ ID NO: 44099 - DNA, 626 bp, Homo sapiens
ttcaggcatgattgcatttgttacctctggataaatgctcatggattgaagcacctgtttaaatcgcaccctacttctagccctgcctccagactcgcctctttgcattcagggagcacagaaatgtggaaccccatctaatgggttcactggcacacagacctcagacaagggggagctgaggactggactctgaccactgttcttggttctaaatttcttcccgaggcccaagaggaggtcacgtccaccagctaaacctagcattcttttctgctggctacaaaatttttagacaaggctttgctccttaaacaattgcaagtttaaaaatctttgaatccagccatctatgacctgtgggcccccacttggagatgttccacgtttttaggtcaagccaatgtacagcctccacctattgatttatgactttgcctgtgacctctgcctccctccctttaaaaactcctacctgtaagccattgaggccagggtctaaatcatgagctgccctgcaatcggtgcctcaatttctctcgccgcaaccctgaggtcagccttggctttgctctgctgcactggtggacccaagctctgttcactgttgtcagcctagggtcctg

SEQ ID NO: 44100 - DNA, 651 bp, Homo sapiens
tcgttagtagagacggggttttaccatgttggtcaggctggtctcaaatgcctgacctcaggtgatctgcccaccttggcctcccaaagtgctgggattaccggtgtgaaacactgtgcccgaccattatatttctttatcaacattttgaaatgattaaatttctgattctcttcatgtatattctggtaacagcactgctgcatagtaaaatgggcaaaaggtagaaagaagaagagagtaacaaaaggtttaaaatacgttcacttattgaaccccatattatctaagttagaccattaaaatggatgctctccagcttgctcaaacaacaaagtatttgtgaactttgcagccatttgcatctttctcggaggcaagcactttataaagaaacacatactttatagtaaaatttgcagccttataggagtaagcgttagattaatgcaataaatacttaatgcagatgacggctaaatcttgggagtgggtgcaagcggcctgctttcctggtagctgatgccttgcatcgcatttgtactctggaacaagttactctgcttgctcttcctgcagttagggaatggttaagtgtctacaacaagttatgactgctttttctggattcaagttttattttatttttat

SEQ ID NO: 44101 - DNA, 191 bp, Homo sapiens
attgatatggattcactaagcagagattctgcatttaatattacagttggaggagttagaaaaggcttagacagtttgattgctttactgaaacatggaccaacaggtggcccacaataaatatgttaaaatgctgaacctggcttgatttatcatagaggaaaggatttagaggattagagagattggga

SEQ ID NO: 44102 - DNA, 344 bp, Homo sapiens
tttttgaggtggagtcttgctgtgtcgcccaggctggagtgcagtggtgcaatctcagctcactgcaagctccgccccccgggttcacaccattctcctgactcagccttccgagcagctgggactactggcacccgccaccaggcccagccaattttttgcatttttagtagacacagggtttcaccgtgttagcgaggatggtctcgatctcctgacctcatgatccgcctgccttggcctcccaaagtgctgggattacaggcgtgagccaccatgcccagcctaaaaactctaatttttaacagagatttgcacatttggaaaacatatctgatgattcg

SEQ ID NO: 44103 - DNA, 387 bp, Homo sapiens
ggccctctagggagcagaatggccaagatgttcactaaaacctacaaaagattactgtgggaaattaaagaatattgaaatcgacataccatgttcatgggtcagaagacctattaatgttactaaatctcctcaatgtgttttattttatttttcgagactccatctcaaaaaaacaaacaaacaaaaaacaaatgttgagggaagagtccagcacttaatatctgaaacataaagctgagtgtattggtagtttaagcaagaagagctgtgcttataagacttagtctctctgagcaaagcagagaactactgtcttttgtagagtggttattaaagtttggtcaagtgtattttggttgcctgttgcactgtgttggcatctgc

SEQ ID NO: 44104 - DNA, 371 bp, Homo sapiens
attaaggcgcaaaaagttaaggaattggcctaaaaagtcacactgcagctagagaatatcaattcaggatttttgaccccagggaaagagtgagcttctaattacagcagggagaggttggggtttggggagatcctatggacggaccagaggtaaagtttgaactaaagacccttaaagctcttgccaccctaagttttataaggatctcaagggccattattttgcttggctatgcctcctggtcttgcgggcaggtggcaggcactgctgaatagtgggaagggcaggatcctggaatcacaggaggccctgcacagttctggaattccataaagagagtacagccttatgatgccccggggttgtag

SEQ ID NO: 44105 - DNA, 405 bp, Homo sapiens
caaaacaataaggggatcctgaatgtaagcacatgtgtgcctgagcatgcaccatacacacaaaacaccctgcaatgtgctagaatcccacagtcatggaattaactgacagttgtgcagctgtgttcagccaataagtcacctttgcctactggccagtgccagtcaagtctccttgggctgagcagtaagggcccaaagtctgatccctgtccttagctgtccaggcaggcactgccaagctcccagaccatgtaccacagaattccatttggcactccacgctcttgtccccagtcctcccactctgctatcagtgctctactctgaagcccaggtatttccaaattcaaatgtcatggtgattcacattaccctataccttcattccatgggttctttctc

SEQ ID NO: 44106 - DNA, 103 bp, Homo sapiens
tttgagggtgaatgttcattattttgattgtggtaatggttttatggctatatctacaggttaaagcttctcaaattgtacatttatatatgtacagcttatt

SEQ ID NO: 44107 - DNA, 856 bp, Homo sapiens
  misc_feature (856)..(856): n is a, c, g, or t
cacacaccataatggcactagcagcaagtccatctacggggagaaatttgatgatgagaacttcatcctaaagcatacaggtcctggcatcttgtccatggcaaatgctggacccaacacaaacagttcccagtttttcatctgcactgccaagactgagtggttggatggcaagcatgtggtctttggcaaggcgaaagaaggcatgaatattgtggaggccatagagcactttgggtccaggaatggcaagaccagcaagaagatcaccactgctgactgtggacaactcttaataagtttgacttgtgttttatcttagccaccagaccattccttctgtaggtcaggagagcacccctccaccccatttgctcgcagtatccttgaatctttgtgctcttgctgcagttccctttgggctccatgttttctctgttttcttccatgactagctggattgcagagttaagtttatgattatgaaataaacactaaataacaaaaataaataaaaaaaaaaagaaaccaacaccaaccacaacgaacaaacaaacaggcaagcccacgccccagccctgccagccacggtgaacgaaacataaacaacaacacacgacaagcgggggagggggccggtacctaactaagtgagcagaggagaaaccacaccgcgcaatagtatgctgacgacgatcgagcaagtatgatatctgcgcacgaggcacgtccctcgcgcgcgtggcatcaccccgtgtggtgaacgcagcccactggggggtagagagctgcgaccactgaggctccggaacaacatggctgtatgaaatcaaacgcgggagggagtggataaacn

SEQ ID NO: 44108 - DNA, 387 bp, Homo sapiens
tatttctgttctcaaggacacatagtgatttttttactctgatcctgtcagaaaatggaattttaaataatattttgctttatgtctaattagagttttaagaactggaatggccccttataaagttatgttagattttattggaagtcactcttatcattagaagtgtttcaatattattgtgtttttttttaaaatcccactgtattctgtcccagtattgatcaccgtgttgattattaatgtttttagaaatgaaaataattttttaaattcacaggcatcccattttacatatgcacaataaaaacaattagtcttaaaagttaaagctggaaactaaagtctaagggattactaactttagcattaacatactgaactaat

SEQ ID NO: 44109 - DNA, 579 bp, Homo sapiens
tatctccttgtatgacaatctcttaactgtttcgagatgatttacttgcttcttaggcttccattaaaaataagcacatgcttatatgggggaaaatgcaaatagtaatataatagcatataaagttaaaaagtggacatctccttctttattgtctccctccctttgaaactctgcccatacccacattctgtgtcttcataggaataaccctgttcatccctactgatgccctgtattgtgatcaagatggttaattgttttagggtataataaattggggatatagtcagagacagtacattttgggagaaccctccattcccagtggcatcaagcagcttgatcaaagaaaagaaaaaggtgtacaccaagatgagatgaggcatacttagtaagcaataataaaacgtcaagatgtcttcatgcatataatcatgacaatgttggatgtgatatctcatccctgtacatctgcatatatatcttatatagcatgttattctttctgcatttcccccttcaatagagctttattgtaaccatttccatctctgtaaaattaagggagggagggga

SEQ ID NO: 44110 - DNA, 2438 bp, Homo sapiens
cgcaagaatgcatacaaactccagggctgctctctcctggagagggagggaggggatttaaaaacctgcagcaacatgggggaggaggctgtttgtccttctctctctggggaagtaactcgctcaaactgccttccttgctgagctgcttcgcgtagctttgaggaaggtctagtgaaattggtctttccattacatctggatgtactaccagagagttctgctgctgttgttttttttagcttttctttctttgagtctttaaagggcaattgtcgacactctgcaaacataccgatttgttgtctgcccactttggagtcttcaatctgggcagtaactatttaccctttttcctgctagcctgtccccctctctggattgaagtcacctgctaagacaatggactaccgaccagactcccggaaatcatgttggtaggatcccagtctttttcgcctggagggcccaatgggatcattagaagccagtcctttgcgggtttcagcggcctccaggaaaggcgatccaggtgtaactccttcattgaaaattcctccgctctcaagaagcctcaggccaaactgaagaaaatgcacaatttaggccacaaaaacaacaatccccccaaagagcctcagcctaaaagggtggaagaagtctacagggccttgaaaaatggacttgatgaatatctggaggttcaccagacggagctggacaagttgacagctcagttaaaagatatgaaaagaaactctcgcctgggtgtactgtatgacctagacaagcaaattaaaacaattgaaagatacatgagacgcctggagtttcatataagtaaggtagatgaactctatgaagcttattgtatccagcgacgcctccaggatggtgccagcaaaatgaagcaagccttcgcaacatcccctgccagcaaagctgcccgggagagtctgacagagatcaatcggagcttcaaggagtacacagagaatatgtgcaccattgaagtggagctagagaatctgctgggagaattctccatcaagatgaaaggtctggctggctttgcacgcctctgtcctggagatcaatatgaaattttcatgaagtatggccggcagcggtggaaactgaaaggcaaaatagaagtaaatggcaagcagagctgggatggagaagaaacagtttttctgcccctgatagttgggttcatctccatcaaggtcacggagctcaaagggctagcaactcacatcctggtaggtagcgtgacctgtgagaccaaagagctgtttgcagcccgacctcaggtagtggctgtcgacatcaatgaccttggtaccatcaaactgaacctggaaatcacctggtatccatttgacgtggaggacatgaccgcatcctcaggcgctgggaacaaggcagcagcccttcagaggagaatgtccatgtacagccagggtaccccggaaacgcccaccttcaaagaccactccttcttttcaaatctacctgatgacatctttgaaaatggaaaggcagccgaggagaaaatgccactgtcgctcagcttcagtgacctgcccaacggggactgcgccctcacctcccactcaacaggctccccttccaactcaacaaatccagaaattaccatcacccctgcggagtttaacctcagcagcttggcctcccagaatgagggtatggatgacaccagctcagcatcttccaggaactccctgggagaaggccaagagccaaagtcacacctgaaggaggaagacccagaggagcccagaaaacctgcctcggccccatctgaggcttgccgccgacagtcctcaggtgctggggctgagcacctgttccttgagaatgatgttgcagaagcacttctgcaagagtctgaggaggcctctgagctcaagcctgtggaactggacacttcggaaggaaacatcacaaagcagctggtcaagaggctcacatctgcagaggtgccaatggccacagacaggctgctctctgagggttctgttggtggagaatctgaaggctgcagatcctttctagatggaagcttagaggatgcttttaatgggcttttacttgcattagaaccacataaagagcagtataaagagtttcaggatctgaaccaagaagtcatgaatttggatgatattctaaaaaagtagagaagatcctctaatggatcccagtgtgcccatccctcaacctcctcagtgatcaactcatggccaatcttgtttcctattcttcaacctgctgacttccctctggattcttctgcaaccagtcccagatattgtgccattttatccatggttgtacttcttttttggatataaagatttttaaatgcattttttaaatgctaacaaaaaataaaaacttgaaacaaaaaa

SEQ ID NO: 44111 - DNA, 461 bp, Homo sapiens
ttttgtaaaacaccgaagacattgccacttggaattagagattggtcagtattcagcattgactcactgacttaaaatttgtctgcttgtggtattttattttggggtgagcactaggcagagggatatagcagttctgtttcccaaggctttgtggttgacatggttttgttttttgttttttttgttttttttcaactttttgttataaaaatttcaaacagaagtagagaagatcctctaatggatcccagtgtgcccatccctcaacctcctcagtgatcaactcatggccaatcttgtttcctattcttcaacctgctgacttccctctggattcttctgcaaccagtcccagatattgtgccattttatccatggttgtacttcttttttggatataaagatttttaaatgcattttttaaatgctaacaaaaaataaaaacttgaaacaaaaaa

SEQ ID NO: 44112 - DNA, 467 bp, Homo sapiens
tgtttaaaattcagttgattttggaagatattttaaaagagaaaaggtattagttgagacaaattaaagtgactctttcaagtaccagaaggacagagaaaagttggagagcaagaaaaagaactagtaaatggtcctagaaagtgaaaatggaaagaagaaaatgaaactagaaatgcaagtgctaatgagacagtaaactctcttgtacttcctcatcattcagtatggtccaggctgtgccaggtgctagtttctgggaccctgaaatgaggatgtgcttggctgactatgagggtgatgattccataacatctgcacaccctaggctgaagagggacgtgtcaagagcctgaactgttggattcttgttgacagacaaatcagatcatgtaagctaaaaaccatctttactttgtgctgtgtagccagagcatatcttatcatttagaatattccttccaaaa

SEQ ID NO: 44113 - DNA, 3054 bp, Homo sapiens
cgcaagaatgcatacaaactccagggctgctctctcctggagagggagggaggggatttaaaaacctgcagcaacatgggggaggaggctgtttgtccttctctctctggggaagtaactcgctcaaactgccttccttgctgagctgcttcgcgtagctttgaggaaggtctagtgaaattggtctttccattacatctggatgtactaccagagagttctgctgctgttgttttttttagcttttctttctttgagtctttaaagggcaattgtcgacactctgcaaacataccgatttgttgtctgcccactttggagtcttcaatctgggcagtaactatttaccctttttcctgctagcctgtccccctctctggattgaagtcacctgctaagacaatggtatgtgctttgactcctcctgatctaaaaggaatagaattacctaacagttgcagggtcatcctttgggggaactagccctgggcttctgctcagctgaagttgtgttttgacaatgcttcttggtctgttgtggtaagtccttacaaaagccaagcaaaagactgaaatacaagttgtgcgctttctgctgtattttcctcttaccttccccccgaccgcccttgtgttcttatctaacctagattatcacatcttttgtgagcactccctttacccttcttattttgcactgtcacagtagtggcacaatcttagctttcagaatattcttaaagatagaaagggagaactagttcaagtaagttcatctctaaagtaacctagtgttttagctttatgacccctaggtgtagaattccgccttaagacttgactgtgttttcagtttgacgcatgacttatctgaagctttgacttggcctatttgtgtgtttttattgttgttgaatggagataaatgttacaacagttttcatgtttttgagggtgtggttgaaccttgttttaaaaaaaaaaattcttgaaggaaacctaaagtgatggacaattttgtgactaccgaccagactcccggaaatcatgttggtaggatcccagtctttttcgcctggagggcccaatgggatcattagaagccagtcctttgcgggtttcagcggcctccaggaaaggcgatccaggtgtaactccttcattgaaaattcctccgctctcaagaagcctcaggccaaactgaagaaaatgcacaatttaggccacaaaaacaacaatccccccaaagagcctcagcctaaaagggtggaagaagtctacagggccttgaaaaatggacttgatgaatatctggaggttcaccagacggagctggacaagttgacagctcagttaaaagatatgaaaagaaactctcgcctgggtgtactgtatgacctagacaagcaaattaaaacaattgaaagatacatgagacgcctggagtttcatataagtaaggtagatgaactctatgaagcttattgtatccagcgacgcctccaggatggtgccagcaaaatgaagcaagccttcgcaacatcccctgccagcaaagctgcccgggagagtctgacagagatcaatcggagcttcaaggagtacacagagaatatgtgcaccattgaagtggagctagagaatctgctgggagaattctccatcaagatgaaaggtctggctggctttgcacgcctctgtcctggagatcaatatgaaattttcatgaagtatggccggcagcggtggaaactgaaaggcaaaatagaagtaaatggcaagcagagctgggatggagaagaaacagtttttctgcccctgatagttgggttcatctccatcaaggtcacggagctcaaagggctagcaactcacatcctggtaggtagcgtgacctgtgagaccaaagagctgtttgcagcccgacctcaggtagtggctgtcgacatcaatgaccttggtaccatcaaactgaacctggaaatcacctggtatccatttgacgtggaggacatgaccgcatcctcaggcgctgggaacaaggcagcagcccttcagaggagaatgtccatgtacagccagggtaccccggaaacgcccaccttcaaagaccactccttcttttcaaatctacctgatgacatctttgaaaatggaaaggcagccgaggagaaaatgccactgtcgctcagcttcagtgacctgcccaacggggactgcgccctcacctcccactcaacaggctccccttccaactcaacaaatccagaaattaccatcacccctgcggagtttaacctcagcagcttggcctcccagaatgagggtatggatgacaccagctcagcatcttccaggaactccctgggagaaggccaagagccaaagtcacacctgaaggaggaagacccagaggagcccagaaaacctgcctcggccccatctgaggcttgccgccgacagtcctcaggtgctggggctgagcacctgttccttgagaatgatgttgcagaagcacttctgcaagagtctgaggaggcctctgagctcaagcctgtggaactggacacttcggaaggaaacatcacaaagcagctggtcaagaggctcacatctgcagaggtgccaatggccacagacaggctgctctctgagggttctgttggtggagaatctgaaggctgcagatcctttctagatggaagcttagaggatgcttttaatgggcttttacttgcattagaaccacataaagagcagtataaagagtttcaggatctgaaccaagaagtcatgaatttggatgatattctaaaaaagtagagaagatcctctaatggatcccagtgtgcccatccctcaacctcctcagtgatcaactcatggccaatcttgtttcctattcttcaacctgctgacttccctctggattcttctgcaaccagtcccagatattgtgccattttatccatggttgtacttcttttttggatataaagatttttaaatgcattttttaaatgctaacaaaaaataaaaacttgaaacaaaaaa

SEQ ID NO: 44114 - DNA, 5276 bp, Homo sapiens
  misc_feature (2574)..(2574): n is a, c, g, or t
  misc_feature (3185)..(3185): n is a, c, g, or t
gcagtgtgactgctgagactgccggggctgctgcctgctgcttctcgcgcctgtcctctccaagatgcagttttttgatgctgaggagctcctggtcgatgaagaggatgatgtttttggtgaaggactaccgaccagactcccggaaatcatgttggtaggatcccagtctttttcgcctggagggcccaatgggatcattagaagccagtcctttgcgggtttcagcggcctccaggaaaggcgatccaggtgtaactccttcattgaaaattcctccgctctcaagaagcctcaggccaaactgaagaaaatgcacaatttaggccacaaaaacaacaatccccccaaagagcctcagcctaaaagggtggaagaagtctacagggccttgaaaaatggacttgatgaatatctggaggttcaccagacggagctggacaagttgacagctcagttaaaagatatgaaaagaaactctcgcctgggtgtactgtatgacctagacaagcaaattaaaacaattgaaagatacatgagacgcctggagtttcatataagtaaggtagatgaactctatgaagcttattgtatccagcgacgcctccaggatggtgccagcaaaatgaagcaagccttcgcaacatcccctgccagcaaagctgcccgggagagtctgacagagatcaatcggagcttcaaggagtacacagagaatatgtgcaccattgaagtggagctagagaatctgctgggagaattctccatcaagatgaaaggtctggctggctttgcacgcctctgtcctggagatcaatatgaaattttcatgaagtatggccggcagcggtggaaactgaaaggcaaaatagaagtaaatggcaagcagagctgggatggagaagaaacagtttttctgcccctgatagttgggttcatctccatcaaggtcacggagctcaaagggctagcaactcacatcctggtaggtagcgtgacctgtgagaccaaagagctgtttgcagcccgacctcaggtagtggctgtcgacatcaatgaccttggtaccatcaaactgaacctggaaatcacctggtatccatttgacgtggaggacatgaccgcatcctcaggcgctgggaacaaggcagcagcccttcagaggagaatgtccatgtacagccagggtaccccggaaacgcccaccttcaaagaccactccttcttttcaaatctacctgatgacatctttgaaaatggaaaggcagccgaggagaaaatgccactgtcgctcagcttcagtgacctgcccaacggggactgcgccctcacctcccactcaacaggctccccttccaactcaacaaatccagaaattaccatcacccctgcggagtttaacctcagcagcttggcctcccagaatgagggtatggatgacaccagctcagcatcttccaggaactccctgggagaaggccaagagccaaagtcacacctgaaggaggaagacccagaggagcccagaaaacctgcctcggccccatctgaggcttgccgccgacagtcctcaggtgctggggctgagcacctgttccttgagaatgatgttgcagaagcacttctgcaagagtctgaggaggcctctgagctcaagcctgtggaactggacacttcggaaggaaacatcacaaagcagctggtcaagaggctcacatctgcagaggtgccaatggccacagacaggctgctctctgagggttctgttggtggagaatctgaaggctgcagatcctttctagatggaagcttagaggatgcttttaatgggcttttacttgcattagaaccacataaagagcagtataaagagtttcaggatctgaaccaagaagtcatgaatttggatgatattctaaaatgcaagccagcagtaagccgcagcaggtcttccagtttaagtctcacagttgaaagtgctttagaaagctttgatttcctgaacacctctgattttgacgaggaggaggatggtgatgaggtttgtaatgttggcggaggtgctgactcagtattttcagacactgagactgagaaacacagttacaggtcggttcacccagaagccagggggcatctcagtgaagcgctcactgaagacacaggagttgggaccagtgtggcaggaagtcctctcccactgaccacaggcaacgagagcctggacatcaccatcgtcaggcacctccagtactgcacccaactcgtgcagcaaattgttttctcaagcaaaaccccatttgtggcaagaagtctcttagagaaactcgcagctgtcagtgatgagaacataggaaatatcagttctgttgtggaagccataccagaatttcacaaaaagctgtctttgctgtcattctggaccaagtgctgcagccctgttggtgtctaccacagcccagcggacagagtgatgaagcagctggaggccagctttgccagaactgtcaacaaagaatatccaggacttgcagacccagtgtttcgaaccctggtgtcccaaattctggaccnggctgagcctctgctttcctccagcctgtcctcggaagtcgtcactgttttccagtattacagttacttcaccagccacggcgtcagtgacctggagagttacctgagccagctggccaggcaagtttccatggttcagactctgcaatcactaagagatgaaaaactgctacaaaccatgagtgaccttgctcccagcaacctcctggcccagcaggaagtactcaggactctggctctgctattaaccagagaggacaacgaagttagcgaggctgtgacgctttacttggcagcagcctccaaaaatcagcatttcagggaaaaggccttgctctattactgtgaagcactaacaaagacaaacctccagctccagaaagcagcttgcctggctctgaaaatccttgaggctactgaaagcattaaaatgctggtgacattgtgtcaatctgatactgaagaaatcagaaatgtggcctcagaaaccctcttgtctctgggagaagatgggcggctggcatatgaacaattggacaaatttcctcgagactgtgttaaagtcggaggtcgtcatggaactgaagttgccacagccttttaattacagnttaactgcctaacagctgtcttaatatctggcccttttcatcaggatggtgctgtggtttgggctggaaattgtttagagcctgagagacacgacaactgaaataaaaatgtaggccaggtgcagtggctcatgcctgtaatcccagtactttgggaggccaacgcaggagaattgcttaagcccaggaggttcaagaccaacctgggcaacatagcaaggccctgtctctacaaaaaaaatagtttaattagtcgggcgtggtggcatgcacctgtagtcccagctacttgggaggctaaggtgggaggattgcttgagcccagaagattcaggctgcagtgagccataattgccccactgcactccagactgggtgacagagcaaaaccctgtctcaaaaaacaaaacaacaacaacaactaaaaaaacatgttatagaaagaattcagagtctcgtttcacagtacctatctacttttcctttggccaatatagaatagggctatggtataattcaaatagattacatcgtcgattgtgtctgataatactcagtgaaagagtccatcttatcttaatatgtatgaaatttaaaaatagccatctttgtacttttttgcaagtttctctataagcttgaaatagtcatgtgatacttcgacaaacatcatatgccttgcagtttttctcggtcgtgttctcagggttgagtagtccccttagctacctaactttactttcaatacaaagcacaaaaaagaatacttcaaataaaagtttgcctgcagaacctggcaaaatgacccattatgagagtttagatgttttaattttatgtgctcccagctactctggagtctgaggtgggaggatcacttgaggcagaggttgcagtaagctgagattacactactgcactccagcccatgtgacagaggaatgagagccagtctcaaaaaaaaaacacaaaaaactcccataatttattttgtttcttttccccatcctgaaaattcccaaatcatgtttccattatggaaaaatgataagtaaatgactaagaactacattaagattatgcctatacacttaaacaaaaaactcaaagcttatgctttttttttttaattaatgagagctattttttatgatattcttaccataggggtgttttgctgctaagacaaatcaaaaccaaaagctgtagattcacaaacctgtgatgctctttgaggtggaggaacctagaagtcagagaaatcctaatggagtaggagtggaggaacatttaaagtggtccctccttctgtaaaaatgaccgtgggattagaaagaaggacatcctgaggggtggttactgcccccagggaaatcactcactggtaggattccctggccaaatagttcaaacatcaggtcccattattgcttcagtatcagagatgcaagttcattaagcaaagtacaagaccattcagtagctcttattaaaatatcttttcttcctctaaagagtgtacaaggtggggtatgccaaggtatcaaaacaatatatgtgagtgtaatttaaactgtggaatatcaactgtactatggacgtgtttgtatcatttagatgtcattttaaatatttacattttagcaagacttttaaaaaggactcatttcatttcaaagtgcaaattgtttgccaggcttctggcaaatggttctttcaactgtgaacttatcgtgtacatatctgtatatttataaatattatatatattcatacatccttcactttaaaggtacattgtacagtctgtagttaggaggtatagcctatagcttatgttaaatggttgaaatggttctttttatagaaagtcaaacacagatgttacaggattttgtgtttggtttgtcattttttttattttttattttgactattgcatgagtaattaattccagatcttttgtattcacttctgtattttatgtttggttgaggggtgcttttagttgtgtggcatttgtattcattgatctttcagtcatgtaagttaaaataaaaattatttttgaattactagcaaaaaaaaaa

SEQ ID NO: 44115 - DNA, 5533 bp, Homo sapiens
  misc_feature (2831)..(2831): n is a, c, g, or t
  misc_feature (3442)..(3442): n is a, c, g, or t
tttttttaagaaaagaacaaaaaggggggggttaagttttctttttcatttttatacgtctggacttaacttccaggatagctgcaagacccttttgttcctttgccatgagcaggttttaggccgctctgttgggaccatggtgttaccttcgcgattacactggatcagaaacaggccatggagggacaggatccggaggcgccagctcaaccgttgcttagagtccccagaaagctggcccaacctacctatttcacgaaacctgaccctaaagatgtcctgaaaagccctgagacccttcacgtgcagaggctgagagggcaatctaatgactctactgctgaatttgcaaggatacgggtttataaccgttggtaaggactaccgaccagactcccggaaatcatgttggtaggatcccagtctttttcgcctggagggcccaatgggatcattagaagccagtcctttgcgggtttcagcggcctccaggaaaggcgatccaggtgtaactccttcattgaaaattcctccgctctcaagaagcctcaggccaaactgaagaaaatgcacaatttaggccacaaaaacaacaatccccccaaagagcctcagcctaaaagggtggaagaagtctacagggccttgaaaaatggacttgatgaatatctggaggttcaccagacggagctggacaagttgacagctcagttaaaagatatgaaaagaaactctcgcctgggtgtactgtatgacctagacaagcaaattaaaacaattgaaagatacatgagacgcctggagtttcatataagtaaggtagatgaactctatgaagcttattgtatccagcgacgcctccaggatggtgccagcaaaatgaagcaagccttcgcaacatcccctgccagcaaagctgcccgggagagtctgacagagatcaatcggagcttcaaggagtacacagagaatatgtgcaccattgaagtggagctagagaatctgctgggagaattctccatcaagatgaaaggtctggctggctttgcacgcctctgtcctggagatcaatatgaaattttcatgaagtatggccggcagcggtggaaactgaaaggcaaaatagaagtaaatggcaagcagagctgggatggagaagaaacagtttttctgcccctgatagttgggttcatctccatcaaggtcacggagctcaaagggctagcaactcacatcctggtaggtagcgtgacctgtgagaccaaagagctgtttgcagcccgacctcaggtagtggctgtcgacatcaatgaccttggtaccatcaaactgaacctggaaatcacctggtatccatttgacgtggaggacatgaccgcatcctcaggcgctgggaacaaggcagcagcccttcagaggagaatgtccatgtacagccagggtaccccggaaacgcccaccttcaaagaccactccttcttttcaaatctacctgatgacatctttgaaaatggaaaggcagccgaggagaaaatgccactgtcgctcagcttcagtgacctgcccaacggggactgcgccctcacctcccactcaacaggctccccttccaactcaacaaatccagaaattaccatcacccctgcggagtttaacctcagcagcttggcctcccagaatgagggtatggatgacaccagctcagcatcttccaggaactccctgggagaaggccaagagccaaagtcacacctgaaggaggaagacccagaggagcccagaaaacctgcctcggccccatctgaggcttgccgccgacagtcctcaggtgctggggctgagcacctgttccttgagaatgatgttgcagaagcacttctgcaagagtctgaggaggcctctgagctcaagcctgtggaactggacacttcggaaggaaacatcacaaagcagctggtcaagaggctcacatctgcagaggtgccaatggccacagacaggctgctctctgagggttctgttggtggagaatctgaaggctgcagatcctttctagatggaagcttagaggatgcttttaatgggcttttacttgcattagaaccacataaagagcagtataaagagtttcaggatctgaaccaagaagtcatgaatttggatgatattctaaaatgcaagccagcagtaagccgcagcaggtcttccagtttaagtctcacagttgaaagtgctttagaaagctttgatttcctgaacacctctgattttgacgaggaggaggatggtgatgaggtttgtaatgttggcggaggtgctgactcagtattttcagacactgagactgagaaacacagttacaggtcggttcacccagaagccagggggcatctcagtgaagcgctcactgaagacacaggagttgggaccagtgtggcaggaagtcctctcccactgaccacaggcaacgagagcctggacatcaccatcgtcaggcacctccagtactgcacccaactcgtgcagcaaattgttttctcaagcaaaaccccatttgtggcaagaagtctcttagagaaactcgcagctgtcagtgatgagaacataggaaatatcagttctgttgtggaagccataccagaatttcacaaaaagctgtctttgctgtcattctggaccaagtgctgcagccctgttggtgtctaccacagcccagcggacagagtgatgaagcagctggaggccagctttgccagaactgtcaacaaagaatatccaggacttgcagacccagtgtttcgaaccctggtgtcccaaattctggaccnggctgagcctctgctttcctccagcctgtcctcggaagtcgtcactgttttccagtattacagttacttcaccagccacggcgtcagtgacctggagagttacctgagccagctggccaggcaagtttccatggttcagactctgcaatcactaagagatgaaaaactgctacaaaccatgagtgaccttgctcccagcaacctcctggcccagcaggaagtactcaggactctggctctgctattaaccagagaggacaacgaagttagcgaggctgtgacgctttacttggcagcagcctccaaaaatcagcatttcagggaaaaggccttgctctattactgtgaagcactaacaaagacaaacctccagctccagaaagcagcttgcctggctctgaaaatccttgaggctactgaaagcattaaaatgctggtgacattgtgtcaatctgatactgaagaaatcagaaatgtggcctcagaaaccctcttgtctctgggagaagatgggcggctggcatatgaacaattggacaaatttcctcgagactgtgttaaagtcggaggtcgtcatggaactgaagttgccacagccttttaattacagnttaactgcctaacagctgtcttaatatctggcccttttcatcaggatggtgctgtggtttgggctggaaattgtttagagcctgagagacacgacaactgaaataaaaatgtaggccaggtgcagtggctcatgcctgtaatcccagtactttgggaggccaacgcaggagaattgcttaagcccaggaggttcaagaccaacctgggcaacatagcaaggccctgtctctacaaaaaaaatagtttaattagtcgggcgtggtggcatgcacctgtagtcccagctacttgggaggctaaggtgggaggattgcttgagcccagaagattcaggctgcagtgagccataattgccccactgcactccagactgggtgacagagcaaaaccctgtctcaaaaaacaaaacaacaacaacaactaaaaaaacatgttatagaaagaattcagagtctcgtttcacagtacctatctacttttcctttggccaatatagaatagggctatggtataattcaaatagattacatcgtcgattgtgtctgataatactcagtgaaagagtccatcttatcttaatatgtatgaaatttaaaaatagccatctttgtacttttttgcaagtttctctataagcttgaaatagtcatgtgatacttcgacaaacatcatatgccttgcagtttttctcggtcgtgttctcagggttgagtagtccccttagctacctaactttactttcaatacaaagcacaaaaaagaatacttcaaataaaagtttgcctgcagaacctggcaaaatgacccattatgagagtttagatgttttaattttatgtgctcccagctactctggagtctgaggtgggaggatcacttgaggcagaggttgcagtaagctgagattacactactgcactccagcccatgtgacagaggaatgagagccagtctcaaaaaaaaaacacaaaaaactcccataatttattttgtttcttttccccatcctgaaaattcccaaatcatgtttccattatggaaaaatgataagtaaatgactaagaactacattaagattatgcctatacacttaaacaaaaaactcaaagcttatgctttttttttttaattaatgagagctattttttatgatattcttaccataggggtgttttgctgctaagacaaatcaaaaccaaaagctgtagattcacaaacctgtgatgctctttgaggtggaggaacctagaagtcagagaaatcctaatggagtaggagtggaggaacatttaaagtggtccctccttctgtaaaaatgaccgtgggattagaaagaaggacatcctgaggggtggttactgcccccagggaaatcactcactggtaggattccctggccaaatagttcaaacatcaggtcccattattgcttcagtatcagagatgcaagttcattaagcaaagtacaagaccattcagtagctcttattaaaatatcttttcttcctctaaagagtgtacaaggtggggtatgccaaggtatcaaaacaatatatgtgagtgtaatttaaactgtggaatatcaactgtactatggacgtgtttgtatcatttagatgtcattttaaatatttacattttagcaagacttttaaaaaggactcatttcatttcaaagtgcaaattgtttgccaggcttctggcaaatggttctttcaactgtgaacttatcgtgtacatatctgtatatttataaatattatatatattcatacatccttcactttaaaggtacattgtacagtctgtagttaggaggtatagcctatagcttatgttaaatggttgaaatggttctttttatagaaagtcaaacacagatgttacaggattttgtgtttggtttgtcattttttttattttttattttgactattgcatgagtaattaattccagatcttttgtattcacttctgtattttatgtttggttgaggggtgcttttagttgtgtggcatttgtattcattgatctttcagtcatgtaagttaaaataaaaattatttttgaattactagcaaaaaaaaaa

SEQ ID NO: 44116 - DNA, 3192 bp, Homo sapiens
gcagtgtgactgctgagactgccggggctgctgcctgctgcttctcgcgcctgtcctctccaagatgcagttttttgatgctgaggagctcctggtcgatgaagaggatgatgtttttggtgaaggactaccgaccagactcccggaaatcatgttggtaggatcccagtctttttcgcctggagggcccaatgggatcattagaagccagtcctttgcgggtttcagcggcctccaggaaaggcgatccaggtgtaactccttcattgaaaattcctccgctctcaagaagcctcaggccaaactgaagaaaatgcacaatttaggccacaaaaacaacaatccccccaaagagcctcagcctaaaagggtggaagaagtctacagggccttgaaaaatggacttgatgaatatctggaggttcaccagacggagctggacaagttgacagctcagttaaaagatatgaaaagaaactctcgcctgggtgtactgtatgacctagacaagcaaattaaaacaattgaaagatacatgagacgcctggagtttcatataagtaaggtagatgaactctatgaagcttattgtatccagcgacgcctccaggatggtgccagcaaaatgaagcaagccttcgcaacatcccctgccagcaaagctgcccgggagagtctgacagagatcaatcggagcttcaaggagtacacagagaatatgtgcaccattgaagtggagctagagaatctgctgggagaattctccatcaagatgaaaggtctggctggctttgcacgcctctgtcctggagatcaatatgaaattttcatgaagtatggccggcagcggtggaaactgaaaggcaaaatagaagtaaatggcaagcagagctgggatggagaagaaacagtttttctgcccctgatagttgggttcatctccatcaaggtcacggagctcaaagggctagcaactcacatcctggtaggtagcgtgacctgtgagaccaaagagctgtttgcagcccgacctcaggtagtggctgtcgacatcaatgaccttggtaccatcaaactgaacctggaaatcacctggtatccatttgacgtggaggacatgaccgcatcctcaggcgctgggaacaaggcagcagcccttcagaggagaatgtccatgtacagccagggtaccccggaaacgcccaccttcaaagaccactccttcttttcaaatctacctgatgacatctttgaaaatggaaaggcagccgaggagaaaatgccactgtcgctcagcttcagtgacctgcccaacggggactgcgccctcacctcccactcaacaggctccccttccaactcaacaaatccagaaattaccatcacccctgcggagtttaacctcagcagcttggcctcccagaatgagggtatggatgacaccagctcagcatcttccaggaactccctgggagaaggccaagagccaaagtcacacctgaaggaggaagacccagaggagcccagaaaacctgcctcggccccatctgaggcttgccgccgacagtcctcaggtgctggggctgagcacctgttccttgagaatgatgttgcagaagcacttctgcaagagtctgaggaggcctctgagctcaagcctgtggaactggacacttcggaaggaaacatcacaaagcagctggtcaagaggctcacatctgcagaggtgccaatggccacagacaggctgctctctgagggttctgttggtggagaatctgaaggctgcagatcctttctagatggaagcttagaggatgcttttaatgggcttttacttgcattagaaccacataaagagcagtataaagagtttcaggatctgaaccaagaagtcatgaatttggatgatattctaaaagatgctaaacaccttgacgatcagaaactaaatggtgctgcctcttggacggagatcactgagggtgaatgagacaactgtgatttaaaagaccgaaagacgttttcccatgtgcttttgtgccatcttgagtgtcagagacagatccctgcaaggcccttcctaccttgcgctaagaaatcagcaaggagtgtcacctaactggatggaggacatttagtgcttctaacttgcagaatttgtcccattcgacccaccccagcatcctcttgaatatttggaaatacttctctccaactctgtgcccatagcaactggcattgttttgcttgtaatgtttctgcatgtggccagcattatagaatgctccaggccagagaatgggattgctcccatgatgccagggcctggtcagggaagtggtgggacttgttccctttgaggcagagctccagaggaagcagggctgcttcttgtcatgcccaaggcattcattctttcctcagtcctcagaggaaaaattatatgctgtgagcaggtgcggtggctcatgcctgtaatcccaacactttgggaagcccaggattgctggagcccaagagttcaagaccggtatggtcaacatagggagaccctgtctctgcaataaaagaaaaaaattagcctggtgtggtggcacatgcctgtggtctcagctacctgggaggctaaggtgagaggattgcttaagcccgggagattgaggctgcagtgagctgtgatcacaccactgcactccagcctgagtgacagagcaagaccttgtctcaaaaaaaaaaaaaaaaaaaaaaattggggggttttttccctggggacctggggctagggggatttggacccctttccggtccgggaaaattggtctgcggaaagccccttaaaaagccaaatgcccttaagaatagcatagccgccctgttgggtaaaaaccccgcgaaaagaacttttgccccttggaatttagcacaattggcgccagtatttcacggcattggaccctccgttgacctttcaacatttgtgctccgcctgtggggggcaattctacactgcggggggtggaccccatacgggcagaagcggcaatactacgccagttctggtgttcccccaaggctttggtgtgtatgcaccctgtgcttcgggtatatctggggttcaggcgggaatataccacacctttgtggttatacaacattttcaccgtaatgttaggaaaatcctctgagggc

SEQ ID NO: 44117 - DNA, 663 bp, Homo sapiens
tttttttaagaaaagaacaaaaaggggggggttaagttttctttttcatttttatacgtctggacttaacttccaggatagctgcaagacccttttgttcctttgccatgagcaggttttaggccgctctgttgggaccatggtgttaccttcgcgattacactggatcagaaacaggccatggagggacaggatccggaggcgccagctcaaccgttgcttagagtccccagaaagctggcccaacctacctatttcacgaaacctgaccctaaagatgtcctgaaaagccctgagacccttcacgtgcagaggctgagagggcaatctaatgactctactgctgaatttgcaaggatacgggtttataaccgttggtaaggtgagaagtctctaaaatctgctgtaaaaacaccttttaaaggcttcaacctcgtgatactttcatgaggtttgagttctgggttttgcttcttgttttttggagagctggcggctttctgctcccctccctcttgaaactatggtgtttctatcttcttgctttctcctcctctggcccccagcattttccttggtctacacccttgtttgtaagtcttggttcactgccttcagcgctgtttgtggtctcagagaggatgggtggcgcttttcaaattg

SEQ ID NO: 44118 - DNA, 775 bp, Homo sapiens
tttcttgctctgaaggtagtgcaaaatgtgtaggttatatgctatagtttatctcagagagtaagaatgaggtatacctcttaaactacgaacaaaccaaaatgccttcatgaggtccctccttctctttcaggccttgctctattactgtgaagcactaacaaagacaaacctccagctccagaaagcagcttgcctggctctgaaaatccttgaggtaaagcccagccttggagctcccctggcagctcagcttggagccaggctaagctgagtgtatataacagcttttctttcatgtttgaaagtacttttttagcagtatttcttgtcttctttgcaccgtatgttagttttagtatttttctcccttaaacagtaattacatgtgactttgttttgttaaagtcaataagtggcagaaagcaatcatgttttgcactagcccaagggaaccagtttgcctttaggtcagtattagaaaagtacatcttattagccggcacagtggctcatgcctgtaatcccagcattttgggaggccgaggccggtggatcacctgaggtcaggagtttgagatcaacctggccaacatggtgaaacctcatctctacaaaaatacaaaaactagctgggcatgatggcaggtgcctgtaatcccagctactcaggaggctgaggagggagaattgcttgaacccaggaagttgcagtgagccaagattgtgccattgtactccagcctgggtggcagagccagactctgtctcaaaa

SEQ ID NO: 44119 - DNA, 5576 bp, Homo sapiens
  misc_feature (2874)..(2874): n is a, c, g, or t
  misc_feature (3485)..(3485): n is a, c, g, or t
agccccgcaacttcaccccgcgcgccgcagctgctgcgagcggacgcggcagggcagccggcgctggggacagctcgcgtccacccgacttcctcccggggtccccttcacccaagtgagccagctcaggctgtctgcaaagccggaggtgcgggcagctccgggcattgcattggtgcggaggcttttatatgccagagaaccctgagtgtgcccctgacatgacaaggagccgtcgtcgttaggactaccgaccagactcccggaaatcatgttggtaggatcccagtctttttcgcctggagggcccaatgggatcattagaagccagtcctttgcgggtttcagcggcctccaggaaaggcgatccaggtgtaactccttcattgaaaattcctccgctctcaagaagcctcaggccaaactgaagaaaatgcacaatttaggccacaaaaacaacaatccccccaaagagcctcagcctaaaagggtggaagaagtctacagggccttgaaaaatggacttgatgaatatctggaggttcaccagacggagctggacaagttgacagctcagttaaaagatatgaaaagaaactctcgcctgggtgtactgtatgacctagacaagcaaattaaaacaattgaaagatacatgagacgcctggagtttcatataagtaaggtagatgaactctatgaagcttattgtatccagcgacgcctccaggatggtgccagcaaaatgaagcaagccttcgcaacatcccctgccagcaaagctgcccgggagagtctgacagagatcaatcggagcttcaaggagtacacagagaatatgtgcaccattgaagtggagctagagaatctgctgggagaattctccatcaagatgaaaggtctggctggctttgcacgcctctgtcctggagatcaatatgaaattttcatgaagtatggccggcagcggtggaaactgaaaggcaaaatagaagtaaatggcaagcagagctgggatggagaagaaacagtttttctgcccctgatagttgggttcatctccatcaaggtcacggagctcaaagggctagcaactcacatcctggtaggtagcgtgacctgtgagaccaaagagctgtttgcagcccgacctcaggtagtggctgtcgacatcaatgaccttggtaccatcaaactgaacctggaaatcacctggtatccatttgacgtggaggacatgaccgcatcctcaggcgctgggaacaaggcagcagcccttcagaggagaatgtccatgtacagccagggtaccccggaaacgcccaccttcaaagaccactccttctttaggtggctgcatccttccccagacaagcccaggcggctgtctgtcttgagtgccttgcaagacactttctttgccaagctgcaccgcagccgctccttcagtgacctgccctccctcaggccgagtcccaaggccgtgctagagctctattcaaatctacctgatgacatctttgaaaatggaaaggcagccgaggagaaaatgccactgtcgctcagcttcagtgacctgcccaacggggactgcgccctcacctcccactcaacaggctccccttccaactcaacaaatccagaaattaccatcacccctgcggagtttaacctcagcagcttggcctcccagaatgagggtatggatgacaccagctcagcatcttccaggaactccctgggagaaggccaagagccaaagtcacacctgaaggaggaagacccagaggagcccagaaaacctgcctcggccccatctgaggcttgccgccgacagtcctcaggtgctggggctgagcacctgttccttgagaatgatgttgcagaagcacttctgcaagagtctgaggaggcctctgagctcaagcctgtggaactggacacttcggaaggaaacatcacaaagcagctggtcaagaggctcacatctgcagaggtgccaatggccacagacaggctgctctctgagggttctgttggtggagaatctgaaggctgcagatcctttctagatggaagcttagaggatgcttttaatgggcttttacttgcattagaaccacataaagagcagtataaagagtttcaggatctgaaccaagaagtcatgaatttggatgatattctaaaatgcaagccagcagtaagccgcagcaggtcttccagtttaagtctcacagttgaaagtgctttagaaagctttgatttcctgaacacctctgattttgacgaggaggaggatggtgatgaggtttgtaatgttggcggaggtgctgactcagtattttcagacactgagactgagaaacacagttacaggtcggttcacccagaagccagggggcatctcagtgaagcgctcactgaagacacaggagttgggaccagtgtggcaggaagtcctctcccactgaccacaggcaacgagagcctggacatcaccatcgtcaggcacctccagtactgcacccaactcgtgcagcaaattgttttctcaagcaaaaccccatttgtggcaagaagtctcttagagaagctttctaggcagatccaagtgatggagaaactcgcagctgtcagtgatgagaacataggaaatatcagttctgttgtggaagccataccagaatttcacaaaaagctgtctttgctgtcattctggaccaagtgctgcagccctgttggtgtctaccacagcccagcggacagagtgatgaagcagctggaggccagctttgccagaactgtcaacaaagaatatccaggacttgcagacccagtgtttcgaaccctggtgtcccaaattctggaccnggctgagcctctgctttcctccagcctgtcctcggaagtcgtcactgttttccagtattacagttacttcaccagccacggcgtcagtgacctggagagttacctgagccagctggccaggcaagtttccatggttcagactctgcaatcactaagagatgaaaaactgctacaaaccatgagtgaccttgctcccagcaacctcctggcccagcaggaagtactcaggactctggctctgctattaaccagagaggacaacgaagttagcgaggctgtgacgctttacttggcagcagcctccaaaaatcagcatttcagggaaaaggccttgctctattactgtgaagcactaacaaagacaaacctccagctccagaaagcagcttgcctggctctgaaaatccttgaggctactgaaagcattaaaatgctggtgacattgtgtcaatctgatactgaagaaatcagaaatgtggcctcagaaaccctcttgtctctgggagaagatgggcggctggcatatgaacaattggacaaatttcctcgagactgtgttaaagtcggaggtcgtcatggaactgaagttgccacagccttttaattacagnttaactgcctaacagctgtcttaatatctggcccttttcatcaggatggtgctgtggtttgggctggaaattgtttagagcctgagagacacgacaactgaaataaaaatgtaggccaggtgcagtggctcatgcctgtaatcccagtactttgggaggccaacgcaggagaattgcttaagcccaggaggttcaagaccaacctgggcaacatagcaaggccctgtctctacaaaaaaaatagtttaattagtcgggcgtggtggcatgcacctgtagtcccagctacttgggaggctaaggtgggaggattgcttgagcccagaagattcaggctgcagtgagccataattgccccactgcactccagactgggtgacagagcaaaaccctgtctcaaaaaacaaaacaacaacaacaactaaaaaaacatgttatagaaagaattcagagtctcgtttcacagtacctatctacttttcctttggccaatatagaatagggctatggtataattcaaatagattacatcgtcgattgtgtctgataatactcagtgaaagagtccatcttatcttaatatgtatgaaatttaaaaatagccatctttgtacttttttgcaagtttctctataagcttgaaatagtcatgtgatacttcgacaaacatcatatgccttgcagtttttctcggtcgtgttctcagggttgagtagtccccttagctacctaactttactttcaatacaaagcacaaaaaagaatacttcaaataaaagtttgcctgcagaacctggcaaaatgacccattatgagagtttagatgttttaattttatgtgctcccagctactctggagtctgaggtgggaggatcacttgaggcagaggttgcagtaagctgagattacactactgcactccagcccatgtgacagaggaatgagagccagtctcaaaaaaaaaacacaaaaaactcccataatttattttgtttcttttccccatcctgaaaattcccaaatcatgtttccattatggaaaaatgataagtaaatgactaagaactacattaagattatgcctatacacttaaacaaaaaactcaaagcttatgctttttttttttaattaatgagagctattttttatgatattcttaccataggggtgttttgctgctaagacaaatcaaaaccaaaagctgtagattcacaaacctgtgatgctctttgaggtggaggaacctagaagtcagagaaatcctaatggagtaggagtggaggaacatttaaagtggtccctccttctgtaaaaatgaccgtgggattagaaagaaggacatcctgaggggtggttactgcccccagggaaatcactcactggtaggattccctggccaaatagttcaaacatcaggtcccattattgcttcagtatcagagatgcaagttcattaagcaaagtacaagaccattcagtagctcttattaaaatatcttttcttcctctaaagagtgtacaaggtggggtatgccaaggtatcaaaacaatatatgtgagtgtaatttaaactgtggaatatcaactgtactatggacgtgtttgtatcatttagatgtcattttaaatatttacattttagcaagacttttaaaaaggactcatttcatttcaaagtgcaaattgtttgccaggcttctggcaaatggttctttcaactgtgaacttatcgtgtacatatctgtatatttataaatattatatatattcatacatccttcactttaaaggtacattgtacagtctgtagttaggaggtatagcctatagcttatgttaaatggttgaaatggttctttttatagaaagtcaaacacagatgttacaggattttgtgtttggtttgtcattttttttattttttattttgactattgcatgagtaattaattccagatcttttgtattcacttctgtattttatgtttggttgaggggtgcttttagttgtgtggcatttgtattcattgatctttcagtcatgtaagttaaaataaaaattatttttgaattactagcaaaaaaaaaa

SEQ ID NO: 44120 - DNA, 899 bp, Homo sapiens
atgcacagtgtaggttcctatcctgctttcaagaacagaacagaattcacgtgtgggagcaaacggctcaccaggtggtggactaccgaccagactcccggaaatcatgttggtaggatcccagtctttttcgcctggagggcccaatgggatcattagaagccagtcctttgcgggtttcagcggcctccaggaaaggcgatccaggtgtaactccttcattgaaaattcctccgctctcaagaagcctcaggccaaactgaagaaaatgcacaatttaggccacaaaaacaacaatccccccaaagagcctcagcctaaaagggtggaagaagtctacagggccttgaaaaatggacttgatgaatatctggaggttcaccagacggagctggacaagttgacagctcagttaaaagatatgaaaagaaactctcgcctgggtgtactgtatgacctagacaagcaaattaaaacaattgaaagatacatgagacgcctggagtttcatataagtaaggtagatgaactctatgaagcttattgtatccagcgacgcctccaggatggtgccagcaaaatgaagcaagccttcgcaacatcccctgccagcaaagctgcccgggagagtctgacagagatcaatcggagcttcaaggagtacacagagaatatgtgcaccattgaaagtggaggctagaagagatcttgctggggaaaaattcctccatcaacgatgaacaggtctggcctggctttgcaccgcctctgttcctggacgatcactatgacaattttcatgaaagtatgggcgggcaagccggtggaacctggaaggcaactagaacttacatggcagccaaaactgggatggggaaaaacaaggttttggccctgat

SEQ ID NO: 44121 - DNA, 5543 bp, Homo sapiens
  misc_feature (2841)..(2841): n is a, c, g, or t
  misc_feature (3452)..(3452): n is a, c, g, or t
tgtttaaaattcagttgattttggaagatattttaaaagagaaaaggtattagttgagacaaattaaagtgactctttcaagtaccagaaggacagagaaaagttggagagcaagaaaaagaactagtaaatggtcctagaaagtgaaaatggaaagaagaaaatgaaactagaaatgcaagtgctaatgagacagtaaactctcttgtacttcctcatcattcagtatggtccaggctgtgccaggtgctagtttctgggaccctgaaatgaggatgtgcttggctgactatgagggtgatgattccataacatctgcacaccctaggctgaagagggacgtgtcaagagcctgaactgttggattcttgttgacagacaaatcagatcatgactaccgaccagactcccggaaatcatgttggtaggatcccagtctttttcgcctggagggcccaatgggatcattagaagccagtcctttgcgggtttcagcggcctccaggaaaggcgatccaggtgtaactccttcattgaaaattcctccgctctcaagaagcctcaggccaaactgaagaaaatgcacaatttaggccacaaaaacaacaatccccccaaagagcctcagcctaaaagggtggaagaagtctacagggccttgaaaaatggacttgatgaatatctggaggttcaccagacggagctggacaagttgacagctcagttaaaagatatgaaaagaaactctcgcctgggtgtactgtatgacctagacaagcaaattaaaacaattgaaagatacatgagacgcctggagtttcatataagtaaggtagatgaactctatgaagcttattgtatccagcgacgcctccaggatggtgccagcaaaatgaagcaagccttcgcaacatcccctgccagcaaagctgcccgggagagtctgacagagatcaatcggagcttcaaggagtacacagagaatatgtgcaccattgaagtggagctagagaatctgctgggagaattctccatcaagatgaaaggtctggctggctttgcacgcctctgtcctggagatcaatatgaaattttcatgaagtatggccggcagcggtggaaactgaaaggcaaaatagaagtaaatggcaagcagagctgggatggagaagaaacagtttttctgcccctgatagttgggttcatctccatcaaggtcacggagctcaaagggctagcaactcacatcctggtaggtagcgtgacctgtgagaccaaagagctgtttgcagcccgacctcaggtagtggctgtcgacatcaatgaccttggtaccatcaaactgaacctggaaatcacctggtatccatttgacgtggaggacatgaccgcatcctcaggcgctgggaacaaggcagcagcccttcagaggagaatgtccatgtacagccagggtaccccggaaacgcccaccttcaaagaccactccttcttttcaaatctacctgatgacatctttgaaaatggaaaggcagccgaggagaaaatgccactgtcgctcagcttcagtgacctgcccaacggggactgcgccctcacctcccactcaacaggctccccttccaactcaacaaatccagaaattaccatcacccctgcggagtttaacctcagcagcttggcctcccagaatgagggtatggatgacaccagctcagcatcttccaggaactccctgggagaaggccaagagccaaagtcacacctgaaggaggaagacccagaggagcccagaaaacctgcctcggccccatctgaggcttgccgccgacagtcctcaggtgctggggctgagcacctgttccttgagaatgatgttgcagaagcacttctgcaagagtctgaggaggcctctgagctcaagcctgtggaactggacacttcggaaggaaacatcacaaagcagctggtcaagaggctcacatctgcagaggtgccaatggccacagacaggctgctctctgagggttctgttggtggagaatctgaaggctgcagatcctttctagatggaagcttagaggatgcttttaatgggcttttacttgcattagaaccacataaagagcagtataaagagtttcaggatctgaaccaagaagtcatgaatttggatgatattctaaaatgcaagccagcagtaagccgcagcaggtcttccagtttaagtctcacagttgaaagtgctttagaaagctttgatttcctgaacacctctgattttgacgaggaggaggatggtgatgaggtttgtaatgttggcggaggtgctgactcagtattttcagacactgagactgagaaacacagttacaggtcggttcacccagaagccagggggcatctcagtgaagcgctcactgaagacacaggagttgggaccagtgtggcaggaagtcctctcccactgaccacaggcaacgagagcctggacatcaccatcgtcaggcacctccagtactgcacccaactcgtgcagcaaattgttttctcaagcaaaaccccatttgtggcaagaagtctcttagagaaactcgcagctgtcagtgatgagaacataggaaatatcagttctgttgtggaagccataccagaatttcacaaaaagctgtctttgctgtcattctggaccaagtgctgcagccctgttggtgtctaccacagcccagcggacagagtgatgaagcagctggaggccagctttgccagaactgtcaacaaagaatatccaggacttgcagacccagtgtttcgaaccctggtgtcccaaattctggaccnggctgagcctctgctttcctccagcctgtcctcggaagtcgtcactgttttccagtattacagttacttcaccagccacggcgtcagtgacctggagagttacctgagccagctggccaggcaagtttccatggttcagactctgcaatcactaagagatgaaaaactgctacaaaccatgagtgaccttgctcccagcaacctcctggcccagcaggaagtactcaggactctggctctgctattaaccagagaggacaacgaagttagcgaggctgtgacgctttacttggcagcagcctccaaaaatcagcatttcagggaaaaggccttgctctattactgtgaagcactaacaaagacaaacctccagctccagaaagcagcttgcctggctctgaaaatccttgaggctactgaaagcattaaaatgctggtgacattgtgtcaatctgatactgaagaaatcagaaatgtggcctcagaaaccctcttgtctctgggagaagatgggcggctggcatatgaacaattggacaaatttcctcgagactgtgttaaagtcggaggtcgtcatggaactgaagttgccacagccttttaattacagnttaactgcctaacagctgtcttaatatctggcccttttcatcaggatggtgctgtggtttgggctggaaattgtttagagcctgagagacacgacaactgaaataaaaatgtaggccaggtgcagtggctcatgcctgtaatcccagtactttgggaggccaacgcaggagaattgcttaagcccaggaggttcaagaccaacctgggcaacatagcaaggccctgtctctacaaaaaaaatagtttaattagtcgggcgtggtggcatgcacctgtagtcccagctacttgggaggctaaggtgggaggattgcttgagcccagaagattcaggctgcagtgagccataattgccccactgcactccagactgggtgacagagcaaaaccctgtctcaaaaaacaaaacaacaacaacaactaaaaaaacatgttatagaaagaattcagagtctcgtttcacagtacctatctacttttcctttggccaatatagaatagggctatggtataattcaaatagattacatcgtcgattgtgtctgataatactcagtgaaagagtccatcttatcttaatatgtatgaaatttaaaaatagccatctttgtacttttttgcaagtttctctataagcttgaaatagtcatgtgatacttcgacaaacatcatatgccttgcagtttttctcggtcgtgttctcagggttgagtagtccccttagctacctaactttactttcaatacaaagcacaaaaaagaatacttcaaataaaagtttgcctgcagaacctggcaaaatgacccattatgagagtttagatgttttaattttatgtgctcccagctactctggagtctgaggtgggaggatcacttgaggcagaggttgcagtaagctgagattacactactgcactccagcccatgtgacagaggaatgagagccagtctcaaaaaaaaaacacaaaaaactcccataatttattttgtttcttttccccatcctgaaaattcccaaatcatgtttccattatggaaaaatgataagtaaatgactaagaactacattaagattatgcctatacacttaaacaaaaaactcaaagcttatgctttttttttttaattaatgagagctattttttatgatattcttaccataggggtgttttgctgctaagacaaatcaaaaccaaaagctgtagattcacaaacctgtgatgctctttgaggtggaggaacctagaagtcagagaaatcctaatggagtaggagtggaggaacatttaaagtggtccctccttctgtaaaaatgaccgtgggattagaaagaaggacatcctgaggggtggttactgcccccagggaaatcactcactggtaggattccctggccaaatagttcaaacatcaggtcccattattgcttcagtatcagagatgcaagttcattaagcaaagtacaagaccattcagtagctcttattaaaatatcttttcttcctctaaagagtgtacaaggtggggtatgccaaggtatcaaaacaatatatgtgagtgtaatttaaactgtggaatatcaactgtactatggacgtgtttgtatcatttagatgtcattttaaatatttacattttagcaagacttttaaaaaggactcatttcatttcaaagtgcaaattgtttgccaggcttctggcaaatggttctttcaactgtgaacttatcgtgtacatatctgtatatttataaatattatatatattcatacatccttcactttaaaggtacattgtacagtctgtagttaggaggtatagcctatagcttatgttaaatggttgaaatggttctttttatagaaagtcaaacacagatgttacaggattttgtgtttggtttgtcattttttttattttttattttgactattgcatgagtaattaattccagatcttttgtattcacttctgtattttatgtttggttgaggggtgcttttagttgtgtggcatttgtattcattgatctttcagtcatgtaagttaaaataaaaattatttttgaattactagcaaaaaaaaaa

SEQ ID NO: 44122 - DNA, 3382 bp, Homo sapiens
  misc_feature (680)..(680): n is a, c, g, or t
  misc_feature (1291)..(1291): n is a, c, g, or t
ggcaatttggtgaccaggctgaattaagtaattttttaaaggtgtctctatttttcaagataggcaagtgaaagactgttttcagtgggtgctgttggggcccgatgcaaaccatgtggacttgacctgtggtttgtgcacagaaaaagaatagctaatgttttgcccaccttcaatagttacaggtcggttcacccagaagccagggggcatctcagtgaagcgctcactgaagacacaggagttgggaccagtgtggcaggaagtcctctcccactgaccacaggcaacgagagcctggacatcaccatcgtcaggcacctccagtactgcacccaactcgtgcagcaaattgttttctcaagcaaaaccccatttgtggcaagaagtctcttagagaagctttctaggcagatccaagtgatggagaaactcgcagctgtcagtgatgagaacataggaaatatcagttctgttgtggaagccataccagaatttcacaaaaagctgtctttgctgtcattctggaccaagtgctgcagccctgttggtgtctaccacagcccagcggacagagtgatgaagcagctggaggccagctttgccagaactgtcaacaaagaatatccaggacttgcagacccagtgtttcgaaccctggtgtcccaaattctggaccnggctgagcctctgctttcctccagcctgtcctcggaagtcgtcactgttttccagtattacagttacttcaccagccacggcgtcagtgacctggagagttacctgagccagctggccaggcaagtttccatggttcagactctgcaatcactaagagatgaaaaactgctacaaaccatgagtgaccttgctcccagcaacctcctggcccagcaggaagtactcaggactctggctctgctattaaccagagaggacaacgaagttagcgaggctgtgacgctttacttggcagcagcctccaaaaatcagcatttcagggaaaaggccttgctctattactgtgaagcactaacaaagacaaacctccagctccagaaagcagcttgcctggctctgaaaatccttgaggctactgaaagcattaaaatgctggtgacattgtgtcaatctgatactgaagaaatcagaaatgtggcctcagaaaccctcttgtctctgggagaagatgggcggctggcatatgaacaattggacaaatttcctcgagactgtgttaaagtcggaggtcgtcatggaactgaagttgccacagccttttaattacagnttaactgcctaacagctgtcttaatatctggcccttttcatcaggatggtgctgtggtttgggctggaaattgtttagagcctgagagacacgacaactgaaataaaaatgtaggccaggtgcagtggctcatgcctgtaatcccagtactttgggaggccaacgcaggagaattgcttaagcccaggaggttcaagaccaacctgggcaacatagcaaggccctgtctctacaaaaaaaatagtttaattagtcgggcgtggtggcatgcacctgtagtcccagctacttgggaggctaaggtgggaggattgcttgagcccagaagattcaggctgcagtgagccataattgccccactgcactccagactgggtgacagagcaaaaccctgtctcaaaaaacaaaacaacaacaacaactaaaaaaacatgttatagaaagaattcagagtctcgtttcacagtacctatctacttttcctttggccaatatagaatagggctatggtataattcaaatagattacatcgtcgattgtgtctgataatactcagtgaaagagtccatcttatcttaatatgtatgaaatttaaaaatagccatctttgtacttttttgcaagtttctctataagcttgaaatagtcatgtgatacttcgacaaacatcatatgccttgcagtttttctcggtcgtgttctcagggttgagtagtccccttagctacctaactttactttcaatacaaagcacaaaaaagaatacttcaaataaaagtttgcctgcagaacctggcaaaatgacccattatgagagtttagatgttttaattttatgtgctcccagctactctggagtctgaggtgggaggatcacttgaggcagaggttgcagtaagctgagattacactactgcactccagcccatgtgacagaggaatgagagccagtctcaaaaaaaaaacacaaaaaactcccataatttattttgtttcttttccccatcctgaaaattcccaaatcatgtttccattatggaaaaatgataagtaaatgactaagaactacattaagattatgcctatacacttaaacaaaaaactcaaagcttatgctttttttttttaattaatgagagctattttttatgatattcttaccataggggtgttttgctgctaagacaaatcaaaaccaaaagctgtagattcacaaacctgtgatgctctttgaggtggaggaacctagaagtcagagaaatcctaatggagtaggagtggaggaacatttaaagtggtccctccttctgtaaaaatgaccgtgggattagaaagaaggacatcctgaggggtggttactgcccccagggaaatcactcactggtaggattccctggccaaatagttcaaacatcaggtcccattattgcttcagtatcagagatgcaagttcattaagcaaagtacaagaccattcagtagctcttattaaaatatcttttcttcctctaaagagtgtacaaggtggggtatgccaaggtatcaaaacaatatatgtgagtgtaatttaaactgtggaatatcaactgtactatggacgtgtttgtatcatttagatgtcattttaaatatttacattttagcaagacttttaaaaaggactcatttcatttcaaagtgcaaattgtttgccaggcttctggcaaatggttctttcaactgtgaacttatcgtgtacatatctgtatatttataaatattatatatattcatacatccttcactttaaaggtacattgtacagtctgtagttaggaggtatagcctatagcttatgttaaatggttgaaatggttctttttatagaaagtcaaacacagatgttacaggattttgtgtttggtttgtcattttttttattttttattttgactattgcatgagtaattaattccagatcttttgtattcacttctgtattttatgtttggttgaggggtgcttttagttgtgtggcatttgtattcattgatctttcagtcatgtaagttaaaataaaaattatttttgaattactagcaaaaaaaaaa

SEQ ID NO: 44123 - DNA, 1434 bp, Homo sapiens
gcagtgtgactgctgagactgccggggctgctgcctgctgcttctcgcgcctgtcctctccaagatgcagttttttgatgctgaggagctcctggtcgatgaagaggatgatgtttttggtgaaggactaccgaccagactcccggaaatcatgttggtaggatcccagtctttttcgcctggagggcccaatgggatcattagaagccagtcctttgcgggtttcagcggcctccaggaaaggcgatccaggtgtaactccttcattgaaaattcctccgctctcaagaagcctcaggccaaactgaagaaaatgcacaatttaggccacaaaaacaacaatccccccaaagagcctcagcctaaaagggtggaagaagtctacagggccttgaaaaatggacttgatgaatatctggaggttcaccagacggagctggacaagttgacagctcagttaaaagatatgaaaagaaactctcgcctgggtgtactgtatgacctagacaagcaaattaaaacaattgaaagatacatgagacgcctggagtttcatataagtaaggtagatgaactctatgaagcttattgtatccagcgacgcctccaggatggtgccagcaaaatgaagcaagccttcgcaacatcccctgccagcaaagctgcccgggagagtctgacagagatcaatcggagcttcaaggagtacacagagaatatgtgcaccattgaagtggagctagagaatctgctgggagaattctccatcaagatgaaaggtctggctggctttgcacgcctctgtcctggagatcaatatgaaattttcatgaagtatggccggcagcggtggaaactgaaaggcaaaatagaagtaaatggcaagcagagctgggatggagaagaaacagtttttctgcccctgatagttgggttcatctccatcaaggtacagtattgtcattgcctgttgtctttcctggtgccacggctggatgatccattggtggggcccttacccgtgacccctgcctgttgcccctccatcccacagacttctctgcacaagtctattacaaagacagctgccctctcatcagagtaagtaaagtcaatctaagatacacttttgaaatatccacctctggccaggcgtagtgtagtggctcacgcctgtaatcccagcactttgggaggctgaggtgggtggatcacttgagcccaggaggtcgagaccagcctggccaacatggcaaaacgccgtctctacaaaagtacaaaaattagccagacgtggtccgtgtgcctgtagtcccagctacttgggagtctgaggtgggaggatcacttgagcccaggaggtcaaggctgcaattagccatgatcacactactgcactatagcctgggtgacagagagagaccctgtctccaa

SEQ ID NO: 44124 - DNA, 342 bp, Homo sapiens
gcaaggatagataattacattcagacttaaataaaaggagtcaaggatcacttgggtctatgttagaggcagcctatcatagtacggatcaataactagttggatggatggatggatggatggatggatggatggatggatgtggagggatggtcagtcaggcagacagatgatgggcaaatagattaatgctataccacaatataatttaatttatgttgcatacccaacttaatcctgaaaaacttgagactatttaggaaagattgaccaggatggtgagaggtataactattttccttctatatataaaagttaaaatattctataaccctttgcctt

SEQ ID NO: 44125 - DNA, 1034 bp, Homo sapiens
ccctggcgtgttggggtttaaaaagaataaacttcaagttaatctcttcccaaagtataagtataccttttgatgtcatgatagcaggaccatgtgaagagtacatattttgaaatttgcttgcacttttgccctttcactctattggatttcaaaattcaacagctgtcagcatttgtagctgtgtaatcctgtataattatcatcttttatccaaatttgtataaaacttacaagttttcctaatttttttggagtattagagatcttgcctgtctttccagcatggatattttattttaattttcttaatgttccttcaaattacgtagtttgaaatgtttgtacatctttatttccttgctagatgggttgtttatatgattagataattcttcatttacagagggttaaagtaactttttttaaatgaagtactgaatagaggttaggaaagttgttggaacctgataaatttgtaaaatttacaaaatttctcattttaaaagctacagttttaaaatttcatgctttttaagcatccattgtaagagtaggagtgtccaaaagcaataagaacaagaaatctttgtaagattggtagtttcagtgtttagccaaaccattatcagaattagaatgactaatgttatgtaggtttggttttcaactccattctttttttgtttcattttttaaaaaattccaaatctctaacctggccttggcgctctgagtcttctgatctctgcccacctcatcactcactttgttctccccattttgtttatttcaattgctgaactggctgagcttttactctccccaccttaggttgttccactcttcatctgtcaagctcctactcatcctgtggactcaaccactgggttagatgaaagaaaagtttgacgtgtccactctttaaaaacattaagtgttttttgttgtttgtttgagactgtcgtccaggctgtagtgcagtggcgcaatcttgggctcacggcagcctcgacctcctggggctaaatgat

SEQ ID NO: 44126 - DNA, 497 bp, Homo sapiens
gaggatttgaatagtgttatttaataatgttgacttgagagtatattgtaaattgcaccatatttgggttttaccaaatacacagtatattacctttctaaaatctgaaaaattctgaattctgaaaaagaactgtcccgaggggtccttataaccctataaggattgtggaccttttatctccttgccattcgttctacaacagccacacacacacacatatatattctataaatattagtacttgctttaaatgtttcaacatgacatatggagaaccagagccagtatttgttgaatacttgctgtgttctgaacaatgggctgtgtactttgcatatgttatttaattcagtcttaatcaccactttgaaatggaatctgaggctcaaaatatttaagaatctttagtgcccaacatcgctcacctggtaggtagccaagttggaatattaatctagatttgtctattattacattgcctcctatgattgtgc

SEQ ID NO: 44127 - DNA, 3248 bp, Homo sapiens
acgtccccgccgggcccgcgcgcctcgtgcctcgcgcctcgcgcctccagccacgtccccgccccggctccggcgcgccgcggagttggctgctgggaggtgcgggactgggtgtggccggcggctctggtctcggctgtgagctgcgctctccacgccggctccgcgctccaggggctgctgagcgcccagcggacaccggcagcgcgcggtcgacgcgggcctgagctccctccagctgttttcactcattagctcctgaggtaaacaaattgaaaaaatgagcgaactggaacagttgaggcaagaagcagaacaactgcggaatcagattcaggatgctcggaaagcatgtaatgatgcaacgcttgttcagattacatcaaatatggactccgtgggtcgaatacaaatgcgaacaagacgtacactgaggggccacctagctaaaatctatgctatgcattggggatacgattccaggctgctagtcagtgcttctcaagatggaaaattaattatttgggatagctatacaacaaataagatgcatgctattcctttgaggtcctcctgggtgatgacctgtgcttatgctccctctggtaattatgttgcctgtggaggcttggacaacatctgctctatatataacttaaagaccagagagggaaatgtgagagtaagccgagagttgccaggtcacacagggtacttgtcctgctgtcgttttttagatgacagccaaattgttacaagttcaggagatacaacttgtgctttatgggacatcgaaactgcccagcagaccaccacattcactgggcattctggagatgtgatgagtctttctttgagtcctgacatgaggacttttgtttctggtgcttgtgatgcctcttccaaattatgggatattcgagatggaatgtgtagacagtctttcacgggacatgtctcagatatcaatgctgtcagttttttcccaaatggatatgccttcgccactggctctgatgatgccacttgccggctctttgaccttcgtgcagatcaagagttattattgtattctcatgacaatatcatctgtggaatcacttctgtagccttctcaaaaagtgggcgtctcttgttggctggttacgatgactttaattgtaatgtatgggacacgctaaaaggagatcgtgcaggtgtccttgctggtcatgacaaccgtgtgagctgcttaggtgtaactgatgatggcatggctgtggcaacaggctcttgggacagttttcttagaatctggaattaacagtgtcatacatatttgttctccattgatatatctggagaaatcaatgctacagcctatagctgtgaaaaaattctaccttatatttgcaggtgaagatttttctattagattatctacaaaaacaagctttcagtaaactaccaaaaaaaaagtgggggtggaggaattgggttattttaaccttggtgaattgttgtgtgtactcagagtgtattttctttgtgtagaacagaatgtacacattatagcagctcgccattgtgtttgcattttttaagaagtacatttttaactttgtatacacaagaaatgtcatatttttgagttttgtaatggaagaaccaggcacagaaacagacagaaatgatactgtatgtgtgtgtatttatgtctgaagaaagtccccttgaattctgatatctctttgaatctaagagatcctgatagcttcatgtttaagagcattgacaggtggggcacctctgaggggagttcattgtttctcatgcatcatttgccatatactattaatcaaagtgcttgctttcagtcctttgaggggacagataatctgaaggccagagattagagatttcactgatattttggacatacataagaaacatcattataattaataaaaagtaggtaatagcatataaatggttcttgacattttaaaagcctggttatgatcagttgacactttgagtacccccctaaatagctggactttccttttcatttcatatttggaactaagtttgtagcgtatactcatctttcagaagtttggtaaacattgggattgtccctgcatctgaacatctttcccagtgctatcagtatacatctagagaggaaatgcaatgtgacagtgttacatttggagagaagtgtgaaatctaaccaatcgctagcacatatttgttgtaatacggtggtttatttcatgtttgcatactataaaatctgaattgatgtgaaatatctgtgcctttaaatttcttaaacctttaagctttttgttctgttttgcaacattttgtagtatttcttcccttccttagcacaaaatactggtttctaagtggttttgcttcaaaggatgtctagatgtaagtgattccacttaaagccaaaataaaaattcctaaagcagttcttaaaggagttagagagctatattaaacagtttttctgtggtataataatgtgtctcttactagaagtcccccacgaccaagttaaagatacttttcctgttggattctcttttacaaataagtctaaatgactgataatagaagattgttagtcttgcttgatggtaaagtcttggattattctgatatatagacgtgcattgttttgtaacttagttacttttcagataggtctgtgttaacttttgaacatgtgtaacttaacctaaatactcccaaactttacctctaaatttttgtttttatgttgtgaatgtgctaatatgtgcatcaactgtaaagatgtatcagttttattaaaatcagttgacaattagaataataaagtggataaaggcaaattaagatataggaccaaaacagaatattgtagatggcagttatgaatgtatatttatattttgattaagatttctattaactttttggctgggcagagtggcttacacctataatcccagcaatttgggaggccaaggtgggcagatcacttgaggtcaggagttcgcgaccagcctacccaacatggtgaaaccccatctcttctaaaaatacaaacattagccgggcgtggtggcacattcctgtaatcccagctactcgggaggctgaggcaggagattcgcctgaacccgggaggcagaggttgcagtgagccgagattgtgccactgcactccagcctaggcgacagagtgagactccatctcaaattgg

SEQ ID NO: 44128 - DNA, 1671 bp, Homo sapiens
acgtccccgccgggcccgcgcgcctcgtgcctcgcgcctcgcgcctccagccacgtccccgccccggctccggcgcgccgcggagttggctgctgggaggtgcgggactgggtgtggccggcggctctggtctcggctgtgagctgcgctctccacgccggctccgcgctccaggggctgctgagcgcccagcggacaccggcagcgcgcggtcgacgcgggcctgagctccctccagctgttttcactcattagctcctgaggtaaacaaattgaaaaaatgagcgaactggaacagttgaggcaagaagcagaacaactgcggaatcagattcaggatgctcggaaagcatgtaatgatgcaacgcttgttcagattacatcaaatatggactccgtgggtcgaatacaaatgcgaacaagacgtacactgaggggccacctagctaaaatctatgctatgcattggggatacgattccaggctgctagtcagtgcttctcaagatggaaaattaattatttgggatagctatacaacaaataagatgcatgctattcctttgaggtcctcctgggtgatgacctgtgcttatgctccctctggtaattatgttgcctgtggaggcttggacaacatctgctctatatataacttaaagaccagagagggaaatgtgagagtaagccgagagttgccaggtcacacagggtacttgtcctgctgtcgttttttagatgacagccaaattgttacaagttcaggagatacaacttgtgctttatgggacatcgaaactgcccagcagaccaccacattcactgggcattctggagatgtgatgagtctttctttgagtcctgacatgaggacttttgtttctggtgcttgtgatgcctcttccaaattatgggatattcgagatggaatgtgtagacagtctttcacgggacatgtctcagatatcaatgctgtcagtgtaagtgaatagcatttctagagaaaatttattatgcatttaaagtgttgagctctatggcatgattttaacaacaaattgccttcaaggattcttacaagtaatgtgctcttataactttgaatctccaagtcataagggtttttgattttttaaaaaagaaagcttcaattcatagtcctagatcttttttgttattgttggatttttttttgttgttatttttttgtttttttgagacagtcttgctctgtcgtccaggctggagtgcagcggtgcagtcacggctcactgcagcctcgacctcctgggctcaagcgatcctcccacctcagtctcctggtagctaggattacaggtacacaccaccatgcatggccaattttgtattttttatagagatggggttttgccatgttgtccaggctggtctcgaactcctgagctgaagcaatcttcctgcctcggcctcccaaagtgttgggattacaggcatgagccactgttcctggcaacctaggtttttaattgctggtgaatatcactttttttttttttttccaaagtggagggattatcatgagtaaacaagcagatcgtggatgttctaccagtgaattcagatgagaaaaaagtctcgtctttctccccagtagcctgttcccttgctgtctttcatcctgagtcccgct

SEQ ID NO: 44129 - DNA, 510 bp, Homo sapiens
atcaccactttgaaatggaatctgaggctcaaaatatttaagaatctttagtgcccaacatcgctcacctggtaggtagccaagttggaatattaatctagatttgtctattattacattgcctcctatgattgtgcatacatctgtagaataaatgtttgttactttcctgtctagtttttcccaaatggatatgccttcgccactggctctgatgatgccacttgccggctctttgaccttcgtgcagatcaagagttattattgtattctcatgacaatatcatctgtggaatcacttctgtagccttctcaaaaagtgggcgtctcttgttggctggttacgatgactttaattgtaatgtatgggacacgctaaaaggagatcgtgcaggttagtaaataagtccacattaggttctgattttcaggaagcgtgaagaggttcccatcagttgtgttctaggcctccatggacatcttggagttgtggaaagtggtaacccgatg

SEQ ID NO: 44130 - DNA, 3302 bp, Homo sapiens
acgtccccgccgggcccgcgcgcctcgtgcctcgcgcctcgcgcctccagccacgtccccgccccggctccggcgcgccgcggagttggctgctgggaggtgcgggactgggtgtggccggcggctctggtctcggctgtgagctgcgctctccacgccggctccgcgctccaggggctgctgagcgcccagcggacaccggcagcgcgcggtcgacgcgggcctgagctccctccagctgttttcactcattagctcctgaggtaaacaaattgaaaaaatgagcgaactggaacagttgaggcaagaagcagaacaactgcggaatcagattcaggatgctcggaaagcatgtaatgatgcaacgcttgttcagattacatcaaatatggactccgtgggtcgaatacaaatgcgaacaagacgtacactgaggggccacctagctaaaatctatgctatgcattggggatacgattccaggctgctagtcagtgcttctcaagatggaaaattaattatttgggatagctatacaacaaataagatgcatgctattcctttgaggtcctcctgggtgatgacctgtgcttatgctccctctggtaattatgttgcctgtggaggcttggacaacatctgctctatatataacttaaagaccagagagggaaatgtgagagtaagccgagagttgccaggtcacacagggtacttgtcctgctgtcgttttttagatgacagccaaattgttacaagttcaggagatacaacttgtgctttatgggacatcgaaactgcccagcagaccaccacattcactgggcattctggagatgtgatgagtctttctttgagtcctgacatgaggacttttgtttctggtgcttgtgatgcctcttccaaattatgggatattcgagatggaatgtgtagacagtctttcacgggacatgtctcagatatcaatgctgtcagttttttcccaaatggatatgccttcgccactggctctgatgatgccacttgccggctctttgaccttcgtgcagatcaagagttattattgtattctcatgacaatatcatctgtggaatcacttctgtagccttctcaaaaagtgggcgtctcttgttggctggttacgatgactttaattgtaatgtatgggacacgctaaaaggagatcgtgcaggtgtccttgctggtcatgacaaccgtgtgagctgcttaggtgtaactgatgatggcatggctgtggcaacaggctcttgggacagttttcttagaatctggaattaacagtgtcatacatatttgttctccattgatatatctggagaaatcaatgctacagcctatagctgtgaaaaaattctaccttatatttgcaggtgaagatttttctattagattatctacaaaaacaagctttcagtaaactaccaaaaaaaaagtgggggtggaggaaaaaaggcaaaggcgccttctgagatcaaaaggaccagtgtattaatttgaggggttgggttattttaaccttggtgaattgttgtgtgtactcagagtgtattttctttgtgtagaacagaatgtacacattatagcagctcgccattgtgtttgcattttttaagaagtacatttttaactttgtatacacaagaaatgtcatatttttgagttttgtaatggaagaaccaggcacagaaacagacagaaatgatactgtatgtgtgtgtatttatgtctgaagaaagtccccttgaattctgatatctctttgaatctaagagatcctgatagcttcatgtttaagagcattgacaggtggggcacctctgaggggagttcattgtttctcatgcatcatttgccatatactattaatcaaagtgcttgctttcagtcctttgaggggacagataatctgaaggccagagattagagatttcactgatattttggacatacataagaaacatcattataattaataaaaagtaggtaatagcatataaatggttcttgacattttaaaagcctggttatgatcagttgacactttgagtacccccctaaatagctggactttccttttcatttcatatttggaactaagtttgtagcgtatactcatctttcagaagtttggtaaacattgggattgtccctgcatctgaacatctttcccagtgctatcagtatacatctagagaggaaatgcaatgtgacagtgttacatttggagagaagtgtgaaatctaaccaatcgctagcacatatttgttgtaatacggtggtttatttcatgtttgcatactataaaatctgaattgatgtgaaatatctgtgcctttaaatttcttaaacctttaagctttttgttctgttttgcaacattttgtagtatttcttcccttccttagcacaaaatactggtttctaagtggttttgcttcaaaggatgtctagatgtaagtgattccacttaaagccaaaataaaaattcctaaagcagttcttaaaggagttagagagctatattaaacagtttttctgtggtataataatgtgtctcttactagaagtcccccacgaccaagttaaagatacttttcctgttggattctcttttacaaataagtctaaatgactgataatagaagattgttagtcttgcttgatggtaaagtcttggattattctgatatatagacgtgcattgttttgtaacttagttacttttcagataggtctgtgttaacttttgaacatgtgtaacttaacctaaatactcccaaactttacctctaaatttttgtttttatgttgtgaatgtgctaatatgtgcatcaactgtaaagatgtatcagttttattaaaatcagttgacaattagaataataaagtggataaaggcaaattaagatataggaccaaaacagaatattgtagatggcagttatgaatgtatatttatattttgattaagatttctattaactttttggctgggcagagtggcttacacctataatcccagcaatttgggaggccaaggtgggcagatcacttgaggtcaggagttcgcgaccagcctacccaacatggtgaaaccccatctcttctaaaaatacaaacattagccgggcgtggtggcacattcctgtaatcccagctactcgggaggctgaggcaggagattcgcctgaacccgggaggcagaggttgcagtgagccgagattgtgccactgcactccagcctaggcgacagagtgagactccatctcaaattgg

SEQ ID NO: 44131 - DNA, 3127 bp, Homo sapiens
acgtccccgccgggcccgcgcgcctcgtgcctcgcgcctcgcgcctccagccacgtccccgccccggctccggcgcgccgcggagttggctgctgggaggtgcgggactgggtgtggccggcggctctggtctcggctgtgagctgcgctctccacgccggctccgcgctccaggggctgctgagcgcccagcggacaccggcagcgcgcggtcgacgcgggcctgagctccctccagctgttttcactcattagctcctgaggtaaacaaattgaaaaaatgagcgaactggaacagttgaggcaagaagcagaacaactgcggaatcagattcaggatgctcggaaagcatgtaatgatgcaacgcttgttcagattacatcaaatatggactccgtgggtcgaatacaaatgcgaacaagacgtacactgaggggccacctagctaaaatctatgctatgcattggggatacgattccaggctgctagtcagtgcttctcaagatggaaaattaattatttgggatagctatacaacaaataagatgcatgctattcctttgaggtcctcctgggtgatgacctgtgcttatgctccctctggtaattatgttgcctgtggaggcttggacaacatctgctctatatataacttaaagaccagagagggaaatgtgagagtaagccgagagttgccaggtcacacagggtacttgtcctgctgtcgttttttagatgacagccaaattgttacaagttcaggagatacaacttgtgctttatgggacatcgaaactgcccagcagaccaccacattcactgggcattctggagatgtgatgagtctttctttgagtcctgacatgaggacttttgtttctggtgcttgtgatgcctcttccaaattatgggatattcgagatggaatgtgtagacagtctttcacgggacatgtctcagatatcaatgctgtcagttttttcccaaatggatatgccttcgccactggctctgatgatgccacttgccggctctttgaccttcgtgcagatcaagagttattattgtattctcatgacaatatcatctgtggaatcacttctgtagccttctcaaaaagtgggcgtctcttgttggctggttacgatgactttaattgtaatgtatgggacacgctaaaaggagatcgtgcaggtgtccttgctggtcatgacaaccgtgtgagctgcttaggtgtaactgatgatggcatggctgtggcaacaggctcttgggacagttttcttagaatctggaattaacagtgtcatacatatttgttctccattgatatatctggagaaatcaatgctacagcctatagctgtgaaaaaattctaccttatatttgcaggtgaagatttttctattagattatctacaaaaacaagctttcagtaaactaccaaaaaaaaagtgggggtggaggaaaaaaggcaaaggcgccttctgagatcaaaaggaccagtgtattaatttgaggggttgggttattttaaccttggtgaattgttgtgtgtactcagagtgtattttctttgtgtagaacagaatgtacacattatagcagctcgccattgtgtttgcattttttaagaagtacatttttaactttgtatacacaagaaatgtcatatttttgagttttgtaatggaagaaccaggcacagaaacagacagaaatgatactgtatgtgtgtgtatttatgtctgaagaaagtccccttgaattctgatatctctttgaatctaagagatcctgatagcttcatgtttaagagcattgacaggtggggcacctctgaggggagttcattgtttctcatgcatcatttgccatatactattaatcaaagtgcttgctttcagtcctttgaggggacagataatctgaaggccagagattagagatttcactgatattttggacatacataagaaacatcattataattaataaaaagtaggtaatagcatataaatggttcttgacattttaaaagcctggttatgatcagttgacactttgagtacccccctaaatagctggactttccttttcatttcatatttggaactaagtttgtagcgtatactcatctttcagaagtttggtaaacattgggattgtccctgcatctgaacatctttcccagtgctatcagtatacatctagagaggaaatgcaatgtgacagtgttacatttggagagaagtgtgaaatctaaccaatcgctagcacatatttgttgtaatacggtggtttatttcatgtttgcatactataaaatctgaattgatgtgaaatatctgtgcctttaaatttcttaaacctttaagctttttgttctgttttgcaacattttgtagtatttcttcccttccttagcacaaaatactggtttctaagtggttttgcttcaaaggatgtctagatgtaagtgattccacttaaagccaaaataaaaattcctaaagcagttcttaaaggagttagagagctatattaaacagtttttctgtggtataataatgtgtctcttactagaagtcccccacgaccaatgataatgaaaaaaccatcggttggtatttcaactacaagaacaccaagaaaaaaaaaaaaaaaataacaaaacaacaaacacaaaacagaaaaaagccaagcacaaaaacacagccaacaagcaacacaaaaacaaacaaaagggggggggggcgcggcacaaaaaaccccggggggggcccactatagccaacccgcctttaatagaaaggaggcccccaaggggggaataaaataaagcggagcgcgcgcgataaaaacaccgcaggagaggaaaacacgccacgagtcattcatgagaggaaagacacccaactgtctggcgagaacatagatgagcccacccaaaaccaaaggataaggcgccggcgacaaaaaacacgcggttgtgtaaggaccgcacattcgcgcggaaacattgtcttcgttcttcttcaataccccgtccaccacatcaaccgaagcagagcagcaagcagagaagagacagcgacacgtgaaaggacgcacaccacacaca

SEQ ID NO: 44132 - DNA, 2488 bp, Homo sapiens
acgtccccgccgggcccgcgcgcctcgtgcctcgcgcctcgcgcctccagccacgtccccgccccggctccggcgcgccgcggagttggctgctgggaggtgcgggactgggtgtggccggcggctctggtctcggctgtgagctgcgctctccacgccggctccgcgctccaggggctgctgagcgcccagcggacaccggcagcgcgcggtcgacgcgggcctgagctccctccagctgttttcactcattagctcctgaggtaaacaaattgaaaaaatgagcgaactggaacagttgaggcaagaagcagaacaactgcggaatcagattcaggatgctcggaaagcatgtaatgatgcaacgcttgttcagattacatcaaatatggactccgtgggtcgaatacaaatgcgaacaagacgtacactgaggggccacctagctaaaatctatgctatgcattggggatacgattccaggctgctagtcagtgcttctcaagatggaaaattaattatttgggatagctatacaacaaataagatgcatgctattcctttgaggtcctcctgggtgatgacctgtgcttatgctccctctggtaattatgttgcctgtggaggcttggacaacatctgctctatatataacttaaagaccagagagggaaatgtgagagtaagccgagagttgccaggtcacacagggtacttgtcctgctgtcgttttttagatgacagccaaattgttacaagttcaggagatacaacttgtgctttatgggacatcgaaactgcccagcagaccaccacattcactgggcattctggagatgtgatgagtctttctttgagtcctgacatgaggacttttgtttctggtgcttgtgatgcctcttccaaattatgggatattcgagatggaatgtgtagacagtctttcacgggacatgtctcagatatcaatgctgtcagtgtaagtgaatagcatttctagagaaaatttattatgcatttaaagtgttgagctctatggcatgattttaacaacaaattgccttcaaggattcttacaagtaatgtgctcttataactttgaatctccaagtcataagggtttttgattttttaaaaaagaaagcttcaattcatagtcctagatcttttttgttattgttggatttttttttgttgttatttttttgtttttttgagacagtcttgctctgtcgtccaggctggagtgcagcggtgcagtcacggctcactgcagcctcgacctcctgggctcaagcgatcctcccacctcagtctcctggtagctaggattacaggtacacaccaccatgcatggccaattttgtattttttatagagatggggttttgccatgttgtccaggctggtctcgaactcctgagctgaagcaatcttcctgcctcggcctcccaaagtgttgggattacaggcatgagccactgttcctggcaacctaggtttttaattgctggtgaatatcactttttttttttttttccaaagtggagggattatcatgagtaaacaagcagatcgtggatgttctaccagtgaattcagatgagaaaaaagtctcgtctttctgggaccaaagtgaacaacccaaagagagaacaataaggatgaaaaaagcagctgattagtgtggagtatagcttttgaagtcagtgcaacccgggacctaatcttagttctgctgccattaagcacctgtgtgaaactagtcatgctgcttcatcttcgtgaacctcagattcttcagtttttaaaatagggataataccacctacatcagagaatggtgtggagactaaatgaaactaggtattagatgctcagtaaatggtataaattattattattattatttagagacagggtctcattccgttgcccaggctggagtacaatggcatgatcatagctcacagcagccttgaactcctgggctcaagtgatcttcctgcctcagcctcaggagtactgtgactacaggcatacaccaccacacctggctagtgtttgtttgttttttttaatctttggtagaggcagagtctcactatgttgcccaggctgctcttgaactcctgggctcagcgatcctcccacctcagtcttccaaagtgctgggattacaaggagtgagctaccatgccttgctgtatcagttatttataagctacttcgtatttaaaaaaactacctaaacagaaaaccataaatagattaagccaggtaaaaagtactcagtatataggaggataagctagtcatagatatctgtaaattagggtaaagtgaaaataacattttgaatgacaatcaaaatgattatcaaatggtcagaattgagggggaggggtgttaaaagaaggtaggatactgcttgagttaggttacctaagcagatcagatgccaaacagtacagatatgactagaatg

SEQ ID NO: 44133 - DNA, 402 bp, Homo sapiens
aaaacccagcagaagaataggcaggtgttaatttttacattatataaattttacattttataaaggaaaaaaggcaataacttgaatgtccattaataatggcttagataaatcgtgctttatccatttgctggataactgtgctatgactaacatgaatgaaggaatgaagatctgtatgtattgatacagaaagacggacaaatacataattacaaaacacgttgattcagtcaacattagctgagggtcggccttgtccaagctccatctgaatgagtttctccaaggcagacttctgcctactcgtggcagaaccaccaaggagcttattaaaatgctgaatccagaccccattccaaccagcacagcttccggagagccctctctttccttgacttc

SEQ ID NO: 44134 - DNA, 407 bp, Homo sapiens
cccacgaccgctcagtggcttgttggctaccccgggtcggatgtgtggaggaggagtcctccaggccaagagagaattaagagctgacagggggtcagctccagactgggggacacagtgcaagagaagaggacagagggaagggactgagtgtggccctttgaggaaggaggatgcagcgggaggtggagagagctgcagtggaagcggcgtgagggcagggccagtgctggagtgggcttggtcgccagtgggacgtgtacgtttccttctaagtgttacggggttggttggatctgacttgaaggttcactctggctgtggggtggggagcagatggtaggggctgaggtggagtcaggagggcgaggccctggacatgggacgcttgggggatggtggatggg

SEQ ID NO: 44135 - DNA, 980 bp, Homo sapiens
aaaggtgaggcgcgtgacaaacccaaagtgctgagaaaagtgaggcacgtgacaaacccaaactgttgacaagggtgaggcgcgtgacaaacccgaactgctgagaaaagtgaggcgcttgataaacccaaactgccgagaaaggtgaggtgtgtgacaaacccaaactgttgagaaaggtgaggcgcgtgaaaaacacaagctgccgagaagggtgaggtgcatgaaaaacccaaggcctcattcagtgctttccaagaaagctggtgtcctgcactggagggaagagaagcacttctgtggggcctggggaaaagcaactcagagccacctcttcatattatcagattatgatgagaaaaagtattagggacagtattcctgacagtggacgagacttccaggcacacggcgcttcaatgtttagaactgtaaggcacgaggatctgacggagcacttgttagctctccacatcagtggggatctctgctcgtccccacagctgggctgctgaacttagcagtagagtgacttaaatataatttggtaccaacacaaatttgtgccttctgatctttgtataatcaaatgtctttactcatctcccaaactatctgtccctcctcaagatcctcaaatcctatctgcctgtcttctctagagactttggtcagtattcatggaaactgaaaaagcaggttagaaatcttgattaaatggtatttttttcaaagatattaggatgctttatccaaatagttgcttctacaaagaaagtagtcaaggttaaaaaggtagagaggaatctaaaaacatctgtcaaccctgtaataagctgtcacagtatggtcaaattactacctccaatagtaaaaggaaattgcagaagataaccatttttatctatttctagtctacataaaaagcaggccatcaattaattcacacagtaaataaagcaattgatcttttccaaaat

SEQ ID NO: 44136 - DNA, 2771 bp, Homo sapiens
ttttttgtatgaaacttggaggcttacaggtatagacagctttcagctacagcacattctaattttttattttgtttagttcttttgtattcacttctggtctctttaagactgttttaaaagaaatcaatttagggaaccccagttatataatataaactttgtaatctgagagaaaaaatgtatagtaaatctaagtcttgatttttaactttctattgtaaaaaataataatatacagagtttaatagaaggtgatgttttggttttgttttcccagaggctgccatatggtctttgagtacggggatgtcccaaactggcccaccaatgagcatggcggctccggccaggaatgccagagttagcctcccaggcttgcgggtggacatgcctgctccctgccagcctccagtggcctggccaggccctcccgagcctgtctgccctccccaggggtggaggagtctctgggccccaggaggattccctcccggagactcgcacggtgctccctgctcacgcgttgtcacagttagtccggaaatgactgaaaccaggcattctcccggacctcagcgtgggggagcctccaggcagacgctgggtatggagctgtggtgtggtctgtcctgtatggtggccagtgctttctgccagcatttctggatggatatagggactatcattagtatcctaatacacggtgattttaaaacaaccataaaattgattcagagtccactgacccttacagatgtaggtatacccttactggagagggaactctgatgaggagatgctggtaaattatcattttttaaattgctggtgagtctgacacttggtgagttttcagccagtttgttaaacttttaattaagttttgtttataataaaaatataaatggatttgaaagtttccattttttaaagttaccctcgttttcaaaggtattttctaaacagatctttaatggactatttaaaccgaatttaaggaattcacacacgacagttgacaggtcttcacgcaggctggttggtaacgtgctgccagcacagggctgggtgatacgtacaccctaagccgggggtgcctggggctggggggcgctccttgcaatgcccctccagccacagggcagtgaggtgctgcctgtgtgagccgtcgggggagcggccggctgtgggggcagcgcagcaggagcatcgtggggcctttccttctcggctggttctctgtgacggtggcgtcggctcgcctctgctcctttcatctagaaagaagccactgaccctgacagcccacggcgggtacactgagcagctgcattggtgctgtcacttttttaaggctttctgtccagacttcaacactggtttcttttcagagtttcgaaggattaatgacttcctcagcgcccttgctggcgggctgagggtgacagtcacgtccgtttcttctgtattagaaggctgcggtgattcaattagattgtcccactgctgagacctgtagggcagcttctaacatgcttttttcaaggggagaggagtagtgacaagtcgtgtgtcggaattggatttgagaacactctgaatgacccctggaggccgagggggcaggcttcgggcgtgaactgaactccagacccctctttgtgttgggcagtgtcatcttgcttacaaactgtaagacacatttttttgtgtgtttgtttttgttgttgttcttttgcagcactcacgcctctgacagtcttttgggaaagagtaacacccacatacagaatttgtcacatccagagtagcactgttccttaatactggcataatgcttccaggaagtttttcttttttatatttaaaatgttacttttctgtatgatgtgcatgcaagtttaccgtaacttttcttaaactttttagtgccgtttctagtatattcctgtaaatgtcagttactgaaaatgagtccaatgtaagtagtttagcttgtttattgcaatgctggcctcaacacaacagaataaaaatggtagaaagtactctttgatgtttctggtaatcatggacccttctcctggggcatttgttttgttttcataataaaaagcaaaaaaaaaaaaaagactgttttttttttttgcattttcctgtgctttctgtgggggctcccagcctctctcctggagcctggaaatgtctggaagcacctggtctggaacagccttcactggtccacagcaagggtgctgagctccccacacttgacatcctgtaactcttggcaaaaacacccagagcatccaaaaggggccccaaaaaaccatttaaaggcaggatgcagtggctcgtgcctgtgatcacagcactttgggaggctgaggcaggaggatggcctgaggcaggagtttgaggctgcagtaagccatgattgcatcactgcactccagcctggacaacatctcttaaaaaataataataatcaaaccattaagtagctcttgtcctgagccctggcaggatgaagggagcatcatttcttgcctcactaggaagccacaatcccctttactgacagttcattggttccctggaacaagctgccctcttcgagacagccaggttctgtgctcttctagtcaacctggccgcttgtcccctccctctgcacctcagtctatcctgaagtggcttgtgatgcgctcagtctaatggaaatgcaaataaaatcccaaaagcagattttcatagtgaggtttaac

SEQ ID NO: 44137 - DNA, 2737 bp, Homo sapiens
ttttttgtatgaaacttggaggcttacaggtatagacagctttcagctacagcacattctaattttttattttgtttagttcttttgtattcacttctggtctctttaagactgttttaaaagaaatcaatttagggaaccccagttatataatataaactttgtaatctgagagaaaaaatgtatagtaaatctaagtcttgatttttaactttctattgtaaaaaataataatatacagagtttaatagaaggtgatgttttggttttgttttcccagaggctgccatatggtctttgagtacggggatgtcccaaactggcccaccaatgagcatggcggctccggccaggaatgccagagttagcctcccaggcttgcgggtggacatgcctgctccctgccagcctccagtggcctggccaggccctcccgagcctgtctgccctccccaggggtggaggagtctctgggccccaggaggattccctcccggagactcgcacggtgctccctgctcacgcgttgtcacagttagtccggaaatgactgaaaccaggcattctcccggacctcagcgtgggggagcctccaggcagacgctgggtatggagctgtggtgtggtctgtcctgtatggtggccagtgctttctgccagcatttctggatggatatagggactatcattagtatcctaatacacggtgattttaaaacaaccataaaattgattcagagtccactgacccttacagatgtaggtatacccttactggagagggaactctgatgaggagatgctggtaaattatcattttttaaattgctggtgagtctgacacttggtgagttttcagccagtttgttaaacttttaattaagttttgtttataataaaaatataaatggatttgaaagtttccattttttaaagttaccctcgttttcaaaggtattttctaaacagatctttaatggactatttaaaccgaatttaaggaattcacacacgacagttgacaggtcttcacgcaggctggttggtaacgtgctgccagcacagggctgggtgatacgtacaccctaagccgggggtgcctggggctggggggcgctccttgcaatgcccctccagccacagggcagtgaggtgctgcctgtgtgagccgtcgggggagcggccggctgtgggggcagcgcagcaggagcatcgtggggcctttccttctcggctggttctctgtgacggtggcgtcggctcgcctctgctcctttcatctagaaagaagccactgaccctgacagcccacggcgggtacactgagcagctgcattggtgctgtcacttttttaaggctttctgtccagacttcaacactggtttcttttcagagtttcgaaggattaatgacttcctcagcgcccttgctggcgggctgagggtgacagtcacgtccgtttcttctgtattagaaggctgcggtgattcaattagattgtcccactgctgagacctgtagggcagcttctaacatgcttttttcaaggggagaggagtagtgacaagtcgtgtgtcggaattggatttgagaacactctgaatgacccctggaggccgagggggcaggcttcgggcgtgaactgaactccagacccctctttgtgttgggcagtgtcatcttgcttacaaactgtaagacacatttttttgtgtgtttgtttttgttgttgttcttttgcagcactcacgcctctgacagtcttttgggaaagagtaacacccacatacagaatttgtcacatccagagtagcactgttccttaatactggcataatgcttccaggaagtttttcttttttatatttaaaatgttacttttctgtatgatgtgcatgcaagtttaccgtaacttttcttaaactttttagtgccgtttctagtatattcctgtaaatgtcagttactgaaaatgagtccaatgtaagtagtttagcttgtttattgcaatgctggcctcaacacaacagaataaaaatggtagaaagtaaaaaaaaaaaaaaaaaaaaaaaaaaaaaaaaagaaaaaaaaaaaaaaaaaaaaacaagaaagacgacaaaacaaagaaagaacaaaaaaaacaaaggaacaaaagaggaccgtaaaacagacgcggacaaaacacactaacacagaggaacgcaacattaaacaacagtccatatccggtaacccgcgcactgagaaccctgacacaagacacacaaaacacagcggcgcgagcacaccacacaggaaccacaaccaacctagcagtaggataacacaccaaaggcaagcgacacacacaccagcgccaacgcggcgaacacacacacgaacaccccacccgacgcacaaccagcgcccaccgagaacacaatcaccgaacacactcaacacgcagccggacacaagagcaggacgaacaggactgactagtaggatggactgaagggaacagcacacaacagcagaagaccccgtgacagcgaggtcgacaaacacaaactaagtaccgaacgaccacaccgaccacagcacgaccacctgggaacgaagcaaataacaagagaaagcggaacaaggatcgagggagaacgcgcacgggagaggctagatgagcgagagacgaaccaaagcaagagagatagaggaaaggaggcagagcgaaagcaggacagatacgaacggaca

SEQ ID NO: 44138 - DNA, 2002 bp, Homo sapiens
ttttttgtatgaaacttggaggcttacaggtatagacagctttcagctacagcacattctaattttttattttgtttagttcttttgtattcacttctggtctctttaagactgttttaaaagaaatcaatttagggaaccccagttatataatataaactttgtaatctgagagaaaaaatgtatagtaaatctaagtcttgatttttaactttctattgtaaaaaataataatatacagagtttaatagaaggtgatgttttggttttgttttcccagaggctgccatatggtctttgagtacggggatgtcccaaactggcccaccaatgagcatggcggctccggccaggaatgccagagttagcctcccaggcttgcgggtggacatgcctgctccctgccagcctccagtggcctggccaggccctcccgagcctgtctgccctccccaggggtggaggagtctctgggccccaggaggattccctcccggagactcgcacggtgctccctgctcacgcgttgtcacagttagtccggaaatgactgaaaccaggcattctcccggacctcagcgtgggggagcctccaggcagacgctgggtatggagctgtggtgtggtctgtcctgtatggtggccagtgctttctgccagcatttctggatggatatagggactatcattagtatcctaatacacggtgattttaaaacaaccataaaattgattcagagtccactgacccttacagatgtaggtatacccttactggagagggaactctgatgaggagatgctggtaaattatcattttttaaattgctggtgagtctgacacttggtgagttttcagccagtttgttaaacttttaattaagttttgtttataataaaaatataaatggatttgaaagtttccattttttaaagttaccctcgttttcaaaggtattttctaaacagatctttaatggactatttaaaccgaatttaaggaattcacacacgacagttgacaggtcttcacgcaggctggttggtaacgtgctgccagcacagggctgggtgatacgtacaccctaagccgggggtgcctggggctggggggcgctccttgcaatgcccctccagccacagggcagtgaggtgctgcctgtgtgagccgtcgggggagcggccggctgtgggggcagcgcagcaggagcatcgtggggcctttccttctcggctggttctctgtgacggtggcgtcggctcgcctctgctcctttcatctagaaagaagccactgaccctgacagcccacggcgggtacactgagcagctgcattggtgctgtcacttttttaaggctttctgtccagacttcaacactggtttcttttcagagtttcgaaggattaatgacttcctcagcgcccttgctggcgggctgagggtgacagtcacgtccgtttcttctgtattagaaggctgcggtgattcaattagattgtcccactgctgagacctgtagggcagcttctaacatgcttttttcaaggggagaggagtagtgacaagtcgtgtgtcggaattggatttgagaacactctgaatgacccctggaggccgagggggcaggcttcgggcgtgaactgaactccagacccctctttgtgttgggcagtgtcatcttgcttacaaactgtaagacacatttttttgtgtgtttgtttttgttgttgttcttttgcagcactcacgcctctgacagtcttttgggaaagagtaacacccacatacagaatttgtcacatccagagtagcactgttccttaatactggcataatgcttccaggaagtttttcttttttatatttaaaatgttacttttctgtatgatgtgcatgcaagtttaccgtaacttttcttaaactttttagtgccgtttctagtatattcctgtaaatgtcagtcgactcggccgttaatttagtagtagtaggcggccgc

SEQ ID NO: 44139 - DNA, 1421 bp, Homo sapiens
gacctagaggatccccgtcattttcaacactggtttcttttcagagtttcgaaggattaatgacttcctcagcgcccttgctggcgggctgagggtgacagtcacgtccgtttcttctgtattagaaggctgcggtgattcaattagattgtcccactgctgagacctgtagggcagcttctaacatgcttttttcaaggggagaggagtagtgacaagtcgtgtgtcggaattggatttgagaacactctgaatgacccctggaggccgagggggcaggcttcgggcgtgaactgaactccagacccctctttgtgttgggcagtgtcatcttgcttacaaactgtaagacacatttttttgtgtgtttgtttttgttgttgttcttttgcagcactcacgcctctgacagtcttttgggaaagagtaacacccacatacagaatttgtcacatccagagtagcactgttccttaatactggcataatgcttccaggaagtttttcttttttatatttaaaatgttacttttctgtatgatgtgcatgcaagtttaccgtaacttttcttaaactttttagtgccgtttctagtatattcctgtaaatgtcagttactgaaaatgagtccaatgtaagtagtttagcttgtttattgcaatgctggcctcaacacaacagaataaaaatggtagaaagtactctttgatgtttctggtaatcatggacccttctcctggggcatttgttttgttttcataataaaaagcaaaaaaaaaaaaaagactgttttttttttttgcattttcctgtgctttctgtgggggctcccagcctctctcctggagcctggaaatgtctggaagcacctggtctggaacagccttcactggtccacagcaagggtgctgagctccccacacttgacatcctgtaactcttggcaaaaacacccagagcatccaaaaggggccccaaaaaaccatttaaaggcaggatgcagtggctcgtgcctgtgatcacagcactttgggaggctgaggcaggaggatggcctgaggcaggagtttgaggctgcagtaagccatgattgcatcactgcactccagcctggacaacatctcttaaaaaataataataatcaaaccattaagtagctcttgtcctgagccctggcaggatgaagggagcatcatttcttgcctcactaggaagccacaatcccctttactgacagttcattggttccctggaacaagctgccctcttcgagacagccaggttctgtgctcttctagtcaacctggccgcttgtcccctccctctgcacctcagtctatcctgaagtggcttgtgatgcgctcagtctaatggaaatgcaaataaaatcccaaaagcagattttcatagtgaggtttaac

SEQ ID NO: 44140 - DNA, 1812 bp, Homo sapiens
ttttttgtatgaaacttggaggcttacaggtatagacagctttcagctacagcacattctaattttttattttgtttagttcttttgtattcacttctggtctctttaagactgttttaaaagaaatcaatttagggaaccccagttatataatataaactttgtaatctgagagaaaaaatgtatagtaaatctaagtcttgatttttaactttctattgtaaaaaataataatatacagagtttaatagaaggtgatgttttggttttgttttcccagaggctgccatatggtctttgagtacggggatgtcccaaactggcccaccaatgagcatggcggctccggccaggaatgccagagttagcctcccaggcttgcgggtggacatgcctgctccctgccagcctccagtggcctggccaggccctcccgagcctgtctgccctccccaggggtggaggagtctctgggccccaggaggattccctcccggagactcgcacggtgctccctgctcacgcgttgtcacagttagtccggaaatgactgaaaccaggcattctcccggacctcagcgtgggggagcctccaggcagacgctgggtatggagctgtggtgtggtctgtcctgtatggtggccagtgctttctgccagcatttctggatggatatagggactatcattagtatcctaatacacggtgattttaaaacaaccataaaattgattcagagtccactgacccttacagatgtaggtatacccttactggagagggaactctgatgaggagatgctggtaaattatcattttttaaattgctggtgagtctgacacttggtgagttttcagccagtttgttaaacttttaattaagttttgtttataataaaaatataaatggatttgaaagtttccattttttaaagttaccctcgttttcaaaggtattttctaaacagatctttaatggactatttaaaccgaatttaaggaattcacacacgacagttgacaggtcttcacgcaggctggttggtaacgtgctgccagcacagggctgggtgatacgtacaccctaagccgggggtgcctggggctggggggcgctccttgcaatgcccctccagccacagggcagtgaggtgctgcctgtgtgagccgtcgggggagcggccggctgtgggggcagcgcagcaggagcatcgtggggcctttccttctcggctggttctctgtgacggtggcgtcggctcgcctctgctcctttcatctagaaagaagccactgaccctgacagcccacggcgggtacactgagcagctgcattggtgctgtcacttttttaaggctttctgtccagacttcaacactggtttcttttcagagtttcgaaggattaatgacttcctcagcgcccttgctggcgggctgagggtgacagtcacgtccgtttcttctgtattagaaggctgcggtgattcaattagattgtcccactgctgagacctgtagggcagcttctaacatgcttttttcaaggggagaggagtagtgacaagtcgtgtgtcggaattggatttgagaacactctgaatgacccctggaggccgagggggcaggcttcgggcgtgaactgaactccagaccgatgttatcgccccacacgttatcgtagtggtggtggtgatgagtaccgtggttggggtctgtgtgccggtgggtgtcggggttggggtcaccgtggtgttggtggtgatggtgtcgtgttggggtctgtgtgccggtggtgttgggattctgcg

SEQ ID NO: 44141 - DNA, 1998 bp, Homo sapiens
ctgtcgcctggttgggcccggaaatgggacgtcgcgctttctcagggagcttagaagcagccagggcctctccaagccgctgctgtgacagaaagtgagtgagctgccggaggatgtccaccgccacgacagtcgcccccgcggggatcccggcgaccccgggccctgtgaacccaccccccccggaggtctccaaccccagcaagcccggccgcaagaccaaccagctgcagtacatgcagaatgtggtggtgaagacgctctggaaacaccagttcgcctggcccttctaccagcccgtggacgcaatcaaattgaacctgccggattatcataaaataattaaaaacccaatggatatggggactattaagaagagactagaaaataattattattggagtgcaagcgaatgtatgcaggacttcaacaccatgtttacaaattgttacatttataacaagcccacagatgacatagtgctaatggcccaagctttagagaaaatttttctacaaaaagtggcccagatgccccaagaggaagttgaattattaccccctgctccaaagggcaaaggtcggaagccggctgcgggagcccagagcgcaggtacacagcaagtggcggccgtgtcctctgtctccccagcgaccccctttcagagcgtgccccccaccgtctcccagacgcccgtcatcgctgccacccctgtaccaaccatcactgcaaacgtcacgtcggtcccagtccccccagctgccgccccacctcctcctgccacacccatcgtccccgtggtccctcctacgccgcctgtcgtcaagaaaaagggcgtgaagcggaaagcagacacaaccactcccacgacgtcggccatcactgccagccggagtgagtcgcccccgccgttgtcagaccccaagcaggccaaagtggtggcccggcgggagagtggtggccgccccatcaagcctcccaagaaggacctggaggacggcgaggtgccccagcacgcaggcaagaagggcaagctgtcggagcacctgcgctactgcgacagcatcctcagggagatgctatccaagaagcacgcggcctacgcctggcccttctacaagccagtggatgccgaggccctggagctgcacgactaccacgacatcatcaagcacccgatggacctcagcaccgtgaaaaggaagatggatggccgagagtacccagacgcacagggctttgctgctgatgtccggctgatgttctcgaattgctacaaatacaatcccccagaccacgaggttgtggccatggcccggaagctccaggacgtgtttgagatgaggtttgccaagatgccagatgagcccgtggaggcaccggcgctgcctgcccccgcggcccccatggtgagcaagggcgctgagagcagccgtagcagtgaggagagctcttcggactcaggcagctcggactcggaggaggagcgggccaccaggctggcggagctgcaggagcagctgaaggccgtgcacgagcagctggccgccctgtctcaggccccagtaaacaaaccaaagaagaagaaggagaaagaaggagaaggagaagaagaagaaggacaaggagaaggagaaggagaagcacaaagtgaaggccgatggaagagaagaaggccaaggtggctccgcctgccaagcaggctcagcagaagaaggctcctgccaagaaggccaacagcacgaccacggccggcagacagctgaagaaaggcggcaagcaggcatctgcctcctacgactcagaggaagaggaggagggcctgcccatgagctacgatgaaaagcgccagcttagcctggacatcaaccggctgcccggggagaagctgggccgggtagtgcacatcatccaatctcgggagccctcgctcagggactccaaccccgatgagatagaaattgactttgagactctgaaacccaccactttgcggga

SEQ ID NO: 44142 - DNA, 1766 bp, Homo sapiens
ctgtcgcctggttgggcccggaaatgggacgtcgcgctttctcagggagcttagaagcagccagggcctctccaagccgctgctgtgacagaaagtgagtgagctgccggaggatgtccaccgccacgacagtcgcccccgcggggatcccggcgaccccgggccctgtgaacccaccccccccggaggtctccaaccccagcaagcccggccgcaagaccaaccagctgcagtacatgcagaatgtggtggtgaagacgctctggaaacaccagttcgcctggcccttctaccagcccgtggacgcaatcaaattgaacctgccggattatcataaaataattaaaaacccaatggatatggggactattaagaagagactagaaaataattattattggagtgcaagcgaatgtatgcaggacttcaacaccatgtttacaaattgttacatttataacaagcccacagatgacatagtgctaatggcccaagctttagagaaaatttttctacaaaaagtggcccagatgccccaagaggaagttgaattattaccccctgctccaaagggcaaaggtcggaagccggctgcgggagcccagagcgcaggtacacagcaagtggcggccgtgtcctctgtctccccagcgaccccctttcagagcgtgccccccaccgtctcccagacgcccgtcatcgctgccacccctgtaccaaccatcactgcaaacgtcacgtcggtcccagtccccccagctgccgccccacctcctcctgccacacccatcgtccccgtggtccctcctacgccgcctgtcgtcaagaaaaagggcgtgaagcggaaagcagacacaaccactcccacgacgtcggccatcactgccagccggagtgagtcgcccccgccgttgtcagaccccaagcaggccaaagtggtggcccggcgggagagtggtggccgccccatcaagcctcccaagaaggacctggaggacggcgaggtgccccagcacgcaggcaagaagggcaagctgtcggagcacctgcgctactgcgacagcatcctcagggagatgctatccaagaagcacgcggcctacgcctggcccttctacaagccagtggatgccgaggccctggagctgcacgactaccacgacatcatcaagcacccgatggacctcagcaccgtgaaaaggaagatggatggccgagagtacccagacgcacagggctttgctgctgatgtccggctgatgttctcgaattgctacaaatacaatcccccagaccacgaggttgtggccatggcccggaagctccaggacgtgtttgagatgaggtttgccaagatgccagatgagcccgtggaggcaccggcgctgcctgcccccgcggcccccatggtgagcaagggcgctgagagcagccgtagcagtgaggagagctcttcggactcaggcagctcggactcggaggaggagcgggccaccaggctggcggagctgcaggagcagctgaaggccgtgcacgagcagctggccgccctgtctcaggccccagtaaacaaaccaaagaagaagaaggagaaagaaggagaaacattcccattataaaacatgcatgcaaatcattaatcataatataaatttataattgaactttgaaatttcaagttttacctgaaataacttctctattagtagtttctacttcattggagaatttttttaagtgattattacctactagtttatcctgag

SEQ ID NO: 44143 - DNA, 1358 bp, Homo sapiens
ctgtcgcctggttgggcccggaaatgggacgtcgcgctttctcagggagcttagaagcagccagggcctctccaagccgctgctgtgacagaaagtgagtgagctgccggaggatgtccaccgccacgacagtcgcccccgcggggatcccggcgaccccgggccctgtgaacccaccccccccggaggtctccaaccccagcaagcccggccgcaagaccaaccagctgcagtacatgcagaatgtggtggtgaagacgctctggaaacaccagttcgcctggcccttctaccagcccgtggacgcaatcaaattgaacctgccggattatcataaaataattaaaaacccaatggatatggggactattaagaagagactagaaaataattattattggagtgcaagcgaatgtatgcaggacttcaacaccatgtttacaaattgttacatttataacaagcccacagatgacatagtgctaatggcccaagctttagagaaaatttttctacaaaaagtggcccagatgccccaagaggaagttgaattattaccccctgctccaaagggcaaaggtcggaagccggctgcgggagcccagagcgcaggtacacagcaagtggcggccgtgtcctctgtctccccagcgaccccctttcagagcgtgccccccaccgtctcccagacgcccgtcatcgctgccacccctgtaccaaccatcactgcaaacgtcacgtcggtcccagtccccccagctgccgccccacctcctcctgccacacccatcgtccccgtggtccctcctacgccgcctgtcgtcaagaaaaagggcgtgaagcggaaagcagacacaaccactcccacgacgtcggccatcactgccagccggagtgagtcgcccccgccctgtctcaggccccagtaaacaaaccaaagaagaagaaggagaaagaaggagaaggagaagaagaagaaggacaaggagaaggagaaggagaagcacaaagtgaaggccgatggaagagaagaaggccaaggtggctccgcctgccaagcaggctcagcagaagaaggctcctgccaagaaggccaacagcacgaccacggccggcagacagctgaagaaaggcggcaagcaggcatctgcctcctacgactcagaggaagaggaggagggcctgcccatgagctacgatgaaaagcgccagcttagcctggacatcaaccggctgcccggggagaagctgggccgggtagtgcacatcatccaatctcgggagccctcgctcagggactccaaccccgatgagatagaaattgactttgagactctgaaacccaccactttgcggga

SEQ ID NO: 44144 - DNA, 1033 bp, Homo sapiens
ttattattttctagtctcttcctaagtagttacatatccattgggtatttaattatttaatgataacccggccgcaagaccaaccagctgcagtacatgcagaatgtggtggtgaagacgctctggaaacaccagttcgcctggcccttctacaagccagtggatgccgaggccctggagctgcacgactaccacgacatcatcaagcacccgatggacctcagcaccgtgaaaaggaagatggatggccgagagtacccagacgcacagggctttgctgctgatgtccggctgatgttctcgaattgctacaaatacaatcccccagaccacgaggttgtggccatggcccggaagctccaggacgtgtttgagatgaggtttgccaagatgccagatgagcccgtggaggcaccggcgctgcctgcccccgcggcccccatggtgagcaagggcgctgagagcagccgtagcagtgaggagagctcttcggactcaggcagctcggactcggaggaggagcgggccaccaggctggcggagctgcaggagcagctgaaggccgtgcacgagcagctggccgccctgtctcaggccccagtaaacaaaccaaagaagaagaaggagaaagaaggagaaggagaagaagaagaaggacaaggagaaggagaaggagaagcacaaagtgaaggccgatggaagagaagaaggccaaggtggctccgcctgccaagcaggctcagcagaagaaggctcctgccaagaaggccaacagcacgaccacggccggcagacagctgaagaaaggcggcaagcaggcatctgcctcctacgactcagaggaagaggaggagggcctgcccatgagctacgatgaaaagcgccagcttagcctggacatcaaccggctgcccggggagaagctgggccgggtagtgcacatcatccaatctcgggagccctcgctcagggactccaaccccgatgagatagaaattgactttgagactctgaaacccaccactttgcggga

SEQ ID NO: 44145 - DNA, 436 bp, Homo sapiens
ctaccgtggcacatgtatacctatgtaacaaacctgcacattctgcacatgtatccccgaacttaaagtataatacattttttttaaaaagttagctgccctcaccgagtccctgttgtgccacccgcgcagtgctgagcctgtggccaggcagctcttccccactgcaggcgaagaagccgaggcggagagggctcatgactcactgggggtcacgggagtgaggggcagagcagggcccaggtgctcctggttcacctcctcacccagctgaggcagctccgacatcgccccaagccccctccaatcccagggcgccacgcagccccagtggtgtgggccgtgcccagcacctgctcagccgcccgctcttttccagctgaaggccgtgcacgagcagctggccgccctgtctcaggccccagtaaacaaacca

SEQ ID NO: 44146 - DNA, 711 bp, Homo sapiens
agttgggaatctatagcctgctaccatttattgtgtagcctgcaaatggtttttacatttttaatacattggaaaaaaaattaaagaagattattatttcgtgatgtgaaaattatacatgttgaaaggaaaactttagagtttaattgagtaaagaatgatctgtgaattaggcagcccccagaaccagagtagggttggttacagctgagcatttgccttatttgaacctggtttgaagagttggctgcctgtggttggctgaagttcagctgctgtgattggctgagactcactacttgttacaagagtaggttacatatcaagttttacatatcaagttgaaatatagttttttatgtactgggaaacctttagggtaaacttaaaatatgtaaggaggcagctttaggccacaatgaatttaacaattcctccttttggtcaacctgtcaattttgagaggatgattaattttgaggttgcccaaaactttaggcattgacatcactttttatcatcataaatagagttatttggtctctaatcccattggaaaatagcagaacactggattttgtaaggtgggaacaaggaaacagtatagaaaaaaaaaactgattggttaacatcagattacttttttatttttttgtcacccaggatggagtgcagtggcacaatcttggctcactgcaacgtcaccttttg

SEQ ID NO: 44147 - DNA, 275 bp, Homo sapiens
gaaataccacatgcaataagtgaaattaagtttgagcatttatacttatcacacgaacaatatctttctaaacataatctttgagaatattccctcttaaagcatcagagataaggtgcaatttatattgatacttttccatctcattagaatcttttgtgagcaatctatagcctggagcatctgtttctgcttctagtggtgtggttagaaagcagatttaactattttggctttggagtttgctttaaagctaatataggcaaaagtcacgt

SEQ ID NO: 44148 - DNA, 450 bp, Homo sapiens
tcacataaacaacacttatacttcctgtaaacccaattaaaaccacatttcaggtttgctcttatgatttagaagtaaatttagaatcagtttcatgaatcttgcagtatttttcaaattaatgtctttaggcatttggacaatgggctgtgtgaatgcaaactgcgttttcttcaattgctatcaattagagacagttaagaactcaactgatgaagaaatagccacctgaaagtgagcccacaggcaagtcacaggcccctcttcctcctgaaggtgcacgggagacttcgttaaaaaaaaaaaagctgtagtaaaatacgtataagataaaaatttaccattttaagtttcttttttttgaagacgaagccttgctctgtcacccaggctggagtgcagtggtgtgatcacaattcactgcagcctcaccctctccggctcaagcga

SEQ ID NO: 44149 - DNA, 344 bp, Homo sapiens
acctttagaatggttaaaaatatttctccggtagccatatgattattattcatccattagataatatagtcaaatgggccatgttatttactgttcatagaagaggggctttttgcaacttgggctacaaaggagatatgtaaggaatttaaggaatggttacatggaactagatttaattgaatctagtggtttaattgattcactaggatatatgctactgaaaggggaatctgcttaaagtgctttctgatatttattattactaaaacttagaatttattaaaaatactgactgtgaaaattacttgggtcgtttgcctttttaaaaggatttttggcat

SEQ ID NO: 44150 - DNA, 8570 bp, Homo sapiens
gattacaggcgtgagccaccacacctggcccagttaagagagtcttaactctcttaactctcttgtcacaaggaaaagagaccttgtgacactgaaatgactcggggtggtgggggaacaagccagccctttccctgaaggaggcctctaacctctcctctcaggtcctcagctattaactggaggaaacagctgctttttcagtgcttctcagctactctgtttagctgagagatgaagtaggaagatttggacttctcttattgaaaggcctagagaaggttttggtgtccttttaagatgtcacagaaaatttttgtttcaggattgtagggagcagattcctactgttcttaaaggacagtaatgccttttgagtctggtctgaagaacataacaggtctgtgatcagaagtaggttgcatctctctcaactttaatttccttagctatacctgtagggatgacttaagcctaggggagctcctatatttgggaagcttgtgcacagggaagccttaaatgatggtgcctgcagattggatctagtagaaattaggtccttgggcatggatgcttggggaacctctcagtgacctcaggtgaacttgttgctcgtagagccaagaggcgaagttaattcaggccttccttttgaccactgccccctcttcctaggccttggcccctccaccagaggaaggtgctgccacgtgtctgctccttctgaacctccaggtttctgctacgttgccccatggaggacacacccccctcactcagctgctccgactgtcagcgccactttcccagcctcccagagctctctcggcaccgagaactgctccatccatctcccaaccaggacagtgaggaggctgacagcatccctcggccctaccgttgtcagcagtgtgggcggggctaccgtcaccccgggagcctggttaaccatcgtcggacccacgagactggccttttcccctgtaccacctgtggcaaggacttctccaatcccatggctctcaagagccatatgaggacacatgctcctgagggccgccgcaggcacaggcccccacgccccaaggaagccactccacacctccagggtgagacggtgtccactgactcctggggccaaaggcttggctctagtgaaggctgggaaaaccagacaaaacatacagaagagacacctgactgtgaatctgtacctgaccccagggcagcttcgggtacgtgggaagatctgcccaccagacaaagagaaggcttggcaagccacccaggtcctgaggatggtgcagacggctggggaccctccactaactctgccagagcccctcctctccccatcccagccagcagccttcttagcaacttggaacagtatctggctgaatcagtagtgaacttcacagggggccaggagcccacccagtcccctcctgctgaggaggagcggcggtacaaatgtagtcagtgtggcaagacctacaagcacgccgggagcctcaccaaccaccgccagagccacacgctgggcatctacccctgtgccatctgtttcaaggagttctctaacctcatggctctgaagaaccactctcgactgcatgcccagtatcggccttaccactgtccccactgcccccgtgtcttccggctcccccgggagctgctggaacaccagcagtcccatgagggtgaaaggcaggagccacgctgggaggagaaagggatgcccaccaccaatgggcacacagatgagagcagccaggaccagctccccagtgcacagatgctgaatggctctgcggagctcagcacctctggggagctggaggacagtggcctggaggaataccggcctttccgctgtggggactgtggccgtacttaccgccatgctgggagcctcatcaaccatcgaaagagccaccagacaggtgtctacccctgctcactctgttctaagcagctgttcaatgcggctgccctcaaaaaccatgtgcgggctcatcacaggcccaggcaaggagttggggaaaatgggcagccatcagtcccaccagctcccctgctgctggctgagaccacccacaaagaggaagaggaccccaccaccaccctggaccatcggccctataagtgcagtgagtgtggtcgtgcttaccgccaccgggggagcctggtgaaccatcgccacagccatcggactggagagtaccagtgctcactctgtccccgcaagtaccccaatctcatggccctgcgcaaccacgtgcgggtacattgcaaggctgctcgccgaagtgcagacatcggggctgagggtgcccccagccacctcaaggtagaactcccgcctgacccagtggaggcagaggcagccccgcacacagatcaggaccatgtgtgcaaacatgaagaagaggccacggacatcaccccagcagcagacaagacagcagcacatatctgtagcatctgtgggctgctctttgaagacgctgagagccttgaacgtcatggcctgactcatggggcaggggaaaaggaaaatagcagaacagagaccacaatgtcacctcctagggcctttgcctgccgagactgtggaaagagctatcgccactcaggcagccttatcaaccacaggcagacccaccagacaggagacttcagttgtggggcctgtgccaagcacttccacaccatggctgccatgaagaaccacttgcgccggcacagtcggcggcggagcaggcggcatcggaagcgggctggcggtgccagcggtgggagagaagccaaactcctggcagcggagagctggacccgggagctagaagacaatgaaggcctggagtctccccaagacccttcaggggaaagtcctcatggggctgaaggcaacctggaaagtgatggggactgtttgcaggctgaatctgaaggggacaaatgtgggcttgagagggatgagacccatttccagggtgataaagagagcggaggcactggggaaggactggaaaggaaggatgccagtttacttgacaacttggacatcccaggtgaggaaggtggtggcactcacttctgcgatagcctcactggggtggatgaagaccagaagccagccactggccaacccaactcctcttcccactctgccaatgctgtcactggctggcaggctggggccgctcacacatgctctgactgtgggcattctttcccccatgccactggcctgctgagccacaggccctgccacccaccaggcatctatcagtgctccctctgcccgaaggagtttgactctctgcctgccctccgcagccacttccagaaccataggcctggggaggcgacctcagcacagcctttcctctgctgcctctgtggcatgatcttccctgggcgggctggctacaggcttcaccggcgccaggcccacagctcctctggcatgactgagggctcagaggaggagggggaagaggaaggagtggcagaggcagcccctgcacgcagtccaccactgcagctctcggaagcagagctgctgaatcagctgcagcgggaggtggaagcgctggacagtgcagggtatgggcacatctgtggctgctgtggtcagacctacgatgacctggggagcctggagcgtcaccaccaaagtcagagttctgggactactgcagacaaggctcccagccccttgggagtggcaggtgatgccatggagatggtcgtggacagtgtcttggaggacatagtgaattctgtctctggagagggtggagatgccaagtctcaagagggagcaggcacccccttgggagacagcctctgcatccagggtggggaaagtttgttggaggctcagccccgccccttccgctgcaaccagtgtggcaagacctatcgccatgggggcagcctggtgaaccaccgcaagatccaccagactggagactttctctgccctgtctgctcccgctgctaccccaacctggctgcctaccgtaatcatctgcggaaccaccctcgctgcaaaggctctgagccccaggttgggcccatcccagaggcagcaggtagcagtgagctgcaggttgggcccatcccagaaggaggcagcaacaagccccagcacatggcagaggaggggccggggcaagcagaagtcgagaagctccaggaagaacttaaagtggagcccctggaggaagtggccagggtgaaagaagaggtgtgggaggagaccactgtgaagggggaggagatagagcccaggctggagactgccgagaagggctgccagactgaagccagctctgagcggcccttcagctgcgaggtgtgtggccgatcctacaagcacgccggcagcctcatcaaccaccggcagagccaccagaccggccactttggctgtcaggcctgctccaagggcttctcaaacctcatgtccctcaagaaccaccggcgcatccatgcagatccccgacgtttccgctgcagcgagtgtgggaaggccttccgcctgcggaaacagctggccagccaccagcgggtccacatggaacggcgtgggggtgggggcacccgaaaggcgactcgggaagatcggcccttccgctgtgggcagtgcgggcggacctatcgccacgccggcagcctcctgaaccaccggcgcagccacgagacgggccagtacagctgccccacctgccccaagacctactccaaccgcatggccctgaaggaccaccagaggctgcactcagagaatcggcggcgacgggctggacggtccaggcgcacagctgtgcgttgcgccctctgtggccgcagcttccctggccggggatctttggagcggcacctgcgggagcatgaggagacagaaagggagccagccaatggccagggaggcctggatggcacagcggccagtgaggcgaacctgactggcagccagggactagagacccaattgggtggtgctgagccagtaccccacttggaggatggagtcccaaggccaggggagcgcagtcagagccccatcagggcagcaagctcagaagccccagagccactgtcctggggtgcagggaaggcaggtgggtggccggtaggtgggggactggggaatcatagtggaggctgggttcctcagttcctaactaggtcagaggagccagaggacagtgtccacaggagtccttgccacgctggtgactgccagctcaatggacctactctgagtcacatggatagctgggacaacagagacaacagctctcagctgcagccagggagccactcctcttgcagccagtgtggcaagacttactgccagtcaggcagcctcttgaaccacaacaccaacaagacagaccgacactattgcctgctctgctccaaggagttcttaaatcctgtggccacaaagagccacagccacaaccacatagacgcccagacctttgcctgtcctgactgtggcaaagcctttgagtcccaccaggaactggccagccacctgcaggctcatgcccggggccacagccaggtgccagcccagatggaggaggccagagatcccaaagccgggactggggaggaccaggtggttctccctggtcaagggaaagcccaggaggccccatcagaaacccccagaggcccaggagagagtgtggagagagccaggggaggacaagcggtgacgtccatggcggctgaggacaaggagcggcccttccgctgcacccagtgcgggcgctcctaccgccatgctggcagcctgctgaaccaccagaaggcccacaccacagggttgtacccgtgctccctctgtcccaaacttctccctaacctgctgtctcttaagaaccacagcaggacccacacggaccccaagcgccactgctgcagcatctgtggcaaggcctttcggacagctgcccggctggagggccacgggcgggtccatgcaccccgggaggggcctttcacctgcccccattgtccccgccacttccgccgccgaatcagcttcgtgcagcaccagcagcagcaccaggaggagtggacggtggccggctccggtagggggcatgaagggtcccaggaggaggtgggcacacagtggagggggaagtccagccccaaagtcggtgggggagcaaggagtgagaggagagagccccggggattctaagaggtgggtgggggcttggctatggggtgagagaagtagcttgaggatgtgctgagctgagcacccgcaagtcaggtataacaaatagcagggtgggttgggcagcacgtgggggcgtggtcaggccgaggctgctacctgggctcctccattacactgtagccagaatggaatggtctttctgttcaggggaaggtcactgggtaccccctggctgctgtgtctggaaaccctcctgagtcagccagtaaagtaatgacttccagagaaaaagaggaagccattggtttggtctaggttccattctttcctggagcaggccgggtgccagggaacaagggatggggcatgggctccacggcttccctgctgacttggccacggaaactggttcactggttggcaccctactccctgtccctctttccctgcgccttgtctctgctgctcctctccttggaaactagacctctggtccttccctgtcagtgttgctcccatctcttctctaacctttattcagccccttttccctctgctgccaacggcctttttaggatccaaccaaaccaccctttctacctgcgcaccctgccaccctctgcacacctttaactggaggactgagtcacagataattgtttccttgaagtccaggcccagctgcagcaacaacagtcattagcccgtgtcacatccctgatcagagggcatctccgtggggaatcgcctccacccagcactgctggaagccgcggctgccagggagtggggcggccggttccctcagcaggacctgggctggcctctccacctcccctagtagaggcggacccattccatctagtggccaccgagggtgggtggccctgagatggtgggcccttgacaggccttgtcagagcagagggcaggtgggagtcacctgaaagctgaaggaatggctttaaggatagaagatttctcatgacctcaagggatatgagggaggagccagtttgccagggctgggaaaataattaggaggcctagaatccctgttctcatctgggcctccggggccaggggcaggggaatggcctgcagggctgggagggggtacacgctgtgcggggtctgcccctcagttggtgacctcctctctctctccccccaggagccccagtggcaccagtgacgggcagaggggacttgccattgccccctccacccacccccacgaccccactcctggatccttcaccccagtggcctgcagacctcagcttctccctctgaacttcaagtctccaaagatcagaatctgggggagggagcgcgtgcagggaggggcttgatctccacattttctcaggagtagttcgggcatccccatatcttctcctctccccttgtgaagaggacccagatctggcttctttcccaaggagggggtggggtgttcctcgcgtccctgtccttgaaggacctccttcccccagcctcatcaccgtgctcttctcagcgccaccctcagcagccagattgcaacaccagggagaggcggatgcagagccccaccggtgggaaagttgcctgtggaagggagccttttgctacaatttgtaacttattttctaaagtctattttgtaacaatttatttaagtttaaaaaaaggaaaactgctgccccccaaaaaaagaaattttcaaaacaacgtggctggcgtgattgtatctgaaagggtaaaggaggaggaaagctgagacgcctgcttggtagcagagttgggtgtgggagtgtccacagacacccctgtcctgcagggtggggagtgggcacctgtggccccaggcaggttccttcccacagctgctgggcttctgggcctgccctggtgcctggaatcacacatgacagggtggggaggacaggggcagtaatgccatttgcctgcctgcattctcttgtcctgagaatggccaggtcccctgtcagcagctggttggttggcctgtggggaaggaaggagggtggagttgtcctcatcctcacggctttggtccctccctccctccccattcctcgaaggaacagggtctgtcttggccgccatgacagatgagaatactgaggctcaaagcggttgagcagcctgctccaagtcacacgatgacaaagaaccagaatctgaatcaaatgggtctgcctgttgctccaccctacccaaggcagctggagtgggttagaacggcacgttctcactggagagagaagggtcctggagaggcagggtttggcaggaggccccggggccacatacttatgttggccaggcagct

SEQ ID NO: 44151 - DNA, 6153 bp, Homo sapiens
gacctagcgttaccgaatcatagaggcacgcagagcacgtagcagcagacaagacagcagcacatatctgtagcatctgtgggctgctctttgaagacgctgagagccttgaacgtcatggcctgactcatggggcaggggaaaaggaaaatagcagaacagagaccacaatgtcacctcctagggcctttgcctgccgagactgtggaaagagctatcgccactcaggcagccttatcaaccacaggcagacccaccagacaggagacttcagttgtggggcctgtgccaagcacttccacaccatggctgccatgaagaaccacttgcgccggcacagtcggcggcggagcaggcggcatcggaagcgggctggcggtgccagcggtgggagagaagccaaactcctggcagcggagagctggacccgggagctagaagacaatgaaggcctggagtctccccaagacccttcaggggaaagtcctcatggggctgaaggcaacctggaaagtgatggggactgtttgcaggctgaatctgaaggggacaaatgtgggcttgagagggatgagacccatttccagggtgataaagagagcggaggcactggggaaggactggaaaggaaggatgccagtttacttgacaacttggacatcccaggtgaggaaggtggtggcactcacttctgcgatagcctcactggggtggatgaagaccagaagccagccactggccaacccaactcctcttcccactctgccaatgctgtcactggctggcaggctggggccgctcacacatgctctgactgtgggcattctttcccccatgccactggcctgctgagccacaggccctgccacccaccaggcatctatcagtgctccctctgcccgaaggagtttgactctctgcctgccctccgcagccacttccagaaccataggcctggggaggcgacctcagcacagcctttcctctgctgcctctgtggcatgatcttccctgggcgggctggctacaggcttcaccggcgccaggcccacagctcctctggcatgactgagggctcagaggaggagggggaagaggaaggagtggcagaggcagcccctgcacgcagtccaccactgcagctctcggaagcagagctgctgaatcagctgcagcgggaggtggaagcgctggacagtgcagggtatgggcacatctgtggctgctgtggtcagacctacgatgacctggggagcctggagcgtcaccaccaaagtcagagttctgggactactgcagacaaggctcccagccccttgggagtggcaggtgatgccatggagatggtcgtggacagtgtcttggaggacatagtgaattctgtctctggagagggtggagatgccaagtctcaagagggagcaggcacccccttgggagacagcctctgcatccagggtggggaaagtttgttggaggctcagccccgccccttccgctgcaaccagtgtggcaagacctatcgccatgggggcagcctggtgaaccaccgcaagatccaccagactggagactttctctgccctgtctgctcccgctgctaccccaacctggctgcctaccgtaatcatctgcggaaccaccctcgctgcaaaggctctgagccccaggttgggcccatcccagaggcagcaggtagcagtgagctgcaggttgggcccatcccagaaggaggcagcaacaagccccagcacatggcagaggaggggccggggcaagcagaagtcgagaagctccaggaagaacttaaagtggagcccctggaggaagtggccagggtgaaagaagaggtgtgggaggagaccactgtgaagggggaggagatagagcccaggctggagactgccgagaagggctgccagactgaagccagctctgagcggcccttcagctgcgaggtgtgtggccgatcctacaagcacgccggcagcctcatcaaccaccggcagagccaccagaccggccactttggctgtcaggcctgctccaagggcttctcaaacctcatgtccctcaagaaccaccggcgcatccatgcagatccccgacgtttccgctgcagcgagtgtgggaaggccttccgcctgcggaaacagctggccagccaccagcgggtccacatggaacggcgtgggggtgggggcacccgaaaggcgactcgggaagatcggcccttccgctgtgggcagtgcgggcggacctatcgccacgccggcagcctcctgaaccaccggcgcagccacgagacgggccagtacagctgccccacctgccccaagacctactccaaccgcatggccctgaaggaccaccagaggctgcactcagagaatcggcggcgacgggctggacggtccaggcgcacagctgtgcgttgcgccctctgtggccgcagcttccctggccggggatctttggagcggcacctgcgggagcatgaggagacagaaagggagccagccaatggccagggaggcctggatggcacagcggccagtgaggcgaacctgactggcagccagggactagagacccaattgggtggtgctgagccagtaccccacttggaggatggagtcccaaggccaggggagcgcagtcagagccccatcagggcagcaagctcagaagccccagagccactgtcctggggtgcagggaaggcaggtgggtggccggtaggtgggggactggggaatcatagtggaggctgggttcctcagttcctaactaggtcagaggagccagaggacagtgtccacaggagtccttgccacgctggtgactgccagctcaatggacctactctgagtcacatggatagctgggacaacagagacaacagctctcagctgcagccagggagccactcctcttgcagccagtgtggcaagacttactgccagtcaggcagcctcttgaaccacaacaccaacaagacagaccgacactattgcctgctctgctccaaggagttcttaaatcctgtggccacaaagagccacagccacaaccacatagacgcccagacctttgcctgtcctgactgtggcaaagcctttgagtcccaccaggaactggccagccacctgcaggctcatgcccggggccacagccaggtgccagcccagatggaggaggccagagatcccaaagccgggactggggaggaccaggtggttctccctggtcaagggaaagcccaggaggccccatcagaaacccccagaggcccaggagagagtgtggagagagccaggggaggacaagcggtgacgtccatggcggctgaggacaaggagcggcccttccgctgcacccagtgcgggcgctcctaccgccatgctggcagcctgctgaaccaccagaaggcccacaccacagggttgtacccgtgctccctctgtcccaaacttctccctaacctgctgtctcttaagaaccacagcaggacccacacggaccccaagcgccactgctgcagcatctgtggcaaggcctttcggacagctgcccggctggagggccacgggcgggtccatgcaccccgggaggggcctttcacctgcccccattgtccccgccacttccgccgccgaatcagcttcgtgcagcaccagcagcagcaccaggaggagtggacggtggccggctccggtagggggcatgaagggtcccaggaggaggtgggcacacagtggagggggaagtccagccccaaagtcggtgggggagcaaggagtgagaggagagagccccggggattctaagaggtgggtgggggcttggctatggggtgagagaagtagcttgaggatgtgctgagctgagcacccgcaagtcaggtataacaaatagcagggtgggttgggcagcacgtgggggcgtggtcaggccgaggctgctacctgggctcctccattacactgtagccagaatggaatggtctttctgttcaggggaaggtcactgggtaccccctggctgctgtgtctggaaaccctcctgagtcagccagtaaagtaatgacttccagagaaaaagaggaagccattggtttggtctaggttccattctttcctggagcaggccgggtgccagggaacaagggatggggcatgggctccacggcttccctgctgacttggccacggaaactggttcactggttggcaccctactccctgtccctctttccctgcgccttgtctctgctgctcctctccttggaaactagacctctggtccttccctgtcagtgttgctcccatctcttctctaacctttattcagccccttttccctctgctgccaacggcctttttaggatccaaccaaaccaccctttctacctgcgcaccctgccaccctctgcacacctttaactggaggactgagtcacagataattgtttccttgaagtccaggcccagctgcagcaacaacagtcattagcccgtgtcacatccctgatcagagggcatctccgtggggaatcgcctccacccagcactgctggaagccgcggctgccagggagtggggcggccggttccctcagcaggacctgggctggcctctccacctcccctagtagaggcggacccattccatctagtggccaccgagggtgggtggccctgagatggtgggcccttgacaggccttgtcagagcagagggcaggtgggagtcacctgaaagctgaaggaatggctttaaggatagaagatttctcatgacctcaagggatatgagggaggagccagtttgccagggctgggaaaataattaggaggcctagaatccctgttctcatctgggcctccggggccaggggcaggggaatggcctgcagggctgggagggggtacacgctgtgcggggtctgcccctcagttggtgacctcctctctctctccccccaggagccccagtggcaccagtgacgggcagaggggacttgccattgccccctccacccacccccacgaccccactcctggatccttcaccccagtggcctgcagacctcagcttctccctctgaacttcaagtctccaaagatcagaatctgggggagggagcgcgtgcagggaggggcttgatctccacattttctcaggagtagttcgggcatccccatatcttctcctctccccttgtgaagaggacccagatctggcttctttcccaaggagggggtggggtgttcctcgcgtccctgtccttgaaggacctccttcccccagcctcatcaccgtgctcttctcagcgccaccctcagcagccagattgcaacaccagggagaggcggatgcagagccccaccggtgggaaagttgcctgtggaagggagccttttgctacaatttgtaacttattttctaaagtctattttgtaacaatttatttaagtttaaaaaaaggaaaactgctgccccccaaaaaaagaaattttcaaaacaacgtggctggcgtgattgtatctgaaagggtaaaggaggaggaaagctgagacgcctgcttggtagcagagttgggtgtgggagtgtccacagacacccctgtcctgcagggtggggagtgggcacctgtggccccaggcaggttccttcccacagctgctgggcttctgggcctgccctggtgcctggaatcacacatgacagggtggggaggacaggggcagtaatgccatttgcctgcctgcattctcttgtcctgagaatggccaggtcccctgtcagcagctggttggttggcctgtggggaaggaaggagggtggagttgtcctcatcctcacggctttggtccctccctccctccccattcctcgaaggaacagggtctgtcttggccgccatgacagatgagaatactgaggctcaaagcggttgagcagcctgctccaagtcacacgatgacaaagaaccagaatctgaatcaaatgggtctgcctgttgctccaccctacccaaggcagctggagtgggttagaacggcacgttctcactggagagagaagggtcctggagaggcagggtttggcaggaggccccggggccacatacttatgttggccaggcagct

SEQ ID NO: 44152 - DNA, 8148 bp, Homo sapiens
gattacaggcgtgagccaccacacctggcccagttaagagagtcttaactctcttaactctcttgtcacaaggaaaagagaccttgtgacactgaaatgactcggggtggtgggggaacaagccagccctttccctgaaggaggcctctaacctctcctctcaggtcctcagctattaactggaggaaacagctgctttttcagtgcttctcagctactctgtttagctgagagatgaagtaggaagatttggacttctcttattgaaaggcctagagaaggttttggtgtccttttaagatgtcacagaaaatttttgtttcaggattgtagggagcagattcctactgttcttaaaggacagtaatgccttttgagtctggtctgaagaacataacaggtctgtgatcagaagtaggttgcatctctctcaactttaatttccttagctatacctgtagggatgacttaagcctaggggagctcctatatttgggaagcttgtgcacagggaagccttaaatgatggtgcctgcagattggatctagtagaaattaggtccttgggcatggatgcttggggaacctctcagtgacctcaggtgaacttgttgctcgtagagccaagaggcgaagttaattcaggccttccttttgaccactgccccctcttcctaggccttggcccctccaccagaggaaggtgctgccacgtgtctgctccttctgaacctccaggtttctgctacgttgccccatggaggacacacccccctcactcagctgctccgactgtcagcgccactttcccagcctcccagagctctctcggcaccgagaactgctccatccatctcccaaccaggacagtgaggaggctgacagcatccctcggccctaccgttgtcagcagtgtgggcggggctaccgtcaccccgggagcctggttaaccatcgtcggacccacgagactggccttttcccctgtaccacctgtggcaaggacttctccaatcccatggctctcaagagccatatgaggacacatgctcctgagggccgccgcaggcacaggcccccacgccccaaggaagccactccacacctccagggtgagacggtgtccactgactcctggggccaaaggcttggctctagtgaaggctgggaaaaccagacaaaacatacagaagagacacctgactgtgaatctgtacctgaccccagggcagcttcgggtacgtgggaagatctgcccaccagacaaagagaaggcttggcaagccacccaggtcctgaggatggtgcagacggctggggaccctccactaactctgccagagcccctcctctccccatcccagccagcagccttcttagcaacttggaacagtatctggctgaatcagtagtgaacttcacagggggccaggagcccacccagtcccctcctgctgaggaggagcggcggtacaaatgtagtcagtgtggcaagacctacaagcacgccgggagcctcaccaaccaccgccagagccacacgctgggcatctacccctgtgccatctgtttcaaggagttctctaacctcatggctctgaagaaccactctcgactgcatgcccagtatcggccttaccactgtccccactgcccccgtgtcttccggctcccccgggagctgctggaacaccagcagtcccatgagggtgaaaggcaggagccacgctgggaggagaaagggatgcccaccaccaatgggcacacagatgagagcagccaggaccagctccccagtgcacagatgctgaatggctctgcggagctcagcacctctggggagctggaggacagtggcctggaggaataccggcctttccgctgtggggactgtggccgtacttaccgccatgctgggagcctcatcaaccatcgaaagagccaccagacaggtgtctacccctgctcactctgttctaagcagctgttcaatgcggctgccctcaaaaaccatgtgcgggctcatcacaggcccaggcaaggagttggggaaaatgggcagccatcagtcccaccagctcccctgctgctggctgagaccacccacaaagaggaagaggaccccaccaccaccctggaccatcggccctataagtgcagtgagtgtggtcgtgcttaccgccaccgggggagcctggtgaaccatcgccacagccatcggactggagagtaccagtgctcactctgtccccgcaagtaccccaatctcatggccctgcgcaaccacgtgcgggtacattgcaaggctgctcgccgaagtgcagacatcggggctgagggtgcccccagccacctcaaggtagaactcccgcctgacccagtggaggcagaggcagccccgcacacagatcaggaccatgtgtgcaaacatgaagaagaggccacggacatcaccccagcagcagacaagacagcagcacatatctgtagcatctgtgggctgctctttgaagacgctgagagccttgaacgtcatggcctgactcatggggcaggggaaaaggaaaatagcagaacagagaccacaatgtcacctcctagggcctttgcctgccgagactgtggaaagagctatcgccactcaggcagccttatcaaccacaggcagacccaccagacaggagacttcagttgtggggcctgtgccaagcacttccacaccatggctgccatgaagaaccacttgcgccggcacagtcggcggcggagcaggcggcatcggaagcgggctggcggtgccagcggtgggagagaagccaaactcctggcagcggagagctggacccgggagctagaagacaatgaaggcctggagtctccccaagacccttcaggggaaagtcctcatggggctgaaggcaacctggaaagtgatggggactgtttgcaggctgaatctgaaggggacaaatgtgggcttgagagggatgagacccatttccagggtgataaagagagcggaggcactggggaaggactggaaaggaaggatgccagtttacttgacaacttggacatcccaggtgaggaaggtggtggcactcacttctgcgatagcctcactggggtggatgaagaccagaagccagccactggccaacccaactcctcttcccactctgccaatgctgtcactggctggcaggctggggccgctcacacatgctctgactgtgggcattctttcccccatgccactggcctgctgagccacaggccctgccacccaccaggcatctatcagtgctccctctgcccgaaggagtttgactctctgcctgccctccgcagccacttccagaaccataggcctggggaggcgacctcagcacagcctttcctctgctgcctctgtggcatgatcttccctgggcgggctggctacaggcttcaccggcgccaggcccacagctcctctggcatgactgagggctcagaggaggagggggaagaggaaggagtggcagaggcagcccctgcacgcagtccaccactgcagctctcggaagcagagctgctgaatcagctgcagcgggaggtggaagcgctggacagtgcagggtatgggcacatctgtggctgctgtggtcagacctacgatgacctggggagcctggagcgtcaccaccaaagtcagagttctgggactactgcagacaaggctcccagccccttgggagtggcaggtgatgccatggagatggtcgtggacagtgtcttggaggacatagtgaattctgtctctggagagggtggagatgccaagtctcaagagggagcaggcacccccttgggagacagcctctgcatccagggtggggaaagtttgttggaggctcagccccgccccttccgctgcaaccagtgtggcaagacctatcgccatgggggcagcctggtgaaccaccgcaagatccaccagactggagactttctctgccctgtctgctcccgctgctaccccaacctggctgcctaccgtaatcatctgcggaaccaccctcgctgcaaaggctctgagccccaggttgggcccatcccagaggcagcaggtagcagtgagctgcaggttgggcccatcccagaaggaggcagcaacaagccccagcacatggcagaggaggggccggggcaagcagaagtcgagaagctccaggaagaacttaaagtggagcccctggaggaagtggccagggtgaaagaagaggtgtgggaggagaccactgtgaagggggaggagatagagcccaggctggagactgccgagaagggctgccagactgaagccagctctgagcggcccttcagctgcgaggtgtgtggccgatcctacaagcacgccggcagcctcatcaaccaccggcagagccaccagaccggccactttggctgtcaggcctgctccaagggcttctcaaacctcatgtccctcaagaaccaccggcgcatccatgcagatccccgacgtttccgctgcagcgagtgtgggaaggccttccgcctgcggaaacagctggccagccaccagcgggtccacatggaacggcgtgggggtgggggcacccgaaaggcgactcgggaagatcggcccttccgctgtgggcagtgcgggcggacctatcgccacgccggcagcctcctgaaccaccggcgcagccacgagacgggccagtacagctgccccacctgccccaagacctactccaaccgcatggccctgaaggaccaccagaggctgcactcagagaatcggcggcgacgggctggacggtccaggcgcacagctgtgcgttgcgccctctgtggccgcagcttccctggccggggatctttggagcggcacctgcgggagcatgaggagacagaaagggagccagccaatggccagggaggcctggatggcacagcggccagtgaggcgaacctgactggcagccagggactagagacccaattgggtggtgctgagccagtaccccacttggaggatggagtcccaaggccaggggagcgcagtcagagccccatcagggcagcaagctcagaagccccagagccactgtcctggggtgcagggaaggcaggtgggtggccggtaggtgggggactggggaatcatagtggaggctgggttcctcagttcctaactaggtcagaggagccagaggacagtgtccacaggagtccttgccacgctggtgactgccagctcaatggacctactctgagtcacatggatagctgggacaacagagacaacagctctcagctgcagccagggagccactcctcttgcagccagtgtggcaagacttactgccagtcaggcagcctcttgaaccacaacaccaacaagacagaccgacactattgcctgctctgctccaaggagttcttaaatcctgtggccacaaagagccacagccacaaccacatagacgcccagacctttgcctgtcctgactgtggcaaagcctttgagtcccaccaggaactggccagccacctgcaggctcatgcccggggccacagccaggtgccagcccagatggaggaggccagagatcccaaagccgggactggggaggaccaggtggttctccctggtcaagggaaagcccaggaggccccatcagaaacccccagaggcccaggagagagtgtggagagagccaggggaggacaagcggtgacgtccatggcggctgaggacaaggagcggcccttccgctgcacccagtgcgggcgctcctaccgccatgctggcagcctgctgaaccaccagaaggcccacaccacagggttgtacccgtgctccctctgtcccaaacttctccctaacctgctgtctcttaagaaccacagcaggacccacacggaccccaagcgccactgctgcagcatctgtggcaaggcctttcggacagctgcccggctggagggccacgggcgggtccatgcaccccgggaggggcctttcacctgcccccattgtccccgccacttccgccgccgaatcagcttcgtgcagcaccagcagcagcaccaggaggagtggacggtggccggctccggtagggggcatgaagggtcccaggaggaggtgggcacacagtggagggggaagtccagccccaaagtcggtgggggagcaaggagtgagaggagagagccccggggattctaagaggtgggtgggggcttggctatggggtgagagaagtagcttgaggatgtgctgagctgagcacccgcaagtcaggtataacaaatagcagggtgggttgggcagcacgtgggggcgtggtcaggccgaggctgctacctgggctcctccattacactgtagccagaatggaatggtctttctgttcaggggaaggtcactgggtaccccctggctgctgtgtctggaaaccctcctgagtcagccagtaaagtaatgacttccagagaaaaagaggaagccattggtttggtctaggttccattctttcctggagcaggccgggtgccagggaacaagggatggggcatgggctccacggcttccctgctgacttggccacggaaactggttcactggttggcaccctactccctgtccctctttccctgcgccttgtctctgctgctcctctccttggaaactagacctctggtccttccctgtcagtgttgctcccatctcttctctaacctttattcagccccttttccctctgctgccaacggcctttttaggatccaaccaaaccaccctttctacctgcgcaccctgccaccctctgcacacctttaactggaggactgagtcacagataattgtttccttgaagtccaggcccagctgcagcaacaacagtcattagcccgtgtcacatccctgatcagagggcatctccgtggggaatcgcctccacccagcactgctggaagccgcggctgccagggagtggggcggccggttccctcagcaggacctgggctggcctctccacctcccctagtagaggcggacccattccatctagtggccaccgagggtgggtggccctgagatggtgggcccttgacaggccttgtcagagcagagggcaggtgggagtcacctgaaagctgaaggaatggctttaaggatagaagatttctccccttgtgaagaggacccagatctggcttctttcccaaggagggggtggggtgttcctcgcgtccctgtccttgaaggacctccttcccccagcctcatcaccgtgctcttctcagcgccaccctcagcagccagattgcaacaccagggagaggcggatgcagagccccaccggtgggaaagttgcctgtggaagggagccttttgctacaatttgtaacttattttctaaagtctattttgtaacaatttatttaagtttaaaaaaaggaaaactgctgccccccaaaaaaagaaattttcaaaacaacgtggctggcgtgattgtatctgaaagggtaaaggaggaggaaagctgagacgcctgcttggtagcagagttgggtgtgggagtgtccacagacacccctgtcctgcagggtggggagtgggcacctgtggccccaggcaggttccttcccacagctgctgggcttctgggcctgccctggtgcctggaatcacacatgacagggtggggaggacaggggcagtaatgccatttgcctgcctgcattctcttgtcctgagaatggccaggtcccctgtcagcagctggttggttggcctgtggggaaggaaggagggtggagttgtcctcatcctcacggctttggtccctccctccctccccattcctcgaaggaacagggtctgtcttggccgccatgacagatgagaatactgaggctcaaagcggttgagcagcctgctccaagtcacacgatgacaaagaaccagaatctgaatcaaatgggtctgcctgttgctccaccctacccaaggcagctggagtgggttagaacggcacgttctcactggagagagaagggtcctggagaggcagggtttggcaggaggccccggggccacatacttatgttggccaggcagct

SEQ ID NO: 44153 - DNA, 1175 bp, Homo sapiens
aacagcacaacggtacactccttgtctaacccagttttgtcaatagtactatagcatcttgtggaaaatcttagaagggaacattgtctcccccaccctctctcttccctgttaagaccatccctatatgctttcaagtctccaaagatcagaatctgggggagggagcgcgtgcagggaggggcttgatctccacattttctcaggagtagttcgggcatccccatatcttctcctctccccttgtgaagaggacccagatctggcttctttcccaaggagggggtggggtgttcctcgcgtccctgtccttgaaggacctccttcccccagcctcatcaccgtgctcttctcagcgccaccctcagcagccagattgcaacaccagggagaggcggatgcagagccccaccggtgggaaagttgcctgtggaagggagccttttgctacaatttgtaacttattttctaaagtctattttgtaacaatttatttaagtttaaaaaaaggaaaactgctgccccccaaaaaaagaaattttcaaaacaacgtggctggcgtgattgtatctgaaagggtaaaggaggaggaaagctgagacgcctgcttggtagcagagttgggtgtgggagtgtccacagacacccctgtcctgcagggtggggagtgggcacctgtggccccaggcaggttccttcccacagctgctgggcttctgggcctgccctggtgcctggaatcacacatgacagggtggggaggacaggggcagtaatgccatttgcctgcctgcattctcttgtcctgagaatggccaggtcccctgtcagcagctggttggttggcctgtggggaaggaaggagggtggagttgtcctcatcctcacggctttggtccctccctccctccccattcctcgaaggaacagggtctgtcttggccgccatgacagatgagaatactgaggctcaaagcggttgagcagcctgctccaagtcacacgatgacaaagaaccagaatctgaatcaaatgggtctgcctgttgctccaccctacccaaggcagctggagtgggttagaacggcacgttctcactggagagagaagggtcctggagaggcagggtttggcaggaggccccggggccacatacttatgttggccaggcagct

SEQ ID NO: 44154 - DNA, 8516 bp, Homo sapiens
gattacaggcgtgagccaccacacctggcccagttaagagagtcttaactctcttaactctcttgtcacaaggaaaagagaccttgtgacactgaaatgactcggggtggtgggggaacaagccagccctttccctgaaggaggcctctaacctctcctctcaggtcctcagctattaactggaggaaacagctgctttttcagtgcttctcagctactctgtttagctgagagatgaagtaggaagatttggacttctcttattgaaaggcctagagaaggttttggtgtccttttaagatgtcacagaaaatttttgtttcaggattgtagggagcagattcctactgttcttaaaggacagtaatgccttttgagtctggtctgaagaacataacaggtctgtgatcagaagtaggttgcatctctctcaactttaatttccttagctatacctgtagggatgacttaagcctaggggagctcctatatttgggaagcttgtgcacagggaagccttaaatgatggtgcctgcagattggatctagtagaaattaggtccttgggcatggatgcttggggaacctctcagtgacctcaggtgaacttgttgctcgtagagccaagaggcgaagttaattcaggccttccttttgaccactgccccctcttcctaggccttggcccctccaccagaggaaggtgctgccacgtgtctgctccttctgaacctccaggtttctgctacgttgccccatggaggacacacccccctcactcagctgctccgactgtcagcgccactttcccagcctcccagagctctctcggcaccgagaactgctccatccatctcccaaccaggacagtgaggaggctgacagcatccctcggccctaccgttgtcagcagtgtgggcggggctaccgtcaccccgggagcctggttaaccatcgtcggacccacgagactggccttttcccctgtaccacctgtggcaaggacttctccaatcccatggctctcaagagccatatgaggacacatgctcctgagggccgccgcaggcacaggcccccacgccccaaggaagccactccacacctccagggtgagacggtgtccactgactcctggggccaaaggcttggctctagtgaaggctgggaaaaccagacaaaacatacagaagagacacctgactgtgaatctgtacctgaccccagggcagcttcgggtacgtgggaagatctgcccaccagacaaagagaaggcttggcaagccacccaggtcctgaggatggtgcagacggctggggaccctccactaactctgccagagcccctcctctccccatcccagccagcagccttcttagcaacttggaacagtatctggctgaatcagtagtgaacttcacagggggccaggagcccacccagtcccctcctgctgaggaggagcggcggtacaaatgtagtcagtgtggcaagacctacaagcacgccgggagcctcaccaaccaccgccagagccacacgctgggcatctacccctgtgccatctgtttcaaggagttctctaacctcatggctctgaagaaccactctcgactgcatgcccagtatcggccttaccactgtccccactgcccccgtgtcttccggctcccccgggagctgctggaacaccagcagtcccatgagggtgaaaggcaggagccacgctgggaggagaaagggatgcccaccaccaatgggcacacagatgagagcagccaggaccagctccccagtgcacagatgctgaatggctctgcggagctcagcacctctggggagctggaggacagtggcctggaggaataccggcctttccgctgtggggactgtggccgtacttaccgccatgctgggagcctcatcaaccatcgaaagagccaccagacaggtgtctacccctgctcactctgttctaagcagctgttcaatgcggctgccctcaaaaaccatgtgcgggctcatcacaggcccaggcaaggagttggggaaaatgggcagccatcagtcccaccagctcccctgctgctggctgagaccacccacaaagaggaagaggaccccaccaccaccctggaccatcggccctataagtgcagtgagtgtggtcgtgcttaccgccaccgggggagcctggtgaaccatcgccacagccatcggactggagagtaccagtgctcactctgtccccgcaagtaccccaatctcatggccctgcgcaaccacgtgcgggtacattgcaaggctgctcgccgaagtgcagacatcggggctgagggtgcccccagccacctcaaggtagaactcccgcctgacccagtggaggcagaggcagccccgcacacagatcaggaccatgtgtgcaaacatgaagaagaggccacggacatcaccccagcagcagacaagacagcagcacatatctgtagcatctgtgggctgctctttgaagacgctgagagccttgaacgtcatggcctgactcatggggcaggggaaaaggaaaatagcagaacagagaccacaatgtcacctcctagggcctttgcctgccgagactgtggaaagagctatcgccactcaggcagccttatcaaccacaggcagacccaccagacaggagacttcagttgtggggcctgtgccaagcacttccacaccatggctgccatgaagaaccacttgcgccggcacagtcggcggcggagcaggcggcatcggaagcgggctggcggtgccagcggtgggagagaagccaaactcctggcagcggagagctggacccgggagctagaagacaatgaaggcctggagtctccccaagacccttcaggggaaagtcctcatggggctgaaggcaacctggaaagtgatggggactgtttgcaggctgaatctgaaggggacaaatgtgggcttgagagggatgagacccatttccagggtgataaagagagcggaggcactggggaaggactggaaaggaaggatgccagtttacttgacaacttggacatcccaggtgaggaaggtggtggcactcacttctgcgatagcctcactggggtggatgaagaccagaagccagccactggccaacccaactcctcttcccactctgccaatgctgtcactggctggcaggctggggccgctcacacatgctctgactgtgggcattctttcccccatgccactggcctgctgagccacaggccctgccacccaccaggcatctatcagtgctccctctgcccgaaggagtttgactctctgcctgccctccgcagccacttccagaaccataggcctggggaggcgacctcagcacagcctttcctctgctgcctctgtggcatgatcttccctgggcgggctggctacaggcttcaccggcgccaggcccacagctcctctggcatgactgagggctcagaggaggagggggaagaggaaggagtggcagaggcagcccctgcacgcagtccaccactgcagctctcggaagcagagctgctgaatcagctgcagcgggaggtggaagcgctggacagtgcagggtatgggcacatctgtggctgctgtggtcagacctacgatgacctggggagcctggagcgtcaccaccaaagtcagagttctgggactactgcagacaaggctcccagccccttgggagtggcaggtgatgccatggagatggtcgtggacagtgtcttggaggacatagtgaattctgtctctggagagggtggagatgccaagtctcaagagggagcaggcacccccttgggagacagcctctgcatccagggtggggaaagtttgttggaggctcagccccgccccttccgctgcaaccagtgtggcaagacctatcgccatgggggcagcctggtgaaccaccgcaagatccaccagactggagactttctctgccctgtctgctcccgctgctaccccaacctggctgcctaccgtaatcatctgcggaaccaccctcgctgcaaaggctctgagccccaggttgggcccatcccagaggcagcaggtagcagtgagctgcaggttgggcccatcccagaaggaggcagcaacaagccccagcacatggcagaggaggggccggggcaagcagaagtcgagaagctccaggaagaacttaaagtggagcccctggaggaagtggccagggtgaaagaagaggtgtgggaggagaccactgtgaagggggaggagatagagcccaggctggagactgccgagaagggctgccagactgaagccagctctgagcggcccttcagctgcgaggtgtgtggccgatcctacaagcacgccggcagcctcatcaaccaccggcagagccaccagaccggccactttggctgtcaggcctgctccaagggcttctcaaacctcatgtccctcaagaaccaccggcgcatccatgcagatccccgacgtttccgctgcagcgagtgtgggaaggccttccgcctgcggaaacagctggccagccaccagcgggtccacatggaacggcgtgggggtgggggcacccgaaaggcgactcgggaagatcggcccttccgctgtgggcagtgcgggcggacctatcgccacgccggcagcctcctgaaccaccggcgcagccacgagacgggccagtacagctgccccacctgccccaagacctactccaaccgcatggccctgaaggaccaccagaggctgcactcagagaatcggcggcgacgggctggacggtccaggcgcacagctgtgcgttgcgccctctgtggccgcagcttccctggccggggatctttggagcggcacctgcgggagcatgaggagacagaaagggagccagccaatggccagggaggcctggatggcacagcggccagtgaggcgaacctgactggcagccagggactagagacccaattgggtggtgctgagccagtaccccacttggaggatggagtcccaaggccaggggagcgcagtcagagccccatcagggcagcaagctcagaagccccagagccactgtcctggggtgcagggaaggcaggtgggtggccggtaggtgggggactggggaatcatagtggaggctgggttcctcagttcctaactaggtcagaggagccagaggacagtgtccacaggagtccttgccacgctggtgactgccagctcaatggacctactctgagtcacatggatagctgggacaacagagacaacagctctcagctgcagccagggagccactcctcttgcagccagtgtggcaagacttactgccagtcaggcagcctcttgaaccacaacaccaacaagacagaccgacactattgcctgctctgctccaaggagttcttaaatcctgtggccacaaagagccacagccacaaccacatagacgcccagacctttgcctgtcctgactgtggcaaagcctttgagtcccaccaggaactggccagccacctgcaggctcatgcccggggccacagccaggtgccagcccagatggaggaggccagagatcccaaagccgggactggggaggaccaggtggttctccctggtcaagggaaagcccaggaggccccatcagaaacccccagaggcccaggagagagtgtggagagagccaggggaggacaagcggtgacgtccatggcggctgaggacaaggagcggcccttccgctgcacccagtgcgggcgctcctaccgccatgctggcagcctgctgaaccaccagaaggcccacaccacagggttgtacccgtgctccctctgtcccaaacttctccctaacctgctgtctcttaagaaccacagcaggacccacacggaccccaagcgccactgctgcagcatctgtggcaaggcctttcggacagctgcccggctggagggccacgggcgggtccatgcaccccgggaggggcctttcacctgcccccattgtccccgccacttccgccgccgaatcagcttcgtgcagcaccagcagcagcaccaggaggagtggacggtggccggctccggtagggggcatgaagggtcccaggaggaggtgggcacacagtggagggggaagtccagccccaaagtcggtgggggagcaaggagtgagaggagagagccccggggattctaagaggtgggtgggggcttggctatggggtgagagaagtagcttgaggatgtgctgagctgagcacccgcaagtcaggtataacaaatagcagggtgggttgggcagcacgtgggggcgtggtcaggccgaggctgctacctgggctcctccattacactgtagccagaatggaatggtctttctgttcaggggaaggtcactgggtaccccctggctgctgtgtctggaaaccctcctgagtcagccagtaaagtaatgacttccagagaaaaagaggaagccattggtttggtctaggttccattctttcctggagcaggccgggtgccagggaacaagggatggggcatgggctccacggcttccctgctgacttggccacggaaactggttcactggttggcaccctactccctgtccctctttccctgcgccttgtctctgctgctcctctccttggaaactagacctctggtccttccctgtcagtgttgctcccatctcttctctaacctttattcagccccttttccctctgctgccaacggcctttttaggatccaaccaaaccaccctttctacctgcgcaccctgccaccctctgcacacctttaactggaggactgagtcacagataattgtttccttgaagtccaggcccagctgcagcaacaacagtcattagcccgtgtcacatccctgatcagagggcatctccgtggggaatcgcctccacccagcactgctggaagccgcggctgccagggagtggggcggccggttccctcagcaggacctgggctggcctctccacctcccctagtagaggcggacccattccatctagtggccaccgagggtgggtggccctgagatggtgggcccttgacaggccttgtcagagcagagggcaggtgggagtcacctgaaagctgaaggaatggctttaaggatagaagatttctcatgacctcaagggatatgagggaggagccagtttgccagggctgggaaaataattaggaggcctagaatccctgttctcatctgggcctccggggccaggggcaggggaatggcctgcagggctgggagggggtacacgctgtgcggggtctgcccctcagttggtgacctcctctctctctccccccaggagccccagtggcaccagtgacgggcagaggggacttgccattgccccctccacccacccccacgaccccactcctggatccttcaccccagtggcctgcagacctcagcttctccctctgaacttcaagtctccaaagatcagaatctgggggagggagcgcgtgcagggaggggcttgatctccacattttctcaggagtagttcgggcatccccatatcttctcctctccccttgtgaagaggacccagatctggctccttcccccagcctcatcaccgtgctcttctcagcgccaccctcagcagccagattgcaacaccagggagaggcggatgcagagccccaccggtgggaaagttgcctgtggaagggagccttttgctacaatttgtaacttattttctaaagtctattttgtaacaatttatttaagtttaaaaaaaggaaaactgctgccccccaaaaaaagaaattttcaaaacaacgtggctggcgtgattgtatctgaaagggtaaaggaggaggaaagctgagacgcctgcttggtagcagagttgggtgtgggagtgtccacagacacccctgtcctgcagggtggggagtgggcacctgtggccccaggcaggttccttcccacagctgctgggcttctgggcctgccctggtgcctggaatcacacatgacagggtggggaggacaggggcagtaatgccatttgcctgcctgcattctcttgtcctgagaatggccaggtcccctgtcagcagctggttggttggcctgtggggaaggaaggagggtggagttgtcctcatcctcacggctttggtccctccctccctccccattcctcgaaggaacagggtctgtcttggccgccatgacagatgagaatactgaggctcaaagcggttgagcagcctgctccaagtcacacgatgacaaagaaccagaatctgaatcaaatgggtctgcctgttgctccaccctacccaaggcagctggagtgggttagaacggcacgttctcactggagagagaagggtcctggagaggcagggtttggcaggaggccccggggccacatacttatgttggccaggcagct

SEQ ID NO: 44155 - DNA, 3437 bp, Homo sapiens
tcggctaggtacgaggctggggttgaatcggccgatggggaatcatagtggaggctgggttcctcagttcctaactaggtcagaggagccagaggacagtgtccacaggagtccttgccacgctggtgactgccagctcaatggacctactctgagtcacatggatagctgggacaacagagacaacagctctcagctgcagccagggagccactcctcttgcagccagtgtggcaagacttactgccagtcaggcagcctcttgaaccacaacaccaacaagacagaccgacactattgcctgctctgctccaaggagttcttaaatcctgtggccacaaagagccacagccacaaccacatagacgcccagacctttgcctgtcctgactgtggcaaagcctttgagtcccaccaggaactggccagccacctgcaggctcatgcccggggccacagccaggtgccagcccagatggaggaggccagagatcccaaagccgggactggggaggaccaggtggttctccctggtcaagggaaagcccaggaggccccatcagaaacccccagaggcccaggagagagtgtggagagagccaggggaggacaagcggtgacgtccatggcggctgaggacaaggagcggcccttccgctgcacccagtgcgggcgctcctaccgccatgctggcagcctgctgaaccaccagaaggcccacaccacagggttgtacccgtgctccctctgtcccaaacttctccctaacctgctgtctcttaagaaccacagcaggacccacacggaccccaagcgccactgctgcagcatctgtggcaaggcctttcggacagctgcccggctggagggccacgggcgggtccatgcaccccgggaggggcctttcacctgcccccattgtccccgccacttccgccgccgaatcagcttcgtgcagcaccagcagcagcaccaggaggagtggacggtggccggctccggtagggggcatgaagggtcccaggaggaggtgggcacacagtggagggggaagtccagccccaaagtcggtgggggagcaaggagtgagaggagagagccccggggattctaagaggtgggtgggggcttggctatggggtgagagaagtagcttgaggatgtgctgagctgagcacccgcaagtcaggtataacaaatagcagggtgggttgggcagcacgtgggggcgtggtcaggccgaggctgctacctgggctcctccattacactgtagccagaatggaatggtctttctgttcaggggaaggtcactgggtaccccctggctgctgtgtctggaaaccctcctgagtcagccagtaaagtaatgacttccagagaaaaagaggaagccattggtttggtctaggttccattctttcctggagcaggccgggtgccagggaacaagggatggggcatgggctccacggcttccctgctgacttggccacggaaactggttcactggttggcaccctactccctgtccctctttccctgcgccttgtctctgctgctcctctccttggaaactagacctctggtccttccctgtcagtgttgctcccatctcttctctaacctttattcagccccttttccctctgctgccaacggcctttttaggatccaaccaaaccaccctttctacctgcgcaccctgccaccctctgcacacctttaactggaggactgagtcacagataattgtttccttgaagtccaggcccagctgcagcaacaacagtcattagcccgtgtcacatccctgatcagagggcatctccgtggggaatcgcctccacccagcactgctggaagccgcggctgccagggagtggggcggccggttccctcagcaggacctgggctggcctctccacctcccctagtagaggcggacccattccatctagtggccaccgagggtgggtggccctgagatggtgggcccttgacaggccttgtcagagcagagggcaggtgggagtcacctgaaagctgaaggaatggctttaaggatagaagatttctcatgacctcaagggatatgagggaggagccagtttgccagggctgggaaaataattaggaggcctagaatccctgttctcatctgggcctccggggccaggggcaggggaatggcctgcagggctgggagggggtacacgctgtgcggggtctgcccctcagttggtgacctcctctctctctccccccaggagccccagtggcaccagtgacgggcagaggggacttgccattgccccctccacccacccccacgaccccactcctggatccttcaccccagtggcctgcagacctcagcttctccctctgaacttcaagtctccaaagatcagaatctgggggagggagcgcgtgcagggaggggcttgatctccacattttctcaggagtagttcgggcatccccatatcttctcctctccccttgtgaagaggacccagatctggcttctttcccaaggagggggtggggtgttcctcgcgtccctgtccttgaaggacctccttcccccagcctcatcaccgtgctcttctcagcgccaccctcagcagccagattgcaacaccagggagaggcggatgcagagccccaccggtgggaaagttgcctgtggaagggagccttttgctacaatttgtaacttattttctaaagtctattttgtaacaatttatttaagtttaaaaaaaggaaaactgctgccccccaaaaaaagaaattttcaaaacaacgtggctggcgtgattgtatctgaaagggtaaaggaggaggaaagctgagacgcctgcttggtagcagagttgggtgtgggagtgtccacagacacccctgtcctgcagggtggggagtgggcacctgtggccccaggcaggttccttcccacagctgctgggcttctgggcctgccctggtgcctggaatcacacatgacagggtggggaggacaggggcagtaatgccatttgcctgcctgcattctcttgtcctgagaatggccaggtcccctgtcagcagctggttggttggcctgtggggaaggaaggagggtggagttgtcctcatcctcacggctttggtccctccctccctccccattcctcgaaggaacagggtctgtcttggccgccatgacagatgagaatactgaggctcaaagcggttgagcagcctgctccaagtcacacgatgacaaagaaccagaatctgaatcaaatgggtctgcctgttgctccaccctacccaaggcagctggagtgggttagaacggcacgttctcactggagagagaagggtcctggagaggcagggtttggcaggaggccccggggccacatacttatgttggccaggcagct

SEQ ID NO: 44156 - DNA, 354 bp, Homo sapiens
gcctcaacctgccgggctcaagcaatcctcccacttcaaccttatgagcagctgtgactacaggcatgcatcaccaagcccagctaatttttgtattttttgcagagacagggtttcgccatgttgcccaggctggtctcaaactcctgggctcaagtgatctgcccgcctcggcctcccaaagtgctggtattacaggtgtgagccactgcgcctagccttggttgtgtatttctatggataaaaatatatacactcagcaaataaaataaaacttgtaaactcttctgcatcctctctccccctccccagaccctagaagtaacaggtattaggaatttggcacagcatttt

SEQ ID NO: 44157 - DNA, 567 bp, Homo sapiens
acttaaggtataatcgtattccaggtaattataactcattgagtccagtgctctcctctctacattggagaggagttgtgttaaagaatgttgtttccatatatagagagcatagaaagctacattgtttgctagcaacttaacactgtttcagtgttgaagttgggctgaactgttaagaatggaagggagcttaggatccatgtggtgagaactgcattttgtggatgaggaaaataaggccaagtgaagtgacgtgatttgtgaagggccaggtgtagaaagaagccaggcctgaggactttcactacaccaaactgctaaaggagaaagcccatgtcagaagaaacagtggcaaatgttacatctggaaaataaaaaggattttcaatctagatcttgcccctgcctaaggaggatgcctgtggccttccccctcttgctgagtgaccccttcatcagatgggtcttctcaactccaacttagttgtcttataaacccattcgcaatactcctgtgttctgtggtaagttttcctacaggccctgctggcaggcatcgccttg

SEQ ID NO: 44158 - DNA, 362 bp, Homo sapiens
ctccccaggcatctgggtcaggaaagggacataaaccagtggcatcccttgattgtcccccttttgatcccaactcatagttgtgaagtccataattattccacagaggggcagtcctgttttttacttccctaactacgtgctggtgcattgctctgagacgcaagaaggcaactcctagggaatgtgtaaataatgcctgtgctctgattgatggctttgtttgcagccagaggaagttgaaactggggcctctgaccctggcctggtctggcttcttccttgaagcctgcagtcatgagcaaggaaatgaaggatcacttcctggggataactggatcaggagaaagcaacaacagcca

SEQ ID NO: 44159 - DNA, 415 bp, Homo sapiens
ctaataacaccttctgcctttgaaatatcttgtctggtattagtatcacttttacttttccacatctatttttgttattgtttgcatagtatatctttttttataatttcaccttcaacctttttgtgtctttgaatctaaagtgtatctcttgtatacagcatatgtttagatcatgtttgttttttcctaatccgttctgtcagcctctgtcttttggttggagtatttaatccatttacatttaatgtaattaaagataaagtaggatttatgtcttcaattttaaaatttgtttccaatgttatgtcttgtttgtttctcaacttctccattattgcatacttttgttgggggggggatttttttttttttttaatgcagtttcggtcttgttgcccaggccagagtgcaa

SEQ ID NO: 44160 - DNA, 446 bp, Homo sapiens
tttttttttgagagggagtttcgctcttgttgcccaggctggagtgcaatggcatgatcttggctcactgcaacctccgcctcccgggttcaagcgattctcctgtctcagcctcctgagttgctgggattacaggcatgtgctaccatgcccagctaatttttgtgtttttagtagagactgggtttcaccattttggccaggctagtcttgaactcctgacttcaagtgatccacccgtctcggccttccaaagtgctgggattacagtcgtgagccacaacgcccggccaatggaacttttttctaaatatagaaacatcatagagatttgaaatatgttttgttgactttttctgaaatgtatttgagtgtgcttgtaataagcctcactctgtggtcagatatgtgattgtgtactttggagggtaacagacctttgaata

SEQ ID NO: 44161 - DNA, 1093 bp, Homo sapiens
tgaagccattgtcagaaatttgtcctttatcctgactgagcagaagaaacactgaaggattttgagcagaggcatgtcttgatttcatttcatttttagaggtatagataattcaggctgctattttgagactcgactgagaagaggtgtgtactggcacccgtttcctacagatgtgtccctccactctttgaagccgagggcaaaatcatgctgaagacctagaaatcccaccagtctgaagaccagctgcaaccacaatgggttagcccttttcaggatgcctcctcttcagcataaagcagccagaaagattgatgaccagcttccccaggattgaggaactgataagtggaaagaggggactgaaaccaccccaattgtcccgtagaattgatgtttatgatcttttggaataaacatagatattgaccctcatggtcttaaagattgaaatgtacattgcctgagttccttcctcagaaaacaaaaactcagggctctgagtatcaaggaactgaaactcaccaggtcaccacatccagacaatgagacaacagaccccttattcatcatgattacttccttccccctccgttattcccgttttcccacatgtagctccattccttcccttttatataaactcccaattttaattgattggagaggacttgagacttatctctcatctcctcagctgatatcacctgattaaagcctttctttcatggcaatactcattgtctcagtgactggctttctgtacagcaaggaacaggatctagaccaaaccccctggcattttggtaacaaggggaataagaaacctagccttactgacagtttatttcttaagttgactttattaaaaggtcaaggaaagaaaactagcccaaagaataaatgaacatacccactttatcactttgacaggtttaacaaattcctaatgaagaataatttatgtgtttgctcaggcatggtggcttatgtctgtaatcccagcattttggggggctgaagcaggaggattacctgaggccagaagtttgagagcagtctgagcaacacagtgagaccacatctctac

SEQ ID NO: 44162 - DNA, 301 bp, Homo sapiens
ctagcacacttccgtctatatagatattggaattaacgattatttatccataactttgctttctctttctgagaataactagagtcaaatatctatagtcagtcatattgaagaaaaacctcagaaatatacttcttagtaactcaacacccaagagcaaatcataatggaaattataaaatatttttaattaaaaaatgtatactacattataaaatgtgtcattttagaggaaaatgtagaaccttaaattcttattttatgaggacaacaaattaatttttaaaatgttttgaattta

SEQ ID NO: 44163 - DNA, 389 bp, Homo sapiens
tcacccatgtaacaaatctgcacatatacccccaaacctaaaataaaagttggaaggaaataaataaataaatatgtaactatttaattttaaaagatgggcctcatgctatttacctttcagtgtccttatgatgattagagatgacagatgtaaaattgccaggcacgtatgaagtagcgggagtcattattatttttaataagttatttaaattctggagcatttttcgttcttgaactgcaaaacaaggtaggttgtattctataaagttactctcttagatgctttattctgatgaattctcagtggtgttcattcctgttttcttttttaaatcagaggttttcgaccttcaatgcaaattacaattacttgggaggctttaa

SEQ ID NO: 44164 - DNA, 359 bp, Homo sapiens
gataaactgaccaatggtacagaattctaagagcctagaaaaacacgtatatatctgtgaaactttgatttttgacagaactgcctggaaaaggaaaagctggaaaaattgtttatccatgggggggaaaaaaaaagaaattggattcttagtcacaccatgccgaaaaattcactccagatggatgaagagctgaaatgtcaaaagcaaactctgagaatttgaaaaggaaatataagtgagtatctttctgagcttgaagtagggaagaatttacaaagatagaaaaaaggacaggcataaaagaaaagatccaataagtttgggctacatttaatatttaaagcctttgtccatca

SEQ ID NO: 44165 - DNA, 345 bp, Homo sapiens
gtcaccacacaaataaagagactgagcatcggagaaactaaacagcttgcctgaggtcttgtagaactgcctggaaaaggaaaagctggaaaaattgtttatccatgggggggaaaaaaaaagaaattggattcttagtcacaccatgccgaaaaattcactccagatggatgaagagctgaaatgtcaaaagcaaactctgagaatttgaaaaggaaatataagtgagtatctttctgagcttgaagtagggaagaatttacaaagatagaaaaaaggacaggcataaaagaaaagatccaataagtttgggctacatttaatatttaaagcctttgtccatca

SEQ ID NO: 44166 - DNA, 449 bp, Homo sapiens
tgtgtgcatactcctgcgtaattatcttcagtacactgataacatacttttactttgcaaattaggagtggcctcaaggggcagttaggattggtgatatataaaagttctctagtatcaagtcttcctctagatggaactcttctatctaggtaagagttctagtttcttatcttgctcagtaagatgccagccttattgtctaattggctttaagaaaaaatagtgactgcttaccaagtgctagatactgtgggtttgctcttcatatctgtgggcctctaatttgtatggatccattcttaagcaatataaaacaccagcacatcagattcttgtgagagagtagaatctagaattgtccttcctaactttttctcagaagtttgggctgaaagaagtattaattgcagaaggtcatttaaaggactggtggcaggtccattcat

SEQ ID NO: 44167 - DNA, 601 bp, Homo sapiens
ctaagtgtagaacaaggtgagcaagatgggagagggtggccgtctacttcggcgggttggggcaaacaccagagggagaaagacattaacggcctctcaaagcagtggtcctcctctgggctgtgaactctttgaagctatgcaaggtaaggatgggtccacagttttcatcattctcaagtctatgacccaaatatgttgcaagacctgggaataaatctggacaaagaggcaaatgggaaaattggactgtcttttgggggtgaggtagaagagttcctcagttagttgccctgtgttaagcccgtaccatcttgccagacacttgtcactcatttcaccatcaccacaacccaagaactttataatatttctattttatgggtgagaagcttaaggctcatgaaagtaggtttcttgcctatatcacataatgaggaagtgacgggctaagaggacgagcccaagactgtaagactcagccttttccccgtatcctgcctcacaatgtagtttatcttttaggttttgttttgaagtctcgctctgtcacccaggctggagtgcagtggcacaatcttggctcactgcaacctccacc

SEQ ID NO: 44168 - DNA, 454 bp, Homo sapiens
ctcgactacttatggcactcagtgcagcctccgccttctccaggtgggtggggacgtggtgggaccggaatgcggggtgctgaagccgcgcccagggaagagcccccagcgcattccaggatatctgcgtaccgcgcctgcgggcgtctggccggttctcccacctgatttccagcccagctcccgccaccctcgccggtcggtttgctgtttgctgttccttgaatgccccaaggtagttgtttcagctcaggactttcaccgtttcctcaacctggattcttgtggcccacaactctgtgccttgagaatcctcttctagcctcaagggacggtaagacaaaagaaaatttaaaaagggggctcagctgttcttttatgcaaaggtgaaaaaagcttcattgcctaaagaagggacagatgggatcttgcttcctacaggaaaattaatttt

SEQ ID NO: 44169 - DNA, 266 bp, Homo sapiens
actctgggactcagaggctggaagctctgccagcaggaaccaggccctggagcctctgtgactcatcctttccccaaggtcaatcgttgttttgaaggtcaactgtcctcagagctctggaagccatgcctttagtaggtcaagtttgcaagtacacctcctggttccctttccttgtctgcacccctccacggcctttatctgaacttccccctagtgtgtcctgtgcttttataaatagtcctgagatgtttcgttttaaattc

SEQ ID NO: 44170 - DNA, 425 bp, Homo sapiens
tgtatagatgcagatttccattttcttcctgcctaactttttaaaatatatcttgtggtgtgactttccccgtttaaacccttcttcagacattaggaagtgggagagcagggatcaaaagacaccctgtttctcactgctcacccccctgttccccaaggacttcttcctcttggctgaggctgccacctcctggcttggaatttcacagcacagagcggactccccgagtactgcgggtttgtctcaccccagggctgtgctccttgcaggcaggaccagcccgacccaaatcacagcctcccccacctcacactgctaggcactaatcagaactcaatgtgtgcatattttaggtaatattaggcactatattaccgggggatttaattgacactttacttccctaagtgactgtaaatcca

SEQ ID NO: 44171 - DNA, 702 bp, Homo sapiens
aggccgtctcagcgtaagaggcttctctaagcaagttgaatatggtacggaggtgcacaggtcttccttgctaaccaagcgtgtggtacttgtagagattcgtgtggttctgaacaccgtaagtaggccgactacgtagagtgtactcgggccaaacaagcacgagatggcctagtgacggtgtctgcctgcatgatgtacggggcattcgtcacacacacagcaaggtgtgcttttgtttttgttttttgagacagagtccctgcccaggctggagtaccatggcgccatcatagctcactgcaacctcaaactcccaggctcaagcagtcctcctgccacagcctcctgagtagctgggaccacaggtgtgcatctccacaccaggctaattcttaaattttttgtagagacaggttttcactgtgttgcccaagctagtctccaactctgggaagattgcctgaggctaggtgttcgagaccaacctgagcaacataaggagactccatctctagaaaaattttttaaattaactgggcatgttggtgtgcacctctagtccctactaagactagaggctaaggcaagaggatcacttgagcccaagaatttgaggttgcagtaaattctgattgtactccaatcagattgtactactgtactccagcctgggcaactgagctagactgtctaaaaaaa

SEQ ID NO: 44172 - DNA, 840 bp, Homo sapiens
aggccgtctcagcgtaagaggcttctctaagcaagttgaatatggtacggaggtgcacaggtcttccttgctaaccaagcgtgtggtacttgtagagattcgtgtggttctgaacaccgtaagtaggccgactacgtagagtgtactcgggccaaacaagcacgagatggcctagtgacggtgtctgcctgcatgatgtacggggcattcgtcacacacacagcaaggtgtgcttttgtttttgttttttgagacagagtccctgcccaggctggagtaccatggcgccatcatagctcactgcaacctcaaactcccaggctcaagcagtcctcctgccacagcctcctgagtagctgggaccacaggtgtgcatctccacaccaggctaattcttaaattttttgtagagacaggttttcactgtgttgcccaagctagtctccaactcctgggtgcaagcagtcctcccacctgggcctcccaaagttctgggatgacaggtgtgcttttttgcataaagaaaaaagccttggctaggcacagtggctcacagacctgtcattcccagcactttgggatgccaaagtgggaagattgcctgaggctaggtgttcgagaccaacctgagcaacataaggagactccatctctagaaaaattttttaaattaactgggcatgttggtgtgcacctctagtccctactaagactagaggctaaggcaagaggatcacttgagcccaagaatttgaggttgcagtaaattctgattgtactccaatcagattgtactactgtactccagcctgggcaactgagctagactgtctaaaaaaa

SEQ ID NO: 44173 - DNA, 397 bp, Homo sapiens
atcgtgcgtttctgggcatctaatctttacttacctgtgtctcttcatcctgctcacctttcttttaccttgatttagagggaaaaaaaattgtctgtgtgtagatacatatgtatgtatacatgtatttattttgctttattccattttgtaatttcaaagctgcctcgaatggtctttgcaaggaagtgatgtagggtgtgaatttcataggaaaattggggtttcaacaggccttttttctatgttgccccggctggagtgcagtggctattcacaggtgcaattatggcatgctgcagcctcaaactgctgggctcaagtaattctcctgccttagcctcctgagtatagtagctgggactataggcacatgctactggctcagcaacaacag

SEQ ID NO: 44174 - DNA, 512 bp, Homo sapiens
actgtaagctatttcaagggatccaggaagaaagcattcttgagaaactgctatggattagaagggtattctcagcaatcatttgaagtaaatgctattaccattttgcatatgagttaactgaagctgaaaggtgaaattacttgcctggactcacacagcttagtaagtggaagaactgagattcaaactcagatacattttctccaaatttcttttttttttttttttacagtatagcattcctgcataaaacagagttgggtttattctcctgaaatgtttgagcaatgaatgctgagtaaatttcgatttgtagtcattttgtagagtctcttggtgtatctgcagatcttccagtgcagactgtgtaaatgaagatgtgagtccccggtttgcccattataccctttctagagccccagcagttctaagctcataggagatggcgagtttctacagagagaaacatttggagtttaaactgaaggatccagcttaacaaaaaaaaa

SEQ ID NO: 44175 - DNA, 678 bp, Homo sapiens
gggatgtggtctttgctgaatgaataagcaggggatgtgtgatacaagaatttgtaccagaacctttggccaacatttccccaaggcccagcatccaatggtagagatcctgggtgactctctgtagatggtggtccttcacttctcatataggccattccaatctgaatgcagcttgttttgtgtgtgggaaggaattacgttttagggtattaaatatcctttctgggccatttagttacttgtctcctctcaaaacactaaaagcaattacatggtaattaagataaattacttgaccaattttcatagcaaactgattggtttcacttatccccccactgaactgttaagacctggcgagatcctttttatagttctttaaacttccaggactttctgcttatcttcaggaaggacagtggaccttcaggggagaggagaaggaggaaatttgcatatttaaaatgtgtgatctgagccaaacgctcttcagctaacttgatctcgcatcattttcccagcttcctttgagaattcagaatcaaaattcaggcatcaccatctagtgaccacagggtcctgcaccccagcccaaacctggggaccccttagggataatgccctttctcatttgtctttgagtgccctgctctttccactgaagaccccacctaa

SEQ ID NO: 44176 - DNA, 379 bp, Homo sapiens
gaagtcagtaaaagtctgaggttaaaatgttctgagatcattatattacccatgagaaaggtaaaggagtttattcactgtataatttggtaagttaaatacgtgtattgtaagtctcggacaatattaacaaatagagacagacgtataatttctttctttctttttttttttttgagatggagttttgttcttgttgcccaggccggagtgcaatggcatgatctccgctcactgcaacctccgcctcccaggttcaagcacttctccagcctcagcctcccgagtagctgggattacagatgcctaccaccatgcccggctaatttttttttgtatttttagtagagacggggtttcaccatgttggccaggctgc

SEQ ID NO: 44177 - DNA, 321 bp, Homo sapiens
cttatattgctctcaaataaaattctaatggaaagttctgagagctatgacaagtctttggtgatggtagaaaatgaaaaatgactgcaatcaactaaggaattggcttacttcattccaaaaccaaagaacaagtattcaccaaaaaagggacctgggagaatctaggtaattttttttcctacagactgtattttttaaattaaatctaaacaaccttttattttattcatttgttttcaatgaatgaccagtaggtttagctgagcgagacacaaatttgtaaggctcttcaaaggaacttacatcagtttctttatg

SEQ ID NO: 44178 - DNA, 273 bp, Homo sapiens
acccaggctaaagtgcagtggcccaatctcggctcactacaacctctgcctactgggttcaagccattctcatgtctcagccttctgagtagctggaattataggcacacatcaccatgcctagctaatttttgtgtttttttttttgtagagaccaagttctgccacattgccctggctggtctcgaactcctggcttcaggcaatccacccgccacccaaagcgctgggattacaggcatgagccaccataccaggacgcaaagttattat

SEQ ID NO: 44179 - DNA, 268 bp, Homo sapiens
ctaaaatctaacaaacaatcatttctttccaaagattaaatccgtttttctgtgctataatttcatgtgaaagaagaactaggttgctttgctcatatgtacagttcttaaaataagttgtaggtaattaatataaaagttgtaggtaattaatgataaaaattggtttcttgtggcttgctgtattcagtccaccacagtatgaacttcgcatgctaaatatagaaagataataagtatctcatgtaatgacaactaactttatatt

SEQ ID NO: 44180 - DNA, 359 bp, Homo sapiens
acccattgtttgtgagctcctgggactcgcaactagccaggataacgggcagcccgagggggcctgggccaagtctccacagggcacttcacataaggacagagccacgggccaaagaggcaaaacaaatgcaagggaaatcttgccagcaatgcctggggcgcagggcagctggcctcccacccgcaggacagcaggcagcacctggcactggggctcagcttggcaccgtgcaacctcaagcttcccactccatgctcaccccccaccccagaagcaagtgttgtgcgcccagcagtggccctggatgcttggcagggctacccacagggaccacgggggaccaccagggcagccac

SEQ ID NO: 44181 - DNA, 472 bp, Homo sapiens
  misc_feature (13)..(13): n is a, c, g, or t
  misc_feature (51)..(51): n is a, c, g, or t
  misc_feature (67)..(67): n is a, c, g, or t
cctttgggaaggnatggggccccctggggaagggaaccctttttacaagtnaatttaaaggattaanccccttacttttaaggcccagtcattgtgactcacgccctgtaatcccccatagtgctgggattattggcataagccacggctccaggccgaattcttattgtttgaaataatgttagtagctcaggcctgcccagtgtgagggagaacaatctgtaaatatcatctagaagcaagtgtattacaggcttagattacatgacatggttgggtacaatgaaagtatttaaatatttaactttcagaatttaagtccatataagcagcagtatgggcagtggttaagggcacaatctcaaccaggtgtagtggctcatgcctgtaatcccagaactttgggaggccaaggcagcaggaccactttaggctagatggtcaacatggtgagactccatctctacaaaag

SEQ ID NO: 44182 - DNA, 420 bp, Homo sapiens
atctcccccacccttaagaaggttctttgtaattctccccacccttgagaatgtgctttgtgagatccacccgctgccagcaaaacattgctcctaacttcaatgcctatcccaaaacctaaaagaactaatgataatcccaccaccctttgctgactccttttttggactcagcccgcctgcacccaggtgaaataaacggccttgttgctcacacaaagcctgtttggtggtctcttcacacagacacgtgagacagaaacaagaagctccctctatgtgccctgtagggacatttttcttggagaatcgtaactctaaattcttacctcgcagagagggacccgatgggacctgtttagtaaatattactgagttctgccacttgtcgacaatcttccagggagataactcctaatt

SEQ ID NO: 44183 - DNA, 420 bp, Homo sapiens
gaagatgaattgtgctgttcactgagagcagaaggggactaagaacccaagccttttccaaaagcaaggcactgtctggggcccatgacttgcaatgtgctggcttcattgctctgacaacatgaaggatgtttggttttgttcccagcgctgttatcatttatcttcctcttgtaagagctggcaccctccgcctgttccctcttccttctcactctctcccaactcccacattcaatccaatctccctattttcctgatccccctgccactgagaggagccctcttgtgtgtaccccagaggaaactctcccctattggttcccagaagcccaagggatacccctgttgaactcaactcttaaacatttgctgagcagttcatctgggcaaagtactgtgcttgaggctttgggtggt

SEQ ID NO: 44184 - DNA, 408 bp, Homo sapiens
tcttcttgcattggttttcttaaaaagggtttcgaaaattataaaaatgaagttgtaaagcctccctcaaatgtggttttagacctgtgcaaatacaggatatgacctacttcgtgcaaagaaacgtgtatatgtttttggtgaaaatggttattttgaacgacttatcacaacagcattaaaatactgttggaggttttagtgaaatgagagtctgaacctcattttcagcctttaacgtaggaaaggagtcaatgaagataaattatgatgatacctacccttttactcaaagatttaactaattattgagtttaaaatccaaattaacaaatagatgtgaagctcttttttcaataggtggaccttggaaagagaaaacatgtagatgatcaatatttaataata

SEQ ID NO: 44185 - DNA, 371 bp, Homo sapiens
ctctactttaattcaagagtaaattttgttttcgaatgaatgaataagtgaattgtagctggtactatgatccacccacctgtacttctttttgactctgatagtgaatagaagtttacaaaagtttaccctcctagtttggccttaaaaacatagaaccttggtttcagggctatttgactgctgctttagctaaacaatagcaataattaaccattactatgtcccatgtcataggtaccatgcctggcacatcatttgctgtatctcattcagtgtttgcaatagccctttgagttaggtattgttatttttccgttttacaaagagagaagtaggattcagcaaaactcgataacgatcaaatgcta

SEQ ID NO: 44186 - DNA, 464 bp, Homo sapiens
gtaactttatgtagataggaaaaaagtgctttctttttaaattggaaaaaccaaatgccctttttctgtaattataagagatcatggcaattctacattgtttggagaatttgctatagcttcagtttttcttcttgtatgtcagagtactttgccagctataattgggtagtttatattttttgcatactctattgtttctgtgagtttcacacaggagaaatgaagttgtggacatgaggtgggagcaagaagtaaaactctgaagtctgtgttatggatatgtttgttaataattatttatttatttattttttagagttagggtctcactctgtcatccaggctggaaggcagtggcacgatcatgtctgactataacctcaaactcctggcctcaaaccatctgcccacttcagcctcctaagtagctgggcctacaggtgcctgccactatgcctaga

SEQ ID NO: 44187 - DNA, 408 bp, Homo sapiens
agagagagggaggagatgccaggctttttttaacaactagctcttgagggcaccgaatagagtgaaaactcacttaccccacatggagagcattaatctattcatgagagatctgcccccatgacccaaacacctcccactaggccccacctccaacatgggggatcaaatttcaacatgaggtttggaggagaccaacatcccaaccacagaagccactttctaggatcactttggagattctgaatcagtaagttttggcagaatgttaaaatctacgtattcaaaaagttcctcaggattacagcagtaacaaagtaagaagtatcacacctacccactatagtcaactataaaactggacaaaaatatatgaagtaaatgttttcatgtattttacaacataca

SEQ ID NO: 44188 - DNA, 475 bp, Homo sapiens
gagagatttaaaacatttagcatataatagcagttgaaaattaaagaaaatttttagagttttttgtggtttggaaaactttcagtaatacttttatgttacatggcattttaatatatcaatttagctataactttggaaactaaaattttaagtttttgctctggaaggagcagtatcgtttctttccagaaattctggtgggtaacttgataatttgacactagaaataatgggacaagaaaaacagcctggtttgacagagaggcccattttaacttttgttggtattcactagggtttctcacataagtacatgtgataacttttaaaatgtccaatactggaaaaagcagttttgagagctttaaagtgttagctctcacttaaatatcctgaaatatcctcctgagatggcttgctaattcctagagtagttccctgcctcacactctgtcaatttgggaaattaaaa

SEQ ID NO: 44189 - DNA, 463 bp, Homo sapiens
aatgaatgaatgaataaaaatcataataactaacatttattgagcacttagtgtatgccagccattacactaagcacgttacacatattaactcatttaatattcattatcacaggggcaacgatgcctcatgtcattccgtgtttaacaccagtctcccctcgtagaagggaggccccatgggggcagggaccatggctgatttgctaagagctctcttttctgtgcctagatgctctgagatgggcatgagggggagacagagagagaaaactggcctcccagatgtctgacttgccccaaataactcacagactctgggactcccaggagatctgaaaccactgctgcccaccggccatcaagttttgactgtgaggttgctggtggttggatccagccaccatggtccttcttggaggatgatggaagcccacaatttgatgttgcaggtacaaaaaga

SEQ ID NO: 44190 - DNA, 440 bp, Homo sapiens
atttttagggagtgataacttcttgagaatttgatatttcaagtgtcatatatgtcatgaatgtcaaggattagttaatgtggagtgggtttatctcttctaagcacatttttaatgtattctactgatttttaaaaaaatgaatttgctttctgtagtgggagagaaagggtggagtgaaaagttgagaacaggaaatgaaaaattatgcctgggaatgtttccactggtatctatgcatctatcgtgtttccagaagttaaaaccatgttcaagggaggtcttgctcatttgcttaggaagtattagcactctagagtggcttaggtatctgcaatgtgaagtcatgtatgaaactgacattcaacttagctggatgacaaatccataaaaaataaatgcacatttgtgttatatcatcttggtagcaatttgcataa

SEQ ID NO: 44191 - DNA, 2002 bp, Homo sapiens
ccaccaccaccgcctcctccaccccctgccctgccaggcccaggcccggtctcagtcccagagttgaagccggaatcttcccagaccccagtggtctctacccgcaaaggcaagtgccggggcgtgcggcgcatggtggtgaagatggccaagatccccgtatcgctggggcggcggaacaagaccacatacaaagtgtcttccttgagcagcagcctgagcgtggagggcaaggagctgggcctgcgcgtgtcggctgagcccaccccgctgctgaagatgaagaacaatgggcggaacgtggtagtggtcttcccacccggtgagatgcccattattctcaaacgtaagcgcggccgccctcctaagaacctgctgctgggtcccggcaagcccaaggagccagctgtggtggcggccgaggcagccactgtggcagcggccaccatggccatgccagaggtaaaaaaacgacggcggcggaagcagaagctggcatctccccagccatcctatgcagcagacgccaacgacagcaaggccgagtactcagacgtcctggccaagctggccttcctgaaccgccagagccagtgcgctggacggtgctcaccgccccgctgctggacacccagtgagccggagtcggtgcaccaggcccccgacacccagagcatctcccacttcctgcatcgtgtgcagggcttccggcggcgtgggggcaaagcaggcggttttggtggccggggtgggggccatgcggccaagtcagcccgatgctccttcagtgacttctttgagggcatcggcaagaaaaagaaggtggtggccgtggcagccgctggggtcgggggccctggccttactgagttggggcacccacgcaaacggggccggggggaggtagacgctgtgactgggaagccaaagcgcaagagacggtcccggaagaatgggactctgttcccagagcaggtgcccagtggcccaggctttggggaggcaggtgctgagtgggccggggataagggtggtggctgggcccctcaccatgggcacccaggcggacaagctggccgaaactgtgggtttcaggggaccgaggcccgggcctttgcctccactgggctggagagtggagcctcaggccgtggcagctactacagcacgggtgcaccctcaggccagaccgagctcagccaggagcgccaaaacctcttcaccggctactttcgctcgctgctcgattcggatgactcctccgatctcttggactttgccctctcagcctctcgcccagagtcccggaaggcatcgggcacctatgcagggccacccaccagtgccctgcctgcccagcggggcctggccaccttccctagccggggagccaaggccagcccagtggcagtgggtagcagcggggctggggcggacccctcctttcagcctgtcctgtccgcgcgccagaccttcccaccaggacgagcagcaagctatgggctaactccagccacttcagactgccgggcagccgagaccttccccaagctggtgcccccgccctcagccatggcccgctcacctaccacccacccgcctgccaacacctacctgccccagtacggcggctatggggccggacaaagcgtattcgccccaactaagccctttacaggccaggactgcgctaacagcaaggactgcagcttcgcctatggcagtggcaacagcctccctgcctcacccagcagcgcccacagcgccggctatgccccaccgcctaccgggggcccctgcctgccaccaagcaaggcctccttcttcagcagctctgagggggcccccttctctggttcagcccccacgcccctgcgctgtgacagccgggccagcacagtctcgcccggtggctacatggtacccaagggcaccacagcctctgccacctctgcagcctctgccgcctcctcctcctcctcctccttccagccctcgcccg

SEQ ID NO: 44192 - DNA, 847 bp, Homo sapiens
ccaccaccaccgcctcctccaccccctgccctgccaggcccaggcccggtctcagtcccagagttgaagccggaatcttcccagaccccagtggtctctacccgcaaaggcaagtgccggggcgtgcggcgcatggtggtgaagatggccaagatccccgtatcgctggggcggcggaacaagaccacatacaaagtgtcttccttgagcagcagcctgagcgtggagggcaaggagctgggcctgcgcgtgtcggctgagcccaccccgctgctgaagatgaagaacaatgggcggaacgtggtagtggtcttcccacccggtgagatgcccattattctcaaacgtaagcgcggccgccctcctaagaacctgctgctgggtcccggcaagcccaaggagccagctgtggtggcggccgaggcagccactgtggcagcggccaccatggccatgccagaggtaaaaaaacgacggcggcggaagcagaagctggcatctccccagccatcctatgcagcagacgccaacgacagcaaggccgagtactcagacgtcctggccaagctggccttcctgaaccgccagagccagtgcgctggacggtgctcaccgccccgctgctggacacccagtgagccggagtcggtgcaccaggcccccggcccctgcttcccacccggccccctgccagcccacctgacaaggccttctccacccacgccttctccgagaacccacgcccacccccacgccgggaccccagcacccggcgcccaccagtccttgccaagggggacgacccgctgcccccacgggcagcccgtcctgtctcacaggcccgctg

SEQ ID NO: 44193 - DNA, 301 bp, Homo sapiens
tgacatccagctggcatcaggggtacagtcagaccaggtctcagggtgtcacacacctgagggcagatggggacatgaagaatcagagaacccctgggtctcagtatgtgttgggaccaggaccaaactgcaagactcccaggttcatggccagtttctgcggggtccaccaggggatttgaagtccaagaagcatggcatcttgtcacagcttctttgattccaagttgtgtggctttgagcaagtcattctacctccctgagcctcagttctcctaagtgagattaacggtacccactt

SEQ ID NO: 44194 - DNA, 182 bp, Homo sapiens
cacaaatacaaaacaacaccattcaatcagtatttttcatgccttgatcaggggtcattgccatgcaggaactttaacaaaacagtacaggctaataatagaattgttggaattaactcacacagcacacctatgagagagagttaagatagagggtcttggtggtctctaacagttgaatt

SEQ ID NO: 44195 - DNA, 656 bp, Homo sapiens
tataaatcccttatctatatcctttgtaataaccttcatgatataccagcagatgtgtttccaagttctgtgaagtgctctagcaaattaatcaaacttaaagagagggtcatgggaacctcagtttataaccttgttggtcagcacaagtaaagcaacctagggcttgcaattggcatctgaagtgggacctcatcctttaacttgtgggactgagccctcaacctgtggaattctaatgccatctccaggtagatggcatcagaattgaattggagggcacccagctggtatccacggcagaactgattgctcacttgctggggagaaatctactggtcacagaagtcttctatgctgattgttttgtggtgtgagaacagaggaaaaatagtttgagcgctttccactcaactattaaggaattgaatacataattttaaaactcccccaaaagaaatctccagacccagatggttcactggagaattctaaaaaatgtttaaaaaagaattaactcaaatttttaataatctctaccagaaaacagaataggaaaggatacttcccagttcattatataaggcagtattaccccgataccaaaaccagaaaaagtactgaaaaataaaactgcagaccaatatccctcatga

SEQ ID NO: 44196 - DNA, 767 bp, Homo sapiens
cccaggctggagtgcagtgctgtgatgtcagctcactgcaacctccgcctcctgtgttcaagccattctcctgccacagcctcccgagtagctgggattacaggcacctgccaccacacatggctaatctttgtatttttagtagagatggggtttcatcatgttggccaggctggtcttgaactcctgacctcaggtgatccacctgcctcagcctcccaaagttctgggataacaggcatgagccactgcgcccggccgcacccttcattcttgattcacctggttacaaactcgcagataaactgtttctacctgtgacaaatgagtcatccatcttccatgtggtgtcgactttgtccctgttataatattcctgtctcttgttctggtttttggcgtcccgcacattgtccctgttacagtcgtgtctcttgtttctggggtcacccctgtggtgagttgactgtgccctgttcctgaggctggtgaggatgctgtggacaccttaatcacggctgtgaacaaactggctaaagctaggcaccatggagctttgcagtggatgctaagtcgtggtacccattctttgatcagtgacggagccaggtgtcttattaagtctcggggatttgtggaagcccagagcaggcatgcaccttctacattgaaaggaatccttttgacactcaacgttggtgtcgtgaagtcctgcctctggaaatccctgatttcctaagacactaatctaacattttaaaagagtt

SEQ ID NO: 44197 - DNA, 414 bp, Homo sapiens
ctctatgtgttatagctgttttaagtccattagatatacagtctcccatcttgtaaaggtaatttgttactgaaaattccctcataggaaagttttcttaaaatgtaaatagaattactattagtttcattagccacatttctttctttaaatttctttaaaatgtaattgaccgttgcataatacagagattagggaacaacccccaccccccccgactccctcttcaaagttgaaaatttaggtataacttttgactttataaaaacttaattgttaatagcctactgttgacctgaagccttactgatgacataaagctgattaacacacattttgtgtgttatatgtgttatatactgtattcttacaataaggtaagctagaaaaaagaaaatgttattaagaaaaaaa

SEQ ID NO: 44198 - DNA, 981 bp, Homo sapiens
  misc_feature (814)..(814): n is a, c, g, or t
acccccatctctacagaaaaatactttaaaaattagccaagcatggtggcttacgcctgtagtcctagctacttggaagggtgaggtgggaggatcgtttgagactgggaggtcaaggctgcagtgagccctgatcatgccactgcacaccagcatgggtgacagagtgagacactgtctcaataaaaaacaaaaacaaaaacaaaaaaagaggcaggtggtatcaattcacaagccacatggccggaaatctttattagtaccagcagcaaaggatccaaatctgaagaacagacaatcaaacaagaagaaaccaaggagctaagtggtgaatgacaataaataacttctctgtttccttgttcaacccaggttattcaccatttactaagtacctaccatgggcctggcattgagctactgcgagaaataaaaataagaatgagacaatgaccctgcctcataaaaagctctcattctcctgagtggagtttaagggcctctcctttcattcaaaagaaaaaaaaaaaacaagcaactaataatatgcagtacctccagggaggaaattgggaggctaagagacaggggtagttatcactatgtacctatttacaccttttgaattcgaactccatgaatgtattatctatttaaaagataaagttgaatttgccaggcgcggtggctcacgcctgtaatcccagcactttgggaggccaaggtgagaggatcacttagggggccaaggtgagaggtggccaggagttcgagaccagttccgtcaacatagggagaccccatctctacaganaaatactttaaaaattagccaagcatggtggcttacgccttgagccctagctactttgaaaaggtgaagttgggaagatcggttgagactgctgagtcaaggcttgaatgaagccctggacatggcacttgccaccaaaatgggtgacgtgagaacttgctcaatac

SEQ ID NO: 44199 - DNA, 358 bp, Homo sapiens
tgagacggagtctcactctgtcacccaggctgaagggcagtggcgtgatctctgctgacttcaagctccacctccccggttcatgccattctcctgcctcagcctccaaaatagctgggactacaggcccccgccaccatacccggctaattttttgcatatttagtagagacggggtttcaccgtgttagccaggatagtctccatctcctgtgacaacactccaaattttctcacgttattttaaagtatacaatatattactgttgactatagtcaccttactgtgctatagaacaccaacctctccccatttccactccacactactctcccaagcttctggtaaccactattc

SEQ ID NO: 44200 - DNA, 377 bp, Homo sapiens
tttattgagacctgactttttgattttctcttatactagagttgaagaggttgataggaggccagttgctaaaagtgaagaggggctttgcatctttttcctgctaaaataaattgtgtgcttagctcagtgttgttcacaagcagccatcgaatacatgtttgataagctgatcagtagtgacagcttgttggaatgcaggaaagggggaggacagcaaactgaatggctagcagtggaaatgctgaatcactaagccggcagtccagcaggcatggatcctcattgtttggttctgagttagtgtctcagacttgattgtccttttcacaaggacctgtgccttgcatgcctatattcctctttgtcaggttcat

SEQ ID NO: 44201 - DNA, 493 bp, Homo sapiens
ggcagttctccaagatatgttacccaaagacctctcattctgtgatctgaactccattatcttttccctgtgactagctaaacactctttttgttgtttttcagaggaggcaagtctgatttacaaggtctttaatgtgtgcaaaaggtaacatgcattgctgatatccattcttgagcgtgagaaatgcctctatgtttattcacttcactagctctgccagagaaaaccagcactggggcataagctgagaacacagagcttggaagcatctaatttggacacagatgcttttgatgtaatgggttacctatgaaacctactgctcttttgttagtattcactggtggagaaagacaggaaatgatatacttctatcaaaggagtcaggctgcagcatgctgctggctgctgtcttgggcacgggacagccataataaccttgcatttggcagtttcctgtcaagttaaattgtagttggcagtttcctgt

SEQ ID NO: 44202 - DNA, 444 bp, Homo sapiens
aaactttagaatatgacagccacttctagggagctgctcaagggtagatgggattcccagcttctaaaggaaggttggccttttataacaaaatctatactgtaaatagtttcagggacaggctaaaaatgagtaggaagatcataaactctacaatcaggcagatttaggttcaaatcctggatctgccacataccatgatgggatcacagggtagtcctttaacttctgagtctctgtttcctctaacctcaaaatgggaaaaaaacaaaaaacataatttgtaaaaaaaaattttttaatgacaggttcattaaagtataatttccatatagtaaaattttacctcttttaggtatatagttctatgagcccctgaaaaacgtattcagttgtacaaacatcaccacaatcaagatataaaatattttcattaccccaaaa

SEQ ID NO: 44203 - DNA, 403 bp, Homo sapiens
atcaatatgcaatacttgttttaaactgtttttctcgtaattattacagaggctgaacctttcccacatgttttgtcactacgtttactaatctacaaactgcttgcatcattttaattcttgttaagcttagctatttttatggaaagttatttaataaactcaggaaatagaaatgaaagctgagtacaaactactgagcttcttcttacttggacgaaaaagagccaaatcaagcttattgaattggacagaggcagccttgcaccaaccccaagccccacaactcccaccctctcacctcttactggagaagctgcatttagccaatgatcatgtcagtcacgttcccttattatgtgcctggcatacagttggtatttagtacatagtaatggaggaa

SEQ ID NO: 44204 - DNA, 678 bp, Homo sapiens
atttagaccagtgtcttctcctagccccatccctcactctatcacttgctcctactttcgtcatatgacatgcctgctcccctttcaccttctgccatgattgtaagcttcctgaggcctccctagaagctgagcagatgccagcaccatgcttcctgtagtctgtagaaccataagccaaataaacatcttttctttataaatttataaattacccagtcgcagatatttatagaaagaacagcctaatacaggtgctaaatacatatctgacaataaatggtagttatctcttagaactgttatgaggattaaacgagttacagtgtccatcttaaaaagataattctgaaaaaaatctcataggttcactttgccttgtcaagaatatgattaccattaacttctgtagataggaaaaaaatgtgctgagctccaaaactgacagacattttgctaaaacaatatcaaatctcattaaaatgatgacagttatttcaatagttgacagtagctatcccaatacaacctaacaaggcattttctcttcagaatcactcgatcatatggccatttccctaagcttttatagctattgcccagtgtacactgaagacaacagctaacgaacaacatacgtgtgataatttatgtagttgaacctctaaggcaaaaaaa

SEQ ID NO: 44205 - DNA, 891 bp, Homo sapiens
atacaaaaaattagccgggcatggtggccggcccctgtagtcccagctactggggaggctgaggcaggagaatggcgtgaacccgggaggcagagctggcagtgagccgagaccacgccactgcactccagcctgggtgacagagcgagactccgtctcaacataaaaaaaaaaaaaaaaaagaaaatgtcactagctaggcatagagataagatacctttccacatactgtcaaatgcccttttacttgcttctttaccacgtagccaacctacctggtatccaaatgtcagtctgtaatctttcaatacctgaaataaactgagtattgatctaactagcaactatctccctcctcataaaactaaagggggtgagaagtaggaaagggggcttccatgacaaataaatctaagccaaagtcaaaaggccaaaacaaaatctccagtcaacctagatccataatgcagcaggagaaacaccccctcccacttgaagtagcatctatttcaagaatgccggaaacattttgcaaaaacctacagcaagcttcggacgggtctggaaccagagagtcagtgtctgaggtttggtcaaaggataactgttgtgtagggagctataaacagctatctgtcattacaaaacggcttcagtatgggaagaatggcactgctttttaagactcctcaaactaaggaggcaagtcgaagtaatcatttcttataaatgagtaacaaagtgtaactatcttattcttttgcaaaacttctggcaatctcaaccacccaaagtttaaacaaatcaaccaactgaccagcaaacagaagctctttcctcccaggccccattgacaccatgtacaattcttaacagctttgtcgtctcttg

SEQ ID NO: 44206 - DNA, 428 bp, Homo sapiens
tagttccctgagccatcagacttcttttactgttcacggaccttaaataacattaaattgtaattatcctaaatataaattagtgtgccttttaatatcactgtatctcccaacagcgtactttaatgttttaaaatgcaggaagaaggcttgaaggctatgtgaagtcattgtcttaaactagttaactttttttaaaatttctcttttttccagaaacatttatagtttactgaaaagaggctggggttgggtattcagaccaactggcttaggaatcatagctctattgattacaagctaacaagctgtgtgatcttggacatatttttaaccttcctcagcatcattttcccaagtttgttgcagtagagaaaaaatgcgaaatgctaatcctagcacatagaaagtgtttggacgatcatttg

SEQ ID NO: 44207 - DNA, 369 bp, Homo sapiens
cagaaaaataagaatctggaagcaatagtgacctcatagagtgcttgtgaatatcagcaataatgtaagaaagacacctagcacaatgtctggcacatagtaggtgctcaatgctaataataattagattctgcagatggtgtcttctggccagaataatttgaattaagggggtttgtgcaattgagtttccagcatcctcccttttttcctagaaaaagctggctcctggggcattttctccccctctatgaggcgaaagcccagtctggatcgtgtcctctctatgcagcccaaacatgcttttccacagccatgaccctgcatgcacaccacatggaaccagtcctgcctgagaccgcaggtctg

SEQ ID NO: 44208 - DNA, 313 bp, Homo sapiens
aaatccaagtgagtgatctttcacatttctaccataagcctttgtagcaagcaagggcaggccaaagaagaacatacagaataaagaaaaacggatctagtggcaggcctaaaattggtctaaaatcaccagcagagatagaaattctatcctaggtgcaaaaatataaagtatcttagtatcacaacacttattacaggatagcttcagggagtggagagagcaaaaagaataggcaaggtgccttttggcaactggatggtgaaggggaaaagaagcaacaggagaaattcagggtcctgcaagacaaaaa

SEQ ID NO: 44209 - DNA, 366 bp, Homo sapiens
agattgtaatcatctgagaaacgaggagtgacacttgggtttaattggaaagaatgatacacagaatggcccacctattcctatccagggatagaagcattatcatggaaattatattctgaggtcagtaagcaaaatgacaagaagatggtctgtgccaatagtttaaatgccaagaggcaccaggccaagaaggtgcacagacataaatccggcagtggcactgatgtaattatgggcttagaccaattctcaaacatgccagaagctgaaccacagtccttatgggaaaagagagagtatgaaggtagttagaagaaaaaagctgaggaaagatatgtgacttaagaaaaaaaaaaaaaaaac

SEQ ID NO: 44210 - DNA, 516 bp, Homo sapiens
tggctatgcacacagacactagagccagccagcctgcaccaaatcctgttttgccactgactgtgtgaccttgggcaagtaactccatttttctgtgcttcgtttgcttcatctgcaaaatgtggctgatacttgtctcttagagctactgcaaagattccaagaattggtgcttgtaaagcattcagagcaatgacttgcacagggaaagcacaatgtgcttgttaaaatacttaattatcccttgcaaatagccatgtaattccagagacattgatgccttatgttagcttatgctggtgggtgtttgtggtctcatcaccttgaatgcaaaagctatcacttcaattccaatggaataattaggtgttgctagactgggaagggggagggtatattacttcttatgacccattgtacctcattttattttttagttagcaagaacaaattcacaactgagtgaaaataaaacatagagagtgctttttgttaataagaatgttctaattttga

SEQ ID NO: 44211 - DNA, 603 bp, Homo sapiens
gttaatcttcttgccaaaattttctgtaacatttaagacttatccatggatcgtagttataaacactcaactatggggcttctggactgcccctgggccctggggtagcgttgatgttggggtttctctgtcagtgtcaccctgaggatacacactttcctgtgcttttagttaggcggcttctctgttcaccctaaaataagaagttggtgaaaatcttttcaaacatcacattcgtttcttcagttttgccaacatcacatagcaggactcgttcatctgtgggtggatgagacggtgaggatggttgtgctcagtctgccacgtgcaggcgctgttccacatgttgctctgaaggctccgcgaaatacactgaagttcttccactagatactttctcataagctcagagaattgatgcagtggtctgaggggcaagtcaagctttgtaaacacactaaggggcagggctgtgttgaccagaagccagtgtgagggagctggccagggaaggtggggttattccacgctaggttttagccaaaaatgatgctttgggacttgtgcaagtcacttgacctctttctctggaaaatgtgggga

SEQ ID NO: 44212 - DNA, 466 bp, Homo sapiens
aagaataataaaataaaacagatgtagtggtgacagctgtagcattgtaagctttagagtagccctcatgcttctggccatgataacactagattctcaagttccttaggccagagtggtcacactgaagtgtctgtggagactaggcaggtcatctaagcaaaggggttgttgtagactattgtacataaataatagctgcctctccctgagggtggattacacttcccagccccaatgccttcacccttgccatggaacttgctttgggcaatgaaataacagcagatacttcaggagatagtgtatttttgttaatgtaccctttcctcactccagtgatgctccagagagactgctccctgctctgctggctggggtgaagatgatgtgggagcagaaccacagtcaacccaccataggataaggcaatgttgagcaagaaataaacctttctagtaagcca

SEQ ID NO: 44213 - DNA, 932 bp, Homo sapiens
cgcgtgattgtgcgctgtgtgagtgaggtgcgcgccgcgtgatcgtgtgctgtgtgagtgaggtgcaggccacgtgatcgtgcgctgtgtgtgtgtgaggtgcgcactgcgtgaccgtgcgctgcatgtgagtgaggtgtgcgccgcgtgatttgggaagaggcttctgcaatgggcaggcttctgggtacatcacttaattcgttcaggccggctcctacctgctgtccagtgatgaagtctccacacaggaacaggttcatgctggcgatgactatgatgtggggtatcgctgggtactcagaatccttttgtgtatcaaaagctggaatgcttcaaatttttcataagtgccttgttttccttttaacattgatctggaaacagtgctgtctgcaaagctgaggcccactcctctctgctggggatcaggggtttcagaaggcaggggccatgctgggccactgtcctgtacaagcagcctggcctccttcacgctgccagggcatctggcgcagggcatgctttctcattcatagtctgctttgaaagtcttggttttaggagaggttcaggttggtcttgctggcatcttcacctaaaatagggtctggcagacaggcccatgcgctgcatcctgcccacggcctgatagatggcctgtgaatggcttttttacattttaaaagtggttgaaaacaaattaaaaatatatttcatgacatgaaaatcatgaaattcacatttcattatctgagaataaacttttatggatgcagccatgcctgtctgtccatgtcttatctgtgtctgctttgtgctacggctgcagagtggagtggctgggactgagacggaacgccctcctcacggggccgcgtctctccaccaggaccgcggggctactctgaggctctgcttcttccccagcg

SEQ ID NO: 44214 - DNA, 542 bp, Homo sapiens
attacctccatgtgggagatggtgaaattgagaggtcagatgatgtgctccaggccaaaaggttgattatgagaccctgctgggtccagaccccaggccacaatccaggtcctgcttccattcatggccccagtaatgagtttgccacatggcagtgattccccactccacccctggttcgatctttttattttagttctcttcttcagaaagctttttatagaaatataaagccaaagttcttagctttgaatccaaaggtgaccagagtctccttcataaataagcagatcccttttccactgtgttagaaataaaagctcttttggtccgagctcaaggttggatccttctcaggttgtctgtaatgtggatccatggctaagtcttggtctgaaactagacctgactcaaatcccagcaggttaataattcttcctactgacctgccctccttgctagagatgttagttttgtatgtgaagactctgagtccatagcaggcattagagcagtacctccagggctgaaatcaaagtgaa

SEQ ID NO: 44215 - DNA, 398 bp, Homo sapiens
tccacagatgtgttttgtttggcctgtggtgtttgaaaaatattgaataagttgccaacatttaaaaatcagggcatttcactgaaacgtctggagctctggcatctcttgaaaactcaaaagatctggagccacaattttatctttggacaggacataaattctccagattgttgcagccttcaccactctatgctcttgtctagccccctacctgaatcattatgtcacatgtttccagacccttcgttattctcattttcttttcctagctgtgatgcaaagtgtcagtggtcccatctttaaagaaaatttttctttttatgtttacaaaaatgatagttaacaataataataaacataatattatagaaaatttggaaattacaaaaaaagaa

SEQ ID NO: 44216 - DNA, 267 bp, Homo sapiens
tgcgtttgcttgcttttcagttccaggcctgctgctgagggaagtccaggtgtcaaatactaaggctaactgtagccctggaggtgctggcaccaggcagaaaggttttacaaagctgatgacccatatccactggccttaggaaggacaggaccagctttaggaccctgggccagagccagaaggaagcacagagactaaattggttgactctgggaaagactaagggccagaaacgttgtgggccttacttcagatctcacttgg

SEQ ID NO: 44217 - DNA, 356 bp, Homo sapiens
catgttggccaggctggtctcgaactcctgacctcaggtgatccgcccaccttggccacccaaagtgctgggattacaggcatgagccaccatgcctggccctctctgctcttttaatagcagccatcctgagggtgtgaggaggctgtttccttcctctttggacccacacaccttcgagccccgctcatagcaggcactccatggatcttcaccctgtgaactagattctctcctgagctttctggctcctaggaggcaaacaggctgtttctctccctgcaggggaccttgggccttgtggctcttggggattatttacagccagggccacctctgttctccccttgggcagg

SEQ ID NO: 44218 - DNA, 518 bp, Homo sapiens
  misc_feature (510)..(513): n is a, c, g, or t
  misc_feature (515)..(516): n is a, c, g, or t
cagtgattccatgtagacagttgtgcaactgtcagaatccctgggagttccctgaaagcttcggggatttcaggcgacttcagacgcctcaaagtcaaacaaaaccaaaaatgtccccttcaggaagtcaggccatgttctgtccttccgttttccttcttactagggaacttggggagggaggctgggcggcagcagttaaacaactcacccaatgggaaaaccagcacgctctgggaccacctctgaagtgatctcacaccctgaccacacactctaaactcactgtcataatccttccccttggtcaaaaataaaagcagcacacccactctgctgggagtgagtcacaaaccgaaaaaagtcaatgggtctgagccaagaggatctactaacaaggggaaagatctcccagtggaggtgtttcagcggatgctgcggtcttacccttgtagcctggatgaccagacagatcaaaaaaaatattaaagtccaggcatctgacactannnnannaa

SEQ ID NO: 44219 - DNA, 415 bp, Homo sapiens
agagagctagcaccatgatcaataccctgccaaatccccctctgtgagaaacacccaagaatgatcaataaaaaaaaatttaaaaaaaacaaaaaaaaaaacaaagagtattagggtctagaatcaaaccatccacataatttttggcaaactgcttaaaatatcagagcttgagtttattcatctgtaaatcagagctgctacaaaactttcataagatatttaatagagcacaaatgtaggacaaatgtccaccatatgttaagttctcaggaaaactgctgttacactacttcttactttaaatccaatcttttttccaaaaaggagagatctggcaaagtacaaagtagggtgggcttacaggactttacacttaggaccccttcttacagggcagctagggtttttatgc

SEQ ID NO: 44220 - DNA, 276 bp, Homo sapiens
agggcagccagtctaaggacaggatggatctcaaccatggccaggccaccctcctactggaaccaccgtttgctttcatggagccaccttgcttcagtatcctcacaggattgctgcaactggtcattttgggttcacttccaaactgcttcaaagatttttatttatgtttatatatttatttttttttaagacagagtctcgctctgttgcccagctggatcgtgccacttcactccagcctgggaacagagtgagactcagtctcaaaaaaaa

SEQ ID NO: 44221 - DNA, 343 bp, Homo sapiens
atgtttttttttttctcatcacattcctgttgctaaggaaaccgtctcctttgtgtagcatattcagagaggcacttgaggtagactccaactcaaagagtgtgagctccttgaattgtgtcatttttaacaatgggaaattaaaaagacaaaagcccttgacagaaggtggaaaaatactcagaaacttctatggcattgtccttgtttggggagagaagcagcaaaaccaaagtttattgtgaaatatttgttgaatgtagaagctaaagaagatacatgagagatttgaaagctttagttcccccgccccccaagtatatgcttctttattgatgaggaa

SEQ ID NO: 44222 - DNA, 105 bp, Homo sapiens
cttattggctttctaccttgcctttccctacttgcatttccaaaaatgtccattatatgtaggatgatgctagcaatctaaagtcccccactcggggacgccaac

SEQ ID NO: 44223 - DNA, 340 bp, Homo sapiens
cttccttttctcctttcttctggctccgtctccctcacctcatgtggctgtggaaaactttctagctattgagcattagccctagctgtgatgaccatgaacatccagcgaagggtttttctgcctcgctctacatcatattcatctgaggagatattattttaaggagatgctcatggcctcatctcaagagatctgaaatcaaatattctgggatgcagcccaggcattggtatttttaaaatgcttccccaagaaatgctaaagtgcagtcagtattgagaatcacagatctaaattttccctccatatcttaatttctttttctataaaatgaact

SEQ ID NO: 44224 - DNA, 498 bp, Homo sapiens
aataaaagtgaacatacaaaaaagagctcttgtcacagaaatgaaaaccttgggagcaggactgcacccacggttcccaccaacctatcctgccatcatgttttctccctactccagcttcctcccaagctcactctacgtagatggtttttcttcccttagccaacaaacgaaattctgcctataaattaagccaggacactaggatatggaggtatattatttatgtctcttttccagtgtttcctggtatataacagcaaagatggtttagcaagttaactggtcaggccagaattcttgatggttgccaagtcaggaggcagacggtgaaggaatgcattctggttatgaaaaatggcaatgacgagtaagttgcagagtaaagatgccttttagaggaaattaaggtttgcaataaatacatgctaatcctctaattttgatgaaagactaaagctcttgttttggtttgcatttcaaagagcaagagcatag

SEQ ID NO: 44225 - DNA, 358 bp, Homo sapiens
tttttttttgagacaaagtctcactctgtcacccaggctggagtgcagtggcacaatcccagcttactgcaacctctgcctcctgggttcaagcgatcctcctgcatcagcctcccgagtagctgggattacaagtgcatgccaacatgcctggctaatttttgtacttttagtagaaacggggtttcaccatgttggccaggctggcttcgaacttctgacctcaagcgatccccctgcctcagcctgccaaagtgctgagattacagatgtgaaccaccgcacccggccaagtattacttttctaaattcaaaaaggttcataggaattgctttaaaaggctacaattggtcgatt

SEQ ID NO: 44226 - DNA, 597 bp, Homo sapiens
tctaaagcagtggttctcaaagcgtgtcatgcattcatatcacctggtcatttgctagaaatgcaagttcataggccccaccccagtcccagtgaatcagaaactctggggctggggcccagcaatctaggttttgacaagccttagaatattcagatgtccaccgaagtttgacagccactgacctagagagctttggaaagggtggccatctacatttttaacaagttcttcccttagtgttatagtttcctgttgctgctataacaattttcacaaatggagtggcttaagacaacacacatgaggccgggcatggtggctcatgcctgtaatcatagcactttgggaggctgaggtggatagactgcttgagctcaggcgttcaagaccagcctgggcagcatggtgaaacctcatctctgcaaaaaaaaaaaacaaaaaaattagccaggcgtggcggtgcacgcttgtagttcagctccttgggggctgaggtaggagggtcacttgaacccaggaggttgaggctgcagtgagctgagatttcaccactgcactccagcagcctgggtgacaaagtgagactctgtttcc

SEQ ID NO: 44227 - DNA, 484 bp, Homo sapiens
aggtccggattccttgaatacagattgcccctccttccagacgtctggccagtggatgcttttggttacgaggccctggctgagagaagggctggctctctgctatccatccccctggtggagggccaggcccagaggaagtctcagaggtcttagagataggcacctctagatggcaaaaacacgactgcagaagggcagaggagcggcctcaggaaaaacccagggggatatatgatcttgaacgtacatggtgtcgaaactgcggcccttggctttcccatgtgtgaaatgcgactaagactaatgaaagtcttttatgtgtgtaggcaaaaatcttatttagcaattcctctaccaggtgcaatttttttttttttttttttgagatggagtcttgctctgtcactccagcatgggcaacaagaacgaaactccgtctcaaaaaaaccaaacaaaacaaaagaacagagccgtgattcta

SEQ ID NO: 44228 - DNA, 407 bp, Homo sapiens
ccagtggatgcttttggttacgaggccctggctgagagaagggctggctctctgctatccatccccctggtggagggccaggcccagaggaagtctcagaggtcttagagataggcacctctagatggcaaaaacacgactgcagaagggcagaggagcggcctcaggaaaaacccagggggatatatgatcttgaacgtacatggtgtcgaaactgcggcccttggctttcccatgtgtgaaatgcgactaagactaatgaaagtcttttatgtgtgtaggcaaaaatcttatttagcaattcctctaccaggtgcaatttttttttttttttttttgagatggagtcttgctctgtcactccaggctggagtgcagtggcacgatctcagctcagtgcaagctcc

SEQ ID NO: 44229 - DNA, 407 bp, Homo sapiens
cggctgcatcacatactgtcattggactccaccgggatttgtttaaatattcttctatggttgaacattaagattattacagtttttttgttactacaaataatgctgttattaatatccttatgtccaaatctttgtgccctttattatttacttagactggattcctagaagtagaggtgttgggtcaaggggtctggaagttttgaaggcccttgattcatatttccaacttactttctaggaagttcatattaaattatccccatttccaccagcagtgtatgacactgcctacttcaccacatggtacctaacagtggacattgtgttaaacaagagagagaatggtatctaatcagtgaccttgctaaaagtcaatctgattgtaaacccccagagcccac

SEQ ID NO: 44230 - DNA, 4067 bp, Homo sapiens
  misc_feature (222)..(222): n is a, c, g, or t
  misc_feature (243)..(243): n is a, c, g, or t
  misc_feature (437)..(438): n is a, c, g, or t
  misc_feature (447)..(447): n is a, c, g, or t
atgacagcctccgtgctcctccacccccgctggatcgagcccaccgtcatgtttctctacgacaacggcggcggcctggtggccgacgagctcaacaagaacatggaaggggcggcggcggctgcagcagcggctgcagcggcggcggctgccggggccgggggcgggggcttcccccacccggcggctgcggcggcagggggcaacttctcggtggcggcngcggccgcggctgcggcggcngccgcggccaaccagtgccgcaacctgatggcgcacccggcgcccttggcgccaggagccgcgtccgcctacagcagcgcccccggggaggcgcccccgtcggctgccgccgctgctgccgcggctgccgctgcagccgccgccgccgccgccgcgtcgtcctcgggaggtcccggcccggcgggcccggcggnngcagaggcngccaagcaatgcagcccctgctcggcagcggcgcagagctcgtcggggcccgcggcgctgccctatggctacttcggcagcggctactacccgtgcgcccgcatgggcccgcaccccaacgccatcaagtcgtgcgcgcagcccgcctcggccgccgccgccgccgccttcgcggacaagtacatggataccgccggcccagctgccgaggagttcagctcccgcgctaaggagttcgccttctaccaccagggctacgcagccgggccttaccaccaccatcagcccatgcctggctacctggatatgccagtggtgccgggcctcgggggccccggcgagtcgcgccacgaacccttgggtcttcccatggaaagctaccagccctgggcgctgcccaacggctggaacggccaaatgtactgccccaaagagcaggcgcagcctccccacctctggaagtccactctgcccgacgtggtctcccatccctcggatgccagctcctataggagggggagaaagaagcgcgtgccttataccaaggtgcaattaaaagaacttgaacgggaatacgccacgaataaattcattactaaggacaaacggaggcggatatcagccacgacgaatctctctgagcggcaggtcacaatctggttccagaacaggagggttaaagagaaaaaagtcatcaacaaactgaaaaccactagttaatggattaaaaatagagcaagaaggcaacttgaagaaacgcttcagaactcgttgctttgcccagataatgataataatgcttaataataattgaagaatgggaaagagaaagagacagagactggcattttcctctcccgaaggagatctctttctctttaatggaatctacaactgttttaaaactttaagaaaggtaaagactgccagttcttccgccaaccccatcagcccagcccgttaaatgtcaaacgtcaacccccaaaatacgcaatttcagataagttacgcagttactgaaatcttgtaagtatttaagtgatcgttacattttaggacactgcgttagatggtaataatctggaagttggttacaaacgcaagaggccattgtaaacatctgcttgtccttcttaggtcgccattccctttgcatgttaagcgtctgctcaggtaaatcttagtgaaattcctaccgttgttgtacgttctgcaaaacattttatgtatagatttagaggggaaacgagaaggtactgaaataatgatcttggaatatttgctgtgaagggagaaagggagagaaaactcttctgaggatcatttgtcttggtagtatagtaaaaccaaccagctgaacctttcaggctacaagagaacccgggtcggtaatgtctttttaagaataatttttaattgcttataacaagcatattttgtggcatttgaactatatttactgctccaatatccgttattttccaaaggattttgtatctttttgaaaatgtttacatcatcagatgatccacagaattcactttatgtgagatctcccgagagtttccatcccaacataatggactttggtttgaacacaattcgttttttcatttgaattggcatttcccaatatttgctaaacatttgctggagaaatcatttttcttttttcttttttagaaaactcagaatgaaaattcattcccctgaaatatttaggtgtctatattctatattttgatctattaagggattagtatttttccatgtttattgtgttatcagagtgcattagaaagattagtgattcatcttcacagcacatttttaatcaagcagttatttcaaccagcacattcgttttgttcatattcactatagaatgatatcttgtaaataaagacattcagcacactgtgaaaatgtatttgtgcacctgctttttaaatatttctactaaaaatgaaaaaaaaaaacccttagacctgtagatagtgatatcgtaatattaattgttaataaaatagtcactgccattaaaatctgcagaaaatactctttactttcctatgctaaatgtgcactgcacagaaagaaaaggagcaggtttatcttatataaaccaaggaccattctttattattattcagtacttcttttgctaccaaatttttaagaaaagggagaaatccctcataactaaaatcctaaaaaatgataagtgcttcaaggagattaaagtgtcaggtattacaaaagggagagaaaagaaaggaggaagagatagtatgaattcccaggctccctgtggaaaatgaaaaccagttgttttgtagcagcaatgcctaggctgtcgtattttaaaatctgctgttgggtctgcatgtgtctgagagggcaggttttgatatttgttgaaatgacaggactacgaaaggccttaaaccttgaccttgacgaaaaaaaagacaatttgtgaccttgacttttgacagctcatgaattggccttagctggattagtagatcaagggcgccacctcgcgttgacaagcctccttgtaattcttcaaccaagggaatcaagagctcttacctccttgactttagagattcagtactcaattatttggctccagctggagcaaatttgaatatatgtaaattatacatgtccctgtatatatgtaaatatatataatatgtgtacacatgtatacatttgcatattagtgcttgtgtgtgcttgtatatatatttgtagaatctgtacagatatcatatcattaattgctaatgacgcaagatattgtaatttaaggtgatttctagaattgaggtacaaaatgtactttacaagatgaagccttgttccttttctctaatggccaaatttgatttgtcttcacagtggcttgctctgcatcagatttctgcagatctgctttaaagctgtacatttttgttacagtctaagatgtgttcttaaatcaccattccttcctggtcctcaccctccagggtggtctcacactgtaattagagctattgaggagtctttacagcaaattaagattcagatgccttgctaagtctagagttctagagttatgtttcagaaagtctaagaaacccacctcttgagaggtcagtaaagaggacttaatatttcatatctacaaaatgaccacaggattggatacagaacgagagttatcctggataactcagagctgagtactgctccagggtggtgtgcaatcttatattgatgcttgtgaatctgccatttgatttgtaggataaataaatatgtttaatattaacaacttccatcaaaactataataataatattatatctactgttgacctctaacaacaatcaggtgctgtattcagagtcataaagaatacatatgtatgtttgtatatttaatatacacataggataatgtgtttttgtcaaatctatgctatgcgcatatgtattaaaatgttggtggaatcagtagccgtgggatgcagaattgtgagatgcaggctaattttatctttacgttagaggaaagtaatagtgaatggaagaaccagattcatcattttatggaaaataata

SEQ ID NO: 44231 - DNA, 1149 bp, Homo sapiens
  misc_feature (222)..(222): n is a, c, g, or t
  misc_feature (243)..(243): n is a, c, g, or t
  misc_feature (437)..(438): n is a, c, g, or t
  misc_feature (447)..(447): n is a, c, g, or t
atgacagcctccgtgctcctccacccccgctggatcgagcccaccgtcatgtttctctacgacaacggcggcggcctggtggccgacgagctcaacaagaacatggaaggggcggcggcggctgcagcagcggctgcagcggcggcggctgccggggccgggggcgggggcttcccccacccggcggctgcggcggcagggggcaacttctcggtggcggcngcggccgcggctgcggcggcngccgcggccaaccagtgccgcaacctgatggcgcacccggcgcccttggcgccaggagccgcgtccgcctacagcagcgcccccggggaggcgcccccgtcggctgccgccgctgctgccgcggctgccgctgcagccgccgccgccgccgccgcgtcgtcctcgggaggtcccggcccggcgggcccggcggnngcagaggcngccaagcaatgcagcccctgctcggcagcggcgcagagctcgtcggggcccgcggcgctgccctatggctacttcggcagcggctactacccgtgcgcccgcatgggcccgcaccccaacgccatcaagtcgtgcgcgcagcccgcctcggccgccgccgccgccgccttcgcggacaagtacatggataccgccggcccagctgccgaggagttcagctcccgcgctaaggagttcgccttctaccaccagggatatatagcagaaacaatgatctgtgaatgggtcccatcgcagaactgcctggaagggtgtgtaggggaggagggctggatggggtgatggctcttctcaagcctggaatgtgagccaacatgagcactgagtggaaatggagctgccctaggaagcagttggagctttgtggcgtgggggcttcctgtgagctacggctgtagagaccgagacccaaggaccagagccaaccttcgggttgggccacccccttttgtcttctttatctcagacacactctgctgggaaacctgtttgggccaaagctgcatggggaatggaaggcagacactgagaactagggcttcgcccttcaaagtctcccccaccccatttgttcccatgctataggaaaaagaagtctaataattggcaacaataaaaataaaaatagttattaaaggaagt

SEQ ID NO: 44232 - DNA, 3728 bp, Homo sapiens
  misc_feature (222)..(222): n is a, c, g, or t
  misc_feature (243)..(243): n is a, c, g, or t
  misc_feature (437)..(438): n is a, c, g, or t
  misc_feature (447)..(447): n is a, c, g, or t
  misc_feature (3588)..(3588): n is a, c, g, or t
atgacagcctccgtgctcctccacccccgctggatcgagcccaccgtcatgtttctctacgacaacggcggcggcctggtggccgacgagctcaacaagaacatggaaggggcggcggcggctgcagcagcggctgcagcggcggcggctgccggggccgggggcgggggcttcccccacccggcggctgcggcggcagggggcaacttctcggtggcggcngcggccgcggctgcggcggcngccgcggccaaccagtgccgcaacctgatggcgcacccggcgcccttggcgccaggagccgcgtccgcctacagcagcgcccccggggaggcgcccccgtcggctgccgccgctgctgccgcggctgccgctgcagccgccgccgccgccgccgcgtcgtcctcgggaggtcccggcccggcgggcccggcggnngcagaggcngccaagcaatgcagcccctgctcggcagcggcgcagagctcgtcggggcccgcggcgctgccctatggctacttcggcagcggctactacccgtgcgcccgcatgggcccgcaccccaacgccatcaagtcgtgcgcgcagcccgcctcggccgccgccgccgccgccttcgcggacaagtacatggataccgccggcccagctgccgaggagttcagctcccgcgctaaggagttcgccttctaccaccagggctacgcagccgggccttaccaccaccatcagcccatgcctggctacctggatatgccagtggtgccgggcctcgggggccccggcgagtcgcgccacgaacccttgggtcttcccatggaaagctaccagccctgggcgctgcccaacggctggaacggccaaatgtactgccccaaagagcaggcgcagcctccccacctctggaagtccactctgcccgacgtggtctcccatccctcggatgccagctcctataggagggggagaaagaagcgcgtgccttataccaaggtgcaattaaaagaacttgaacgggaatacgccacgaataaattcattactaaggacaaacggaggcggatatcagccacgacgaatctctctgagcggcaggtcacaatctggttccagaacaggagggttaaagagaaaaaagtcatcaacaaactgaaaaccactagttaatggattaaaaatagagcaagaaggcaacttgaagaaacgcttcagaactcgttgctttgcccagataatgataataatgcttaataataattgaagaatgggaaagagaaagagacagagactggcattttcctctcccgaaggagatctctttctctttaatggaatctacaactgttttaaaactttaagaaaggtaaagactgccagttcttccgccaaccccatcagcccagcccgttaaatgtcaaacgtcaacccccaaaatacgcaatttcagataagttacgcagttactgaaatcttgtaagtatttaagtgatcgttacattttaggacactgcgttagatggtaataatctggaagttggttacaaacgcaagaggccattgtaaacatctgcttgtccttcttaggtcgccattccctttgcatgttaagcgtctgctcaggtaaatcttagtgaaattcctaccgttgttgtacgttctgcaaaacattttatgtatagatttagaggggaaacgagaaggtactgaaataatgatcttggaatatttgctgtgaagggagaaagggagagaaaactcttctgaggatcatttgtcttggtagtatagtaaaaccaaccagctgaacctttcaggctacaagagaacccgggtcggtaatgtctttttaagaataatttttaattgcttataacaagcatattttgtggcatttgaactatatttactgctccaatatccgttattttccaaaggattttgtatctttttgaaaatgtttacatcatcagatgatccacagaattcactttatgtgagatctcccgagagtttccatcccaacataatggactttggtttgaacacaattcgttttttcatttgaattggcatttcccaatatttgctaaacatttgctggagaaatcatttttcttttttcttttttagaaaactcagaatgaaaattcattcccctgaaatatttaggtgtctatattctatattttgatctattaagggattagtatttttccatgtttattgtgttatcagagtgcattagaaagattagtgattcatcttcacagcacatttttaatcaagcagttatttcaaccagcacattcgttttgttcatattcactatagaatgatatcttgtaaataaagacattcagcacactgtgaaaatgtatttgtgcacctgctttttaaatatttctactaaaaatgaaaaaaaaaaacccttagacctgtagatagtgatatcgtaatattaattgttaataaaatagtcactgccattaaaatctgcagaaaatactctttactttcctatgctaaatgtgcactgcacagaaagaaaaggagcaggtttatcttatataaaccaaggaccattctttattattattcagtacttcttttgctaccaaatttttaagaaaagggagaaatccctcataactaaaatcctaaaaaatgataagtgcttcaaggagattaaagtgtcaggtattacaaaagggagagaaaagaaaggaggaagagatagtatgaattcccaggctccctgtggaaaatgaaaaccagttgttttgtagcagcaatgcctaggctgtcgtattttaaaatctgctgttgggtctgcatgtgtctgagagggcaggttttgatatttgttgaaatgacaggactacgaaaggccttaaaccttgaccttgacgaaaaaaaagacaatttgtgaccttgacttttgacagctcatgaattggccttagctggattagtagatcaagggcgccacctcgcgttgacaagcctccttgtaattcttcaaccaagggaatcaagagctcttacctccttgactttagagattcagtactcaattatttggctccagctggagcaaatttgaatatatgtaaattatacatgtccctgtatatatgtaaatatatataatatgtgtacacatgtagagaagaacagaacaagaatatacatacaaggacaacatagacatataacataataaataagagagacatatataaagcactccataacagatatgcagaaactcacctcctaggttgagaccaagaattggcaaatttgcatgagctcctggaaagagttgctgactttgtatctaagacctgccagggaataccaagagttgtttctacagactttttttggtttgggacgaacgatactgtgcgcaacccaggacggacactggaaaaaaaaggttgctttctctctacagcaaaatttattgtgaggaaagctcctccaaatcctcgaggctattataaggtcacaaaatcaagtgcctagggacaaatcccaaagggcatgacttcggggagctatctggtactacctggaaggtcnctgacacaatgatttcccattaatgacgcaggtctccaggtatataaaaccccatggtttgtcacccaattgggcactaaaggtcctccggggaatgtttacggtaaccactgaaaggtttttattaagaccctttcaac

SEQ ID NO: 44233 - DNA, 1293 bp, Homo sapiens
gagaaacctcataaatgtactgaatgtgggaagtctttcaatgagaagtcaaccctcattgtgcatcaaagaactcatacaggagagaaaccctatgaatgtgatgtgtgtggaaaaaccttcacgcaaaagtcaaaccttggtgtacatcagagaactcattcaggagagaaaccctttgaatgtaatgaatgtgagaaagccttctctcagaagtcctacctcatgctgcatcagagaggtcatacaggagagaaaccttacgagtgcaatgaatgtgaaaaagcattttcacagaaatcatatctcattatacatcaaagaactcatacagaagaaaaaccctataaatgtaatgaatgtggcaaagcttcagagaaaagtcaaagcctcattatacatcagagaattcatacaggagagaaaccttatgaatgtcctgtgtgttggaaagcttttagccagaagtcacagctcataatacatcagagaacgcacacgggagagaaaccctatgcatgcactgagtgtggcaaagccttccgagaaaagtcaacattcactgtacatcaaagaactcatactggagagaaaccctataaatgtacagaatgtgggaaagcctttacccaaaaatcaaaccttattgtacatcagcgaacccatgcaggaaagaaagcccatggaagaggccacactcggaagtcaaagttcatggcacattagagagctaatcagcagtatctattatggacactgaaagaaagttgtgtcaattttactcacattttaaaagtatattttgacttgtggtttaaatatgggagtaaattcagcctttcttcttttcatctcagtcataacccaaaagctacgggagaaaaagcagaagtgtaatctctgtatctgacaaaattaggagacagctgcaaccctaatgagagggctgccacaggcagaggaaatgaagcactggtgcaggagatttcagagtgagagtgctcaaggctgcaggtgcaagacagcactggtaaggactcttagctgaggttcgggatataccccgaggcgcggaaccatagatataacagtggtaacagtgctgtcttgcacaggcagaggaaatgaagcactggtgcaggagatttcagagtgagagtgccagaggatgattttgtaaataaggacagtctatctcagcataacctactacttgtcgatattctcatatctgtttcacggtatgcctaacaatagtaatctcgttttctgatggacgcaacgttggaccgc

SEQ ID NO: 44234 - DNA, 2053 bp, Homo sapiens
gagaaacctcataaatgtactgaatgtgggaagtctttcaatgagaagtcaaccctcattgtgcatcaaagaactcatacaggagagaaaccctatgaatgtgatgtgtgtggaaaaaccttcacgcaaaagtcaaaccttggtgtacatcagagaactcattcaggagagaaaccctttgaatgtaatgaatgtgagaaagccttctctcagaagtcctacctcatgctgcatcagagaggtcatacaggagagaaaccttacgagtgcaatgaatgtgaaaaagcattttcacagaaatcatatctcattatacatcaaagaactcatacagaagaaaaaccctataaatgtaatgaatgtggcaaagcttcagagaaaagtcaaagcctcattatacatcagagaattcatacaggagagaaaccttatgaatgtcctgtgtgttggaaagcttttagccagaagtcacagctcataatacatcagagaacgcacacgggagagaaaccctatgcatgcactgagtgtggcaaagccttccgagaaaagtcaacattcactgtacatcaaagaactcatactggagagaaaccctataaatgtacagaatgtgggaaagcctttacccaaaaatcaaaccttattgtacatcagcgaacccatgcaggaaagaaagcccatggaagaggccacactcggaagtcaaagttcatggcacattagagagctaatcagcagtatctattatggacactgaaagaaagttgtgtcaattttactcacattttaaaagtatattttgacttgtggtttaaatatgggagtaaattcagcctttcttcttttcatctcagtcataacccaaaagctacgggagaaaaagcagaagtgtaatctctgtatctgacaaaattaggagacagctgcaaccctaatgagagggctgccacaggcagaggaaatgaagcactggtgcaggagatttcagagtgagagtgctcaaggctgcaggtgcaagacagcactggtaaggactcttagctgaggttcgggatataccccgaggcgcggaaccatagatataacagtggtaacagtgcgtgggcaggtaggaggtaggatgtttcctagaccatttggggtctgaggagaaacaggctggggcctcgagaaggagtcactcagacaagccatatttttagaaagtagtctactgatgggagcaacagttatggcatgctgggggaagagaagggacttttccttgtgaagagccctacagctgcccctatttactgacttgggagaagtaaagtcagaaagaacgaacagctgtggggggaaaaaattctcagttgtcaaaaaaaaaaaaaactgatctgcttagaatgtggccctggtttcttttcccacatgaacctccagcaaatagcaagtccaggaaaaactcttctcattcaaagaggaattattcaaaagtaatcaaaaccacaaatgcatttggtttttgggccagcaattccacttctaggaatgtacatactcacacatgtacaaaatgatgaacatacagaagtattcattaatgcagcgtttgtgaaaacaaaagattggaagctgtttaaatgacaccatatcagggttctggttccctaaattgtggtatattcatacagcctactcctgggtagacaacaatgaataaataaggagaacttggaaaccatttatgtagtgatgtgggataaccttcagtttatgttattaggtaggaaaaataaggttgaggacagtgactgccatttgtatataaaaaggagaaaaatggtaagtacataattgtgaattcataagttatctctggaaagagacatgagaacctggtaaccctgattaccttgggaggggaaggggcagtggtggctggggggatggaattgagagggagacaactgtatcctttcatagcttttgaaaatgtgggtgtactatgtactatgtggatgtactaccttttcaaaaataaaacatttaaaaagctaaaatgttt

SEQ ID NO: 44235 - DNA, 2733 bp, Homo sapiens
ggcacgagggtggtgcacgcctatagtctcagctactcaggaagttgaggcaggaggatcgcttgagcccaggagtttgatgctgcagtgagctatgattgtgctaccactgtactccagactggacaaaagattcctgtgccttaagaacattagaaccttcctgtccacctgctgtgagaagttcggcctcaagcggagcgagctcttcgaagcctttgacctcttcgatgtgcaggattttggcaaggtcatctacaccctgtctgctctgtcctggaccccgatcgcccagaacagggggatcatgcccttccccaccgaggaggagagtgtaggtgatgaagacatctacagtggcctgtccgaccagatcgacgacacggtggaggaggatgaggacctgtatgactgcgtggagaatgaggaggcggaaggcgacgagatctatgaggacctcatgcgctcggagcccgtgtccatgccgcccaagatgacagagtatgacaagcgctgctgctgcctgcgggagatccagcagacggaggagaagtacactgacacgctgggctccatccagcagcatttcttgaagcccctgcaacggttcctgaaacctcaagacattgagatcatctttatcaacattgaggacctgcttcgtgttcatactcacttcctaaaggagatgaaggaagccctgggcacccctggcgcagccaatctctaccaggtcttcatcaaatacaaggagaggttcctcgtctatggccgctactgcagccaggtggagtcagccagcaaacacctggaccgtgtggccgcagcccgggaggacgtgcagatgaagctggaggaatgttctcagagagccaacaacgggaggttcaccctgcgggacctgctgatggtgcctatgcagcgagttctcaaatatcacctccttctccaggagctggtgaaacacacgcaggaggcgatggagaaggagaacctgcggctggccctggatgccatgagggacctggctcagtgcgtgaacgaggtcaagcgagacaacgagacactgcgacagatcaccaatttccagctgtccattgagaacctggaccagtctctggctcactatggccggcccaagatcgacggggaactcaagatcacctcggtggaacggcgctccaagatggacaggtatgccttcctgctcgacaaagctctactcatctgtaagcgcaggggagactcctatgacctcaaggactttgtaaacctgcacagcttccaggttcgggatgactcttcaggagaccgagacaacaagaagtggagccacatgttcctcctgatcgaggaccaaggtgcccagggctatgagctgttcttcaagacaagagaattgaagaagaagtggatggagcagtttgagatggccatctccaacatctatccggagaatgccaccgccaacgggcatgacttccagatgttctcctttgaggagaccacatcctgcaaggcctgtcagatgctgcttagaggtaccttctatcagggctaccgctgccatcggtgccgggcatctgcacacaaggagtgtctggggagggtccctccatgtggccgacatgggcaagatttcccaggaactatgaagaaggacaaactacatcgcagggctcaggacaaaaagaggaatgagctgggtctgcccaagatggaggtgtttcaggaatactacgggcttcctccaccccctggagccattggaccctttctacggctcaaccctggagacattgtggagctcacgaaggctgaggctgaacagaactggtgggagggcagaaatacatctactaatgaaattggctggtttccttgtaacagggtgaagccctatgtccatggccctcctcaggacctgtctgttcatctctggtacgcaggccccatggagcgggcaggggcagagagcatcctggccaaccgctcggacgggactttcttggtgcggcagagggtgaaggatgcagcagaatttgccatcagcattaaatataacgtcgaggtcaagcacattaaaatcatgacagcagaaggactgtaccggatcacagagaaaaaggctttccgggggcttacggagctggtggagttttaccagcagaactctctaaaggattgcttcaagtctctggacaccaccttgcagttccccttcaaggagcctgaaaagagaaccatcagcaggccagcagtgggaagcacaaagtattttggcacagccaaagcccgctatgacttctgcgcccgagaccgatcagagctgtcgctcaaggagggtgacatcatcaagatccttaacaagaagggacagcaaggctggtggcgaggggagatctatggccgggttggctggttccctgccaactacgtggaggaagattattctgaatactgctgagccctggtgccttggcagagagacgagaaactccaggctctgagcccggcgtgggcaggcagcggagccaggggctgtgacagctcccggcgggtggagactttgggatggactggaggaggccagcgtccagctggcggtgctcccgggatgtgccctgacatggttaatttataacaccccgatttcctcttgggtcccctcaagcagacggggctcaagggggttacatttaataaaaggatgaagatggatagaaaaaaagg

SEQ ID NO: 44236 - DNA, 2899 bp, Homo sapiens
actagctgtcgctccacaggcgagcagggcaggcgtgcgggcgggtgggtggtggaggctgcgagggtgcacggccggccctgggcaggcggtagccatggagctgtggcgccaatgcacccactggctcatccagtgccgggtgctgccgcccagccaccgcgtgacctgggatggggctcaggtgtgtgaactggcccaggccctccgggatggtgtccttctgtgtcagctgcttaacaacctgctaccccatgccatcaacctgcgtgaggtcaacctgcgcccccagatgtcccttcctgtgccttaagaacattagaaccttcctgtccacctgctgtgagaagttcggcctcaagcggagcgagctcttcgaagcctttgacctcttcgatgtgcaggattttggcaaggtcatctacaccctgtctgctctgtcctggaccccgatcgcccagaacagggggatcatgcccttccccaccgaggaggagagtgtaggtgatgaagacatctacagtggcctgtccgaccagatcgacgacacggtggaggaggatgaggacctgtatgactgcgtggagaatgaggaggcggaaggcgacgagatctatgaggacctcatgcgctcggagcccgtgtccatgccgcccaagatgacagagtatgacaagcgctgctgctgcctgcgggagatccagcagacggaggagaagtacactgacacgctgggctccatccagcagcatttcttgaagcccctgcaacggttcctgaaacctcaagacattgagatcatctttatcaacattgaggacctgcttcgtgttcatactcacttcctaaaggagatgaaggaagccctgggcacccctggcgcagccaatctctaccaggtcttcatcaaatacaaggagaggttcctcgtctatggccgctactgcagccaggtggagtcagccagcaaacacctggaccgtgtggccgcagcccgggaggacgtgcagatgaagctggaggaatgttctcagagagccaacaacgggaggttcaccctgcgggacctgctgatggtgcctatgcagcgagttctcaaatatcacctccttctccaggagctggtgaaacacacgcaggaggcgatggagaaggagaacctgcggctggccctggatgccatgagggacctggctcagtgcgtgaacgaggtcaagcgagacaacgagacactgcgacagatcaccaatttccagctgtccattgagaacctggaccagtctctggctcactatggccggcccaagatcgacggggaactcaagatcacctcggtggaacggcgctccaagatggacaggtatgccttcctgctcgacaaagctctactcatctgtaagcgcaggggagactcctatgacctcaaggactttgtaaacctgcacagcttccaggttcgggatgactcttcaggagaccgagacaacaagaagtggagccacatgttcctcctgatcgaggaccaaggtgcccagggctatgagctgttcttcaagacaagagaattgaagaagaagtggatggagcagtttgagatggccatctccaacatctatccggagaatgccaccgccaacgggcatgacttccagatgttctcctttgaggagaccacatcctgcaaggcctgtcagatgctgcttagaggtaccttctatcagggctaccgctgccatcggtgccgggcatctgcacacaaggagtgtctggggagggtccctccatgtggccgacatgggcaagatttcccaggaactatgaagaaggacaaactacatcgcagggctcaggacaaaaagaggaatgagctgggtctgcccaagatggaggtgtttcaggaatactacgggcttcctccaccccctggagccattggaccctttctacggctcaaccctggagacattgtggagctcacgaaggctgaggctgaacagaactggtgggagggcagaaatacatctactaatgaaattggctggtttccttgtaacagggtgaagccctatgtccatggccctcctcaggacctgtctgttcatctctggtacgcaggccccatggagcgggcaggggcagagagcatcctggccaaccgctcggacgggactttcttggtgcggcagagggtgaaggatgcagcagaatttgccatcagcattaaatataacgtcgaggtcaagcacattaaaatcatgacagcagaaggactgtaccggatcacagagaaaaaggctttccgggggcttacggagctggtggagttttaccagcagaactctctaaaggattgcttcaagtctctggacaccaccttgcagttccccttcaaggagcctgaaaagagaaccatcagcaggccagcagtgggaagcacaaagtattttggcacagccaaagcccgctatgacttctgcgcccgagaccgatcagagctgtcgctcaaggagggtgacatcatcaagatccttaacaagaagggacagcaaggctggtggcgaggggagatctatggccgggttggctggttccctgccaactacgtggaggaagattattctgaatactgctgagccctggtgccttggcagagagacgagaaactccaggctctgagcccggcgtgggcaggcagcggagccaggggctgtgacagctcccggcgggtggagactttgggatggactggaggaggccagcgtccagctggcggtgctcccgggatgtgccctgacatggttaatttataacaccccgatttcctcttgggtcccctcaagcagacggggctcaagggggttacatttaataaaaggatgaagatggatagaaaaaaagg

SEQ ID NO: 44237 - DNA, 738 bp, Homo sapiens
tgttttacttattgtcatttaccttgatgactaggttttttggctctcacttacattttgcacctgaggctcgtgactcattctccttcccctacttctgtccgggtgaccacagagatgggcacacagtgagccttcaggaaatgcctggtgaagccatcgccaaattccagacacccagccagacccaaagggctgagccatccccccgaatccatgtgtcaaaccttagtggtgacctgtagaagtggaagcccgctccccatgtctgggctccggcccctgcctccacggggcctaccttggtgctgaagggctgttagagccaggctgtcaccaacttaaaaaatcaaaggggttcagggggaaaggcaacctccatatggcaatatggggacccaggcacggggacgccctcctcaggacctgtctgttcatctctggtacgcaggccccatggagcgggcaggggcagagagcatcctggccaaccgctcggacgggactttcttggtgcggcagagggtgaaggatgcagcagaatttgccatcagcattaagtaactcctttctccctgactcatacccttttggggcctgggccctgcgggcctgggaaaaagggtatccaggttttactttatagaagtgtacggtaatagcatccaccttttactgagcccctgctggttcccacgtgcctttcaccttctttatttcttttaattgacgaccaca

SEQ ID NO: 44238 - DNA, 305 bp, Homo sapiens
cagttttgctctttacacgcccagtacttttgtttagggaagataagattgccattgtctgcccaagatggaggtgtttcaggaatactacgggcttcctccaccccctggagccattggaccctttctacggctcaaccctggagacattgtggagctcacgaaggctgaggctgaacagaactggtgggagggcagaaatacatctactaatgaaattggctggtttccttgtaacagggtgaagccctatgtccatggccctcctcaggacctgtctgttcatctctgtacgcaggccccat

SEQ ID NO: 44239 - DNA, 214 bp, Homo sapiens
gttctgccgtgggggtgtacaaggggctcactgagtggccactgccccgtcacaggtcatctacaccctgtctgctctgtcctggaccccgatcgcccagaacagggggatcatgtgagtaaccacctgggccttgggccatttagccccagtcctccccctccctgaagccccacgataaggtggcccacgcataaggtgtaacgatctctag

SEQ ID NO: 44240 - DNA, 2803 bp, Homo sapiens
actagctgtcgctccacaggcgagcagggcaggcgtgcgggcgggtgggtggtggaggctgcgagggtgcacggccggccctgggcaggcggtagccatggagctgtggcgccaatgcacccactggctcatccagtgccgggtgctgccgcccagccaccgcgtgacctgggatggggctcaggtgtgtgaactggcccaggccctccgggatggtgtccttctgtgtcagctgcttaacaacctgctaccccatgccatcaacctgcgtgaggtcaacctgcgcccccagatgtcccttcctgtgccttaagaacattagaaccttcctgtccacctgctgtgagaagttcggcctcaagcggagcgagctcttcgaagcctttgacctcttcgatgtgcaggattttggcaaggtcatctacaccctgtctgctctgtcctggaccccgatcgcccagaacagggggatcatgcccttccccaccgaggaggagagtgtaggtgatgaagacatctacagtggcctgtccgaccagatcgacgacacggtggaggaggatgaggacctgtatgactgcgtggagaatgaggaggcggaaggcgacgagatctatgaggacctcatgcgctcggagcccgtgtccatgccgcatttcttgaagcccctgcaacggttcctgaaacctcaagacattgagatcatctttatcaacattgaggacctgcttcgtgttcatactcacttcctaaaggagatgaaggaagccctgggcacccctggcgcagccaatctctaccaggtcttcatcaaatacaaggagaggttcctcgtctatggccgctactgcagccaggtggagtcagccagcaaacacctggaccgtgtggccgcagcccgggaggacgtgcagatgaagctggaggaatgttctcagagagccaacaacgggaggttcaccctgcgggacctgctgatggtgcctatgcagcgagttctcaaatatcacctccttctccaggagctggtgaaacacacgcaggaggcgatggagaaggagaacctgcggctggccctggatgccatgagggacctggctcagtgcgtgaacgaggtcaagcgagacaacgagacactgcgacagatcaccaatttccagctgtccattgagaacctggaccagtctctggctcactatggccggcccaagatcgacggggaactcaagatcacctcggtggaacggcgctccaagatggacaggtatgccttcctgctcgacaaagctctactcatctgtaagcgcaggggagactcctatgacctcaaggactttgtaaacctgcacagcttccaggttcgggatgactcttcaggagaccgagacaacaagaagtggagccacatgttcctcctgatcgaggaccaaggtgcccagggctatgagctgttcttcaagacaagagaattgaagaagaagtggatggagcagtttgagatggccatctccaacatctatccggagaatgccaccgccaacgggcatgacttccagatgttctcctttgaggagaccacatcctgcaaggcctgtcagatgctgcttagaggtaccttctatcagggctaccgctgccatcggtgccgggcatctgcacacaaggagtgtctggggagggtccctccatgtggccgacatgggcaagatttcccaggaactatgaagaaggacaaactacatcgcagggctcaggacaaaaagaggaatgagctgggtctgcccaagatggaggtgtttcaggaatactacgggcttcctccaccccctggagccattggaccctttctacggctcaaccctggagacattgtggagctcacgaaggctgaggctgaacagaactggtgggagggcagaaatacatctactaatgaaattggctggtttccttgtaacagggtgaagccctatgtccatggccctcctcaggacctgtctgttcatctctggtacgcaggccccatggagcgggcaggggcagagagcatcctggccaaccgctcggacgggactttcttggtgcggcagagggtgaaggatgcagcagaatttgccatcagcattaaatataacgtcgaggtcaagcacattaaaatcatgacagcagaaggactgtaccggatcacagagaaaaaggctttccgggggcttacggagctggtggagttttaccagcagaactctctaaaggattgcttcaagtctctggacaccaccttgcagttccccttcaaggagcctgaaaagagaaccatcagcaggccagcagtgggaagcacaaagtattttggcacagccaaagcccgctatgacttctgcgcccgagaccgatcagagctgtcgctcaaggagggtgacatcatcaagatccttaacaagaagggacagcaaggctggtggcgaggggagatctatggccgggttggctggttccctgccaactacgtggaggaagattattctgaatactgctgagccctggtgccttggcagagagacgagaaactccaggctctgagcccggcgtgggcaggcagcggagccaggggctgtgacagctcccggcgggtggagactttgggatggactggaggaggccagcgtccagctggcggtgctcccgggatgtgccctgacatggttaatttataacaccccgatttcctcttgggtcccctcaagcagacggggctcaagggggttacatttaataaaaggatgaagatggatagaaaaaaagg

SEQ ID NO: 44241 - DNA, 1350 bp, Homo sapiens
cttcgagaaacctccaaactgctttccgcagtggctgaaccaatttacagtccagcccacagtgtagaggaattcccttctctcacatgctgctgagtttgtaatttcattgttatttttggctcctgtgaatttcccttactttttttttttttgagagctcagcaatttttttctcaacatttctagtgtttttttaaataggaagagttttgtttgtttgtttctttgttttttttttttttttttttgtgatctagtttgccagatgagcaggagtggaggtcttctccaaggccccttttagtctatttccaccatgttgacagaaatgggtctttcctccctcttcctttatatcctatggttgtctatattggtggaaggggaggtctcttcgtatccattctagaacactgccttctttacaagatcttactgacttctcaacaaacctgtgagtcagggaagatgattcctcttctacgagaggaagacattaaggctttagagtagcaaaggccccagggaatgggctctgttgggacagcttgtctttggtttccagtagttactcctccctgaaggggtcaaggttgcttcctccataactggggcttggtggggaatgggcctggtccccagactcagggcccggtgaccatctggttccagatataacgtcgaggtcaagcacattaaaatcatgacagcagaaggactgtaccggatcacagagaaaaaggctttccgggggcttacggagctggtggagttttaccagcagaactctctaaaggattgcttcaagtctctggacaccaccttgcagttccccttcaaggagcctgaaaagagaaccatcagcaggccagcagtgggaagcacaaagtattttggcacagccaaagcccgctatgacttctgcgcccgagaccgatcagagctgtcgctcaaggagggtgacatcatcaagatccttaacaagaagggacagcaaggctggtggcgaggggagatctatggccgggttggctggttccctgccaactacgtggaggaagattattctgaatactgctgagccctggtgccttggcagagagacgagaaactccaggctctgagcccggcgtgggcaggcagcggagccaggggctgtgacagctcccggcgggtggagactttgggatggactggaggaggccagcgtccagctggcggtgctcccgggatgtgccctgacatggttaatttataacaccccgatttcctcttgggtcccctcaagcagacggggctcaagggggttacatttaataaaaggatgaagatggatagaaaaaaagg

SEQ ID NO: 44242 - DNA, 1672 bp, Homo sapiens
ggcacgagggtggtgcacgcctatagtctcagctactcaggaagttgaggcaggaggatcgcttgagcccaggagtttgatgctgcagtgagctatgattgtgctaccactgtactccagactggacaaaagattcctgtgccttaagaacattagaaccttcctgtccacctgctgtgagaagttcggcctcaagcggagcgagctcttcgaagcctttgacctcttcgatgtgcaggattttggcaaggtcatctacaccctgtctgctctgtcctggaccccgatcgcccagaacagggggatcatgcccttccccaccgaggaggagagtgtaggtgatgaagacatctacagtggcctgtccgaccagatcgacgacacggtggaggaggatgaggacctgtatgactgcgtggagaatgaggaggcggaaggcgacgagatctatgaggacctcatgcgctcggagcccgtgtccatgccgcccaagatgacagagtatgacaagcgctgctgctgcctgcgggagatccagcagacggaggagaagtacactgacacgctgggctccatccagcagcatttcttgaagcccctgcaacggttcctgaaacctcaagacattgagatcatctttatcaacattgaggacctgcttcgtgttcatactcacttcctaaaggagatgaaggaagccctgggcacccctggcgcagccaatctctaccaggtcttcatcaaatacaaggagaggttcctcgtctatggccgctactgcagccaggtggagtcagccagcaaacacctggaccgtgtggccgcagcccgggaggacgtgcagatgaagctggaggaatgttctcagagagccaacaacgggaggttcaccctgcgggacctgctgatggtgcctatgcagcgagttctcaaatatcacctccttctccaggagctggtgaaacacacgcaggaggcgatggagaaggagaacctgcggctggccctggatgccatgagggacctggctcagtgcgtgaacgaggtcaagcgagacaacgagacactgcgacagatcaccaatttccagctgtccattgagaacctggaccagtctctggctcactatggccggcccaagatcgacggggaactcaagatcacctcggtggaacggcgctccaagatggacaggtatgccttcctgctcgacaaagctctactcatctgtaagcgcaggggagactcctatgacctcaaggactttgtaaacctgcacagcttccaggttcgggatgactcttcaggagaccgagacaacaagaagtggagccacatgttcctcctgatcgaggaccaaggtgcccagggctatgagctgttcttcaagacaagagaattgaagaagaagtggatggagcagtttgagatggccatctccaacatctatccggagaatgccaccgccaacgggcatgacttccagatgttctcctttgaggagaccacatcctgcaaggcctgtcagatgctgcttagaggtaccttctatcagggctaccgctgccatcggtgccgggcatctgcacacaaggagtgtctggggagggtccctccatgtggccgacatgggcaagatctcccaggaacgtaataagagtcccctcgcaaa

SEQ ID NO: 44243 - DNA, 2157 bp, Homo sapiens
ggcacgagggtggtgcacgcctatagtctcagctactcaggaagttgaggcaggaggatcgcttgagcccaggagtttgatgctgcagtgagctatgattgtgctaccactgtactccagactggacaaaagattcctgtgccttaagaacattagaaccttcctgtccacctgctgtgagaagttcggcctcaagcggagcgagctcttcgaagcctttgacctcttcgatgtgcaggattttggcaaggtcatctacaccctgtctgctctgtcctggaccccgatcgcccagaacagggggatcatgcccttccccaccgaggaggagagtgtaggtgatgaagacatctacagtggcctgtccgaccagatcgacgacacggtggaggaggatgaggacctgtatgactgcgtggagaatgaggaggcggaaggcgacgagatctatgaggacctcatgcgctcggagcccgtgtccatgccgcccaagatgacagagtatgacaagcgctgctgctgcctgcgggagatccagcagacggaggagaagtacactgacacgctgggctccatccagcagcatttcttgaagcccctgcaacggttcctgaaacctcaagacattgagatcatctttatcaacattgaggacctgcttcgtgttcatactcacttcctaaaggagatgaaggaagccctgggcacccctggcgcagccaatctctaccaggtcttcatcaaatacaaggagaggttcctcgtctatggccgctactgcagccaggtggagtcagccagcaaacacctggaccgtgtggccgcagcccgggaggacgtgcagatgaagctggaggaatgttctcagagagccaacaacgggaggttcaccctgcgggacctgctgatggtgcctatgcagcgagttctcaaatatcacctccttctccaggagctggtgaaacacacgcaggaggcgatggagaaggagaacctgcggctggccctggatgccatgagggacctggctcagtgcgtgaacgaggtcaagcgagacaacgagacactgcgacagatcaccaatttccagctgtccattgagaacctggaccagtctctggctcactatggccggcccaagatcgacggggaactcaagatcacctcggtggaacggcgctccaagatggacaggtatgccttcctgctcgacaaagctctactcatctgtaagcgcaggggagactcctatgacctcaaggactttgtaaacctgcacagcttccaggttcgggatgactcttcaggagaccgagacaacaagaagtggagccacatgttcctcctgatcgaggaccaaggtgcccagggctatgagctgttcttcaagacaagagaattgaagaagaagtggatggagcagtttgagatggccatgtgagtccccgtcttcctccctctttctgtccacagaggggcaggggctgggaaggaggaacgtgatctagtccctactctgtcctgacatgccatgggaccactctgaaccacagtctcttcatttgggaaataagagggacaggcccaaggctgtcttcatccttggaatgcaggggttgtgtgcaagcttcagttaccagcccagactcttctcctttcctcctcctctttcttgttctcctctcctcttccttctcctccttctggtttccttcctcctcctcctcctctttctccttctcctttcctcctcctctttcctcctcctccccttcctcttcttcttcctcctcctctccttcctccccttcctcctcctcgccctcctcttcctcttcctcctattcctcctccacctcttcttcctcctcctccctttcctccccttcttcctcctcctcctcctcttcctcctcttctttctcttcctcctccctttcctcctcttcctcttcttccttttcctcctcctccttcttcttcccctcttcctcctcttccacttttgtcttctctttctcctttttatgtgaggcaaaattccaacaacaaaaatctaacaatttcgaagtgtatgatcgcatggcattttgtacactaacagcattgtgcaaccatcaatggccactcaataccgaggatcctcaagaacagcac

SEQ ID NO: 44244 - DNA, 1785 bp, Homo sapiens
tgcggctggccctggatgccatgagggtgagtgggtgtagggtgctggtgactcacctgctgcagacaccctcctggtaggggctgatcctctagccgggattaggtaggagcctgggtcggctgttggggggccaggttcacccctgccccctccccaggacctggctcagtgcgtgaacgaggtcaagcgagacaacgagacactgcgacagatcaccaatttccagctgtccattgagaacctggaccagtctctggctcactatggccggcccaagatcgacggggaactcaagatcacctcggtggaacggcgctccaagatggacagcttccaggttcgggatgactcttcaggagaccgagacaacaagaagtggagccacatgttcctcctgatcgaggaccaaggtgcccagggctatgagctgttcttcaagacaagagaattgaagaagaagtggatggagcagtttgagatggccatctccaacatctatccggagaatgccaccgccaacgggcatgacttccagatgttctcctttgaggagaccacatcctgcaaggcctgtcagatgctgcttagaggtaccttctatcagggctaccgctgccatcggtgccgggcatctgcacacaaggagtgtctggggagggtccctccatgtggccgacatgggcaagatttcccaggaactatgaagaaggacaaactacatcgcagggctcaggacaaaaagaggaatgagctgggtctgcccaagatggaggtgtttcaggaatactacgggcttcctccaccccctggagccattggaccctttctacggctcaaccctggagacattgtggagctcacgaaggctgaggctgaacagaactggtgggagggcagaaatacatctactaatgaaattggctggtttccttgtaacagggtgaagccctatgtccatggccctcctcaggacctgtctgttcatctctggtacgcaggccccatggagcgggcaggggcagagagcatcctggccaaccgctcggacgggactttcttggtgcggcagagggtgaaggatgcagcagaatttgccatcagcattaaatataacgtcgaggtcaagcacattaaaatcatgacagcagaaggactgtaccggatcacagagaaaaaggctttccgggggcttacggagctggtggagttttaccagcagaactctctaaaggattgcttcaagtctctggacaccaccttgcagttccccttcaaggagcctgaaaagagaaccatcagcaggccagcagtgggaagcacaaagtattttggcacagccaaagcccgctatgacttctgcgcccgagaccgatcagagctgtcgctcaaggagggtgacatcatcaagatccttaacaagaagggacagcaaggctggtggcgaggggagatctatggccgggttggctggttccctgccaactacgtggaggaagattattctgaatactgctgagccctggtgccttggcagagagacgagaaactccaggctctgagcccggcgtgggcaggcagcggagccaggggctgtgacagctcccggcgggtggagactttgggatggactggaggaggccagcgtccagctggcggtgctcccgggatgtgccctgacatggttaatttataacaccccgatttcctcttgggtcccctcaagcagacggggctcaagggggttacatttaataaaaggatgaagatggatagaaaaaaagg

SEQ ID NO: 44245 - DNA, 1235 bp, Homo sapiens
tgttttacttattgtcatttaccttgatgactaggttttttggctctcacttacattttgcacctgaggctcgtgactcattctccttcccctacttctgtccgggtgaccacagagatgggcacacagtgagccttcaggaaatgcctggtgaagccatcgccaaattccagacacccagccagacccaaagggctgagccatccccccgaatccatgtgtcaaaccttagtggtgacctgtagaagtggaagcccgctccccatgtctgggctccggcccctgcctccacggggcctaccttggtgctgaagggctgttagagccaggctgtcaccaacttaaaaaatcaaaggggttcagggggaaaggcaacctccatatggcaatatggggacccaggcacggggacgccctcctcaggacctgtctgttcatctctggtacgcaggccccatggagcgggcaggggcagagagcatcctggccaaccgctcggacgggactttcttggtgcggcagagggtgaaggatgcagcagaatttgccatcagcattaaatataacgtcgaggtcaagcacattaaaatcatgacagcagaaggactgtaccggatcacagagaaaaaggctttccgggggcttacggagctggtggagttttaccagcagaactctctaaaggattgcttcaagtctctggacaccaccttgcagttccccttcaaggagcctgaaaagagaaccatcagcaggccagcagtgggaagcacaaagtattttggcacagccaaagcccgctatgacttctgcgcccgagaccgatcagagctgtcgctcaaggagggtgacatcatcaagatccttaacaagaagggacagcaaggctggtggcgaggggagatctatggccgggttggctggttccctgccaactacgtggaggaagattattctgaatactgctgagccctggtgccttggcagagagacgagaaactccaggctctgagcccggcgtgggcaggcagcggagccaggggctgtgacagctcccggcgggtggagactttgggatggactggaggaggccagcgtccagctggcggtgctcccgggatgtgccctgacatggttaatttataacaccccgatttcctcttgggtcccctcaagcagacggggctcaagggggttacatttaataaaaggatgaagatggatagaaaaaaagg

SEQ ID NO: 44246 - DNA, 1365 bp, Homo sapiens
ggcacgagggtggtgcacgcctatagtctcagctactcaggaagttgaggcaggaggatcgcttgagcccaggagtttgatgctgcagtgagctatgattgtgctaccactgtactccagactggacaaaagattcctgtgccttaagaacattagaaccttcctgtccacctgctgtgagaagttcggcctcaagcggagcgagctcttcgaagcctttgacctcttcgatgtgcaggattttggcaaggtcatctacaccctgtctgctctgtcctggaccccgatcgcccagaacagggggatcatgcccttccccaccgaggaggagagtgtaggtgatgaagacatctacagtggcctgtccgaccagatcgacgacacggtggaggaggatgaggacctgtatgactgcgtggagaatgaggaggcggaaggcgacgagatctatgaggacctcatgcgctcggagcccgtgtccatgccgcccaagatgacagagtatgacaagcgctgctgctgcctgcgggagatccagcagacggaggagaagtacactgacacgctgggctccatccagcagcatttcttgaagcccctgcaacggttcctgaaacctcaagacattgagatcatctttatcaacattgaggacctgcttcgtgttcatactcacttcctaaaggagatgaaggaagccctgggcacccctggcgcagccaatctctaccaggtcttcatcaaatacaaggagaggttcctcgtctatggccgctactgcagccaggtggagtcagccagcaaacacctggaccgtgtggccgcagcccgggaggacgtgcagatgaagctggaggaatgttctcagagagccaacaacgggaggttcaccctgcgggacctgctgatggtgcctatgcagcgagttctcaaatatcacctccttctccaggagctggtgaaacacacgcaggaggcgatggagaaggagaacctgcggctggccctggatgccatgagggacctggctcagtgcgtgaacgaggtcaagcgagacaacgagacactgcgacagatcaccaatttccagctgtccattgagaacctggaccagtctctggctcactatggccggcccaagatcgacggggaactcaagatcacctcggtggaacggcgctccaagatggacaggtatgccttcctgctcgacaaagctctactcatctgtaagcgcaggggagactcctatgacctcaaggactttgtaaacctgcacagcttccaggttcgggatgactcttcaggagaccgagacaacaagaaggtggggctttgacgccggaactatggggtcctccacgc

SEQ ID NO: 44247 - DNA, 287 bp, Homo sapiens
atgtcagaaatgacagacatagaattcagaatatggatggccaaaaaaactcaaccagattcaagagaaaaattaaatccaacaaaaataacctagaaaaatgatccaagttttgaaagatgacatacgtttattaagaaagaactaagcagaatttctggaattgaaaaatttatgacagaaatttcaaattacagttggaagccttaacaacagaccagaccatgcagaaaaaagaatttctcagttcaaagaccattccttcaagtcaacccagtcagacaaaa

SEQ ID NO: 44248 - DNA, 416 bp, Homo sapiens
  misc_feature (328)..(328): n is a, c, g, or t
gaggcaggtggatcacctgaggtcaggagtttgagacaagcctagccaacatggcaaaaccctgtctctgctaaaaatagaaaaattagccgggtgtgatggcacgtgcctgtagtcccagctactcgggagactgaggctggagtatggcttgaacctgggaggcagaggttacagtgagccgagattgcgccattgcactccagcctgggtgacagagagagatttcatctaaaaataaaattttttttaaacaggcgtaagccactgcgcccagccaatttaatttaatttttaaaacattttttaaatctttttaaaaattaanaaaactgttcattgaaatggactttgtcttagtccgttttttgttcctgtatctgaaaacctgagactgtgtaatttataaaaaaaaa

SEQ ID NO: 44249 - DNA, 217 bp, Homo sapiens
ggggttattgttttgtcatagcaacctggcctactagaaagaataaaaaatagacccatagaaccagagttctagttcaactctcccacttagctgtgtgctttttagtaagtcccttgacgtcccaagggtccgcttttctcactgttctgtgaagtatcctatgatttttataggtggagggttgtgttaaacatgaagaggccaattacaagca

SEQ ID NO: 44250 - DNA, 499 bp, Homo sapiens
acttttgaatatttatgatggctcataaaacatttattgaggtggctgcgaggtatataataccatgttaggtgctttagacaacacaggatataacatatatattgctagattataatccattggggaactacaacaggcataaaaacttaagtatctgtgcaagaaatctcacaaagtagtgtgttattttcatgagctgtaaatacggtactagaagaattcagacatgagtgaatgcttttaaaaggcagagcagggtgaataaatatcatgtggactatgtctactatttatttgtaacaaaaactttaaagatattatttcctatacgttttaagaattattccagctgggcacagtggctgacgcctgtaatcccgatattttaagaggccaaggcagatggattgcatgagccccggagttcaaggctgcagtgagcgattatgacaccactgtactacagtctgggcaatagagtgagactctgtctctc

SEQ ID NO: 44251 - DNA, 460 bp, Homo sapiens
ttctgcaagggaggaggactccacacacttccccagttcagggctggggctgattcatggaggatgatctggggcgagtaggatgggaggaactgacattctgggcagaaccagagtcctgtttcatgagttcggaaaagcagtctgcagggctctcccaggccaccactgctgctgccgtgtggctccccatggtgggtgctctgttttccttctcggggccccactgccttcctagaaaggctgaccctggccgaggggaagcctgtggcagtagtgtgcccttctctttgccctctatgtcagccgggcagcaggagagtggggactgggaggcactttctgccccaatgctgaagtctgcgtttgttggatgtatggaacagccagcctcaccatcctgccagtgttgcccagtcctgggacttctcgggccttgatttccccttctgtgaaaggg

SEQ ID NO: 44252 - DNA, 927 bp, Homo sapiens
agtaaaaggcctagagatcttcaatgaagtgtcccttttagccaaaccaggccttgcagaaattgtcctcaaaagcaccaagggagaacaaagccaagtgcagaattacccaagggtcacacattttgtattcattttcttataatttgcccaaatgatttgaagtacagcaaaacctgaagttttgcaaagagttactgtaaactgaacttaaaaatgtcagagtgctcggtgacccacttctccagaccctgtcaacctgtgaaaatattggcctttattcagatctctcaagaagttacgcgcagagtttggaaggtctaggcaaaggttattagtcaagtgttcttacagtgtcaacgctcaattcccacaagcgtgagaaagagagacctgtcattcctgagggtgatgacatacatttactggagcttatataatttatcagataagacagcagtctccttcagggtagaaagtgtgttttctacattgatttagtacaaaacaaaaagaaaaggggatatttcaaattttataattatttttctgctaagctgattcagtgtgatttaagcatatttttcaaatcatgaatctgattccatatacatatgtgccttatattgtgataatttatttttaagtgaaatatgctatcatagcctgactttatgtatagtggtgacaacttgcaggatcgcatttctgtaaccaaacggccgacagctgaggtgtagatgcttcctatggtctgtagaataatcactgggcttgttctctagctatgtctgtatgcaatcgcgacagtgttgatcaaaacccatgatcattctctccaaaggtctttgtcactaagccactagggattctgaaaagttcgtgagctgaaacaaataaattgagttggaagattaaaaaagactg

SEQ ID NO: 44253 - DNA, 344 bp, Homo sapiens
cattgatattttgtaattggcaaatgttttgatgactgtctactctttataatttagtgttactttaaataatatgtaaatactaaaatcaataagcttcacttatatagaaagtattcagtaaaaaacataagggaaaactcttccaaaaactagagtgttggaaaaagagaccaaaaatgtaacttgacagtggagaaacctgacaaataccaccttaagccaggtgactgaggttaacatcaatagtgatgaaccatatttgatagtatgtagccttgatgtgatgtgatgataataccacacttcttctgtggtcttcctccaaaaaatattagcccagt

SEQ ID NO: 44254 - DNA, 5920 bp, Homo sapiens
cggaacgcaggcggagcgcaagtccgtcagccagtcagtccgccagtccgccagcccagtacctctctctcctcggccctcgtaagctgtccgcggtctgtttggcccgaacggcggcggaggcgctgatcatggcgacattcatctcggtgcagctgaaaaagacctcagaggtggacctggccaagccgctggtgaagttcatccagcagacttacccaagcggcggggaagagcaggcccagtactgccgcgcggcggaggagctcagcaagctgcgccgcgccgcagtcggtcgtccgctggacaagcacgagggcgcgctcgagacgctcctgagatattatgatcagatttgttctattgaacccaaattcccattttctgaaaatcagatctgcttgacatttacctggaaggatgctttcgataaaggttcactttttggaggctctgtaaaactggctcttgcaagcttaggatatgaaaagagctgtgtgttgttcaattgtgcagccttagctagccaaattgcagcagaacagaacctggataatgatgaaggattgaaaatcgctgctaaacattaccagtttgctagtggtgcctttttacatattaaagagacggttttatctgccttaagtcgagagccgaccgtggacatatctccagatactgttgggaccctcagtcttattatgctggcacaggctcaagaagtattttttttaaaagccacaagagataaaatgaaagatgccatcatagctaaattggctaatcaggctgcagattattttggtgatgctttcaaacagtgtcaatacaaagatactctccccaaggaggtgttccctgtcttggctgcaaagcactgtatcatgcaggccaatgctgagtaccatcagtctatcctggcaaaacagcagaagaaatttggagaagaaattgcaaggttacagcatgcagcagaactgattaaaacagtggcatctcgctatgatgaatatgttaatgtgaaggatttttctgacaaaatcaatcgtgcccttgctgcagcaaagaaggataatgacttcatttatcatgatcgagttccagaccttaaagatctagatcctattggcaaagccacacttgtgaaatctaccccggtcaatgtacccatcagtcagaaatttactgatctgtttgagaagatggttcccgtgtcagtacagcagtctttggctgcctataatcagaggaaagccgatttggttaacagatcaattgctcagatgagagaagccaccactttggcaaatggggtgctagcttcccttaatcttccagcagcaattgaagatgtgtctggagacactgtacctcagtctatattgactaaatccagatctgtgattgaacagggaggcatccagactgttgatcagttgattaaagaactgcctgaattactgcaacgaaatagagaaatcctagatgagtcattaaggttgttggatgaagaagaagcaaccgataatgatttaagagcaaaatttaaggaacgttggcaaaggacaccatccaatgaactgtataagcctttaagagcagagggaaccaacttcagaacagttttagataaagctgtgcaggcagatggacaagtgaaagaatgttaccagtctcatcgtgacaccatcgtgcttttgtgtaagccagagcctgagctgaatgctgccatcccttctgctaatccagcaaagaccatgcagggcagtgaggttgtaaatgtcttaaaatccttattgtcaaatcttgatgaagtaaagaaggaaagagagggtctggagaatgacttgaaatctgtgaattttgacatgacaagcaagtttttgacagccctggctcaagatggtgtgataaatgaagaagctctttctgttactgaactagatcgagtctatggaggtcttacaactaaagtccaagaatctctaaagaaacaggagggacttcttaaaaatattcaggtctcacatcaggaattttcaaaaatgaaacaatctaataatgaagctaacttaagagaagaagttttgaagaatttagctactgcatatgacaactttgttgaacttgtagctaatttgaaggaaggcacaaagttttacaatgagttgactgaaatcctggtcaggttccagaacaaatgcagtgatatagtttttgcacggaagacagaaagagatgaactcttaaaggacttgcaacaaagcattgccagagaacctagtgctccttcaattcctacacctgcgtatcagtcctcaccagcaggaggacatgcaccaactcctccaactccagcgccaagaaccatgccgcctactaagccccagcccccagccaggcctccaccacctgtgcttccagcaaatcgagctccttctgctactgctccatctccagtgggggctgggactgctgcgccagctccatcacaaacgcctggctcagctcctcctccacaggcgcagggaccaccctatcccacctatccaggatatcctgggtattgccaaatgcccatgcccatgggctataatccttatgcgtatggccagtataatatgccatatccaccagtgtatcaccagagtcctggacaggctccatacccgggaccccagcagccttcataccccttccctcagcccccacagcagtcttactatccacagcagtaatatgtctgctcagcagctcagctgattcagatcagagggaaagaaataccaaccctgcaataagtgtactaaactctacgctctggttaatgtaatgtactctcctggactgaatgcagtgtataatttctgtctacagctagaagctgtgccccagttccacatttgattacacatgtgagatttgctgctgttgcagtataaacactaggtataataggatttgaaattgcattacagttcataaaaattgaaaatgagaaattaaacctgcaagtgaaacatttgaaacgattatactttctacataagacatggttgggacatcagatacttacaaagatggtttaagtatggatactagagaaaattaagttttctttctctttggtttattgatttggtttaatttccattatgctattttgcataatcaaggcactgtaaatcttataattttaaaataaattacttaagaacagttgtcattgttatgttttgttattgattctcattactgtctaattttttttctggtattagtctcattttgtatgtatataagttaaacagatactgtttttaagtgcatgaatagtacaagttattatcaaggatgttttacagggaaatcaaaagaatattatcatactttatctttcgtatgctgattagtaaacgatttttgacatttattttagaaagtcctataatgtggaagaaacaaacagttgctaccaaagattcttcaaataaacatacaaataaatgtgtatatttaatgttttattgttagcttctccagaaaattgatgcaaattctggtaataattcttgcattttttccccataacctggttaaaataaatacgccattggcaatacttcataatgtaatggaattgtttggggaacacttactgtaccctctcatcctttttccaccttactgtgttaacttagtgacatttaatgcccaatatgtatgaatagatctaagccatttaattttttttccttaaagattggactattttataattcaaggagcatacaaaacaatggttgggaacatatgccaattatggaataggctatgtatttaatattaatctctgccattaggatatctactcactgtataaacctcagtaaaaatagtgaagacatgcatcatggaatgagaaaatgagaaaggaatgagttgtctaacatcacagtgggatctgttttttgtgaggttcatttctgaacacattaggcatatgagcagatttccagtgaatctatttatgtttattttctgagtttcaacgctgaccttttcttgcattattgtttcattttaatgatagtgttacttgtcccactgttgttttcattgagtttggatttatattttaaatgttcgaatgaaagtatgattgtaaaagggagtgaattggtttaaaaatatatgtatattttaaactttgttgtgtgtaggaaacatgaaggcatgttaattcaatataaatgacctttgatttcatggaatattaaagttggtttaaagtccaatagttaaaccttagcaaaaatagctttttactttatcagttgctaagatttaatactttggattcatcaaagtgtgacatgggcttgtttgacttctgtaagtggcatttaagttccacattcttattacttgaggtactttatactaacataagacagtgagagttagaggtattacaagttgctagtttataatgtcttactaatgcagaaacaaggaaaaaagcaaaattggcctgaatattctcttggggaaagagggcaccaaagaaaagggtaagtgcatctgagggccaaaagagatgtataagccttttagcccattccccatgctgggcctgctcacagagccacaggaagatcattcagaaactaggaaaggaggcccccacagctgatcctgccacagcacacctgactcactcggctctgttagtgtaaccttttaaatgtagcaacacaaaccctttccctcttgtcagttcactcatcctttggtttctttttaatcacctgtgtctgggcacagacaatcacaataaatgcagccctttattactgttaaggatcatactgttggtttggagttggaagggtactactctgtgattcaggtgtgttgtacccatatttataattaggctttattatcttcctaaatcaaggaaaggaaatcatccccagaccatttatgctgagctttggaatactattttaaactggattgtacttaaataatgaagctctgcatagaggaactagtcagaagtggggaaaacactgtctaatttttatcagtctggtataaagtattgatctaagagaactctccctgtgccccttggtctttattctcaattaagaaaaacagtcacatgtcacgacaaaccaatcaatctttatgagatattcctgtatccataccccagcttgtttgcaatttataaacctccccttcaaaactaaggagttgcagaaaaaaatggatttcacagagccttgtgtccctaaagttctgtcccagtcagcagtctttatagtccaaacagattataaaaaatgttttccatttgaactttacagtttgcaaaagtgcttttatacattttctaatttcagaaacaggataatataatttgttaagtgggtttcagtttgctaatagggattttttgtgttttgttttttaattttcagcatctcttgaagaatcttgctacagccaaatggcatctcactttttaaagacgtttgcaattattagttgattcacagtacagaacaaggtataaaggaaaaaaccctgctaggtagtgttataattgctagattaaaaatagactagaacaggttcattttaagatttacttggaagagcaaagaaggaaaaattatatttttaaagaaagagaatattcaggctttatttctggtatgaagtttatattttttaaaaaaatcctatattatcacaccagagattttagattcttttctggttagaaacattgctggtagttggattatatttttattgtattcatttatcttagggggaacattgtaaagaaacaaaaaggtccagatgaatgtatgctagaaataaaagttgaaagattctt

SEQ ID NO: 44255 - DNA, 5029 bp, Homo sapiens
aacggcccaggctggtaccggtcggagtgtaggatcagcagaagaaatttggagaagaaattgcaaggttacagcatgcagcagaactgattaaaacagtggcatctcgctatgatgaatatgttaatgtgaaggatttttctgacaaaatcaatcgtgcccttgctgcagcaaagaaggataatgacttcatttatcatgatcgagttccagaccttaaagatctagatcctattggcaaagccacacttgtgaaatctaccccggtcaatgtacccatcagtcagaaatttactgatctgtttgagaagatggttcccgtgtcagtacagcagtctttggctgcctataatcagaggaaagccgatttggttaacagatcaattgctcagatgagagaagccaccactttggcaaatggggtgctagcttcccttaatcttccagcagcaattgaagatgtgtctggagacactgtacctcagtctatattgactaaatccagatctgtgattgaacagggaggcatccagactgttgatcagttgattaaagaactgcctgaattactgcaacgaaatagagaaatcctagatgagtcattaaggttgttggatgaagaagaagcaaccgataatgatttaagagcaaaatttaaggaacgttggcaaaggacaccatccaatgaactgtataagcctttaagagcagagggaaccaacttcagaacagttttagataaagctgtgcaggcagatggacaagtgaaagaatgttaccagtctcatcgtgacaccatcgtgcttttgtgtaagccagagcctgagctgaatgctgccatcccttctgctaatccagcaaagaccatgcagggcagtgaggttgtaaatgtcttaaaatccttattgtcaaatcttgatgaagtaaagaaggaaagagagggtctggagaatgacttgaaatctgtgaattttgacatgacaagcaagtttttgacagccctggctcaagatggtgtgataaatgaagaagctctttctgttactgaactagatcgagtctatggaggtcttacaactaaagtccaagaatctctaaagaaacaggagggacttcttaaaaatattcaggtctcacatcaggaattttcaaaaatgaaacaatctaataatgaagctaacttaagagaagaagttttgaagaatttagctactgcatatgacaactttgttgaacttgtagctaatttgaaggaaggcacaaagttttacaatgagttgactgaaatcctggtcaggttccagaacaaatgcagtgatatagtttttgcacggaagacagaaagagatgaactcttaaaggacttgcaacaaagcattgccagagaacctagtgctccttcaattcctacacctgcgtatcagtcctcaccagcaggaggacatgcaccaactcctccaactccagcgccaagaaccatgccgcctactaagccccagcccccagccaggcctccaccacctgtgcttccagcaaatcgagctccttctgctactgctccatctccagtgggggctgggactgctgcgccagctccatcacaaacgcctggctcagctcctcctccacaggcgcagggaccaccctatcccacctatccaggatatcctgggtattgccaaatgcccatgcccatgggctataatccttatgcgtatggccagtataatatgccatatccaccagtgtatcaccagagtcctggacaggctccatacccgggaccccagcagccttcataccccttccctcagcccccacagcagtcttactatccacagcagtaatatgtctgctcagcagctcagctgattcagatcagagggaaagaaataccaaccctgcaataagtgtactaaactctacgctctggttaatgtaatgtactctcctggactgaatgcagtgtataatttctgtctacagctagaagctgtgccccagttccacatttgattacacatgtgagatttgctgctgttgcagtataaacactaggtataataggatttgaaattgcattacagttcataaaaattgaaaatgagaaattaaacctgcaagtgaaacatttgaaacgattatactttctacataagacatggttgggacatcagatacttacaaagatggtttaagtatggatactagagaaaattaagttttctttctctttggtttattgatttggtttaatttccattatgctattttgcataatcaaggcactgtaaatcttataattttaaaataaattacttaagaacagttgtcattgttatgttttgttattgattctcattactgtctaattttttttctggtattagtctcattttgtatgtatataagttaaacagatactgtttttaagtgcatgaatagtacaagttattatcaaggatgttttacagggaaatcaaaagaatattatcatactttatctttcgtatgctgattagtaaacgatttttgacatttattttagaaagtcctataatgtggaagaaacaaacagttgctaccaaagattcttcaaataaacatacaaataaatgtgtatatttaatgttttattgttagcttctccagaaaattgatgcaaattctggtaataattcttgcattttttccccataacctggttaaaataaatacgccattggcaatacttcataatgtaatggaattgtttggggaacacttactgtaccctctcatcctttttccaccttactgtgttaacttagtgacatttaatgcccaatatgtatgaatagatctaagccatttaattttttttccttaaagattggactattttataattcaaggagcatacaaaacaatggttgggaacatatgccaattatggaataggctatgtatttaatattaatctctgccattaggatatctactcactgtataaacctcagtaaaaatagtgaagacatgcatcatggaatgagaaaatgagaaaggaatgagttgtctaacatcacagtgggatctgttttttgtgaggttcatttctgaacacattaggcatatgagcagatttccagtgaatctatttatgtttattttctgagtttcaacgctgaccttttcttgcattattgtttcattttaatgatagtgttacttgtcccactgttgttttcattgagtttggatttatattttaaatgttcgaatgaaagtatgattgtaaaagggagtgaattggtttaaaaatatatgtatattttaaactttgttgtgtgtaggaaacatgaaggcatgttaattcaatataaatgacctttgatttcatggaatattaaagttggtttaaagtccaatagttaaaccttagcaaaaatagctttttactttatcagttgctaagatttaatactttggattcatcaaagtgtgacatgggcttgtttgacttctgtaagtggcatttaagttccacattcttattacttgaggtactttatactaacataagacagtgagagttagaggtattacaagttgctagtttataatgtcttactaatgcagaaacaaggaaaaaagcaaaattggcctgaatattctcttggggaaagagggcaccaaagaaaagggtaagtgcatctgagggccaaaagagatgtataagccttttagcccattccccatgctgggcctgctcacagagccacaggaagatcattcagaaactaggaaaggaggcccccacagctgatcctgccacagcacacctgactcactcggctctgttagtgtaaccttttaaatgtagcaacacaaaccctttccctcttgtcagttcactcatcctttggtttctttttaatcacctgtgtctgggcacagacaatcacaataaatgcagccctttattactgttaaggatcatactgttggtttggagttggaagggtactactctgtgattcaggtgtgttgtacccatatttataattaggctttattatcttcctaaatcaaggaaaggaaatcatccccagaccatttatgctgagctttggaatactattttaaactggattgtacttaaataatgaagctctgcatagaggaactagtcagaagtggggaaaacactgtctaatttttatcagtctggtataaagtattgatctaagagaactctccctgtgccccttggtctttattctcaattaagaaaaacagtcacatgtcacgacaaaccaatcaatctttatgagatattcctgtatccataccccagcttgtttgcaatttataaacctccccttcaaaactaaggagttgcagaaaaaaatggatttcacagagccttgtgtccctaaagttctgtcccagtcagcagtctttatagtccaaacagattataaaaaatgttttccatttgaactttacagtttgcaaaagtgcttttatacattttctaatttcagaaacaggataatataatttgttaagtgggtttcagtttgctaatagggattttttgtgttttgttttttaattttcagcatctcttgaagaatcttgctacagccaaatggcatctcactttttaaagacgtttgcaattattagttgattcacagtacagaacaaggtataaaggaaaaaaccctgctaggtagtgttataattgctagattaaaaatagactagaacaggttcattttaagatttacttggaagagcaaagaaggaaaaattatatttttaaagaaagagaatattcaggctttatttctggtatgaagtttatattttttaaaaaaatcctatattatcacaccagagattttagattcttttctggttagaaacattgctggtagttggattatatttttattgtattcatttatcttagggggaacattgtaaagaaacaaaaaggtccagatgaatgtatgctagaaataaaagttgaaagattctt

SEQ ID NO: 44256 - DNA, 5175 bp, Homo sapiens
gcacagtgttccgttacatcctgttgggccattagttcagtcctgtcatggagagaagaaagtcacctacaaagacttggaagctacctctgcagcattcctggaggtgttccctgtcttggctgcaaagcactgtatcatgcaggccaatgctgagtaccatcagtctatcctggcaaaacagcagaagaaatttggagaagaaattgcaaggttacagcatgcagcagaactgattaaaacagtggcatctcgctatgatgaatatgttaatgtgaaggatttttctgacaaaatcaatcgtgcccttgctgcagcaaagaaggataatgacttcatttatcatgatcgagttccagaccttaaagatctagatcctattggcaaagccacacttgtgaaatctaccccggtcaatgtacccatcagtcagaaatttactgatctgtttgagaagatggttcccgtgtcagtacagcagtctttggctgcctataatcagaggaaagccgatttggttaacagatcaattgctcagatgagagaagccaccactttggcaaatggggtgctagcttcccttaatcttccagcagcaattgaagatgtgtctggagacactgtacctcagtctatattgactaaatccagatctgtgattgaacagggaggcatccagactgttgatcagttgattaaagaactgcctgaattactgcaacgaaatagagaaatcctagatgagtcattaaggttgttggatgaagaagaagcaaccgataatgatttaagagcaaaatttaaggaacgttggcaaaggacaccatccaatgaactgtataagcctttaagagcagagggaaccaacttcagaacagttttagataaagctgtgcaggcagatggacaagtgaaagaatgttaccagtctcatcgtgacaccatcgtgcttttgtgtaagccagagcctgagctgaatgctgccatcccttctgctaatccagcaaagaccatgcagggcagtgaggttgtaaatgtcttaaaatccttattgtcaaatcttgatgaagtaaagaaggaaagagagggtctggagaatgacttgaaatctgtgaattttgacatgacaagcaagtttttgacagccctggctcaagatggtgtgataaatgaagaagctctttctgttactgaactagatcgagtctatggaggtcttacaactaaagtccaagaatctctaaagaaacaggagggacttcttaaaaatattcaggtctcacatcaggaattttcaaaaatgaaacaatctaataatgaagctaacttaagagaagaagttttgaagaatttagctactgcatatgacaactttgttgaacttgtagctaatttgaaggaaggcacaaagttttacaatgagttgactgaaatcctggtcaggttccagaacaaatgcagtgatatagtttttgcacggaagacagaaagagatgaactcttaaaggacttgcaacaaagcattgccagagaacctagtgctccttcaattcctacacctgcgtatcagtcctcaccagcaggaggacatgcaccaactcctccaactccagcgccaagaaccatgccgcctactaagccccagcccccagccaggcctccaccacctgtgcttccagcaaatcgagctccttctgctactgctccatctccagtgggggctgggactgctgcgccagctccatcacaaacgcctggctcagctcctcctccacaggcgcagggaccaccctatcccacctatccaggatatcctgggtattgccaaatgcccatgcccatgggctataatccttatgcgtatggccagtataatatgccatatccaccagtgtatcaccagagtcctggacaggctccatacccgggaccccagcagccttcataccccttccctcagcccccacagcagtcttactatccacagcagtaatatgtctgctcagcagctcagctgattcagatcagagggaaagaaataccaaccctgcaataagtgtactaaactctacgctctggttaatgtaatgtactctcctggactgaatgcagtgtataatttctgtctacagctagaagctgtgccccagttccacatttgattacacatgtgagatttgctgctgttgcagtataaacactaggtataataggatttgaaattgcattacagttcataaaaattgaaaatgagaaattaaacctgcaagtgaaacatttgaaacgattatactttctacataagacatggttgggacatcagatacttacaaagatggtttaagtatggatactagagaaaattaagttttctttctctttggtttattgatttggtttaatttccattatgctattttgcataatcaaggcactgtaaatcttataattttaaaataaattacttaagaacagttgtcattgttatgttttgttattgattctcattactgtctaattttttttctggtattagtctcattttgtatgtatataagttaaacagatactgtttttaagtgcatgaatagtacaagttattatcaaggatgttttacagggaaatcaaaagaatattatcatactttatctttcgtatgctgattagtaaacgatttttgacatttattttagaaagtcctataatgtggaagaaacaaacagttgctaccaaagattcttcaaataaacatacaaataaatgtgtatatttaatgttttattgttagcttctccagaaaattgatgcaaattctggtaataattcttgcattttttccccataacctggttaaaataaatacgccattggcaatacttcataatgtaatggaattgtttggggaacacttactgtaccctctcatcctttttccaccttactgtgttaacttagtgacatttaatgcccaatatgtatgaatagatctaagccatttaattttttttccttaaagattggactattttataattcaaggagcatacaaaacaatggttgggaacatatgccaattatggaataggctatgtatttaatattaatctctgccattaggatatctactcactgtataaacctcagtaaaaatagtgaagacatgcatcatggaatgagaaaatgagaaaggaatgagttgtctaacatcacagtgggatctgttttttgtgaggttcatttctgaacacattaggcatatgagcagatttccagtgaatctatttatgtttattttctgagtttcaacgctgaccttttcttgcattattgtttcattttaatgatagtgttacttgtcccactgttgttttcattgagtttggatttatattttaaatgttcgaatgaaagtatgattgtaaaagggagtgaattggtttaaaaatatatgtatattttaaactttgttgtgtgtaggaaacatgaaggcatgttaattcaatataaatgacctttgatttcatggaatattaaagttggtttaaagtccaatagttaaaccttagcaaaaatagctttttactttatcagttgctaagatttaatactttggattcatcaaagtgtgacatgggcttgtttgacttctgtaagtggcatttaagttccacattcttattacttgaggtactttatactaacataagacagtgagagttagaggtattacaagttgctagtttataatgtcttactaatgcagaaacaaggaaaaaagcaaaattggcctgaatattctcttggggaaagagggcaccaaagaaaagggtaagtgcatctgagggccaaaagagatgtataagccttttagcccattccccatgctgggcctgctcacagagccacaggaagatcattcagaaactaggaaaggaggcccccacagctgatcctgccacagcacacctgactcactcggctctgttagtgtaaccttttaaatgtagcaacacaaaccctttccctcttgtcagttcactcatcctttggtttctttttaatcacctgtgtctgggcacagacaatcacaataaatgcagccctttattactgttaaggatcatactgttggtttggagttggaagggtactactctgtgattcaggtgtgttgtacccatatttataattaggctttattatcttcctaaatcaaggaaaggaaatcatccccagaccatttatgctgagctttggaatactattttaaactggattgtacttaaataatgaagctctgcatagaggaactagtcagaagtggggaaaacactgtctaatttttatcagtctggtataaagtattgatctaagagaactctccctgtgccccttggtctttattctcaattaagaaaaacagtcacatgtcacgacaaaccaatcaatctttatgagatattcctgtatccataccccagcttgtttgcaatttataaacctccccttcaaaactaaggagttgcagaaaaaaatggatttcacagagccttgtgtccctaaagttctgtcccagtcagcagtctttatagtccaaacagattataaaaaatgttttccatttgaactttacagtttgcaaaagtgcttttatacattttctaatttcagaaacaggataatataatttgttaagtgggtttcagtttgctaatagggattttttgtgttttgttttttaattttcagcatctcttgaagaatcttgctacagccaaatggcatctcactttttaaagacgtttgcaattattagttgattcacagtacagaacaaggtataaaggaaaaaaccctgctaggtagtgttataattgctagattaaaaatagactagaacaggttcattttaagatttacttggaagagcaaagaaggaaaaattatatttttaaagaaagagaatattcaggctttatttctggtatgaagtttatattttttaaaaaaatcctatattatcacaccagagattttagattcttttctggttagaaacattgctggtagttggattatatttttattgtattcatttatcttagggggaacattgtaaagaaacaaaaaggtccagatgaatgtatgctagaaataaaagttgaaagattctt

SEQ ID NO: 44257 - DNA, 2096 bp, Homo sapiens
cggaacgcaggcggagcgcaagtccgtcagccagtcagtccgccagtccgccagcccagtacctctctctcctcggccctcgtaagctgtccgcggtctgtttggcccgaacggcggcggaggcgctgatcatggcgacattcatctcggtgcagctgaaaaagacctcagaggtggacctggccaagccgctggtgaagttcatccagcagacttacccaagcggcggggaagagcaggcccagtactgccgcgcggcggaggagctcagcaagctgcgccgcgccgcagtcggtcgtccgctggacaagcacgagggcgcgctcgagacgctcctgagatattatgatcagatttgttctattgaacccaaattcccattttctgaaaatcagatctgcttgacatttacctggaaggatgctttcgataaaggttcactttttggaggctctgtaaaactggctcttgcaagcttaggatatgaaaagagctgtgtgttgttcaattgtgcagccttagctagccaaattgcagcagaacagaacctggataatgatgaaggattgaaaatcgctgctaaacattaccagtttgctagtggtgcctttttacatattaaagagacggttttatctgccttaagtcgagagccgaccgtggacatatctccagatactgttgggaccctcagtcttattatgctggcacaggctcaagaagtattttttttaaaagccacaagagataaaatgaaagatgccatcatagctaaattggctaatcaggctgcagattattttggtgatgctttcaaacagtgtcaatacaaagatactctccccaaggaggtgttccctgtcttggctgcaaagcactgtatcatgcaggccaatgctgagtaccatcagtctatcctggcaaaacagcagaagaaatttggagaagaaattgcaaggttacagcatgcagcagaactgattaaaacagtggcatctcgctatgatgaatatgttaatgtgaaggatttttctgacaaaatcaatcgtgcccttgctgcagcaaagaaggataatgacttcatttatcatgatcgagttccagaccttaaagatctagatcctattggcaaagccacacttgtgaaatctaccccggtcaatgtacccatcagtcagaaatttactgatctgtttgagaagatggttcccgtgtcagtacagcagtctttggctgcctataatcagaggaaagccgatttggttaacagatcaattgctcagatgagagaagccaccactttggcaaatggggtgctagcttcccttaatcttccagcagcaattgaagatgtgtctggagacactgtacctcagtctatattgactaaatccagatctgtgattgaacagggaggcatccagactgttgatcagttgattaaagaactgcctgaattactgcaacgaaatagagaaatcctagatgagtcattaaggttgttggatgaagaagaagcaaccgataatgatttaagagcaaaatttaaggaacgttggcaaaggacaccatccaatgaactgtataagcctttaagagcagagggaaccaacttcagaacagttttagataaagctgtgcaggcagatggacaagtgaaagaatgttaccagtctcatcgtgacaccatcgtgcttttgtgtaagccagagcctgagctgaatgctgccatcccttctgctaatccagcaaagaccatgcagggcagtgaggttgtaaatgtcttaaaatccttattgtcaaatcttgatgaagtaaagaaggaaagagagggtctggagaatgacttgaaatctgtgaattttgacatgacaagcaagtttttgacagccctggctcaagatggtgtgataaatgaagaagctctttctgttactgaactagatcgagtctatggaggtcttacaactaaagtccaagaatctctaaagaaacaggagggacttcttaaaaatattcagctctctgagctattatagctattatttcaaatgacaatatagagaagcacctgggaaggtctttctggtggaagg

SEQ ID NO: 44258 - DNA, 3215 bp, Homo sapiens
cggaacgcaggcggagcgcaagtccgtcagccagtcagtccgccagtccgccagcccagtacctctctctcctcggccctcgtaagctgtccgcggtctgtttggcccgaacggcggcggaggcgctgatcatggcgacattcatctcggtgcagctgaaaaagacctcagaggtggacctggccaagccgctggtgaagttcatccagcagacttacccaagcggcggggaagagcaggcccagtactgccgcgcggcggaggagctcagcaagctgcgccgcgccgcagtcggtcgtccgctggacaagcacgagggcgcgctcgagacgctcctgagatattatgatcagatttgttctattgaacccaaattcccattttctgaaaatcagatctgcttgacatttacctggaaggatgctttcgataaaggttcactttttggaggctctgtaaaactggctcttgcaagcttaggatatgaaaagagctgtgtgttgttcaattgtgcagccttagctagccaaattgcagcagaacagaacctggataatgatgaaggattgaaaatcgctgctaaacattaccagtttgctagtggtgcctttttacatattaaagagacggttttatctgccttaagtcgagagccgaccgtggacatatctccagatactgttgggaccctcagtcttattatgctggcacaggctcaagaagtattttttttaaaagccacaagagataaaatgaaagatgccatcatagctaaattggctaatcaggctgcagattattttggtgatgctttcaaacagtgtcaatacaaagatactctccccaaggaggtgttccctgtcttggctgcaaagcactgtatcatgcaggccaatgctgagtaccatcagtctatcctggcaaaacagcagaagaaatttggagaagaaattgcaaggttacagcatgcagcagaactgattaaaacagtggcatctcgctatgatgaatatgttaatgtgaaggatttttctgacaaaatcaatcgtgcccttgctgcagcaaagaaggataatgacttcatttatcatgatcgagttccagaccttaaagatctagatcctattggcaaagccacacttgtgaaatctaccccggtcaatgtacccatcagtcagaaatttactgatctgtttgagaagatggttcccgtgtcagtacagcagtctttggctgcctataatcagaggaaagccgatttggttaacagatcaattgctcagatgagagaagccaccactttggcaaatggggtgctagcttcccttaatcttccagcagcaattgaagatgtgtctggagacactgtacctcagtctatattgactaaatccagatctgtgattgaacagggaggcatccagactgttgatcagttgattaaagaactgcctgaattactgcaacgaaatagagaaatcctagatgagtcattaaggttgttggatgaagaagaagcaaccgataatgatttaagagcaaaatttaaggaacgttggcaaaggacaccatccaatgaactgtataagcctttaagagcagagggaaccaacttcagaacagttttagataaagctgtgcaggcagatggacaagtgaaagaatgttaccagtctcatcgtgacaccatcgtgcttttgtgtaagccagagcctgagctgaatgctgccatcccttctgctaatccagcaaagaccatgcagggcagtgaggttgtaaatgtcttaaaatccttattgtcaaatcttgatgaagtaaagaaggaaagagagggtctggagaatgacttgaaatctgtgaattttgacatgacaagcaagtttttgacagccctggctcaagatggtgtgataaatgaagaagctctttctgttactgaactagatcgagtctatggaggtcttacaactaaagtccaagaatctctaaagaaacaggagggacttcttaaaaatattcaggtctcacatcaggaattttcaaaaatgaaacaatctaataatgaagctaacttaagagaagaagttttgaagaatttagctactgcatatgacaactttgttgaacttgtagctaatttgaaggaaggcacaaagttttacaatgagttgactgaaatcctggtcaggttccagaacaaatgcagtgatatagtttttgcacggaagacagaaagagatgaactcttaaaggacttgcaacaaagcattgccagagaacctagtgctccttcaattcctacacctgcgtatcagtcctcaccagcaggaggacatgcaccaactcctccaactccagcgccaagaaccatgccgcctactaagccccagcccccagccaggcctccaccacctgtgcttccagcaaatcgagctccttctgctactgctccatctccagtgggggctgggactgctgcgccagctccatcacaaacgcctggctcagctcctcctccacaggcgcagggaccaccctatcccacctatccaggatatcctgggtattgccaaatgcccatgcccatgggctataatccttatgcgtatggccagtataatatgccatatccaccagtgtatcaccagagtcctggacaggctccatacccgggaccccagcagccttcataccccttccctcagcccccacagcagtcttactatccacagcagtaatatgtctgctcagcagctcagctgattcagatcagagggaaagaaataccaaccctgcaataagtgtactaaactctacgctctggttaatgtaatgtactctcctggactgaatgcagtgtataatttctgtctacagctagaagctgtgccccagttccacatttgattacacatgtgagatttgctgctgttgcagtataaacactaggtataataggatttgaaattgcattacagttcataaaaattgaaaatgagaaattaaacctgcaagtgaaacatttgaaacgattatactttctacataagacatggttgggacatcagatacttacaaagatggtttaagtatggatactagagaaaattaagttttctttctctttggtttattgatttggtttaatttccattatgctattttgcataatcaaggcactgtaaatcttataattttaaaataaattacttaag

SEQ ID NO: 44259 - DNA, 4193 bp, Homo sapiens
gaactcctaggctcaggtgatcctcctaaagtgctgggattgcaggttgtaaatgtcttaaaatccttattgtcaaatcttgatgaagtaaagaaggaaagagagggtctggagaatgacttgaaatctgtgaattttgacatgacaagcaagtttttgacagccctggctcaagatggtgtgataaatgaagaagctctttctgttactgaactagatcgagtctatggaggtcttacaactaaagtccaagaatctctaaagaaacaggagggacttcttaaaaatattcaggtctcacatcaggaattttcaaaaatgaaacaatctaataatgaagctaacttaagagaagaagttttgaagaatttagctactgcatatgacaactttgttgaacttgtagctaatttgaaggaaggcacaaagttttacaatgagttgactgaaatcctggtcaggttccagaacaaatgcagtgatatagtttttgcacggaagacagaaagagatgaactcttaaaggacttgcaacaaagcattgccagagaacctagtgctccttcaattcctacacctgcgtatcagtcctcaccagcaggaggacatgcaccaactcctccaactccagcgccaagaaccatgccgcctactaagccccagcccccagccaggcctccaccacctgtgcttccagcaaatcgagctccttctgctactgctccatctccagtgggggctgggactgctgcgccagctccatcacaaacgcctggctcagctcctcctccacaggcgcagggaccaccctatcccacctatccaggatatcctgggtattgccaaatgcccatgcccatgggctataatccttatgcgtatggccagtataatatgccatatccaccagtgtatcaccagagtcctggacaggctccatacccgggaccccagcagccttcataccccttccctcagcccccacagcagtcttactatccacagcagtaatatgtctgctcagcagctcagctgattcagatcagagggaaagaaataccaaccctgcaataagtgtactaaactctacgctctggttaatgtaatgtactctcctggactgaatgcagtgtataatttctgtctacagctagaagctgtgccccagttccacatttgattacacatgtgagatttgctgctgttgcagtataaacactaggtataataggatttgaaattgcattacagttcataaaaattgaaaatgagaaattaaacctgcaagtgaaacatttgaaacgattatactttctacataagacatggttgggacatcagatacttacaaagatggtttaagtatggatactagagaaaattaagttttctttctctttggtttattgatttggtttaatttccattatgctattttgcataatcaaggcactgtaaatcttataattttaaaataaattacttaagaacagttgtcattgttatgttttgttattgattctcattactgtctaattttttttctggtattagtctcattttgtatgtatataagttaaacagatactgtttttaagtgcatgaatagtacaagttattatcaaggatgttttacagggaaatcaaaagaatattatcatactttatctttcgtatgctgattagtaaacgatttttgacatttattttagaaagtcctataatgtggaagaaacaaacagttgctaccaaagattcttcaaataaacatacaaataaatgtgtatatttaatgttttattgttagcttctccagaaaattgatgcaaattctggtaataattcttgcattttttccccataacctggttaaaataaatacgccattggcaatacttcataatgtaatggaattgtttggggaacacttactgtaccctctcatcctttttccaccttactgtgttaacttagtgacatttaatgcccaatatgtatgaatagatctaagccatttaattttttttccttaaagattggactattttataattcaaggagcatacaaaacaatggttgggaacatatgccaattatggaataggctatgtatttaatattaatctctgccattaggatatctactcactgtataaacctcagtaaaaatagtgaagacatgcatcatggaatgagaaaatgagaaaggaatgagttgtctaacatcacagtgggatctgttttttgtgaggttcatttctgaacacattaggcatatgagcagatttccagtgaatctatttatgtttattttctgagtttcaacgctgaccttttcttgcattattgtttcattttaatgatagtgttacttgtcccactgttgttttcattgagtttggatttatattttaaatgttcgaatgaaagtatgattgtaaaagggagtgaattggtttaaaaatatatgtatattttaaactttgttgtgtgtaggaaacatgaaggcatgttaattcaatataaatgacctttgatttcatggaatattaaagttggtttaaagtccaatagttaaaccttagcaaaaatagctttttactttatcagttgctaagatttaatactttggattcatcaaagtgtgacatgggcttgtttgacttctgtaagtggcatttaagttccacattcttattacttgaggtactttatactaacataagacagtgagagttagaggtattacaagttgctagtttataatgtcttactaatgcagaaacaaggaaaaaagcaaaattggcctgaatattctcttggggaaagagggcaccaaagaaaagggtaagtgcatctgagggccaaaagagatgtataagccttttagcccattccccatgctgggcctgctcacagagccacaggaagatcattcagaaactaggaaaggaggcccccacagctgatcctgccacagcacacctgactcactcggctctgttagtgtaaccttttaaatgtagcaacacaaaccctttccctcttgtcagttcactcatcctttggtttctttttaatcacctgtgtctgggcacagacaatcacaataaatgcagccctttattactgttaaggatcatactgttggtttggagttggaagggtactactctgtgattcaggtgtgttgtacccatatttataattaggctttattatcttcctaaatcaaggaaaggaaatcatccccagaccatttatgctgagctttggaatactattttaaactggattgtacttaaataatgaagctctgcatagaggaactagtcagaagtggggaaaacactgtctaatttttatcagtctggtataaagtattgatctaagagaactctccctgtgccccttggtctttattctcaattaagaaaaacagtcacatgtcacgacaaaccaatcaatctttatgagatattcctgtatccataccccagcttgtttgcaatttataaacctccccttcaaaactaaggagttgcagaaaaaaatggatttcacagagccttgtgtccctaaagttctgtcccagtcagcagtctttatagtccaaacagattataaaaaatgttttccatttgaactttacagtttgcaaaagtgcttttatacattttctaatttcagaaacaggataatataatttgttaagtgggtttcagtttgctaatagggattttttgtgttttgttttttaattttcagcatctcttgaagaatcttgctacagccaaatggcatctcactttttaaagacgtttgcaattattagttgattcacagtacagaacaaggtataaaggaaaaaaccctgctaggtagtgttataattgctagattaaaaatagactagaacaggttcattttaagatttacttggaagagcaaagaaggaaaaattatatttttaaagaaagagaatattcaggctttatttctggtatgaagtttatattttttaaaaaaatcctatattatcacaccagagattttagattcttttctggttagaaacattgctggtagttggattatatttttattgtattcatttatcttagggggaacattgtaaagaaacaaaaaggtccagatgaatgtatgctagaaataaaagttgaaagattctt

SEQ ID NO: 44260 - DNA, 3876 bp, Homo sapiens
gaaacaggagggacttcttaaaaatattcaggtctcacatcaggaattttcattagctactgcatatgacaactttgttgaacttgtagctaatttgaaggaaggcacaaagttttacaatgagttgactgaaatcctggtcaggttccagaacaaatgcagtgatatagtttttgcacggaagacagaaagagatgaactcttaaaggacttgcaacaaagcattgccagagaacctagtgctccttcaattcctacacctgcgtatcagtcctcaccagcaggaggacatgcaccaactcctccaactccagcgccaagaaccatgccgcctactaagccccagcccccagccaggcctccaccacctgtgcttccagcaaatcgagctccttctgctactgctccatctccagtgggggctgggactgctgcgccagctccatcacaaacgcctggctcagctcctcctccacaggcgcagggaccaccctatcccacctatccaggatatcctgggtattgccaaatgcccatgcccatgggctataatccttatgcgtatggccagtataatatgccatatccaccagtgtatcaccagagtcctggacaggctccatacccgggaccccagcagccttcataccccttccctcagcccccacagcagtcttactatccacagcagtaatatgtctgctcagcagctcagctgattcagatcagagggaaagaaataccaaccctgcaataagtgtactaaactctacgctctggttaatgtaatgtactctcctggactgaatgcagtgtataatttctgtctacagctagaagctgtgccccagttccacatttgattacacatgtgagatttgctgctgttgcagtataaacactaggtataataggatttgaaattgcattacagttcataaaaattgaaaatgagaaattaaacctgcaagtgaaacatttgaaacgattatactttctacataagacatggttgggacatcagatacttacaaagatggtttaagtatggatactagagaaaattaagttttctttctctttggtttattgatttggtttaatttccattatgctattttgcataatcaaggcactgtaaatcttataattttaaaataaattacttaagaacagttgtcattgttatgttttgttattgattctcattactgtctaattttttttctggtattagtctcattttgtatgtatataagttaaacagatactgtttttaagtgcatgaatagtacaagttattatcaaggatgttttacagggaaatcaaaagaatattatcatactttatctttcgtatgctgattagtaaacgatttttgacatttattttagaaagtcctataatgtggaagaaacaaacagttgctaccaaagattcttcaaataaacatacaaataaatgtgtatatttaatgttttattgttagcttctccagaaaattgatgcaaattctggtaataattcttgcattttttccccataacctggttaaaataaatacgccattggcaatacttcataatgtaatggaattgtttggggaacacttactgtaccctctcatcctttttccaccttactgtgttaacttagtgacatttaatgcccaatatgtatgaatagatctaagccatttaattttttttccttaaagattggactattttataattcaaggagcatacaaaacaatggttgggaacatatgccaattatggaataggctatgtatttaatattaatctctgccattaggatatctactcactgtataaacctcagtaaaaatagtgaagacatgcatcatggaatgagaaaatgagaaaggaatgagttgtctaacatcacagtgggatctgttttttgtgaggttcatttctgaacacattaggcatatgagcagatttccagtgaatctatttatgtttattttctgagtttcaacgctgaccttttcttgcattattgtttcattttaatgatagtgttacttgtcccactgttgttttcattgagtttggatttatattttaaatgttcgaatgaaagtatgattgtaaaagggagtgaattggtttaaaaatatatgtatattttaaactttgttgtgtgtaggaaacatgaaggcatgttaattcaatataaatgacctttgatttcatggaatattaaagttggtttaaagtccaatagttaaaccttagcaaaaatagctttttactttatcagttgctaagatttaatactttggattcatcaaagtgtgacatgggcttgtttgacttctgtaagtggcatttaagttccacattcttattacttgaggtactttatactaacataagacagtgagagttagaggtattacaagttgctagtttataatgtcttactaatgcagaaacaaggaaaaaagcaaaattggcctgaatattctcttggggaaagagggcaccaaagaaaagggtaagtgcatctgagggccaaaagagatgtataagccttttagcccattccccatgctgggcctgctcacagagccacaggaagatcattcagaaactaggaaaggaggcccccacagctgatcctgccacagcacacctgactcactcggctctgttagtgtaaccttttaaatgtagcaacacaaaccctttccctcttgtcagttcactcatcctttggtttctttttaatcacctgtgtctgggcacagacaatcacaataaatgcagccctttattactgttaaggatcatactgttggtttggagttggaagggtactactctgtgattcaggtgtgttgtacccatatttataattaggctttattatcttcctaaatcaaggaaaggaaatcatccccagaccatttatgctgagctttggaatactattttaaactggattgtacttaaataatgaagctctgcatagaggaactagtcagaagtggggaaaacactgtctaatttttatcagtctggtataaagtattgatctaagagaactctccctgtgccccttggtctttattctcaattaagaaaaacagtcacatgtcacgacaaaccaatcaatctttatgagatattcctgtatccataccccagcttgtttgcaatttataaacctccccttcaaaactaaggagttgcagaaaaaaatggatttcacagagccttgtgtccctaaagttctgtcccagtcagcagtctttatagtccaaacagattataaaaaatgttttccatttgaactttacagtttgcaaaagtgcttttatacattttctaatttcagaaacaggataatataatttgttaagtgggtttcagtttgctaatagggattttttgtgttttgttttttaattttcagcatctcttgaagaatcttgctacagccaaatggcatctcactttttaaagacgtttgcaattattagttgattcacagtacagaacaaggtataaaggaaaaaaccctgctaggtagtgttataattgctagattaaaaatagactagaacaggttcattttaagatttacttggaagagcaaagaaggaaaaattatatttttaaagaaagagaatattcaggctttatttctggtatgaagtttatattttttaaaaaaatcctatattatcacaccagagattttagattcttttctggttagaaacattgctggtagttggattatatttttattgtattcatttatcttagggggaacattgtaaagaaacaaaaaggtccagatgaatgtatgctagaaataaaagttgaaagattctt

SEQ ID NO: 44261 - DNA, 109 bp, Homo sapiens
aaacccatagaatcttttctaaagcagtgactcttttgcggtacattacactgtgctttatttagcattagtgttgtgggaaaaatcacattctaagaagaattgagct

SEQ ID NO: 44262 - DNA, 326 bp, Homo sapiens
gcctagtaagacaggggataggacacttataccacctgagaaatttggaagggctcatgcaagttggtaatatctctttttttctggagtataaatctccaacttcttctgtatggatcactttgtatttgcagagagcccacaaagcgtcattgtttttgaaagcattgcctcttgaaaataaatctgtgtcctttccctcgcagcaggcgctaccaagaccttttctgagggctcaaaccagacagatggagtaagcggccatgaagtaatactaacttacaattactgctctgtatttttaagttaataaataaataattctt

SEQ ID NO: 44263 - DNA, 404 bp, Homo sapiens
tctatccaaagatggccttagttgttatgtgtctcttgcaaatttgccattaactcctctctcacaagtaggactcagcccccatttccttctccttataggattttttggaaactgtttcaaccattgatgaaagagattatatttctgtgaaaatcttagatggattttatttgtaactaattcttggtatattttacttattagtatcaatttctcaagtcaacggtaatattcatctattcatgcttagaaggattttggctgtaatttcaggactgtttctcttcttttagctttgatactatagtatacaaaatactctcacattcatggtttccttcggtagaggtagggaaggggacatttataaataaaagggctttgagatcctaaaatgtatg

SEQ ID NO: 44264 - DNA, 409 bp, Homo sapiens
atcagcacaatctaacaggaagtcctttggaagagatctccagaggcacagaatctagtggcagctctgaaacagatttcttcagcgaccttgggtgtagactttcagtgccttattcatctaaaacttaaggcggacgagacctactttttccatgtctcattgaaatgtgatcaagattaatggcctaacatagaaaacgtttccagcaccttgaaagaccaggcacattattcaatgcctgcctctataaatctggcaaaaatcagtctaattcacttgtcaggaaaaatgttcacttaaaaccatataattttagaacttgatgtttagaaaatgatcgaatccagtgtttttcaaaatgtccttcagaccgatagtgttatctgagacttagggaatagttgac

SEQ ID NO: 44265 - DNA, 1776 bp, Homo sapiens
acaattcagtaggttccctttgtttttgccttttattgcttaaaatggtaattgaaatagctaaattattatttgaaaataggccaatttatatagataatagaattttataagggtgatttatattccaaataatggcccccttttttttttcaaggccttttcaaatagtgtcaacaggtgatctttaatttaactgcattagatgacatatggattacttttgtttttaggaaataacccccaccttaatctatattgccgaccaggtgcggtggctcaaacctgtaatcccagcattttgggaggtcgaggcgggtggatcacctggggtcaggagttcgagaccagcctggccaacatagtggtctctactatagtatagtagaatatatactactacaccctgtctctactaaaaatacaaaaattagctgggtattgtggcaggtgcctgtaatcccagctactcgggaggctgaggcaggagaatcgcttgaacccaggaggcagaggttgcagtgagccaagatcacgccactgcactccaccctgggcaacagagcgagactccgtctcaaaaaaaaaaaaagtctgtattgccattaataagaaaaccttagaaaaatttgtacttcatagttctttctgctcaattagctgttagcattagtgtaaaatatagtttttaataatttctgtacaaagcctttgtacagaaaggcttcatccttaaagtgatgagaatggagtcaaaaaggattcaggtgtttagaggagctgcttttcattaggaccttggagagtcccctcagttttgacacccttgtttcaccacaagaaagcacccgacaccctgggttgcatacttactactcaggggctttccccccagctttcagagcactgaattattgtgagctggtgactctgcaggcctgagtggtattagggttgtggaatgttgttgcatacacgtttatgagttaaccactatttaaatgatgctgctttttaaagttttttcaaagtacaatagatttttgaagtttcaggtaactggaaaaatctttaacttttgctttaagtgtttggggcaggataaaacaacatagaaaatataaaacaatttttgctttgaaaaatacagtgcaggtgaccatttactgcttattctgtaatccttactgtctataattaacttcagtaacactgaaacttgatgaaaagttttaaaaaattatttactgtagggacaaagttatatggaatgtttgttattttctatactatctgaatgcactgccagtgaagactgtaaagacagaacacactattttggagggaggatactaattgtttaaaatttttcatcatttgtgagtgataaaaagtttgtatagtttttataataaatccctattttgaaaaaaaatgctaaaaaaaaaaaaataaaaaaaaaaaaaaagggggggaaaaaaaaaaaaacaaagggggggaaaaataacaatcagctcaccaagatgacccataaaaaggccgacacatagaacacccaacgcaccgccattaaaagcgccaccctgcacacccacaccccgggcccctggacagccaccccaatcaggagagcaccaacgccaccctcctgcgacagcgcccagcacacaaatacctctacgggacaacaccaaccacgtctaaagccagccagaccccaccatacggcactaccagtacaaccacgctcgcccgaccaccatatcacccgcacaa

SEQ ID NO: 44266 - DNA, 1483 bp, Homo sapiens
acaattcagtaggttccctttgtttttgccttttattgcttaaaatggtaattgaaatagctaaattattatttgaaaataggccaatttatatagataatagaattttataagggtgatttatattccaaataatggcccccttttttttttcaaggccttttcaaatagtgtcaacaggtgatctttaatttaactgcattagatgacatatggattacttttgtttttaggaaataacccccaccttaatctatattgccgaccaggtgcggtggctcaaacctgtaatcccagcattttgggaggtcgaggcgggtggatcacctggggtcaggagttcgagaccagcctggccaacatagtggtctctactatagtatagtagaatatatactactacaccctgtctctactaaaaatacaaaaattagctgggtattgtggcaggtgcctgtaatcccagctactcgggaggctgaggcaggagaatcgcttgaacccaggaggcagaggttgcagtgagccaagatcacgccactgcactccaccctgggcaacagagcgagactccgtctcaaaaaaaaaaaaagtctgtattgccattaataagaaaaccttagaaaaatttgtacttcatagttctttctgctcaattagctgttagcattagtgtaaaatatagtttttaataatttctgtacaaagcctttgtacagaaaggcttcatccttaaagtgatgagaatggagtcaaaaaggattcaggtgtttagaggagctgcttttcattaggaccttggagagtcccctcagttttgacacccttgtttcaccacaagaaagcacccgacaccctgggttgcatacttactactcaggggctttccccccagctttcagagcactgaattattgtgagctggtgactctgcaggcctgagtggtattagggttgtggaatgttgttgcatacacgtttatgagttaaccactatttaaatgatgctgctttttaaagttttttcaaagtacaatagatttttgaagtttcaggtaactggaaaaatctttaacttttgctttaagtgtttggggcaggataaaacaacatagaaaatataaaacaatttttgctttgaaaaatacagtgcaggtgaccatttactgcttattctgtaatccttactgtctataattaacttcagtaacactgaaacttgatgaaaagttttaaaaaattatttactgtagggacaaagttatatggaatgtttgttattttctatactatctgaatgcactgccagtgaagactgtaaagacagaacacactattttggagggaggatactaattgtttaaaatttttcatcatttgtgagtgataaaaagtttgtatagtttttataataaatccctattttgaaaaaaaatgctaaaaagcctcattaaatattttcataaaatttttcagattatat

SEQ ID NO: 44267 - DNA, 1070 bp, Homo sapiens
cagaaattcactatgaccatacgtatcggctcgcgatcccgatctggtaagtgaccctgtgcttacataggtgtccccctagtgagcatcctgataatgactacgtagcttgctgttctctgcatacttaaacataacgccacgggggtctacacccgcaaccagttcttgagcaacactctgagatgtagtgcatcgaggtcgattccctggagtcctttcaaatgggtgtgtccaaggtcggaggcatctgattgtcagcataccagcgtcgatgatgttaaccactatttaaatgatgctgctttttaaagttttttcaaagtacaatagatttttgaagtttcaggtaactggaaaaatctttaacttttgctttaagtgtttggggcaggataaaacaacatagaaaatataaaacaatttttgctttgaaaaatacagtgcaggtgaccatttactgcttattctgtaatccttactgtctataattaacttcagtaacactgaaacttgatgaaaagttttaaaaaattatttactgtagggacaaagttatatggaatgtttgttattttctatactatctgaatgcactgccagtgaagactgtaaagacagaacacactattttggagggaggatactaattgtttaaaatttttcatcatttgtgagtgataaaaagtttgtatagtttttataataaatccctattttgaaaaaaaatgctaaaaaaaaaaaaataaaaaaaaaaaaaaagggggggaaaaaaaaaaaaacaaagggggggaaaaataacaatcagctcaccaagatgacccataaaaaggccgacacatagaacacccaacgcaccgccattaaaagcgccaccctgcacacccacaccccgggcccctggacagccaccccaatcaggagagcaccaacgccaccctcctgcgacagcgcccagcacacaaatacctctacgggacaacaccaaccacgtctaaagccagccagaccccaccatacggcactaccagtacaaccacgctcgcccgaccaccatatcacccgcacaa

SEQ ID NO: 44268 - DNA, 2228 bp, Homo sapiens
agcggcgcattctgggattacttcttttccgtgggagtaaggaagtgcttttgaatgaggtactgagggccaaggtgttggaagttcctaattctttcctcggttaactgtgaaactctgcgtattgggaaggcctggcctcagtcatcaggccaggagaggtactggacgccgcgcacgcactcgtctgccagcgaggcccaaaggggaagcctagcggagctcagtgtggcagctgctggcctctgggccgctacttgtcaataccatgctttcctgtaatatttgtggtgaaacagtaacctcagaaccagacatgaaagctcacctaattgttcacatggaaagtgaaattatatgtccattttgcaagttgtcaggtgtgaattatgatgaaatgtgttttcatatcgaaacagctcattttgagcagaatacacttgaaagaaactttgagaggataaatacagtacaatatggaacttcagataacaagaaagacaacaccctacagtgtggaatggaagttaattcaagtattctttcaggttgtgcatctaatcatccaaaaaattcagctcaaaacctgactaaagatagtactttaaaacatgaaggcttctattcagagaacttaactgaatctagaaaattcctgaaaagtagggaaaaacagtccagcctgaccgaaataaaaggatctgtttatgaaacaacatacagtcctcctgaatgtccattctgtggaaaaatagaggagcacagtgaagatatggaaactcatgtgaaaacaaagcatgccaatcttttagacattccattggaagactgtgatcaaccactctatgattgtcctatgtgtgggctcatatgtacaaattaccatattcttcaggaacatgttgacttgcatttggaagaaaacagctttcagcaaggcatggatagagtccagtgttctggtgatctacaattggctcaccagcttcagcaagaagaagacagaaagaggagatctgaagaatcaagacaagaaatagaagaatttcagaagctgcagagacaatatggtttagataattctggaggatacaaacaacaacaactacgaaatatggagatagaagtaaataggggaagaatgcctccatctgaatttcataggagaaaagctgatatgatggaatcattagctcttggttttgacgatggaaaaacaaaaacttccggaattattgaagcacttcataggtattatcagaatgctgccacagatgtgagacgggtgtggctttcttcagtggtggatcactttcattcatctttaggcgacaaaggttggggttgtggttacagaaatttccaaatgctactttcatcattattacaaaatgatgcttacaacgattgcttaaaaggtatgttgattccttgcattccaaaaattcaatctatgattgaagatgcatggaaggaaggttttgatcctcagggggcctctcaacttaataacaggttacagggaacaaaggcctggattggagcatgtgaagtatatatactcctgacctccctaagggtaaagtgtcatattgttgattttcacaaatcaactggtcctttgggtacacaccctcgcttatttgaatggatattgaactattattcttcagagggagaagggagtccaaaggtagtgtgtacatctaaacctcctatctatcttcagcatcaaggtcacagtcgaactgttattggaattgaagagaaaaaaaaccgaacattatgcttactaatacttgatcctggatgtccttctcgagaaatgcagaaattattaaagcaagacatagaggctagcagtctcaagcaacttcggaaatctatgggaaatttaaaacataagcaataccagatattggcagtagagggtgctctttctctagaggagaaacttgccaggagacaagcttctcaagtctttacagccgagaagattccttgaagaatcaagcatttaagcatttcagtgattgagaacaatactttgttttctaaatgtagatattgaactccttaatacaattatgaatctgtgaattctcttaagtcttaacatataatttaatttctaaaatgcctgtgttaattgaattatacctatcatacttcattgtttggtaaattatttcaataaaatgtcttgtttttgcattgtgaaaaatgtt

SEQ ID NO: 44269 - DNA, 2070 bp, Homo sapiens
agcggcgcattctgggattacttcttttccgtgggagtaaggaagtgcttttgaatgaggtactgagggccaaggtgttggaagttcctaattctttcctcggttaactgtgaaactctgcgtattgggaaggcctggcctcagtcatcaggccaggagaggtactggacgccgcgcacgcactcgtctgccagcgaggcccaaaggggaagcctagcggagctcagtgtggcagctgctggcctctgggccggttgtgcatctaatcatccaaaaaattcagctcaaaacctgactaaagatagtactttaaaacatgaaggcttctattcagagaacttaactgaatctagaaaattcctgaaaagtagggaaaaacagtccagcctgaccgaaataaaaggatctgtttatgaaacaacatacagtcctcctgaatgtccattctgtggaaaaatagaggagcacagtgaagatatggaaactcatgtgaaaacaaagcatgccaatcttttagacattccattggaagactgtgatcaaccactctatgattgtcctatgtgtgggctcatatgtacaaattaccatattcttcaggaacatgttgacttgcatttggaagaaaacagctttcagcaagtggcattgtttaaataatcattatggtggcttagaagtggaaaaatcctatatgaatgttagaagcccactgaacgaaaataaaaagtagatcccaagagaaaccaattgtgttttaccctatttcagttttttaaggcatggatagagtccagtgttctggtgatctacaattggctcaccagcttcagcaagaagaagacagaaagaggagatctgaagaatcaagacaagaaatagaagaatttcagaagctgcagagacaatatggtttagataattctggaggatacaaacaacaacaactacgaaatatggagatagaagtaaataggggaagaatgcctccatctgaatttcataggagaaaagctgatatgatggaatcattagctcttggttttgacgatggaaaaacaaaaacttccggaattattgaagcacttcataggtattatcagaatgctgccacagatgtgagacgggtgtggctttcttcagtggtggatcactttcattcatctttaggcgacaaaggttggggttgtggttacagaaatttccaaatgctactttcatcattattacaaaatgatgcttacaacgattgcttaaaaggtatgttgattccttgcattccaaaaattcaatctatgattgaagatgcatggaaggaaggttttgatcctcagggggcctctcaacttaataacaggttacagggaacaaaggcctggattggagcatgtgaagtatatatactcctgacctccctaagggtaaagtgtcatattgttgattttcacaaatcaactggtcctttgggtacacaccctcgcttatttgaatggatattgaactattattcttcagagggagaagggagtccaaaggtagtgtgtacatctaaacctcctatctatcttcagcatcaaggtcacagtcgaactgttattggaattgaagagaaaaaaaaccgaacattatgcttactaatacttgatcctggatgtccttctcgagaaatgcagaaattattaaagcaagacatagaggctagcagtctcaagcaacttcggaaatctatgggaaatttaaaacataagcaataccagatattggcagtagagggtgctctttctctagaggagaaacttgccaggagacaagcttctcaagtctttacagccgagaagattccttgaagaatcaagcatttaagcatttcagtgattgagaacaatactttgttttctaaatgtagatattgaactccttaatacaattatgaatctgtgaattctcttaagtcttaacatataatttaatttctaaaatgcctgtgttaattgaattatacctatcatacttcattgtttggtaaattatttcaataaaatgtcttgtttttgcattgtgaaaaatgtt

SEQ ID NO: 44270 - DNA, 886 bp, Homo sapiens
gacccacgcgtccgcggaccgcgtgggtcgacccacgcgtccgaggagaacttagatacatatgtgtcagagttttgttctagaacagtttttgttctttcatttgagataatttgaataagaaggatcaaaggattgggaaaggaaaagtaaaatatttggcagaataaaaatgttttttttggtaatgaagcctttagaaaactaaagttaaatgaaaaaactgaagtagaactaaactcttacgtcttaggagaacttagatacatatgtgtcagagtctgactgtatttatattctaaacacacatatgatcacacaacatacatacagagactatttgtataactgtaaatagatgtgacgtatgtataacttaaaaatcttttgataggtcacagtcgaactgttattggaattgaagagaaaaaaaaccgaacattatgcttactaatacttgatcctggatgtccttctcgagaaatgcagaaattattaaagcaagacatagaggctagcagtctcaagcaacttcggaaatctatgggaaatttaaaacataagcaataccagatattggcagtagagggtgctctttctctagaggagaaacttgccaggagacaagcttctcaagtctttacagccgagaagattccttgaagaatcaagcatttaagcatttcagtgattgagaacaatactttgttttctaaatgtagatattgaactccttaatacaattatgaatctgtgaattctcttaagtcttaacatataatttaatttctaaaatgcctgtgttaattgaattatacctatcatacttcattgtttggtaaattatttcaataaaatgtcttgtttttgcattgtgaaaaatgtt

SEQ ID NO: 44271 - DNA, 442 bp, Homo sapiens
ggctggaaaaatgtttattcctaatttcagaagtttgagattgcaatttttctttaggaattttcattattatcttgaaaaaaaattccagattttattttttacattagaatgacaacacatattctaattaattgacttatagcttaaaattgttttttaaaatttcttttcaaggccaggagacaagcttctcaagtctttacagccgagaagattccttgaagaatcaagcatttaagcatttcagtgattgagaacaatactttgttttctaaatgtagatattgaactccttaatacaattatgaatctgtgaattctcttaagtcttaacatataatttaatttctaaaatgcctgtgttaattgaattatacctatcatacttcattgtttggtaaattatttcaataaaatgtcttgtttttgcattgtgaaa

SEQ ID NO: 44272 - DNA, 2365 bp, Homo sapiens
agcggcgcattctgggattacttcttttccgtgggagtaaggaagtgcttttgaatgaggtactgagggccaaggtgttggaagttcctaattctttcctcggttaactgtgaaactctgcgtattgggaaggcctggcctcagtcatcaggccaggagaggtactggacgccgcgcacgcactcgtctgccagcgaggcccaaaggggaagcctagcggagctcagtgtggcagctgctggcctctgggccgctacttgtcaataccatgctttcctgtaatatttgtggtgaaacagtaacctcagaaccagacatgaaagctcacctaattgttcacatggaaagtgaaattatatgtccattttgcaagttgtcaggtgtgaattatgatgaaatgtgttttcatatcgaaacagctcattttgagcagaatacacttgaaagaaactttgagaggataaatacagtacaatatggaacttcagataacaagaaagacaacaccctacagtgtggaatggaagttaattcaagtattctttcaggttgtgcatctaatcatccaaaaaattcagctcaaaacctgactaaagatagtactttaaaacatgaaggcttctattcagagaacttaactgaatctagaaaattcctgaaaagtagggaaaaacagtccagcctgaccgaaataaaaggatctgtttatgaaacaacatacagtcctcctgaatgtccattctgtggaaaaatagaggagcacagtgaagatatggaaactcatgtgaaaacaaagcatgccaatcttttagacattccattggaagactgtgatcaaccactctatgattgtcctatgtgtgggctcatatgtacaaattaccatattcttcaggaacatgttgacttgcatttggaagaaaacagctttcagcaagtggcattgtttaaataatcattatggtggcttagaagtggaaaaatcctatatgaatgttagaagcccactgaacgaaaataaaaagtagatcccaagagaaaccaattgtgttttaccctatttcagttttttaaggcatggatagagtccagtgttctggtgatctacaattggctcaccagcttcagcaagaagaagacagaaagaggagatctgaagaatcaagacaagaaatagaagaatttcagaagctgcagagacaatatggtttagataattctggaggatacaaacaacaacaactacgaaatatggagatagaagtaaataggggaagaatgcctccatctgaatttcataggagaaaagctgatatgatggaatcattagctcttggttttgacgatggaaaaacaaaaacttccggaattattgaagcacttcataggtattatcagaatgctgccacagatgtgagacgggtgtggctttcttcagtggtggatcactttcattcatctttaggcgacaaaggttggggttgtggttacagaaatttccaaatgctactttcatcattattacaaaatgatgcttacaacgattgcttaaaaggtatgttgattccttgcattccaaaaattcaatctatgattgaagatgcatggaaggaaggttttgatcctcagggggcctctcaacttaataacaggttacagggaacaaaggcctggattggagcatgtgaagtatatatactcctgacctccctaagggtaaagtgtcatattgttgattttcacaaatcaactggtcctttgggtacacaccctcgcttatttgaatggatattgaactattattcttcagagggagaagggagtccaaaggtagtgtgtacatctaaacctcctatctatcttcagcatcaaggtcacagtcgaactgttattggaattgaagagaaaaaaaaccgaacattatgcttactaatacttgatcctggatgtccttctcgagaaatgcagaaattattaaagcaagacatagaggctagcagtctcaagcaacttcggaaatctatgggaaatttaaaacataagcaataccagatattggcagtagagggtgctctttctctagaggagaaacttgccaggagacaagcttctcaagtctttacagccgagaagattccttgaagaatcaagcatttaagcatttcagtgattgagaacaatactttgttttctaaatgtagatattgaactccttaatacaattatgaatctgtgaattctcttaagtcttaacatataatttaatttctaaaatgcctgtgttaattgaattatacctatcatacttcattgtttggtaaattatttcaataaaatgtcttgtttttgcattgtgaaaaatgtt

SEQ ID NO: 44273 - DNA, 348 bp, Homo sapiens
gagtgcagtggcgtgatctcggctcactgcaaggtccacctcccgggttcacgccattctcctgcctcagcctcccacatagctgggactacaggcgcccgccaccatgccccgcgaattttttgaatttttagtagacacagggtttcactgtgttagccaggatggtcttgatttcctgacctcgtgatccgcccacctcggcctcccaaagtgctgggattacaggcgtgagccaccgtgccctgccctggattgttatttttttaaacataagtagctttttaaaaattataaaagtaaaaatgctcattttataaaaattaaggaagctcagggaatataagt

SEQ ID NO: 44274 - DNA, 198 bp, Homo sapiens
gagataggttcttgctctgtcactcaggctggagtgcagtgatgtgatcctagactcaatcatattattcgaattcaatacaaatctattcaatatttgaatgtctaagtacccaacactgtgtcaggtgatattattttttatggggagaaaatttcaagttcacttaagcaaagacattctttaaggcttctttat

SEQ ID NO: 44275 - DNA, 448 bp, Homo sapiens
tgcatttacttttatgagtaagttttataattatcttagatttcaagatagttctgttgcgatttcactaattgcttcaacattttatattattttgagaaagaaatgtcattgttatgaactgcatcgttttccacaatatcccaaatttttatgttgaagtcctaactcccagtacctcagaatgtgactgtatttgaagacagggcttttaaaggagtaattaaaatgaggtaattagggtgagccctaatccaatgggacattagtccttctaagaagataaaatttagacataagtaggtacagaggaaagaccaagtgaagacacagagagatgatggccatctacaaaccaaggagagagcctcagaagaaactccccttgctgataccttgatcttagacttctgcctccagaactgtgagaaaataaatttgtattgtt

SEQ ID NO: 44276 - DNA, 208 bp, Homo sapiens
gcagcttgcctaggcatagcaaagctggcatggcatgacctcttagagagttgaggattgattaaatttgtgtttcccaggctccattcttggctacccagagaaggctgcttggccaaagagtgttaatgaatgcctgcttgttgccctcattatttgctctgttccagtaagttgtcgtttccattcatgttggaaagtatttggg

SEQ ID NO: 44277 - DNA, 441 bp, Homo sapiens
atttggatacctacagattggtggcttgaaagaaatgtacccgttcctccccccaagtgtgtatgatgtccaccagaagtaagaagaccatagaaaggagaaatttgaagtcagaattgttgtttgtaagcaatgacatcccctccaaatgttcctacaaaatattttattccagtccttacaaaaatttttttgatagttgttttaggtctctgacttgtattttgccttattaccctaattggcaagtaaattctacagattgttatttatcatttaggtatctattttaaaggaagagtttattgtttctgtgttaaaataatgcacaatgaataaaaatgaaaaaataaataaaatatttaaagactggaagaaaaaatatattctcattttcagacaatataattatcacatactaaatcccttaaaaaaaaaaaa

SEQ ID NO: 44278 - DNA, 391 bp, Homo sapiens
cacccacttccgcctccaggcaatgccgaattgggagcttggggaagatgaattgcctgactggttaaagcagggtacagtgggagctgagcttccagcgcggggccctgcgggcctagggcgcatgcgcgaggcgcggccggcccgtacccgtctcgacacccagctggagctcgagactcggggatctagagtttgaagcctggcgcgagatgcggtatacccgagaccggtgaactccagtcacttgacctggtcggatgtgaattgcgcagaaaaaagccattccatatccaccagtgtccatgtgaaaccttaacgaaataaagacggaaattaatgtagactgtttggatttgccctgaaaactatcaatctaactcatgattta

SEQ ID NO: 44279 - DNA, 237 bp, Homo sapiens
ccctgtgatgtttgcactggactcagtttgcttgggagatgcaatctttggttcataacatgggtaacatgtcaatgtagacaaagggtgacctatgctgcatagtttaatgcccaggtctcctggcctgacactgacattgtggatcctagatcatttcagataatggcaacagacactaaacaatgcaacatcgtttcaggtctaggattgctatagcgacttactctgtgacct

SEQ ID NO: 44280 - DNA, 409 bp, Homo sapiens
acccctcgagatgacacgcagtgaccaatttcctcttaaaactcccttcttttcaaaaaccctatgatccatgcaccctctgtctaatcctctgcgatggggccagtctgcagatccgtctgggcgggctgcggtagcattctccacctgccaacactcagttgctggtgagtaaccagcatacggactctcacttcctgtgagtatttctgaaagagcttatgatatttccttcaaaaaaaaaaaattgtggggaggaaagccactcggggaggagaagcaacttcaacaagcaaagctaaaagcatgcaacgtgatcactgttgaccagacacgcctaattttaatttggtttctcaacccctgtgtaattaagacagcccaaagagaacagcatcaagaggaaaga

SEQ ID NO: 44281 - DNA, 361 bp, Homo sapiens
agatacatgagactttgcatttcatttattcaggactgcaacattttgaatatggatgattttgaactccctatttactatttactaagtgatgatgtacttttcaggcggctagccacctgcgttatgtcccattattaacgtaatccaggaagttgcttagagagcatagaattgtgtaacaagaatttcatctaggcaatagaaaccagtttattcctaacccaaacctagtgaccagaaaaagaggcctgtaactctgcagtccggaccagtagttgctgtttacttttccagtgatgcgagacaaactcttaacatttttatttaacttaaaaactaacattcacttgccagtctt

SEQ ID NO: 44282 - DNA, 400 bp, Homo sapiens
tatatgccaggccctgtgctgaggacagaggttacggtagaatataggacttggaagatccctgttctaatggacttagctttcttgaagggaaggcagataataaataagaacattaataagattaatttcagatagtttctttctatgaaggtcaaaaggtacacacttgtagttatgtagaatgagcaaatttggatatctaatacatatgaggactacagttgatgatattgtgtactgcaagtttgctaagggtgtagacgttagggattcctaaccacacacacacacaacccactgactctgtgaggtgtgtaaatttgcttgactatagtaatcatttcacttggtatatgtatatcaaaacatcaagctgtacatgttaaatatatacact

SEQ ID NO: 44283 - DNA, 384 bp, Homo sapiens
attttcatcctgagcctcttattcccaccttcagtcacttcagaaactcccctgcactccattcaactttctggacctcccctttaatgtttgccatttgtgcattctacagctcggtgcacttgttttctgacctcaagagtcaggagaggagctatcccagcttcaattcctcatcaataaggtacagaaaatactctctaggattactgaagaaatgaaataagcaactgtattttaagtattttatgtactgtaaaagcattgtgcgtccgggtgcagtggttcatgcctgtaatcccagcactttaggaggccgaggcaggcagatcatctgaggtcgggagtgactggccaacatggtgaaaccccatttctactaaa

SEQ ID NO: 44284 - DNA, 255 bp, Homo sapiens
tccaaacccgcgcggggcgggggctcatttgtatgccgcaccctggatacaagtgataaggccccaaacactccaaggagaccgcacagatgaaacccggcgctgctcgctcaggaggcgagatatttatagaatccaaatatcagcattttctccccatttacacaaagcaatttcagccttttcagatgagaaaagagcagccccggccgtcattcattcgggtgcgggaatcacatttgggaccaggaagcc

SEQ ID NO: 44285 - DNA, 418 bp, Homo sapiens
ttggggaaatgttagctgacagagctgagagatcagattttcatgttctatcactgtaatggaacctcatttagacctctctagacctttgctagctgtgtggtctgaggaccagtaagtaggattggcattatctggtatcttgttaaaaatgcagaatttcatgccactctaggtctactaaatcagaatttgcattcttaacaaggttcccaagtgatttttatgagaagaaagtatcagagtgcaaacaaattactcgtctaatatgtagaattcccagtggtctcacagccctagatcaaatgtgtcagacactagatcattataatcttcattggttttgacagctaattaattagtttaataatattgacatatggcttcttaagtatttgaattctagattgctaatgat

SEQ ID NO: 44286 - DNA, 429 bp, Homo sapiens
agaaaagaaaaaaaagcagaagtttttttctcctgatttcccggcagccgagccgcggttcggggcgcgcgcgggatttccagcgcgcgaggcggcccggactttcgggggggcctggaatcccctcccgatccgcggagagtcccggaccgcgcctttcccaagttctgctgggggtggaggggctgcaccgggaaggggccccgtttgcagcgtgatctcgcccaggtggtggtgagggccggagtctctcctggctgcgacgaccccagcccctgggtgatttcgcttctcccggcctctctgttcccgtctgagtaatgggtctgcagcgccggcctcgctggtttgcagagcatggcataaaatacggctgacagtaagagcccaatacacatcagctgtcacctggtggtcgcgggaggcctc

SEQ ID NO: 44287 - DNA, 555 bp, Homo sapiens
gatgagccaaaacttgaggagccgggtaatgccattaactgagatgacgtcgactggagaagaacaggctgtcttgcaaatgtttgagtagcctactccacttttgcataaagctatcaaatgggcagttgcatatgagtctggagctcaaagaagagatcaagacaggaaatgtaatcaggaagttagtagcatatggatggcatttaaagctagggatgaaattggcttatgagcgaatgtaagctgaggagagaagagggcccagaaccaagcctgcagcactccagcatctggtggtctggaagggatggagacaatagcaaaagaaactgaggaggtgggagaacactagagggaactgtttcaagaaaccaccagttgggtcaaatgctgcttaaggattaggatgaaaacagagaagtggtctctggatttggcaacatgatgattgttggtggtgttgattgtgtaatggggggtccagaagccaaattggaatgggttcaagagtgaatgcgaagcgagggagtaggaatctgtaggagttaaatc

SEQ ID NO: 44288 - DNA, 442 bp, Homo sapiens
gcctcgaactcttggactaaagcaatcctccctcagcctcccaagtagctgagactataggcatgcaccaccacacccagctaatttttaatttatattttgtagagatagggtctttccatgttgcccaggctggtctcaaattcctgggctcaagcgatcctcctgcctcagcctctcaaagggctggaattacaggcctgagccaccacacccagctgcaaaaacttttgaggactgggaggcagatggaggaaagctgtttcttcccatgtagtccctgccacgctaagactctggcattcctggacctggcaaaaatgcccctcccctcccctccaaggcatggaagccacccaacttcaaggagccactttgggcttgagaaatagaatgagggagcggtgggtgattaattataatgggtaacactccacttaac

SEQ ID NO: 44289 - DNA, 351 bp, Homo sapiens
aaaagcctaccctgcctacttttaggggttgttattaaaaaccaaagcactttgtaaatggtaacacacaatgtaagtgtaaatggttttctttgtaattatactacagaattaacattagtataataaagaactttgtccatatccacattaagattttgagtgaagctataatatacatatttatgaaactgaaactcaagcatattttctattactggcaaatatctgtgtcagacagaacgtctctacttaacaagaactaagtcatcagtaactaattgtcaatacagtaaggtggctatgattcaagcaagcacttaacagatgtatgagtcacaataattcact

SEQ ID NO: 44290 - DNA, 399 bp, Homo sapiens
gacagagtcagagagattggcagtgataatctttacacgtgctttctccttatgtcattttacatttggagcaatcccttgaactcataggatgagtattgttagttccattttacagacaagaaaagaaggctcagagtagtgaaatgacttgccctttgagtagttgatgtctaactccaaatatttattccactattttctctactaatcatgggtatttctcatcaccattgctatgcctgtggggtaggaatttttatccctgttttcagggggggaaaacactaggggttttaaggaaacttttcccccttggataatccctcgattcagtaggttgtgcccgggtacccaacccggggacctctttgtaggggtcacacttcaatccctaac

SEQ ID NO: 44291 - DNA, 437 bp, Homo sapiens
acccctgtgagaggagggtaggcctaagagtgaagtcagaagagagaaaaccagaagcaagagatggaaagacagacatcgagtcttctcaatatcattttaccctgaagtcaccctgaccctggacttactggttaattgagccaataactttccataatggcttaagccagtttcggttggggttctggcacttgccaccaagatagtcctgattagggaagatctcaggttcaattttacacgcagtaaatttgagatacctcagagtggagacatcaagttggctgatgcaaatgtgggtctaatctagaggtttaaattggtaattctcctttgtatagatggaaagtgaattccccgtgcaaaagcagaagatgggtcttcattgaacatttgatgaataaatgaatgaaggcataaacaaatgaatacaa

SEQ ID NO: 44292 - DNA, 353 bp, Homo sapiens
gctcatctggcaagtttaaatcactccggaaacatacagagctgcagtcattggtttgacaagaacagaaagatacttgtctctgttgttgctagtattaaaagagaatttattggccgggcgcggtggctcacacctgtaatctcaactctttgggaggctgaggcaggcggatcatgaggtcaggaggtcgagaccatcctggctaacacggtaaaaccctgtctctactaaaaaatacaaaaaaattagctgggcgtgatggcgggctcctgtaatcacagctactctggaggctgaggcaggagaatggtgtgaacccgggaggtggagcttgcagtgagccgagtttg

SEQ ID NO: 44293 - DNA, 1085 bp, Homo sapiens
agggaaacgaaattatccaccctatttctggaaaaaatatcctgcaatttgtagccatcaaaaggaaggactgtggagaataggcaatcccagggggtatggtggatccaggagagaaaattagtgctacattgaagagagaatttggcgaggaagccatgaactctttacagaaatctaggaaagaaatgcaggagttggagagacaattgcacaaactcctcagtcaggaacattttgaggtctataaaggctacgtggatgattctagaaacacagataactgctggatagagacagaggctgtgaactaccgtgatgaaataatggaccatcttcctctggaagctggcgatgatgccaagaaagtgaaatgggtggacattaatgataaacttgagctttatgccagcctctcccaatttattcaacttgtggctgagaaacgaggtgcccactgatgtgaggatatgtatcctgattgccagggatagtagcttggagtctcatgtgaccaaaggccttcaaatgatcaagagtggataagaggcaaacagcacataactcccactaaacaggacagggagggtcacctctttggtgattacttccaaaactgtgctgtgtgaaggctttgtattaaggaataataatagacaaatacggggaaatgggatcaccagaattttggctttcctgttagaagaagaatatactcatatgctgtatatattgtatacatggtttaaactaacttacacagctactgctctttggagaattgtaagaaaaacaatgacatcttccttaacaaccatagcctctacttttcagccagtttgcatttgtcaattcttctttctcctgatgttttaatgtggcataatctaatgtataatctgacttttgagttaacatttattttttaaatttagctttatgtggtcttgtattccttccttttgagtatgggagctctctggcttttcctttttgtttttttagagcttcagttttatgggaaaagttcaatctctattttggtccacaaggatcaagtgcttatgaaccagaccaaaaaaaaa

SEQ ID NO: 44294 - DNA, 459 bp, Homo sapiens
gtgtggtgcctcacacctgtaatcccaggtactcaggaggctgaggcaggagaatcacttgaacccaggaggtgaaggttgcagtgagccaagatcacgtcactgcactccaacctgggcaacagagcaactccatctcaaaaaaagaaaaatttgaaatagcagtagacttccaaatctgttagaaggccttgtttttagaatagggcaaatgtttgctttagtcagagcttgactggatgagatatgttaggagagtaacagtctcctcttgctacttgtttctgagcaggtaatctaaaaaggaaagccctatactactccagaggtattttcattgcaaaagaaatgtttccaaggtggcccttctttgcacctgttcaataaatgacctttaacattaacagcaacatgaatcaggctgaattaagaaaacatgggtaggccgggtgtggtggc

SEQ ID NO: 44295 - DNA, 2664 bp, Homo sapiens
  misc_feature (72)..(72): n is a, c, g, or t
  misc_feature (251)..(251): n is a, c, g, or t
ctccaggaaacagagtgaagacactggccctggcaggcagcagctgggtctaagagagctgcagcccagggncacagacctgtgggccccatggccgggaaggcggcagaggagagagggctgccgaaaggggccactccccaggatacctcgggcctccaggatagattgttctcctctgaaagtgacaacagcctgtacttcacctacagtggccagcccaacaccctggaggtcagagacctcaactnccaggtggacctggcctctcaggtcccttggtttgagcagctggctcagttcaagatgccctggacatctcccagctgccagaattcttgtgagctgggcatccagaacctaagcttcaaagtgagaagtgggcagatgctggccatcatagggagctcaggttgtgggagagcctccttgctagatgtgatcactggccgaggtcacggcggcaagatcaagtcaggccagatctggatcaatgggcagcccagctcgcctcagctggtgaggaagtgtgtggcccacgtgcgccagcacaaccagctgctccccaacttgactgtgcgagagaccttggccttcattgcccagatgcggctgcccagaaccttctcccaggcccagcgtgacaaaagggtggaggacgtgatcgcggagctgcggcttaggcagtgcgctgacacccgcgtgggcaacatgtacgtgcgggggttgtcggggggtgagcgcaggagagtcagcattggggtgcagctcctgtggaacccaggaatccttattctcgacgaacccacctctgggctcgacagcttcacagcccacaacctggtgaagaccttgtccaggctggccaaaggcaaccggctggtgctcatctccctccaccagcctcgctctgacatcttcaggctgtttgatctggtcctcctgatgacgtctggcacccccatctacttaggggcggcccagcacatggtccagtatttcacagccatcggctacccctgtcctcgctacagcaatcctgctgacttctatgtggacctgaccagcattgacaggcgcagcagagagcaggaattggccaccagggagaaggctcagtcactcgcagccctgtttctagaaaaagtgcgtgacttagatgactttctatggaaagcagagacgaaggatcttgacgaggacacctgtgtggaaagcagcgtgaccccactagacaccaactgcctcccgagtcctacgaagatgcctggggcggtgcagcagtttacgacgctgatccgtcgtcagatttccaacgacttccgagacctgcccaccctcctcatccatggggcggaggcctgtctgatgtcaatgaccatcggcttcctctattttggccatgggagcatccagctctccttcatggatacagccgccctcttgttcatgatcggtgctctcatccctttcaacgtcattctggatgtcatctccaaatgttactcagagagggcaatgctttactatgaactggaagacgggctgtacaccactggtccatatttctttgccaagatcctcggggagcttccggagcactgtgcctacatcatcatctacgggatgcccacctactggctggccaacctgaggccaggcctccagcccttcctgctgcacttcctgctggtgtggctggtggtcttctgttgcaggattatggccctggccgccgcggccctgctccccaccttccacatggcctccttcttcagcaatgccctctacaactccttctacctcgccgggggcttcatgataaacttgagcagcctgtggacagtgcccgcgtggatttccaaagtgtccttcctgcggtggtgttttgaagggctgatgaagattcagttcagcagaagaacttataaaatgcctctcgggaacctcaccatcgcggtctcaggagataaaatcctcagtgccatggagctggactcgtaccctctctacgccatctacctcatcgtcattggcctcagcggtggcttcatggtcctgtactacgtgtccttaaggttcatcaaacagaaaccaagtcaagactggtgattcacgccagacgtctgcccgctggtgggggacctgagcagacccttcaactgcactccctcctcaggagccccttcctggggacagtgaggacaatgaccctacagatgctcagctacatccggcccagggtgctgcagtggcacagaccagccacaggatggcagtagaataaagacagtcgaaagggatttctgctcactggcaggagactgcgatgactgggagaaaacctgcactcggtggcacctacaacgttgctaatttatttccttttgatatgcatttatataggcaactcgatataggatgggagcaaactaggaatgaattgggtagctagactgtgcaggaattgttggaacctggagggaacaataacagtagctagcagatttggcttcatcttccaggggccccacactccgtggtgagccaccatcaatacagaaagtgacctaagatgtaccagcaagatgccatcccttctttttgtgtggggtcatgggctccaaaagccaacgtgaacaattaaaaatgtattgagcatct

SEQ ID NO: 44296 - DNA, 3143 bp, Homo sapiens
  misc_feature (72)..(72): n is a, c, g, or t
  misc_feature (251)..(251): n is a, c, g, or t
ctccaggaaacagagtgaagacactggccctggcaggcagcagctgggtctaagagagctgcagcccagggncacagacctgtgggccccatggccgggaaggcggcagaggagagagggctgccgaaaggggccactccccaggatacctcgggcctccaggatagattgttctcctctgaaagtgacaacagcctgtacttcacctacagtggccagcccaacaccctggaggtcagagacctcaactnccaggtggacctggcctctcaggtcccttggtttgagcagctggctcagttcaagatgccctggacatctcccagctgccagaattcttgtgagctgggcatccagaacctaagcttcaaagtgagaagtgggcagatgctggccatcatagggagctcaggttgtgggagagcctccttgctagatgtgatcactggccgaggtcacggcggcaagatcaagtcaggccagatctggatcaatgggcagcccagctcgcctcagctggtgaggaagtgtgtggcccacgtgcgccagcacaaccagctgctccccaacttgactgtgcgagagaccttggccttcattgcccagatgcggctgcccagaaccttctcccaggcccagcgtgacaaaagggtggaggacgtgatcgcggagctgcggcttaggcagtgcgctgacacccgcgtgggcaacatgtacgtgcgggggttgtcggggggtgagcgcaggagagtcagcattggggtgcagctcctgtggaacccaggaatccttattctcgacgaacccacctctgggctcgacagcttcacagcccacaacctggtgaagaccttgtccaggctggccaaaggcaaccggctggtgctcatctccctccaccagcctcgctctgacatcttcaggctgtttgatctggtcctcctgatgacgtctggcacccccatctacttaggggcggcccagcacatggtccagtatttcacagccatcggctacccctgtcctcgctacagcaatcctgctgacttctatgtggacctgaccagcattgacaggcgcagcagagagcaggaattggccaccagggagaaggctcagtcactcgcagccctgtttctagaaaaagtgcgtgacttagatgactttctatggaaagcagagacgaaggatcttgacgaggacacctgtgtggaaagcagcgtgaccccactagacaccaactgcctcccgagtcctacgaagatgcctggggcggtgcagcagtttacgacgctgatccgtcgtcagatttccaacgacttccgagacctgcccaccctcctcatccatggggcggaggcctgtctgatgtcaatgaccatcggcttcctctattttggccatgggagcatccagctctccttcatggatacagccgccctcttgttcatgatcggtgctctcatccctttcaacgtcattctggatgtcatctccaaatgttactcagagagggcaatgctttactatgaactggaagacgggctgtacaccactggtccatatttctttgccaagatcctcggggagcttccggagcactgtgcctacatcatcatctacgggatgcccacctactggctggccaacctgaggccaggcctccagcccttcctgctgcacttcctgctggtgtggctggtggtcttctgttgcaggattatggccctggccgccgcggccctgctccccaccttccacatggcctccttcttcagcaatgccctctacaactccttctacctcgccgggggcttcatgataaacttgagcagcctgtggacagtgcccgcgtggatttccaaagtgtccttcctgcggtggtgttttgaagggctgatgaagattcagttcagcagaagaacttataaaatgcctctcgggaacctcaccatcgcggtctcaggagataaaatcctcagtgccatggagctggactcgtaccctctctacgccatctacctcatcgtcattggcctcagcggtggcttcatggtcctgtactacgtgtccttaaggttcatcaaacagaaaccaagtcaagactggtgattcacgccagacgtctgcccgctggtgggggacctgagcagacccttcaactgcactccctcctcaggagccccttcctggggacagtgaggacaatgaccctacagatgctcagctacatccggcccagggtgctgcagtggcacagaccagccacaggatggcagtagaataaagacagtcgaaagggatttctgctcactggcaggagactgcgatgactgggagaaaacctgcactcggtggcacctacaacgttgctaatttatttccttttgatatgcatttatataggcaactcgatataggatgggagcaaactaggaatgaattgggtagctagactgtgcaggaattgttggaacctggagggaacaataacagtagctagcagatttggcttcatcttccaggggccccacactccgtggtgagccaccatcaatacagaaagtgacctaagatgtaccagcaagatgccatcccttctttttgtgtggggtcatgggctccaaaagccaacgtgaacaattaaaaatgtattgagcatctactctgtagcaggtcctgtgaaaacactttaggtggacaatcccttgaggtaagtggtatcccattttataggtgtgaaaactgaagcaaaaattcattttcctaagggcacatggatactttgtggtggagtcatatggggatcagaaaagcctttgaggcctttggagttagagggcagaaggcaaggcctgagccgctgtaagccttaggagtttaggaaggctccagaagacaaatggggtctgtagaggctgttaactcagccaggcttcttagagttgcatttcactaactgatatggtttggctctgcgtcctcacccaaatctcaccttgaattgtaataatccccaagtgtcaaggggcgggaccagatggagataattgaatcataggggtggtttctctgatgctgttctcctgagagtgagtgagttctgatgagatccgatggttttataaggggcttccctcttc

SEQ ID NO: 44297 - DNA, 335 bp, Homo sapiens
catgataaaagtaacaatcatttattgagtacctactgtgggacagatgctgtcatcagttttctgatttaatcctcagagccactctatgaggcaggtattaccatccccattttgcataggagaaaaatgaggcttatggagactgtgacattcccagggtcacggggctggtgtatgctgttgcctcagcatctcttccttttggtttttaagtcgtcagatttccaacgacttccgagacctgcccaccctcctcatccatggggcggaggcctgtctgatgtcaatgaccatcggcttcctctattttggccatgggagcatccagctct

SEQ ID NO: 44298 - DNA, 546 bp, Homo sapiens
atttatatttgacagcagaacacgagctacagacttgcaaaacctgaagagcctcatcaaacatctaaattgggatggctttactgtgcctatttaaaaaaaaaaatgagagacttgggcaatatgataactactttgaattgtattaagagagtctccaaaacagaagcactgtagatttattctacttcttcattctcttttcctttcccttactttttaggttactcagagagggcaatgctttactatgaactggaagacgggctgtacaccactggtccatatttctttgccaaggtgactgggcagggttgagagcaagtgcccccccccaccaccagggtgggggtaagtgtggagaaaacgttgctacaaggaaggcttttctgaaccatggggccgtgggtcatgtgaagtcaccgatgccaccagatgccacattttctaggggagtttcagagacttgaacttttattttaaacatttaccaaaacaccaggactgtggaccaggaatgatagttttctggccagaaggaatcta

SEQ ID NO: 44299 - DNA, 1262 bp, Homo sapiens
gaagtgggtggtagggatctagaacaacactgctctgcactctgacaattccaagcgcagactcctgtaaaagcttggacagagctacttaaatcccacatgccagccctgcttaggttggcagatcatgagaccatgactgtgtctgggaaggcaagggcagaggcctttgtctgctttttgggttacaaaagtggattgggctggcacctacagctatgaataaaaggggaagagaaggcaacaaaagagagggagtgactggggtggaggtaaaaatatcttttcctctagaggggactttagagaaatttcttctcctaggtctttcctatacatgtggctttttctccttttctcatgtctcagtcactggccatggggcacagaggctggaggataacagaagcaatgcgagagtgaagtccaggcatctcaggctaaacccactgccacccaagcatggaactgacagcatgcagagccaggtggctggaagttgggcaaaaggggcaactggaggagagttggggagaggcaaccatgagaataaggcagaggatttataggagaatatggcccagagcccttggggataggccacacaggacacagcagatggtccccaagctggcctgatcctcccatcccgtttaataaggagtcaggattatgtgctcaatacctgaggtcctcttcagttcagcattctccagtctggaagaagggactctagagagccaggggaaatgtctgtgtatatgtacatgcatgcacagacacttattaacacacatctacttatattcggggcctcagcctgagtagccaaagaacagccaaaaaactagaagagatgctggagagtatgaggttcagagaggggattttagaagcagaggggctaagtccaaactcagaagtttactacagctgtgtgaccttgtgcaagtgacagcctccctagacctccaatcccttgctggttgaatggagcaaataatagtgttaacctctcaaaggccaggagagagccctgagccacttccacttagaggctcctgtatacttcacaacaaagaacagaaaagttagattatcatagtgtgacgtattttaagtgtttaaagaaaaattttaggccaggcatggtggctcacacctgtaatctcagcactttggatgaccaaggcaggcagatctcctgaggtcaggagttcgagaccagcctgaccaacatgatgaaaacccccatctctact

SEQ ID NO: 44300 - DNA, 618 bp, Homo sapiens
gtaaatgcttgcaggtttctctggcccagcccaggctggagaggagattggctttgctgtcgataaacaagtccctggtgcagcatcaaagctgttctgctttatcaatcgtggcccccccttcccgcatgttcctgtaacttaccaagcatttatgacattgattttacagtcgggctgttaaccctcccgccccttcaggcctgccaacctttttggcccaagctatcaatcagatgtcatccagccaatcagaagcatccctaagaagagccgccctgcagtctcacctgtatcccggctcagccttgcgaggaagtcccattgcgtttgctgtttggtttggtttggtttggtttggtttgggtttggtttactgtagtcatctctgttttaagtcagtatgtcctttctaaggctcatggaactttgtggttgcaaaatctgaagttataaatggagagataggggtatgtgtttgcatgtgtgtattagacacatcatagctttattcttccaaaaagttatttctccctgagacttctggtaaacctgccttccccagtttttcccgagggggagctgttgtctcattgtgcagtcaataatcaagaaatg

SEQ ID NO: 44301 - DNA, 664 bp, Homo sapiens
ggatgttaaatttttatagttattgcatgattgatgtgtttccttttcccacagaactaaagcatgttaaagatgctatttgaatttaattctgggaacataataaaaatagcattggggcattgaggagctcagaggcacaggcctcatcagccctgctttaatacctgagcagcaagaggttacaggtggcttctcctccctcccaggggacctcagtaggtagaggagagaggaggcacacagtcaggggaccctgaggccagagccacaccaggggattctgctgccccagtcccttcccacaggcttgtttgtccattgacaggaacagttgcacgtacaaaatcaactttgctttcccatcctctgtaaaatgtagtgcccagcctctttattatgcattttattactcccatttagaattatattgctatcaggaatgggtttcttgagaactggagcggaagaaaggctgtgtcccacgatatgtgatcctgctaataaagtggatgatcagacacaaagccaagttcatcttcccaccttggggccaccacagagccacgtggtaaccccctttttctgaaggaacggcattgaggcccaggccatgtgcatttccccctgggctgcctcctctgaccccaggattccagctctt

SEQ ID NO: 44302 - DNA, 310 bp, Homo sapiens
ctccccattttgacttctgggttgctggaaacctcaaccagcccacagaccaagggccttccatgggcaggagtcttaaaggacagttcttcctgtgtggccttgggcaggtcacccaagctctctccaaatctgtttcctcctccttaaagcaagacttctggctgggcacggtggctcacacctataatcccagctactcgggaggctgaggcaggagaatcacttgaacccggaggtggaggttgtagtgagccgagatcgcgccattgcactccagcccgggtaacagagcaagacttggactcaa

SEQ ID NO: 44303 - DNA, 533 bp, Homo sapiens
cgctggttgaaagtcaacaacaggtcacttcgattactggcaaagcagagtggtccaaaatgcagggctgagtcgaactcggttacaagtctaccgtggaagtcccagatccggactgagccatcaatgccacctgtgacaaaaagtttcaggggaaggcagacatcaaatgaagtgatgtcacactcatgcaggcattttgtctctctccacacaaagctctgttttgattctgaagatgtcagaaagccttcatagtgccagagacaccagcagtagctttcagtgatggcacccacagaacctggcaagagtatcacacgttttagggggcagccacagaggattttgctgacaggctgaaggactaccttgttcacctgaagcacggcctctgtcaagtgtatgatgttatccgtgccataggaacagagcaaggcgtttccctgagggccttccagggtagacaatgccaatactgccccagagtgaacagtcttctctattcgggcacaactatagtgggaaagggt

SEQ ID NO: 44304 - DNA, 416 bp, Homo sapiens
cacaccttgcagtagttaattggtatttgtggatcgaatgaacatgttaggtgcccactagcaggggttggtcctgtagtctgtggccatggaacattagaagaataaagctattgtggttcatcctgtagtatagtaagttcgagctgagctaacctgtaataacacaaatacaatttttttttttacgtttttaaaagttagagatgggttcttgctatgttgcccagggtagtctcaaactcctcgccttgagatcctcctgccttggctccccaaagtcctgcgattacaggcctgagccattatatttggccaacaaatagaattatttatttatttatttatttattttttgcgatggagtctcaccctgtcacctaggctggagtgcagtggcgtgatcttggctcatt

SEQ ID NO: 44305 - DNA, 2546 bp, Homo sapiens
ctagtcccgattatggttattacagtttgatgaaatgtggctgagatcattggcactgtggagattaagaaatgtgaggtcagagtgttgggtaaattgttcctgcgagtgttaaggttgtcaggataatggtgggaatggggtgaagatgacaactcagcaatgacacaagaagagagtgacacagaaagattcagtagctgagaacttgagcgtagatatgttgtgggcaggagggaaatgatttggatggaagtagccaagtaagtgagaaaggaaagactttccaacaaaacttggcttagctcactcagatccctgagctgcaaacttcttctatacctttcttaccttttccagtgctgctgacttcaccccacttgcagggcatttgtgcagatggttgtttgttgaggaggaatgtgcttaatgttttaggaaccagttacattcaaggatgcctctgtggccttcaccgaggaggagtgaggtcacctggactctgctcccaggaagctgtgcggagctgtgatgctgggcaactacagaaacttggtcttggagacttgaatgaaaattctgtggagaatcttcagcagaaaacacttcaggatctgttacatgagctttcctcctggctagttttggaaggcatggccagtacaattactggaagtcaggattgtattgtgaatcatcgaggggaagtggatggggagcctgaactagatatttccccttgtcaacagtggggagaagcatcttctcctatttccagaaacagggacagtgtgatgactcttcaaagtggttgtttcgaaaacattgaaagtgaaacatatttgcctttgaaagtctcaagccaaatagacacacaagactcttcagtgaagttctgtaagaatgagcctcaggatcatcaggaaagcagacgtctctttgtaatggaagaaagcactgagagaaaagtgataaagggggaaagttgttcagagaaccttcaagttaaactggtgtctgatggacaagaactggcctcgccattgttaaatggtgaggcaacttgccagaatggccagttaaaagaatctttggatcccattgactgtaactgcaaagacattcatggatggaaatcacaggtggtcagttgtagtcagcagagaggtcatacagaggagaaaccctgtgaccataataactgtgggaaaatacttaacaccagcccagatggtcatccatatgagaaaatccacactgcagagaaacaatacgaaggtagtcagtgtggtaagaacttcagtcaaagctcagagctactacttcatcagagagaccacacagaagaaaaaccctacaaatgtgagcaatgtgggaagggcttcacaaggagctcgagtctgcttatccatcaggcagtccacacagatgagaagccttataagtgtgacaagtgtgggaagggcttcaccaggagctcaagtctgctcatccatcatgccgtccatacaggcgaaaaaccttataaatgtgacaagtgtgggaagggctttagtcagagctccaaactgcacatccaccagcgagtccacactggagagaagccctatgagtgtgaggagtgtggtatgagcttcagtcagcgctcaaacctgcacatccaccagcgagtacacacaggagagaggccctacaagtgtggtgagtgtgggaagggcttcagtcagagctcgaaccttcacattcaccggtgcatccacacaggagagaagccttaccaatgctatgagtgtgggaagggtttcagccagagctcggatcttcgcatccatctcagagtccacactggagagaagccctatcactgtggcaagtgtgggaagggatttagccagagttccaaactcctcatccaccagagagtacatactggagagaagccctatgagtgcagcaagtgtgggaagggcttcagccagagctccaaccttcacatccaccagcgggttcacaagaaagatcctcgctaactgacattagcccattcaggtcttcacagcgctcatactgtaaaaactgttaaatatttagtatcactcttactttatattctacaaaggagagagatgtaagggttatttagatatgttccctcactgaaaaatcactcattcaaaatatttaagtatcaagcactttgttatgctgtacaatgaatggattgttcttgtttctcagatgggtagagtaaaagtgtctgtactttacaattcaactacttgttctacccagcattttaacggcaagaactttatatttattctcaagcagggcatgtttccctttgttcacattctctgagaaattgaaactctggtttctcttcaaaaaaagatatagtacaaagaaccccgggcttatacgcgggggcgggaaaagggtatggaaggggccaggggcaaaggtgttccggacccggtttttgacaagggggaaattgccggccccaaaaggggggataattccaaagccgggaacgtagaagg

SEQ ID NO: 44306 - DNA, 2198 bp, Homo sapiens
  misc_feature (2)..(2): n is a, c, g, or t
  misc_feature (4)..(4): n is a, c, g, or t
  misc_feature (7)..(7): n is a, c, g, or t
gncngcntccggaatctggcccctgcaggcgtggggttccacgtgggaggaatccatcccctctgggagtaagaaatgaccagggtccgggaaccagttacattcaaggatgcctctgtggccttcaccgaggaggagtgaggtcacctggactctgctcccaggaagctgtgcggagctgtgatgctgggcaactacagaaacttggtcttggagacttgaatgaaaattctgtggagaatcttcagcagaaaacacttcaggatctgttacatgagctttcctcctggctagttttggaaggcatggccagtacaattactggaagtcaggattgtattgtgaatcatcgaggggaagtggatggggagcctgaactagatatttccccttgtcaacagtggggagaagcatcttctcctatttccagaaacagggacagtgtgatgactcttcaaagtggttgtttcgaaaacattgaaagtgaaacatatttgcctttgaaagtctcaagccaaatagacacacaagactcttcagtgaagttctgtaagaatgagcctcaggatcatcaggaaagcagacgtctctttgtaatggaagaaagcactgagagaaaagtgataaagggggaaagttgttcagagaaccttcaagttaaactggtgtctgatggacaagaactggcctcgccattgttaaatggtgaggcaacttgccagaatggccagttaaaagaatctttggatcccattgactgtaactgcaaagacattcatggatggaaatcacaggtggtcagttgtagtcagcagagaggtcatacagaggagaaaccctgtgaccataataactgtgggaaaatacttaacaccagcccagatggtcatccatatgagaaaatccacactgcagagaaacaatacgaaggtagtcagtgtggtaagaacttcagtcaaagctcagagctactacttcatcagagagaccacacagaagaaaaaccctacaaatgtgagcaatgtgggaagggcttcacaaggagctcgagtctgcttatccatcaggcagtccacacagatgagaagccttataagtgtgacaagtgtgggaagggcttcaccaggagctcaagtctgctcatccatcatgccgtccatacaggcgaaaaaccttataaatgtgacaagtgtgggaagggctttagtcagagctccaaactgcacatccaccagcgagtccacactggagagaagccctatgagtgtgaggagtgtggtatgagcttcagtcagcgctcaaacctgcacatccaccagcgagtacacacaggagagaggccctacaagtgtggtgagtgtgggaagggcttcagtcagagctcgaaccttcacattcaccggtgcatccacacaggagagaagccttaccaatgctatgagtgtgggaagggtttcagccagagctcggatcttcgcatccatctcagagtccacactggagagaagccctatcactgtggcaagtgtgggaagggatttagccagagttccaaactcctcatccaccagagagtacatactggagagaagccctatgagtgcagcaagtgtgggaagggcttcagccagagctccaaccttcacatccaccagcgggttcacaagaaagatcctcgctaactgacattagcccattcaggtcttcacagcgctcatactgtaaaaactgttaaatatttagtatcactcttactttatattctacaaaggagagagatgtaagggttatttagatatgttccctcactgaaaaatcactcattcaaaatatttaagtatcaagcactttgttatgctgtacaatgaatggattgttcttgtttctcagatgggtagagtaaaagtgtctgtactttacaattcaactacttgttctacccagcattttaacggcaagaactttatatttattctcaagcagggcatgtttccctttgttcacattctctgagaaattgaaactctggtttctcttcaaaaaaagatatagtacaaagaaccccgggcttatacgcgggggcgggaaaagggtatggaaggggccaggggcaaaggtgttccggacccggtttttgacaagggggaaattgccggccccaaaaggggggataattccaaagccgggaacgtagaagg

SEQ ID NO: 44307 - DNA, 330 bp, Homo sapiens
tatcatcgaaaaaatctttgaggcagattaatttagaaaggacttcaaataatttaagtacttctcagaataattaacattaaaaaattacagaagtaatacacatcagtatttagcttgatgagttttgacaaatgattacctccttgtaaccaccattgcaatcaaaatgtaaatatttctgtcttcccaaaagttcctccatatccctttgcagtaaccccttcctgtccctaacccttaggcaaatattaatctgctttctttcattgatcagcttgccttttccagaatttcgtttaaatgtgatgacaatacatactccttttg

SEQ ID NO: 44308 - DNA, 398 bp, Homo sapiens
tgtctgaggggttttgtctgtggcttgtcctgctacaatgggagtgacatggaacagcctaggtgagtgctgtgcatcactgctaagggaccttgagcttgggaaaccctgtctgtaagaaaactcactcaacttttgccccaggagaaggtattttatacaaaaataatagaaaagatggtctgaaacaaaagctgttcagtgctgctgctcaccaaatgcacaaacctaagacccatggaaatctttctaccagcctatttcttcctccttccccactttctttaactaaaagagaaatttatgaattaatttcagtggagaagtagatggttttttaaccatcaaatacattataattttactagaaaaagtataagcattatacatatggatat

SEQ ID NO: 44309 - DNA, 451 bp, Homo sapiens
gtctttgagaagagtgttccagaagtgtaaatgagatcaagcaggttgatatgttgtttagataatctataccctgttgcttttctgcattagttctatcaattaccaagagagatatgttgaaatatctgattataattgtggatttgtctgttactttattgatctaacaggtttttactcacatacttagaagctgtattaagagcataatttaggtttgttctttccactggatgaactgtatccttcatcattatgatgatgtaactttctttatccctgatatagtctttttggtgaagtcactttgtttttaatatagccactccagctttcttttgactagtgttaggattttatatatttttccatccttttacttttaacctattagtgcttttatattttaagtattacctgtaggtagcacgtatttgggtctgacttt

SEQ ID NO: 44310 - DNA, 532 bp, Homo sapiens
gcagtatgatattactgtatcggacctgaatcagcccatgcttgttagtctgttaaagaagaagagaaatgacaacagtgagcctcagctcgcccacctgatacctgagctctgctttctaacagggctgactgaccaggcaacatctgatttccagctgatgaaggctgtggctgaaaagacacgtctcagtccttcaggccggcagcagcgcctggccaggcttgtggacaacatccagaggaataccaatgctcgctttgaactagagacctggggactgcattttggaagccagatatctctgactggccggattgtgccttcagaaaaaatattaatgcaagaccacatatgtcaacctgtgtctgctgctgactggtccaaggatattcgaacttgcaagattttaaatgcacagtctttgaatacctggttgattttatgtagcgacagaactgaatatgttgccgagagctttctgaactgcttgagaagagttgcaggttccatgggatttaatgtggactac

SEQ ID NO: 44311 - DNA, 690 bp, Homo sapiens
gctaactgttaaagatattaaaattattgtcatttggcaaccatcgtaataattgattcaggcaaaaatcatgaggggatactaaagttaatggatcaaagttcagtgaggaataggatatttacacagttacaaagggaaaaaaatagtaactttatagtggagaagcctggcagacacctcattcaagtgattaaagttatcaacagtaatgggacatactgacattatatgcctcctgagatgatgcactgagaaggcatcagttctttgttgtttctgtcaaaaatgaataatctgaatctagttatgagaaaacaacaaacccaaattaagggctagtcttcaaagtaactggcctggtctgtatatttcacaaatggcagtcatgaaagacatgccaaataacttctagattagagaataccaaagagacgtgacagttgaatacagtgtgtgatctgaagttttccctttttcgtatttcattgacatttttctcttctagtagctagatactgaagtagtatatttaaacagaaaaaaagtacttctaactaatagtctgaatacagcaatatatcaatgtcccctcctattttctagtttatgtggattttaatcagtattgcagatttggcttggggtgtgtgtgtgtgtgtgtgtgtgtgtgtgtgtgtgtgtatgtgt

SEQ ID NO: 44312 - DNA, 477 bp, Homo sapiens
tacaccaaggttgggagagggccagggccaagagaggttttctgctcttctgatactgacccgaggtaagtaactttttacttttatcctctctcattccttgtcagtttgtgaaatgtgaaaggtgattcccctaggacttggacatcttaggcagattgccttgccctgcaggatgctccagccttgtggacagagtggcatggcttcactgctttgcaggcacctccttcattgtcatttattcattcagcaaactgtatgagtggcgactatgtgccaggtcccgtgctaggcactggaggtgcagtggtgactttttttttctgctgttggtttatctgagtgaatgttcaagtaagtaggtgaggtggagttttgtgagtctgtgggaaggaaggaaattagcatcacacctttcttttatgagcctgtttttgtttacagctttggaactttttgaatgaaaattataaa

SEQ ID NO: 44313 - DNA, 432 bp, Homo sapiens
gttagggtagtttgttttttggcagtcttgtctcttcagatgtgatgtggggtgtttgccaatatactgaaaacgcagcatcacggctgtttctctgacctcagcatcctgaagtggtgtttcagctcctgctctccttacatcgttttaccagtaggtccagtgcatttagatttgtcattagcttttaaggtgaggtttgggcaaaatccattttattttggatgacttatcatcccactgattcttgactccttggtaattctgctaatgctaatttttttagcttcatatattttcattagggcttgaaagtctctgagcttttcttactgattgcatcctatccatggcattcaaatgtgtctgaatttcaacttgttgaaatcattgaaacttaaataaaaactgagaggttgttttatagttaaa

SEQ ID NO: 44314 - DNA, 1218 bp, Homo sapiens
aacttatccaaggtcacaaagacactttgacttcctttgaacccatgtctagtgactccagaaccagtctcttacctagtatgcccccctccgtgaggtagagctctgtggaagaggtagcattttaggctgaatttctttgtttcccaaaaggaagttggtttctatctttatcctttttttaaattaaacttttatttcctccaaggcaattattctaaatggagttccatacctagagctccctttcatattgtaaaaatagcacaactgatggcgtttcatggtgaagctgtgttggatcatcccagagaagctccgagacagggcaagtgaacaccagaccacaaaggacagctacagtgtcaccatctgtggaaactaggcttttcccccatgcacgccttttcctgattcttcctctgcatagagacatttggctactttttccatcatggtggttagaacaagaaaatttgggcggaaaatgggagttctcaggagccaagatttgggcctgggaaaggaaggatgaagaggagcagtttggagcggggcatgaggttagactctcaaggccaggtgggcttgctgagggcagtgatcctctgaggttgttgactcccagtggcaggtgaccccttatcaggacttgcctggtagaagtccctggactgagccagataactaaattgggaccattggtgcttgtgttgccttttgtaccgggtaccctttacgccttgtttgctttttgttggagatatttatctccttgtaaaaagtgcagttctttccctaccccagtcatgaggctctggctcagaggaggtacaagattgtagcaaaaaatttgagagctgggccaccctggggcctgccggaccaggggcatactggggccagtgtgcactctctgaagggacaactgtgatttattctggctaatcattgtcgtgtaggatcacaggctgattgctagcacatttgccagtttttcaaaagaaattagaacctatatttttaatcaaaagtcttttgatttgtaaatagtggcaaccaattcatatatgtcttcaatgtatagtgaaatctggtcagtaggctgcccctgctctctctgacgtagaacataccgattcaccctttgttttctgttcagagcagactacttcaaattaaggaaaagagtacaaaaccaacaacaaactctccatg

SEQ ID NO: 44315 - DNA, 1164 bp, Homo sapiens
aacttatccaaggtcacaaagacactttgacttcctttgaacccatgtctagtgactccagaaccagtctcttacctagtatgcccccctccgtgaggtagagctctgtggaagaggtagcattttaggctgaatttctttgtttcccaaaaggaagttggtttctatctttatcctttttttaaattaaacttttatttcctccaaggcaattattctaaatggagttccatacctagagctccctttcatattgtagaagctccgagacagggcaagtgaacaccagaccacaaaggacagctacagtgtcaccatctgtggaaactaggcttttcccccatgcacgccttttcctgattcttcctctgcatagagacatttggctactttttccatcatggtggttagaacaagaaaatttgggcggaaaatgggagttctcaggagccaagatttgggcctgggaaaggaaggatgaagaggagcagtttggagcggggcatgaggttagactctcaaggccaggtgggcttgctgagggcagtgatcctctgaggttgttgactcccagtggcaggtgaccccttatcaggacttgcctggtagaagtccctggactgagccagataactaaattgggaccattggtgcttgtgttgccttttgtaccgggtaccctttacgccttgtttgctttttgttggagatatttatctccttgtaaaaagtgcagttctttccctaccccagtcatgaggctctggctcagaggaggtacaagattgtagcaaaaaatttgagagctgggccaccctggggcctgccggaccaggggcatactggggccagtgtgcactctctgaagggacaactgtgatttattctggctaatcattgtcgtgtaggatcacaggctgattgctagcacatttgccagtttttcaaaagaaattagaacctatatttttaatcaaaagtcttttgatttgtaaatagtggcaaccaattcatatatgtcttcaatgtatagtgaaatctggtcagtaggctgcccctgctctctctgacgtagaacataccgattcaccctttgttttctgttcagagcagactacttcaaattaaggaaaagagtacaaaaccaacaacaaactctccatg

SEQ ID NO: 44316 - DNA, 434 bp, Homo sapiens
tttattgatagaatgggaaacttactgctggtaactagttaattctgaaagggttagggtttctactgtatacttccaaaagtacaggcctgggggagccaatatgagagacacacataaccaaaaatttgtaaaaactttattttttaataaaaattataaataaaaattataggccgggtgcactagctcatccctgtaattccagcattttgggaggctgaggcggactgatcacttgaggtcaggagtttgaaaccagcctgggcaacatgttgaaaccctgtctctactaaaaatacaaaaattagccatgcatagtggcacacacgtgtaatcccagctacttgggtggctgaggcacgagagtcgcttgagtccgggtggtggaggttgcagtgagccacgatcacgccactgcactccagcctggg

SEQ ID NO: 44317 - DNA, 360 bp, Homo sapiens
gatagatactcacctgcagggacagatccaagttttgtgagtcctcacatatataatttgtgtgtgtgcaggggggcttcttaaagaataagattacaaaattatgaatataataattaggtataggcaacgcatggtgggccacacctgtaaccccagcactttgggaggctgaggcgggtggattgcttgaactcacaggtttgagaccagcctgggcaatatggcaaaacccttgtctttactaaaaatacaaaaattagccgggtgtggtggcgcatgcctctaatcccagctactaggaggctgagacatgagacttgcttgaaccctggattgcagtgagccaaaatcgggcca

SEQ ID NO: 44318 - DNA, 387 bp, Homo sapiens
gaatttaataccgacctcacctataggggaatttgggcccctcgaggccccaagaattcggccaccgaggagtctagtataggaataagatgtgtatgcattataccccattataaaataggatggtttaaatgctaaatttaagtaacagtagcatgctgtggcagcggaagagaatgaacatttaattcagcttggagttagctggaatttgatggacaaaaaggattctgattctgaattggcttaggttctacttgatgtagaataggaaagtcatcccagactttaggaatgacagttttatgacacatcaaaaaaggtttattaggccctatgttaacactatcaatatacattttatgcagtcacttggtagtatacaca

SEQ ID NO: 44319 - DNA, 751 bp, Homo sapiens
ctgtctcaaagaaaaaaaaagaaaattggttagttttctaaattgcattgaaaattttataaataatagaagcccgagagaaagccacacagcaaaactttctctctctgccaatgaaatgtattattttcagccacctctttttaaaaacaatattatcttcattcctgtacccttcattttgctttgtatttttgagagcgctggttgccttaaaatcagtatctcaaatctctggcaaagttccttctgtttctttgactctatgaccctgatattttctagaggtagctggtgtcaatttgagaagcatccagaggagtgaatagaaaagaggccttagcattaaaaagactaaatttaaatccttgttccgccacttcctaactgtgtgaccttgggcaagttaatacacatgctgagcttggattaatcagtggaggcttgtaggacacctactgtgatggcaaattctgtttgtttctagcaggagagattttaaaaagaagttaaagaaaaaaatatgtgagactatgatattctcccatattatcaaaaacacttattttcctcaatgtaggaatagtgcaagcctgtcgacccagctattttagaggctgaagtgggagcatcacatgagcccaggagttcaagaccaggctttaagagaccctgtctcttaaaacagataacaaatgtaaagtttataggaaagattacatcatgttgattcagcaaatattttcctctc

SEQ ID NO: 44320 - DNA, 384 bp, Homo sapiens
aactaatgtaatataccatattaatagaataaaaacatatcagattattatctcaatgtgtgcaataaaataaatttgacaaaataacctgtacccaatcataataaaatctcaacaaattatgaacagattgaactctctcatcctgactaacagcatgaaagaaataaacactcaccttaaacatgaaagcttgaagagattgaatgctttgcctataatattggtagcaaagtaacaatgtctgttttcactacttttattcaacattgcactggagatgtcagacagtacagtcagataagaaattgcaataaaaggtatccaggttggaaaggaaaaagtaaaattctttttagtctcagactacatgatcctgtatgt

SEQ ID NO: 44321 - DNA, 451 bp, Homo sapiens
gataggtaaaatttcttgtgttagtaaaaaaactaaaaatgcctcttcatgaaagtattcagtcactgccaaaagttgtcaagtttctggagcctgagtgtgtggacaggtagggggtcctggggagcctggcctgaactctctggtccacttcaaaggcctcagagctcagtgcaggcagctgccccgagaacaaaggctgctcaagtgagaaggctttaacctcttccttgctgttgctcagccccgctggaaagagatgacgtgttaaattccacagtccatagctacaatttgcctgtgattttccagattgtcacttctctgtggtgattctgtaggaggcctgccataaaactgctgtgatcatctgtggtaacaagggtgggggcagagtaacaagggtctggaaacctcactttggctgtagccctctcctttcacaccttct

SEQ ID NO: 44322 - DNA, 436 bp, Homo sapiens
tcaagacaagagtctcattctttcacccaggctggagtgcagtggtgcgatcataactcactgcagcctggacctcctgtgctcatgtaatcctcccacctcagtttccccaagtagccgggactacaggcacgcgccaccaggcctggttgatttatttttattttttattgagacagggtcttgctgtttcccaggctaacccccacttctgttgtcccaaactggacatctggaaccccgatctccagcatcccatactatccaaccagatcccagtctgttaccccaactaggcaaccagacctataatggctgcagcctcaaactagccaactggtcaccccaggtcttccaccccaagccaaggccctgatccccccaactggtcaccccaggtcttccaccccaagccaaggcgctgatccccccaact

SEQ ID NO: 44323 - DNA, 348 bp, Homo sapiens
cttattgtgaagaaaagatactaaagcatgctgtaggtcagtcattttctagtgacagggattagaggactagaatccattcaatttttaaaactttacctacgaatagttagaaaatatatgcttgaaataatctcattctagtttattgttattgtttattttctaagccttctttacaaatatattttcccactgtaattcagtttaaatggatggtttttacttcttaataaaattattgactattgatttatatctgatacaatcctttgtagtattcaatgctgatgttgaaaaaattcagccacaatgaataaggagtgttcccaaggaccctcagacaaa

SEQ ID NO: 44324 - DNA, 1089 bp, Homo sapiens
ccggggaccacacgccgcgctgtccccagcacccaacccaggttaccatggcctccctgttctctggccgcatcctgatccgcaacaatagcgaccaggacgagctggatacggaggctgaggtcagtcgcaggctggagaaccggctggtgctgctgttctttggtgctggggcttgtccacagtgccaggccttcgtgcccatcctcaaggacttcttcgtgcggctcacagatgagttctatgtactgcgggcggctcagctggccctggtgtacgtgtcccaggactccacggaggagcagcaggacctgttcctcaaggacatgccaaagaaatggcttttcctgccctttgaggatgatctgaggagggacctcgggcgccagttctcagtggagcgcctgccggcggtcgtggtgctcaagccggacggggacgtgctcactcgcgacggcgccgacgagatccagcgcctgggcaccgcctgcttcgccaactggcaggaggcggccgaggtgctggaccgcaacttccagctgccagaggacctggaggaccaggagccacggagcctcaccgagtgcctgcgccgccacaagtctgactggtttctctacgactgccgcctcctcagacacgtggcccttggccttttctgctgtgggatctccgtctatttagcagcactgtccatctatgccttgctacttttcgagatcgagacaggcgcagcagctgcttccatcctcggctcgggcaccctggttctggtggctgtgctgacccacactctcctccgggctgcccgggctgcccgccgtgggctccatgagttgtccccgccatcctttgaagacgacctcgcccgccctgccgaagtctccaaggccagccccagagctcagcctcagcagggtatccatcgtcggaccccctattcaacctgtccagagcctggggaccctttgggtccatggccactgcacagcacctgcagccctggagggaggctgggagagcagcctgcctgcatccagaatgcaccggacactgtcggctggcctggggcactgggacggggttacg

SEQ ID NO: 44325 - DNA, 394 bp, Homo sapiens
ccctggtgtacgtgtcccaggactccacggaggagcagcaggacctgttcctcaaggacatgccaaagaaatggcttttcctgccctttgaggatgatctgaggaggtgaggaggggcagggagggcttcctggaggagggggcatgttcgctgaaagtgaagcatccattctaactagagtgaatgagcagcccctgtgtgccagtccatatactgggaactagggggtacagacaggggtgcccacttccacatgctggcttccatgccaccccagggagcttagagccgagtgagaggaacagatgcaaaagacagaatcaactatgtaatagcaaggccgggcatggtggcttaaccctgtaatcccaggactttggcaggccgaggtgg

SEQ ID NO: 44326 - DNA, 906 bp, Homo sapiens
ccggggaccacacgccgcgctgtccccagcacccaacccaggttaccatggcctccctgttctctggccgcatcctgatccgcaacaatagcgaccaggacgagctggatacggaggctgaggtcagtcgcaggctggagaaccggctggtgctgctgttctttggtgctggggcttgtccacagtgccaggccttcgtgcccatcctcaaggacttcttcgtgcggctcacagatgagttctatgtactgcgggcggctcagctggccctggtgtacgtgtcccaggactccacggaggagcagcaggacctgttcctcaaggacatgccaaagaaatggcttttcctgccctttgaggatgatctgaggagggacctcgggcgccagttctcagtggagcgcctgccggcggtcgtggtgctcaagccggacggggacgtgctcactcgcgacggcgccgacgagatccagcgcctgggcaccgcctgcttcgccaactggcaggaggcggccgaggtgctggaccgcaacttccagctgccagaggacctggaggaccaggagccacggagcctcaccgagtgcctgcgccgccacaagtaccgcgtggaaaaggcggcgcgaggcgggcgcgaccccgggggagggggtggggaggagggcggggccggggggctgttctgacccgctagggtggaggagaggagtggggtttgttgatgaacctccacccccaccccacccccgcacgcctgtaatcccagcacttggggaggccaaggcgggaggatcgcttgagcccagaggttcgagatcaacctgggcaagagagtgagaccctgactctacgaaaattaaaagttagcccggtgtggtggcgcgcacctgtggcttagctaccctg

SEQ ID NO: 44327 - DNA, 632 bp, Homo sapiens
ggccaggagctgggcgccggccccgggctgccagaggacgcggccgggacgctgctgccgctggccgccgcgctggccgcgctggtgctcgtgctggggttcacctgcttgctgctcgccgcgctctgtggccacctgggcgccgagctggcgcgggggcctggccccaggaggtctgactggtttctctacgactgccgcctcctcagacacgtggcccttggccttttctgctgtgggatctccgtctatttagcaggtgtgtgctggaatagaacgtggggcatgggaccctgggctgggtagagagcagcaatggtcccctaactgggatcaactctgcagacagcctccttgagttcaactccaggctctgacacttctttgctttggtgccttgggcaaagtctctctgtgccttgatttcctcatcagtacaatgggaataactgtcattacctcacagaatcacttgaggagattctgagatttaatcctcatgaaagcccataggaccaggcatagtagctcacatctgtaatcccagcaatatgggagactgaggtaggaggattgcttgaggccaggagtttgagaccagcctgggcaacataacaaaaccccatctctac

SEQ ID NO: 44328 - DNA, 2019 bp, Homo sapiens
cctgcggggcggtgactggcccagccgcaccgcgtctcccgccttctccgcagccccgcaggccccgggccctgtcattcccagcgctgccctgtcttgcgttccagtgttccagcttctgcgagatgaccctcaaggcgagcgagggcgagagtgggggcagcatgcacacggcgctctccgacctctacctggagcatttgctgcagaagcgtagtcggccagaggctgtatcgcatccattgaatactgtgaccgaggacatgtacaccaacgggtctcctgccccaggtagccctgcccaggtcaagggacaggaggtgcggaaagtgcgactcatacagtttgagaaggtcacagaagagcccatgggaatcactctgaagctgaatgaaaaacagtcctgtacggtggccagaattcttcatggtggcatgatccatagacaaggctcccttcacgtgggggatgagatcctagaaatcaatggcacaaatgtgacaaatcattcagtggatcagctgcagaaggcgatgaaagaaaccaaaggaatgatctcattaaaagtaattcccaaccagcaaagccgtcttcctgcactacagatgttcatgagagcgcagtttgactatgatcccaaaaaggacaatctgatcccttgcaaggaggcgggactgaagtttgctactggggacattatccagattatcaacaaggatgacagcaattggtggcagggacgggtggaaggctcctccaaggagtcagcaggattgatcccttcccctgagctgcaggaatggcgagtggcaagtatggctcagtcagctcctagcgaagccccgagctgcagtccctttgggaagaagaagaagtacaaagacaaatatctggccaagcacagctcgatttttgatcagttggatgttgtttcctacgaggaagtcgttcggctccctgcattcaagaggaagaccctggtgctgatcggagccagtggggtgggtcgcagccacattaagaatgccctgctcagccagaatccggagaagtttgtgtaccctgtcccatatacaacacggccgccaaggaagagtgaggaagatgggaaggagtaccactttatctcaacggaggagatgacgaggaacatctctgccaatgagttcttggagtttggcagctaccaaggcaacatgtttggcaccaaatttgaaacagtgcaccagatccataagcagaacaagattgccatccttgacattgagccccagaccctgaaaattgttcggacagcagaactttcgcctttcattgtgttcattgcacctactgaccagggcactcagacagaagccctgcagcagctgcagaaggactctgaggccatccgcagccagtacgctcactactttgacctctcactggtcaataatggtgttgatgaaacccttaagaaattacaagaagccttcgaccaagcgtgcagttctccacagtgggtgcctgtctcctgggtttactaagcttgtagaatgggggaacccactgtatgcccctctccagcatttggaattccacccgccttgctttaagacaaacagggctgctccaactagttttgtgtcagcttccagctctctgcagctatcctaattcagccagtaaggttcagtcttcttgctcaggctcctgaagggttgattctcctgatagatggggccccactgatctggatttgaaaaggatttctagaaattgggggtaagaagtactaccaaaatgtaactgctaatcaagggtgatgcacagcaaaagcaatggaccccatccctctaaagcctgccctcctttgccttcaactgtatatgctgggtatttcatttgtctttttattttggagaaagcgtttttaactgcaactttctataatgccaaaatgacacatctgtgcaatagaatgatgtctgctctagggaaaccttcaaaagcaataaaaatgctgtgttgaaatgccaa

SEQ ID NO: 44329 - DNA, 734 bp, Homo sapiens
cctgcggggcggtgactggcccagccgcaccgcgtctcccgccttctccgcagccccgcaggccccgggccctgtcattcccagcgctgccctgtcttgcgttccagtgttccagcttctgcgagatgaccctcaaggcgagcgagggcgagagtgggggcagcatgcacacggcgctctccgacctctacctggagcatttgctgcagaagcgtagtcggccagagatgttcatgagagcgcagtttgactatgatcccaaaaaggacaatctgatcccttgcaaggaggcgggactgaagtttgctactggggacattatccagattatcaacaaggatgacagcaattggtggcagggacgggtggaaggctcctccaaggagtcagcaggattgatcccttcccctgagctgcaggaatggcgagtggcaagtatggctcagtcagctcctagcgaagccccgagctgcagtccctttgggaagaagaagaagtacaaagacaaatatctggccaagcacagctcgatttttgatcagttggatgttgtttcctacgaggaagtcgttcggctccctgcattcaagaggaagaccctggtgctgatcggagccagtggggtgggtcgcagccacattaagaatgccctgctcagccagaatccggagaagtttgtgtaccctgtcccatatacaacacggccgcgcaggtttcggggtcctctagagtca

SEQ ID NO: 44330 - DNA, 478 bp, Homo sapiens
  misc_feature (88)..(88): n is a, c, g, or t
ggggtcccccaaccccggggctgtggaacgggtacctaagccctggccctgttagaaaactgggcccgcacagccagaaaagtgaagntagccctgccctgaacattactgccctgagcttcaccctccccatcaaatcagtagtggcattagattatcataggagcacaaacccctattgtgaaactgtgcatgcacgtgatctaggttgtgtactccttgtgagaatgtaactaatgcctgatgatctgaggtggaacagtttcatcctgaaaccatcccacacagtccatggaaaagcctgccctcctttgccttcaactgtatatgctgggtatttcatttgtctttttattttggagaaagcgtttttaactgcaactttctataatgccaaaatgacacatctgtgcaatagaatgatgtctgctctagggaaaccttcaaaagcaataaaaatgctgtgttgaaatgccaa

SEQ ID NO: 44331 - DNA, 164 bp, Homo sapiens
cgaattcaagcttctaacgatgtacggggacatgtaagtagctcttaggcaccttggaggggaggtgacaggctggtaccactcgccatctgaaataccatagtgttattttattattttttaaattattttattttaaatgattattaaaactaaacaaaata

SEQ ID NO: 44332 - DNA, 2060 bp, Homo sapiens
gtgactggcccacgcgcgacgcgtgtcccgactactccgctgccccggaggatccgggccctgtaattccactagcgctgcactcgtgtattggcgttgccatttgttaccaagctaacatgacagagcaatgaccgcgtcaaacgggcagacgctgacgggacgagaagttgaggagtcgagacatgcagcacggcagtctctcgcgatcttactaaactgggagctattatggctgacgacgaagactgatacgtcgtgacagagcgctgtatcgcatccattgaatactgtgaccgaggacatgtacaccaacgggtctcctgccccaggtagccctgcccaggtcaagggacaggaggtgcggaaagtgcgactcatacagtttgagaaggtcacagaagagcccatgggaatcactctgaagctgaatgaaaaacagtcctgtacggtggccagaattcttcatggtggcatgatccatagacaaggctcccttcacgtgggggatgagatcctagaaatcaatggcacaaatgtgacaaatcattcagtggatcagctgcagaaggcgatgaaagaaaccaaaggaatgatctcattaaaagtaattcccaaccagcaaagccgtcttcctgcactacagatgttcatgagagcgcagtttgactatgatcccaaaaaggacaatctgatcccttgcaaggaggcgggactgaagtttgctactggggacattatccagattatcaacaaggatgacagcaattggtggcagggacgggtggaaggctcctccaaggagtcagcaggattgatcccttcccctgagctgcaggaatggcgagtggcaagtatggctcagtcagctcctagcgaagccccgagctgcagtccctttgggaagaagaagaagtacaaagacaaatatctggccaagcacagctcgatttttgatcagttggatgttgtttcctacgaggaagtcgttcggctccctgcattcaagaggaagaccctggtgctgatcggagccagtggggtgggtcgcagccacattaagaatgccctgctcagccagaatccggagaagtttgtgtaccctgtcccatatacaacacggccgccaaggaagagtgaggaagatgggaaggagtaccactttatctcaacggaggagatgacgaggaacatctctgccaatgagttcttggagtttggcagctaccaaggcaacatgtttggcaccaaatttgaaacagtgcaccagatccataagcagaacaagattgccatccttgacattgagccccagaccctgaaaattgttcggacagcagaactttcgcctttcattgtgttcattgcacctactgaccagggcactcagacagaagccctgcagcagctgcagaaggactctgaggccatccgcagccagtacgctcactactttgacctctcactggtcaataatggtgttgatgaaacccttaagaaattacaagaagccttcgaccaagcgtgcagttctccacagtgggtgcctgtctcctgggtttactaagcttgtagaatgggggaacccactgtatgcccctctccagcatttggaattccacccgccttgctttaagacaaacagggctgctccaactagttttgtgtcagcttccagctctctgcagctatcctaattcagccagtaaggttcagtcttcttgctcaggctcctgaagggttgattctcctgatagatggggccccactgatctggatttgaaaaggatttctagaaattgggggtaagaagtactaccaaaatgtaactgctaatcaagggtgatgcacagcaaaagcaatggaccccatccctctaaagcctgccctcctttgccttcaactgtatatgctgggtatttcatttgtctttttattttggagaaagcgtttttaactgcaactttctataatgccaaaatgacacatctgtgcaatagaatgatgtctgctctagggaaaccttcaaaagcaataaaaatgctgtgttgaaatgccaa

SEQ ID NO: 44333 - DNA, 1944 bp, Homo sapiens
cctgcggggcggtgactggcccagccgcaccgcgtctcccgccttctccgcagccccgcaggccccgggccctgtcattcccagcgctgccctgtcttgcgttccagtgttccagcttctgcgagatgaccctcaaggcgagcgagggcgagagtgggggcagcatgcacacggcgctctccgacctctacctggagcatttgctgcagaagcgtagtcggccagaggctgtatcgcatccattgaatactgtgaccgaggacatgtacaccaacgggtctcctgccccaggtagccctgcccaggtcaagggacaggaggtgcggaaagtgcgactcatacagtttgagaaggtcacagaagagcccatgggaatcactctgaagctgaatgaaaaacagtcctgtacggtggccagaattcttcatggtggcatgatccatagacaaggctcccttcacgtgggggatgagatcctagaaatcaatggcacaaatgtgacaaatcattcagtggatcagctgcagaaggcgatgaaagaaaccaaaggaatgatctcattaaaagtaattcccaaccagcaaagccgtcttcctgcactacagatgttcatgagagcgcagtttgactatgatcccaaaaaggacaatctgatcccttgcaaggaggcgggactgaagtttgctactggggacattatccagattatcaacaaggatgacagcaattggtggcagggacgggtggaaggctcctccaaggagtcagcaggattgatcccttcccctgagctgcaggaatggcgagtggcaagtatggctcagtcagctcctagcgaagccccgagctgcagtccctttgggaagaagaagaagtacaaagacaaatatctggccaagcacagctcgatttttgatcagttggatgttgtttcctacgaggaagtcgttcggctccctgcattcaagaggaagaccctggtgctgatcggagccagtggggtgggtcgcagccacattaagaatgccctgctcagccagaatccggagaagtttgtgtaccctgtcccatatacaacacggccgccaaggaagagtgaggaagatgggaaggagtaccactttatctcaacggaggagatgacgaggaacatctctgccaatgagttcttggagtttggcagctaccaaggcaacatgtttggcaccaaatttgaaacagtgcaccagatccataagcagaacaagattgccatccttgacattgagccccagacagaagccctgcagcagctgcagaaggactctgaggccatccgcagccagtacgctcactactttgacctctcactggtcaataatggtgttgatgaaacccttaagaaattacaagaagccttcgaccaagcgtgcagttctccacagtgggtgcctgtctcctgggtttactaagcttgtagaatgggggaacccactgtatgcccctctccagcatttggaattccacccgccttgctttaagacaaacagggctgctccaactagttttgtgtcagcttccagctctctgcagctatcctaattcagccagtaaggttcagtcttcttgctcaggctcctgaagggttgattctcctgatagatggggccccactgatctggatttgaaaaggatttctagaaattgggggtaagaagtactaccaaaatgtaactgctaatcaagggtgatgcacagcaaaagcaatggaccccatccctctaaagcctgccctcctttgccttcaactgtatatgctgggtatttcatttgtctttttattttggagaaagcgtttttaactgcaactttctataatgccaaaatgacacatctgtgcaatagaatgatgtctgctctagggaaaccttcaaaagcaataaaaatgctgtgttgaaatgccaa

SEQ ID NO: 44334 - DNA, 2010 bp, Homo sapiens
  misc_feature (1997)..(1997): n is a, c, g, or t
cctgcggggcggtgactggcccagccgcaccgcgtctcccgccttctccgcagccccgcaggccccgggccctgtcattcccagcgctgccctgtcttgcgttccagtgttccagcttctgcgagatgaccctcaaggcgagcgagggcgagagtgggggcagcatgcacacggcgctctccgacctctacctggagcatttgctgcagaagcgtagtcggccagaggctgtatcgcatccattgaatactgtgaccgaggacatgtacaccaacgggtctcctgccccaggtagccctgcccaggtcaagggacaggaggtgcggaaagtgcgactcatacagtttgagaaggtcacagaagagcccatgggaatcactctgaagctgaatgaaaaacagtcctgtacggtggccagaattcttcatggtggcatgatccatagacaaggctcccttcacgtgggggatgagatcctagaaatcaatggcacaaatgtgacaaatcattcagtggatcagctgcagaaggcgatgaaagaaaccaaaggaatgatctcattaaaagtaattcccaaccagcaaagccgtcttcctgcactacagatgttcatgagagcgcagtttgactatgatcccaaaaaggacaatctgatcccttgcaaggaggcgggactgaagtttgctactggggacattatccagattatcaacaaggatgacagcaattggtggcagggacgggtggaaggctcctccaaggagtcagcaggattgatcccttcccctgagctgcaggaatggcgagtggcaagtatggctcagtcagctcctagcgaagccccgagctgcagtccctttgggaagaagaagaagtacaaagacaaatatctggccaagcacagctcgatttttgatcagttggatgttgtttcctacgaggaagtcgttcggctccctgcattcaagaggaagaccctggtgctgatcggagccagtggggtgggtcgcagccacattaagaatgccctgctcagccagaatccggagaagtttgtgtaccctgtcccatatacaacacggccgccaaggaagagtgaggaagatgggaaggagtaccactttatctcaacggaggagatgacgaggaacatctctgccaatgagttcttggagtttggcagctaccaaggcaacatgtttggcaccaaatttgaaacagtgcaccagatccataagcagaacaagattgccatccttgacattgagccccagaccctgaaaattgttcggacagcagaactttcgcctttcattgtgttcattgcacctactgaccagggcactcagacagaagccctgcagcagctgcagaaggactctgaggccatccgcagccagtacgctcactactttgacctctcactggtcaataatggtgttgatgaaacccttaagaaattacaagaagccttcgaccaagcgtgcagttctccacagtgggtgcctgtctcctgggtttactaagcttgtagaatgggggaacccactgtatgcccctctccagcatttggaattccacccgccttgctttaagacaaacagggctgctccaactagttttgtgtcagcttccagctctctgcagctatcctaattcagccagtaaggttcagtcttcttgctcaggctcctgaagggttgattctcctgatagatggggccccactgatctggatttgaaaaggatttctagaaattgggggtaagaagtactaccaaaatgtaactgctaatcaagggtgatgcacagcaaaagcaatggaccccatccctctaaagcctgccctcctttgccttcaactgtatatgctgggtatttcatttgtctttttattttggagaaagcgtttttaactgcaactttctataatgccaaaatgacacatctgtgcaatagaatgatgtctgctctagggaaccgtcgattcgagggancctctagagtcac

SEQ ID NO: 44335 - DNA, 1634 bp, Homo sapiens
catctgcatttctcttttctgagacgtcacgtgcacaccaccagccagggaatgatcgtggcagtcttgggttgtaggcaggtaagggggtggagagtcaggatgacaccaggtctctatcttgagcagctgggtcaatagcaccaccatcttctaagataagggacattcaggcagaaccgagatagcattggcattcttcagctctaagtgccaagggaacatctgatactgaaactatggagaagagatgaggacaggagacaagaaaagttggctcagagagatagggcaaggaggaagagagggtgcaaaagttagataaactcccttgctcaaaattccctcaccacactaaaaatacagtccaaagtccttcctccacaccaacctccctcgtctcatctctagtcacttcctccctgcttgttgagatgtcgcgaggctgtttcccatttcagagtgtggaccactgttctccctagctctggaaatgaacactgcttggttttctttgtctctagtttttgatcagttggatgttgtttcctacgaggaagtcgttcggctccctgcattcaagaggaagaccctggtgctgatcggagccagtggggtgggtcgcagccacattaagaatgccctgctcagccagaatccggagaagtttgtgtaccctgtcccatatacaacacggccgccaaggaagagtgaggaagatgggaaggagtaccactttatctcaacggaggagatgacgaggaacatctctgccaatgagttcttggagtttggcagctaccaaggcaacatgtttggcaccaaatttgaaacagtgcaccagatccataagcagaacaagattgccatccttgacattgagccccagaccctgaaaattgttcggacagcagaactttcgcctttcattgtgttcattgcacctactgaccagggcactcagacagaagccctgcagcagctgcagaaggactctgaggccatccgcagccagtacgctcactactttgacctctcactggtcaataatggtgttgatgaaacccttaagaaattacaagaagccttcgaccaagcgtgcagttctccacagtgggtgcctgtctcctgggtttactaagcttgtagaatgggggaacccactgtatgcccctctccagcatttggaattccacccgccttgctttaagacaaacagggctgctccaactagttttgtgtcagcttccagctctctgcagctatcctaattcagccagtaaggttcagtcttcttgctcaggctcctgaagggttgattctcctgatagatggggccccactgatctggatttgaaaaggatttctagaaattgggggtaagaagtactaccaaaatgtaactgctaatcaagggtgatgcacagcaaaagcaatggaccccatccctctaaagcctgccctcctttgccttcaactgtatatgctgggtatttcatttgtctttttattttggagaaagcgtttttaactgcaactttctataatgccaaaatgacacatctgtgcaatagaatgatgtctgctctagggaaaccttcaaaagcaataaaaatgctgtgttgaaatgccaa

SEQ ID NO: 44336 - DNA, 1518 bp, Homo sapiens
caaaggagacagtcaatggaagatggaaagaggggaggttgggaggattgtgtttcaagctacaatatctggagcatattttactgattagacaatttatatgagtaatagaaaatagtccaacttttaacaacatgagctgaaactaaaccaaagtactcttctttccaagtcatgaaaaggaaaccttaaatatatttccaagaaatcctgaccatagtctgtagatctgtttttaaaatattttccgctatcttcatttctaagtttcaatattcctaggatttggtagtttgagagatgtaacttcatttaggggaaaatgataataggaattttctatgttaggctttgccccttaaaaattaaatgtgtcctgggcagatggagggatttcctgggtgtgcatcactttctagcatcagctcttcaggagcccacgggaggaacccctgtattaaagtcaatgcaccaaaggcagctagggtttccatacagacaccatggtccaagccctcatgaaagggtgaggacctggagtttgtcggggatttgggttcttgtacacagatacaacacggccgccaaggaagagtgaggaagatgggaaggagtaccactttatctcaacggaggagatgacgaggaacatctctgccaatgagttcttggagtttggcagctaccaaggcaacatgtttggcaccaaatttgaaacagtgcaccagatccataagcagaacaagattgccatccttgacattgagccccagaccctgaaaattgttcggacagcagaactttcgcctttcattgtgttcattgcacctactgaccagggcactcagacagaagccctgcagcagctgcagaaggactctgaggccatccgcagccagtacgctcactactttgacctctcactggtcaataatggtgttgatgaaacccttaagaaattacaagaagccttcgaccaagcgtgcagttctccacagtgggtgcctgtctcctgggtttactaagcttgtagaatgggggaacccactgtatgcccctctccagcatttggaattccacccgccttgctttaagacaaacagggctgctccaactagttttgtgtcagcttccagctctctgcagctatcctaattcagccagtaaggttcagtcttcttgctcaggctcctgaagggttgattctcctgatagatggggccccactgatctggatttgaaaaggatttctagaaattgggggtaagaagtactaccaaaatgtaactgctaatcaagggtgatgcacagcaaaagcaatggaccccatccctctaaagcctgccctcctttgccttcaactgtatatgctgggtatttcatttgtctttttattttggagaaagcgtttttaactgcaactttctataatgccaaaatgacacatctgtgcaatagaatgatgtctgctctagggaaaccttcaaaagcaataaaaatgctgtgttgaaatgccaa

SEQ ID NO: 44337 - DNA, 1839 bp, Homo sapiens
cctgcggggcggtgactggcccagccgcaccgcgtctcccgccttctccgcagccccgcaggccccgggccctgtcattcccagcgctgccctgtcttgcgttccagtgttccagcttctgcgagatgaccctcaaggcgagcgagggcgagagtgggggcagcatgcacacggcgctctccgacctctacctggagcatttgctgcagaagcgtagtcggccagaggctgtatcgcatccattgaatactgtgaccgaggacatgtacaccaacgggtctcctgccccaggtagccctgcccaggtcaagggacaggaggtgcggaaagtgcgactcatacagtttgagaaggtcacagaagagcccatgggaatcactctgaagctgaatgaaaaacagtcctgtacggtggccagaattcttcatggtggcatgatccatagacaaggctcccttcacgtgggggatgagatcctagaaatcaatggcacaaatgtgacaaatcattcagtggatcagctgcagaaggcgatgaaagaaaccaaaggaatgatctcattaaaagtaattcccaaccagcaaagccgtcttcctgcactacagatgttcatgagagcgcagtttgactatgatcccaaaaaggacaatctgatcccttgcaaggaggcgggactgaagtttgctactggggacattatccagattatcaacaaggatgacagcaattggtggcagggacgggtggaaggctcctccaaggagtcagcaggattgatcccttcccctgagctgcaggaatggcgagtggcaagtatggctcagtcagctcctagcgaagccccgagctgcagtccctttgggaagaagaagaagtacaaagacaaatatctggccaagcacagctcgatttttgatcagttggatgttgtttcctacgaggaagtcgttcggctccctgcattcaagaggaagaccctggtgctgatcggagccagtggggtgggtcgcagccacattaagaatgccctgctcagccagaatccggagaagtttgtgtaccctgtcccatatacaacacggccgccaaggaagagtgaggaagatgggaaggagtaccactttatctcaacggaggagatgacgaggaacatctctgccaatgagttcttggagtttggcagctaccaaggcaacatgtttggcaccaaatttgaaacagtgcaccagatccataagcagaacaagattgccatccttgacattgagccccagaccctgaaaattgttcggacagcagaactttcgcctttcattgtgttcattgcacctactgaccagggcactcagacagaagccctgcagcagctgcagaaggactctgaggccatccgcagccagtacgctcactactttgacctctcactggtcaataatggtgttgatgaaacccttaagaaattacaagaagccttcgaccaagcgtgcagttctccacagtgggtgcctgtctcctgggtttactaagcttgtagaatgggggaacccactgtatgcccctctccagcatttggaattccacccgccttgctttaagacaaacagggctgctccaactagttttgtgtcagcttccagctctctgcagctatcctaattcagccagtaaggttcagtcttcttgctcaggctcctgaagggttgattctcctgatagatggggccccactgatctggatttgaaaaggatttctagaaattgggggtaagaagtactaccatacatcgtgctctatctaaggattgatgcacactcactggcctctatacactgacagca

SEQ ID NO: 44338 - DNA, 1112 bp, Homo sapiens
cctgcggggcggtgactggcccagccgcaccgcgtctcccgccttctccgcagccccgcaggccccgggccctgtcattcccagcgctgccctgtcttgcgttccagtgttccagcttctgcgagatgaccctcaaggcgagcgagggcgagagtgggggcagcatgcacacggcgctctccgacctctacctggagcatttgctgcagaagcgtagtcggccagaggctgtatcgcatccattgaatactgtgaccgaggacatgtacaccaacgggtctcctgccccaggtagccctgcccaggtcaagggacaggaggtgcggaaagtgcgactcatacagtttgagaaggtcacagaagagcccatgggaatcactctgaagctgaatgaaaaacagtcctgtacggtggccagaattcttcatggtggcatgatccatagacaaggctcccttcacgtgggggatgagatcctagaaatcaatggcacaaatgtgacaaatcattcagtggatcagctgcagaaggcgatgaaagaaaccaaaggaatgatctcattaaaagtaattcccaaccagcaaagccgtcttcctgcactacagatgttcatgagagcgcagtttgactatgatcccaaaaaggacaatctgatcccttgcaaggaggcgggactgaagtttgctactggggacattatccagattatcaacaaggatgacagcaattggtggcagggacgggtggaaggctcctccaaggagtcagcaggattgatcccttcccctgagctgcaggaatggcgagtggcaagtatggctcagtcagctcctagcgaagccccgagctgcagtccctttgggaagaagaagaagtacaaagacaaatatctggccaagcacagctcgatttttgatcagttggatgttgtttcctacgaggaagtcgttcggctccctgcattcaagaggaagaccctggtgctgatcggagccagtggggtgggtcgcagccacattaagaatgccctgctcagccagaatccggagaagtttgtgtaccctgtcccatatacaacacggccgcgcaggtttcggggtcctctagagtca

SEQ ID NO: 44339 - DNA, 417 bp, Homo sapiens
cattatagaaagttgcagttaaaaacgctttctccgaaataaaaagacaaatgaaatacccagtaaggttcagtcttcttgctcaggctcctgaagggttgattctcctgatagatggggccccactgatctggatttgaaaaggatttctagaaattgggggtaagaagtactaccaaaatgtaactgctaatcaagggtgatgcacagcaaaagcaatggaccccatccctctaaagcctgccctcctttgccttcaactgtatatgctgggtatttcatttgtctttttattttggagaaagcgtttttaactgcaactttctataatgccaaaatgacacatctgtgcaatagaatgatgtctgctctagggaaaccttcaaaagcaataaaaatgctgtgttgaaatgccaa

SEQ ID NO: 44340 - DNA, 859 bp, Homo sapiens
  misc_feature (821)..(821): n is a, c, g, or t
  misc_feature (824)..(824): n is a, c, g, or t
cctgcggggcggtgactggcccagccgcaccgcgtctcccgccttctccgcagccccgcaggccccgggccctgtcattcccagcgctgccctgtcttgcgttccagtgttccagcttctgcgagatgaccctcaaggcgagcgagggcgagagtgggggcagcatgcacacggcgctctccgacctctacctggagcatttgctgcagaagcgtagtcggccagaggctgtatcgcatccattgaatactgtgaccgaggacatgtacaccaacgggtctcctgccccaggtagccctgcccaggtcaagggacaggaggtgcggaaagtgcgactcatacagtttgagaaggtcacagaagagcccatgggaatcactctgaagctgaatgaaaaacagtcctgtacggtggccagaattcttcatggtggcatgatccatagacaaggctcccttcacgtgggggatgagatcctagaaatcaatggcacaaatgtgacaaatcattcagtggatcagctgcagaaggcgatgaaagaaaccaaaggaatgatctcattaaaagtaattcccaaccagcaaagccgtcttcctgcactacagatgttcatgagagcgcagtttgactatgatcccaaaaaggacaatctgatcccttgcaaggaggcgggactgaagtttgctactggggacattatccagattatcaacaaggatgacagcaattggtggcagggacgggtggaaggctcctccaaagggaagttccagcaagggatttgattcctttccccctgaagcttgcaagggaattgggcnaanttggcaaagttatggggtcaattcaagcctcccta

SEQ ID NO: 44341 - DNA, 588 bp, Homo sapiens
cctgcggggcggtgactggcccagccgcaccgcgtctcccgccttctccgcagccccgcaggccccgggccctgtcattcccagcgctgccctgtcttgcgttccagtgttccagcttctgcgagatgaccctcaaggcgagcgagggcgagagtgggggcagcatgcacacggcgctctccgacctctacctggagcatttgctgcagaagcgtagtcggccagaggctgtatcgcatccattgaatactgtgaccgaggacatgtacaccaacgggtctcctgccccaggtagccctgcccaggtcaagggacaggaggtgcggaaagtgcgactcatacagtttgagaaggtcacagaagagcccatgggaatcactctgaagctgaatgaaaaacagtcctgtacggtggccagaattcttcatggtggcatgatccatagacaaggtactctgtgggagctctgggtggggtttgattcagggattaataatttactccctgttcagtggtgtggggcatgaagcttataatcctccaaactggtagcatttttgtgagtgtgccaagagactttttgtggct
